United States Patent 10,767,156 (POLYNUCLEOTIDES ENCODING BREX SYSTEM POLYPEPTIDES AND METHODS OF USING SAME) - sequence listing, part 4

SEQ ID NO: 2 - DNA, 3005051 bp, Lactobacillus rhamnosus (residues 1,502,527-3,005,051 of 3,005,051)
cggcgactaagaaacccagatacttgaaggctttgagtcgctcaagtgccggttccaattcaggcgtgtatttgagtttaggatcctgcaagtgaaaatacagcgcccccgccggaacaaacggtggctctgccgtcacgttggtcattgcttcaatgtaagtcagcatttgcaaggcaatgccataataagcgtcactatcatcgaagcggcgttgcccacttttataatcgacaataataaaacgccgggcatcaggttcgcgataaatatcaagccgatcgattttaccgcgaacattgacgcgacccccatgcggcaacggccatgataagcctggcagtcccttggtatcgccaatccggccaaactgcagctcggtgcgcaccgggcggaagccgctgcgttgctgttgctggcgcatgttgagcaaaacctgaatgagcagtcgacttaagcgcttggtcaaataagtcatgcgatacgtactgccgaggatttcataccccggctgtttggcaatctcggcaaccatcggcggtacagcagtcataatcgccgcggggtcaacatcggccaagttttgttgttgatcacgcaaatgggttaaatatcgatcaagcacggcatgaaaaagactaccggtgtcggctggtgaaagctcaaattccgggcgcggttggagcagcaaaccatatttaaggaaatattcgaaatgattaagataatacgtctccaatcgcgacacggaaacattcatatcgcggccatagagttgcaccgccagctgtggatcaaggcggccaggatcattttgatacgtcaaacttccggcaaggcgttgggccaggttggctaaatcggtttgtttcaatgcgcttaacacactttgccaagccagactcaggggttgtttttgctgctgggcatcaccggcagcccgaatgaagtcgcttaacattgcccgcgggctgccaaggacagatttgaccgttgtcgcgagtgttaccggcgcccaggtttcgggcacgagatgaagcgcccgtttcagttgctgaaaataaggtgacgcctgattttcactattttcttgcgggttttgcatggggtaacttaacgtcaacgtctcgctggcggccataaaacccaaatagttgatgaacgggtcacctaaagttgttgttgggccttgctcgggtaaaaagcggtcatctggcaactgtgcagctaataattggcgctcttcactgtttaaaacgccgtcatcattaggaacatccggcatggcagtgctggtggccccaatgacaaaaatatgttttgctttggctaatcggactaacccggtttctgaaatcacgaccgcgtcaagtgtggcaggaatctgtgtgtaagtcgcactggcaaagccggcagcaagcaactcatgaaattgctcgcgattaaacttagcgttgcccaaaatggtaacgtaatcatccagcaaagcggtaaatgtggtccatgcttgttcgtgcgctcggctgcgagcaagttcaccggctgcacttgctgcttctcgccacgcgttcaactggtccactaccccggttttcgttaaccagtggtacaaacttcgcgcagcttcaagtccggttttagctgcctgccattgtttgagtaaggccggcacagtttgagccaccagcgtttttatggcattgatttgagcggttttatcggcttcaggatccatttccgtttcatcagcagcgggattacgctgaaaataccgccatggttctgtctgtgtccagcgttttttacctgcaatccccgttcgaaccaaatgattgtcgagggtatcgacggcatcgcgataatctgccaccgtcatctcctgcggcaacaaaagctcagtatgcaacaagcgcatgatgtcttgatactgatagtcatgatcctgaatggcaaataggctttcgatcaacactactaagggatgatccttcatcggccgctgcaagtcggtaaattggggaatctgaaattcagcaaaaatagccggaatgatcgttgcatacggatccaatcgccgcgcaagaatcacaaaatcccgataacgtgctccgttgcgaaccgcttgatagatagattgggccacatgccgcaattcctgatagggatcagtcgcagtggctaaacgcacctgatcggcaacatttgcgggtggcgtcggctgcggttcgatattggtattagcctgccaccaactcgccacccgtcgcatgcccaagcttaagtgccgcggctgagcaaactgatctagcctaatgggaacgcgcatcgttttggctttttgatacaaacgatgataaagtcgaccagctggtaaaaagagattaggagcaacaggcggtgtagttggataaggccgatccaacacgaggccgatcgtcacttctgcggcggtttccagcatcgtttccaccagtgctgactctgaagcagaaaatacgttaaaatggttgagatagataaacgtgtgggtgagatcatgggtacgcatggcttgctgcagcccacttagcagactggcggttgtcgcataaggaccgatttctgcttcatattgatcaagaataatgcctaaatcacgcaacttagcccggtgccgatcgcctggtgtcagagccgcaacggtattggctaaatcttcagcggtaatccggccaatcatgagttcactcaattgatcagcaagctgtgtgacaaaaccagtatgctgagcttctccggcatagatggttaagtccgcttgccgttctgcaagaatcttggcaaccaacatcgtattgttagcttgatccagccgcggttgctgataaagcggcgtgtttttcaaataaaaccaggccaaccgggaaaaggataagacctgaacgcgactttgcacgtaagtctccgagttcccctgttgcaattggcgcaagcgtttgagaagatcaatttctgcttcaaatttaatatggtttggtaccagtaaaaaaagccggttttgggaatcagcggtaagcttttcatgaatcatagccgccatggtttgggtatgatccgtcgttgcatcaccgagaataaactgcaaccccatgtgaaaacctcctaagaaaagtgagcgcgagccggcgcggttagaagtcggagtgtaagcggccttgggcgtgatggccgggctttggccattgcgaccaaggtccttacacgcagacttctgcgctggggagcgcgttatggtatgagcgcgagccagcccggttaaaacctaccccaacccgcatgttgcgatgtgagaaaaccactagcacagcagccccagtacaaagacgaccttaattttaatcgtcattctcttaaaccacctacttaaaggctaccgcaccaacaaaaacagtttcactatttaaatacgtgtgtctgatgacttatgctttagtctagcataactaagtagtgtccgatcagggtttgcgctattataagtaaagaatattaacgaggtgtttatatgaaaatcgggacggggaaaagttacgcaaaaattattctcattggcgagcacgccgttgtttatggggaaccggccatcgctttgccagtcaaaagtattcggttatctgctaaagtcgagccaatacctgatggccggcaggaagtcacgtccgccttttttaccggcgatttgaatgcgggtcagttaaccaattttgccggcattgccatgctcattcgccggctgctcgtgttcttcaatgctgctgatcaaggcttccatctgaccattaccagtgctttgccatcggaacgcggcatgggatcatccgcagcgactgcagtagccgttgtgcgcgccttttacgatgcgtttcaaacgtcgctcagccattcggttttgctaaactgggccgggatctcggaaaaagctttgcacggcaaccccagcggcttggatgcggctacggctagcgctgaaaagccgcagtggtttgtccgcggcaagtcgttacgatccatcatgatgccgcgcaatggcgttttactgattgccgacactgggatcgccggtcagacgaagattgcggttgatcaagtggctcagaaattaaaaaaggacccgaaaacgtatcagccactgattaccgatattggcgatgcggtgcgtcaggcggctttggcactggcacaagatgacattatcactctaggacaacttttaaatcgggatcaagcggacttggcggcccttggcgtcagcagtcctgaactcgatcgactgattaatgttgcccttgataacggcgcatatggggcgaaactgaccggttccggcatgggcggctgcatgattgcccttgccgccgcggaccaggcaccggcaattatccaggcactaaaggtagccaatgccgttaaagtctgggaataccactttgaaacgaaatgaggctgctatgacaacttatgcacgcgcgcacactaacattgcattgatcaaatattggggcaaagcaaataagcaattgatgctgccggcaaccagcagtatttcgcttactctaaatgacttttacacggacacggcggtaacttttgaccctgaactcaatcaggatcaattgacgttgaatcaccaaatgcagtcgcctactgctgtcagccgctttttggatcatgttcggcacctggcccaaattgatacacgcgctcgggtcacctcattgaatcatgtaccgactgctgccggtttggccagttcggcttctgcgtttgcggcgctggcattggctgcaagtcgcgcggctggcctaaatttaacccctaccgccttgtcacggttggcacgtcgcggttcaggatcagccactcgttcaatctttggcggagcggtgatttggcaccgtggcagcgatgatcaatcctcgtttgccgaacccctaaccattcagccaacgctgccgctgcggatgttggtcgtcacggtttctgatcagaaaaaggcagtcagctcccgcacaggcatggccaacacggttgcgaccagcccttattaccaggcatgggtgcaatcgaatgaagcgttaatttcacctatgatcacggcactggccgaaaatgatctgacgacgattggtgcactcaccgaattatcgagtatgcgcatgcacgccgccattatggctgaggagccgccgttcacctactttttgccggaaactttacgcgcctggcaattggtgcaagaacagcgggcactcggcattccggcgtttgccacgatggatgccggacccaacgtcaagatcctcacaaccgcaccgtacgtggatgttctcatgaccgccttgcagcctgtttttggcgaccggattttgagcacccgcctcggcccggacgcgcaagtgattacaaaggagcaatttaatgacacagagtcagcaatcacatcgcaaggatgagcacgtctttttagcggaaaaatattttcaggcgactgcgcatgccggcttcgatcaagttcggctactacaccgggcacttccggaatcctcattagcagatgttgacttgacgcctcccattccttttggctggcgttggccgatttacattaatgcgatgacaggaggttccccgcaaaccggcaagctcaatgctcagctagggcaattagctcaggcgcttgatctggcaattgctagcggctctcaatccgtggccttacatgatcctcaattggcccctacttttaaaacgctgcgtgatcataatccggatggttttattcttgccaatatcggtgccggacacgatcagcacgcagctgaaaaggcaattagtatgttagacgcggatgcacttgaaattcacgtcaatgcggcacaagaagtgatcatgccagaaggtgatcgcgactttttgtggcaggaaaatatccgtaccattgcagcaactgcttcggttccggttgtggttaaggaagtaggtaacggcttcatccgcgaagatctgcaaaccttgcagcaactaggcattcattatgtcgatatcggcgggcgcggcggcacgaactttgcggtcatcgaaaatgctcgccgcccccaccacgacttttcctacctgcaggattgggggcaaacaaccgttgagtcactgcttgaagcccgcggactaccgttaacaatcctggcaaccggtggcattcgatcgccgctggatgtcattaaggcacaacgcttgggggcgcatgcggtgggcatcagtggactggtgctgcaccacttgattcaaactgactatgcggctacattagcctactttcaggaattcctgcaacaattacggcaactgtatgcattgctaggcgtgaccaactggcaagcactgcaaacggcaccggctgtgctcagtcctgaattagaatattatcgccatgtccgtcacttgccagcaatttgattttaggtcaataacaaaaggatgctagtaaacagacaatacctagcctgtcactaacatcctttttgattactttttaagatgctgatactaaattgcaagccaactaaactcgcagcccttttggatagaaattcttaaccgttccattgactaacttgccgattgcaaacggcttatgttcaaacgtgagtaagacgaatcgtttccctgacagcgaggtcgtgagcgtttcgccatgacggtagcgcgcataaccatcggcatccacctcaatcacggtttgaaagtcagatggatctagcgcagttgcgatgctgtggctaggttcaaaccggtttttacggaaacttccaagttcaagccccgcgcgaaccaccttcacgcgatcaaacggtatcatggttttcgggagtaacgacaggaagtccccgtggcggtaaaattgtccggtcaacggcttacgcaagctggtcgagaaaaaagtggtcacttcatcccgcgcggctttcactaaaggttttatctttagcggttttactggttcgttcggcaattcacccgcaagtcgcagtttggcaacgaaatggccttcaccgcgtacgagatgtggaaacagccgcactgtttttgccaattcaggattgccatctgcccattccggtcgaccggcaaccattcctggagactttttaatgggttcgagcgtcaaatcgtagtgagcaagcagccaggcaatgatttgttcgtcttcttccggactgaacgtgcaggttgaataaatcaaacttccgcctggccgcagcattttaattgcagcttgcagaatgacttcttgtcgtgccgcacattctgccggatagtcacggtgccaatactgaatcgcatctggatctttgcgaaacattccttcaccggagcaaggcgcatcgaccaaaatccgatcgaatgtctgcggccaggctgcggctaatgtatccggatcattattggtcactaaaatattccgacttccccaacgttcgagattaccggaaaggaccttcgaccgcggcccgtttatttcattgctgaccagtaacccggtttcaccaagataactagccaattgcgtggatttaccaccaggagcggcacatagatccaacacccgttcccctttttgcggtgccgcgactgtcccgacaaattgcgcactgggttcttggctataaaccagcccggaaacgtgatcaatcccgtttccggcaactttgccataatacccccacggactccaaggaatgggatccgtggtcttttcgtctaatggccaaggtttagccggatcgcgccggaatcccgccaatggttcgtcatcaaaactagccaaaaaagccgaggcgtccgctcctaataactgggtatatttttctttaaatgcttcaggaagttgcacttgttcgatcctttctccgaatcaaatatcgcaggaaaacaacagtcgcaatcgttaaaataattaagaaaccccagatgctggcgcgggtcgtatagtaaaaccaccaattggcaaacaaaccgccaagcagcaaactgatgccaacgtggctggcacagctcgacaagacgccgcgcaaataccgcgcacgcatgttgatttctagtcctgatgtctgcaagggtccgatgagcaccaccattaggacgctcagcaaaccggcccccaacaataagagcacacagaataaagctgtctgtccgtaagcgcgccaccaagttgcggcattgctatcactaaaatgaacccgatgaaccttattggcgcgcagaatacttttaagcactttaccatgctgatttgcaccgtcaacatagacttttacctgcttgaggcgtaatccaccgtttgcggtattgggtgacgcattaagaaataccgccttgttcagcggactacccttacgcgtgcccacagttcccaccactggaacatattgatcattcacgctcaaataacgctgattattgctgccagtgtagagtttatccgctaagtcgtgaccgacaaccgtaaccggtaaacttgattcaaaatcgccattcgaaaaccattgaccagtttcaaccggcaagctcgcaaccgttccacgctgatacacgtagaccacttgcttactcacaaactgcacttgataccccgaaaagtcagtctttgccagttccgcaaccgcagtcgtcacctgccgctgactcttcgtcacatattcttgggcagtctcagacataccaagatgatccagctgactggcatattcattttgatcatgctgcgaccacaccaacccagccaaaattgccaagccgatccatagtaagtcgattaagaatagtttcttcacagtggcctccttaggaaaagtgagcgcgagccggcgcggtttgaagtcggagtgtaagtggccacagacgtgatggccggtctttggccattgcggctgtggtccttacacgcagacttctgcgccggggagcgcgttatggtgagcgcgagccggcgccttattgaaagtgagtccacacactaaaaccaactccgctcatcacatcaaccgatacacccgttcatgaattgcatcaaaatgacccagtgcgcgattcaatgcaaagattcggcgatcaggtaccatcatcgcctcctgccaaaataaccggctattggtcgcaccatagcgctcgccaatcacaaacaattgcttatcaggaaagtatcgttgcatgatatgtaaaaaccgcacatcattggggtctttatctgggctccatgccatgaccaccgcatcaacttgtgccgcatataaaaataaagctgcattggcggtagcggttttcactggcactaatggttggcggccggtgacattttccgcaacccatgtatgagcatcggtggtaatagtcggatttccttgatcacgtaatcctgcactgacatagccattgcccgctgcgacttccagataacgttgacggccatacaactgttgccatgtcgcgaaaaaatctttatgcacaaacgaccacataccatcatgaaacgcaatgtaccgcctaaaattgtgaagcagatgatccaacgccatcaaatcggccaatttggctcccggcagtaacaatgcctgttcaatttgaggggtggttaaccccagccacggcaaggcatgttgcggtaattgctggttggcaagcgcaagccgccacgctgtcatggctgcgatttgtttttttaacggtgaaattgcctgatatttttcagccagttgtaagagtcgtgtccagtaagccatcctaacctcatattctaaatactggcagctacttagctaacccttttttcgcgcaaaagaacaggcaaaagccgccatgaacggcggcttttgcaacaggggcaacaacctcgtactaatgaatgcccagtgccatcttagcataccgactaagacgttccgggccccacgctgggtaccagacaaggtgaatctcaacgctttggatcccgtcaatcgccgttaacgcctgtttgatatcggcatcaagcatatcggttaacgggcaacccatggtggtaagggtcatttcaaccgtacatttaccattttcatccaagtcaaccccatagatgaggccaaggttaatcagatcgatccccaactccggatcaatcacggtttccaatgcatccaggatctgctgtttcattttatcaaaataggcctggtcttgggtggcggcttgatcatgcgtatctgccatcagcagtcccttcctttctgaacgtcttaatggttactttttgtccgcttcaagcacgccagcaactgaataatggttcttggccatttcattcaggacaatatggacatgctcagccggcgctccggtgtccttaacaatggcggcggtaacatctttgaccagtgctttaagctgctccggcgaccggccttcaatcaaatcaatatggactagtggcatcatgctccactccttcaactgagaataaggtacgtgttaatctgctttattttagcatgtgaaacacgtttacgcacgtatgatcaaaaagtaagcgcgagccggcgcggttaggaatcggagtataagtggccttgggcgtgatggccgggctttggccattgcgaccaaggtccttatacgcagattcctgcgccggggagcgcgttatgggcgtaaaggcgaactagtggcctcaggtgtgatggcccggttctggccattgcgcctgaggtccttacacgcagacttctgcgccgggaagcgcgttatgggcataaaggcgagcgcaaacaaaatcaattagcagtcaaggtacatagcttcaagcgtgatagtccgtatttagccactgcaaataagatcgcacaatcaatccccttctctaaactcaagattcttccctttctttaaagtctcacacagtaaacaaattagtcgcctgctgcttcacccactgttgatcagcagtgagaacgatgatgtatccatgtgcctttaaccatgctaggatagcctgtccgcgcgccatgtcaaccacatcgaatgggcggtcaagaatcagcagctggctgctaagtgcggcccgtgccaacgcaattcgttgcttttcgccagtcgagattgttgaagcattgatttgggtgtcagtgtggaaccgcgcggaaataccaaggatgtccagtaagtctttttctactgaacgcgatttggcaactggtgttgtcccaaatgcaaaaccggggaataaatggatgttattcgccaaagactcatggaagacagctggattttcaggaagataacctaccgcaaagtcgggcgatttaaaattggcagccgccaaattcagatatttggcaggttcatttgccagttcgcgaagtaatctgcttttgccactgccattttgcccttctatacatagaatatccccaccacgtaaaacgaccgagctattcttaaattgctttttaagccggtcacgagtctggttatacccagcatcatcccgccctttacgctggaaaaattgcgcgattttagcttcaacaaagcggatgcgctgaagcaattcaagggtttgatttgagatcgtcacaaagtcaaatcctggcgcgatataagttaggaataaggcaatggttcccggagaaatctccttagtctgattcgcaatcaatagcgtgaatgcaatcgccagcatgttaataaaagcaatcatattggtcaaaaatgccgcatatgtcgcctgcttcagaccactgacgagttgttgcttattcttgcgatccagctcggcttcggggtgaagtacccccaagaagcgcatataccggttgttggaaataagatcaaacatgaaattaaaatagttaagcgatgcctttctagcacgcccatacaggacaccattgtatttttgagcaattaaaataacggtttgtacaactatgagtgggatgatgaccgcaaccgtcaacgtttgactgtatgaaaacagaatgaccaaagaacccaccaagaaggcaaatttcacgcacaagtcggtgatggtcaaggcaacaaagtcaattgacggcaaatcaacattcacgacattcagaaggtcggcggcatgcttcgacccaaaatcaggcagttttgcaaataatttattgataaaggttttatcggtattaaacgtgattcgcgcgtcaagcatgccatagcgttgacgcgacaggttgatcaggatgacaaccccaatgaacaccagaatcgtcagccagaacagcgacccgtgatgttttgccaaagcatcaaaggcccgcttttgaatcaggccaatgaccagcggcgcacattcctgtatcaacgaaaataggatcaaggcggcaatcagctttttattgtcgaaaaatagatcgcgaatttttaacattttgttcttcctcgtaggttgatgcccaatctgctagtttcgagaagtagacgcattcaccctttgtgatgccatagacatgatcggcaaaatgtagccggttggttttatgcgaaatcaggatcattttaaccttgaaagtgtccacgtaatgccgcagcaaacgggaaacctcggcaaatcgagccgtatcaagtgagctcagggtttcgtcaaggataatcaagtccttttctagcaaaagcgctcttaatatcagtagcagctggcgatccccatccgctaacttgtcaatgttctcaccggcttcacccacctgagctgataaggttgtgcgcagataatctagcctagctttcgacacaccaagttgtttgagccgttgccagacattttgcgtggcattatttgccgaaaaaccttgtaagttcttctcaattgaaacgtggaaaagcgattggtcaacagagacgtaagcaacgttcgctcccatttcagaagctgatatttttgaaattggcgtctttgaatagtcaatttgcccctcgtactggtgctgcaggccaacgatcgcttttgcaagggtacttttccccgaaccggacacaccggacaccccaatgatttgtcccggtgcaatggccatatcgactttctttagtaccaggtgatcaaaatttcttaagtttgaaatatggagctgaatagtaggtttagtaggatagggactgtttcctgattgcatcacaaatttgcgctccaattcagcaaggttggcaaatgcacctttgagatattgcacattattcgcgtgaaactgcatgctttccaaaggtgcttgaattctggtagcgtaatcgatcatcatatacaccgtccccaacccgatcacgccgcgtaggaaactgtacccgcccagtgctaacgaggtaacttccaaaaaggcaatcagcacaagtgcggcgatccacgaacgataaataaagctctgagcatgtaattccaaaggcagcagcttatcgtactgtttattaaaccaagcaatgacgcgattcgaagcctgcatcggggccacgtcattgttattaacaaaaacatcttgcagaaaatcagccgtctttgcttcccttcttcgcaacttagggatcacatcgttgccactggtattaacgtgccttaaaacgagaatcgagagaagcagataaccagtaaaagctgccccgatcaagactgactgaaaaaacaagacgcaaataatcgtgatcacctgaatcacatctgaccacactggaattaaggtttgctggcaaaaaagtcggcactgatcaatgtccttagtcaggcggtcatttaagtcgccggtttgaaaggattcagaatcgcgaatttcatcaccaaaggaaattaagttgaggtatccttttcgtacccggtgcgtcattttcaaaaaaaccacatacgaaaaagcgctgaagactgtgcgaccggctaacaatatcaaccctagtgctagataaatataaaaattgtgaagaacgtttgcgctgccgggaactgtcacgccgttgatcatgcgctgaacaaagacttcagcgtatactgcactggcactcaacgccaaagatattaataagaccagtcctaatgtcagcttaccgcggcttgaagcaatttcggatttaagtattttaggcataagcgcttccttgttattagtatgaaatcttaactatcggcgagccgttaaaccggatggtatccttcattcttaatggcttttaatattaacaaccatccattgcgtatgtaggatagcagtcgcctggtgatctcattttattatcatcaggctatcattatattgtgaaacggtcaactaatgatctgataagcaatgtattttttttgaattcatcaccggatcacggctttgcaggcttgattttcacgacaacaaaatagagccgtccaaccacctcaactcatcaacgccgcttctgcttaaagtgcgcggaattaatgggtcagtcgataattagacgactctcttgactacaaaaatgttagccgttacataaacgtaaacggatcggtcgacaacttcgatggaattgccttgacgtcccaaccctcagcaaccgcccattcgttgatcaacccggcaactttttctttcatgatcgcttcgatgtgatgcccagggtcgatcacaggtaaatccgctgccagcatatcgtgagccgtgtgatagtaaacatcgccggtaatgaagacatcggcaccagcctctttggcatcgttgaaggcatcgccgccatcgccgccaagaattgcaacttttcgaaccggccgctccaagtcacgagcaacgacgcgtaagcctttgacgtgatacgctgctttgacttgttcaacgaaaacctcgaggcgaactgattcaggcaataagccgattcggcccatattcgcaccttcaccttcgttaataaacggcacgacttgagtcaaacccagcgcatcggccagccaatcattcatgccttcctgaacccgatccaaattggtatgggcgctataaactaacaggtcatcttttaaaatctgcgcgtacatcgcattttgcggaacccgtaagtccagattgtgaaccgaatgaaacattgctgggtgatgggaaaagatcatgtcagcatgaaccgtttcagcctcggccaccacctcgggacgaacgtctaaggtcaccaacacggttttaacgggacgatcagggttgcctaattgtaagccactgggatcgcgctccatagcaaggcttaaaggcgcatagtcttcaaaacgattgataatatctttaccggttgtcatgtgcacttaattcctccttaattaatgccagcaggtgctcctgttcacgaatcttggccaatggtaccatcttcgcatcggctaatccttcaagtaccgcttcggttttttcggcttcacggtgcatctttttcatgaaagtcggatttttttgacggcgcagaatcggaccaaagcgcaggtctgcttctgagtaaggtacatcgggtctggttttgcctgctgccatcatttcgtaaatatggccttcatcttctataatttgttcaccgataatgccataaccgtgtttatctagccatagtcgaacatcgtactggtgacgattaggtgccagtaccagcgtctcggtgccatccaactgcggctgaccggcctcgaggatgttcgtaatgagctggccacccattccggcaatcacaatagttgaaatggcatcagcagggtgaatgccggctaacccatctgcttggcggacgctgatttggtctgtcaaaccagcgtccgcgacattttgcttggcaattgcaacgggtccggcgccaatgtcactggcaacggcgaatttaatgatgccgcgttgcacaaggtcaatcggtaagaaagcatgatccgtgccaatgtcggctaagcgctcgtttggttcgataaacgcgcgaatcgcctgtagccgttttgataaatgtatatgatccatgaatttactgtcccctcatctgattaacagcttttattataacaaactgatgtcacgatgctggtattgtcgctaaaaaggttcagattcttgttgtgtgccggttgtgtttcaaaatagcatctgaccggccgcgccaagtcgcaaaaagccgccatctcaaatgagacagcggctttgtcagttgcttattcaagaaaatccttaagctgcttggaacggcttgggtggcggagtttccgcaatgccttggcttcaatctgacgaatgcgttcacgggtcacgccaaagactttgccgacttcttccagcgtgcgcgtccggccatcgtcaagtccaaagcgcagccgcaaaacattttcttcgcggtcagtcaaagtgtcaagcacgctctccaactgttccttgagcaattcgtaggaagcgtgatcttccggactggtagcgtcttggtcttcaatgaagtcgccgaggtgtgaatcgtcctcttcaccgattggcgtttccaaggacactggctcttgggcgatcttcaaaatttcgcggactttttcggttggcatatccatctcggcaccgatttcctcaggagttggttcgcggccaagatcctgaagcagttgacgttgaatccgaatcagtttattaatggtttcaaccatatgaacaggaattcgaatcgtccgggcttggtcagcaatcgcgcgggtgatcgcctgccgaatccaccaggtggcgtaggtggagaacttgaaccctttgcggtaatcaaacttctcgaccgccttcatcaagcccatgttaccttcctgaatcaaatccagaaactgcatgccacgaccaacatagcgcttagcaatggagaccaccagtcgtaagttagcttcggccagtcgttgcttggcttcttgatcgccttgttcgatcttcaaagcaagggcaacttcttcgtcagcggtcagcaatgaaacccggccgatttccttaagatacatccgcactgggtcattaatcttaaccccagatggcgcggacatatcgctcatttccttcttggaaaccttcttttgcttcttgaggctgatcgttgccggttcgccattttcgtcaacaatcgcgatcccattgtcttcgattttctgcattaaatcatcaatggcggtactctttagctcaaacggcttgatcaatttagaggttaaatcgtcttcggtgatctgctttttcttcttataatctttgatgacagctttgacggcatcatcataagccttagtcgttgtgtgactcttgctagcggtagtcttcttggccgttgttttcttggttgcggtctttttggtcgcagcctttgcttcggttgctgctttggttgaagctgcagccgttgtcttctttgtggtcttgcttacttcagttgctgtttttttatcagccattaaagttcctcccctagccttgttgttgcttcaaaagtttcatgagattcacatattgcaccgttaattcgccttgtttctgtttgtcacccaatcgctgtgcctcggtaatggcttgtttaatcgcctgcagccgcgaaacggttgacgccgatgtgatcgtctggattaactcatcaatcgtggcctcgcttgcttccggcagtgactgcatcgcgacatcagccgccaccccgctgagctcaggattaacccgatccaaaaatcctgcaagctcaccatccggctgttcatgcaaaaagcgcaaccaaccagtgaaaagtgtttgaaaatacggcgttggaaatacaaaagtcgcatttttcaagcgttgcatcacgaggtcatcgtgccagacatagtacaataactggcgctgagccgcggtgtagcgatccagcgggcggacgggttgatcggcaaccggtggctgagctgcggccggtcgcctggtttgcggactcggcaggctttgattgagcgcggcaatgggcacctcggtcgtctctgccagctgtttgacgtaaaccgcccgagcaaccggatcactgattttgccaatgatgcgtaaggccgcattcagataagtcaacttggcctgatcgttgtgcatgtccacaccacgggccagaaattgtaacataaaagcagttggtgtcaaaaccgacttgacttgtgcttgaaaggcttctgctccccgtgcacgaatgtactcatccggatccatgccatccggtaaaacgaccacatccgtttgcaggcgaggatgatcagccagcatggtgacagcccgttcaatcgctttttgacccggttcatcaccatcgtaacaaactgttaaccgtttgctcaaatgactgatgatatcgacttgttccgtggtcaaactggttcccattgaagcgatcccggttttaacaccagcttgatacgccgcaatcacatccatatacccttcaaaaaggatcgggccaccatcacgcccaaactcggctttggcgcgatgaaggttaaataaaatatcccgcttgttgaaaagcttggtttccggactgtttaaatacttagcctgggacttatctaactgtaaaatccgcccggaaaagccgaccaccttgccattagcatccgttaacggaaacatcacccgatcattgaaacgatcaaacaacttaccggcctgatcttcaacaaataggccactggcgcgctgatcctgatattcaacatggcgattattaagaaatgccaccaatagatttcgttcttcaggtgcataacccagttggaattcttcaatcgtttcgtcggttaacccgcgtttatgcaggtaggccagtgcagcctcacctttttccgtatttactaggatatgatgataaagatcagcagtatcctgaagaatgtgctgctgcttggcaacttcaggatcaaccggtgctgcctgacccacttggacgtcaagcggaataccggcaaaatcggctacctttttaactgcctcaggaaaggtcgcgttgtcataatccatgacaaacttgaaaacattaccgccacgtccgcacgaaaaacaatgaaaaatctgtttggattcattaacggaaaaagacggtgtgtgctcttcgtgaaaaggacagaggccaaacagattctgtccagtctttcgcaactgcacgtattgcccaatgtaatcggcaatattgaccgcttttaagacttgatcaatagtggcctcaggaatcattccggcgatatcagctcactcccttcccatggcgaatggcattgcaatcattgcgccaccacgacttgaaccgattgaaatagcggtaaaaagtcgcacttctgacgtgaaatgcgacttttatatagtctatcggcataataatgcaagatatagtatagcctgatgaatcaagaaaagcaagtctatttgacaatcacttggctaacgtcaccaaattggcggattaacttagcaagctgctgcaaggtagcaaggcgattttcgcgaacagtcttatcatctgccatcaccatcgtcgcatcaaagtaggcatcaatcggcttagccaaggcttttaatgcttgataatccgcttcagtcggttcagcagcaaatgttttggcagttgttgtcactgcgtcatgtagttgaccttcagtcgggttttcaaacttagtcggatcaaccgctgtcgttaccgtttgcttaccggtaatccgtaagacccgccccaaggcttccattaccggcttgaaatcagaatcggctgcatgctgggtcagtagcttagcagcagccaaaataccggcaatatcggcatcgctgcgaacagtgacggcatcaacgatatcatgccgaatcttttgaccttgcaacaactgcttggcccgatcaatcatgaaatcgttaagttcttgttggtgcgcggcaaaatcaagtccgttcgtttgatcagcttcagccaaggctttagcaatggtcggctgtaggctagccagcgcaaacggccagtcatgttcggcaatcatgcgcacaataccgtatgcctgacgccgcaacgcatatggatcgttggaaccactcgggattaagtcaacggcaaagaaactcatcagcgaatccagcttatcggcaattgccagcaccgttccgactagactttgcggtaaggcaccgtctgccgcgattggttcataatgttccgcaattgcttgagcaacagcaggtttttcgccggcaagccgggcataatgttcgcccataatcccttgtaattcaggaaattcgccgaccatcgacgtgacaagatcgaatttgtagatcgaagcagcgcgatccagatcagctttttcgtccgcggtcaagccgaattgatcagcaagtaacgcggcaatgactttggtgcgcgccattttgtcgtacattgagctgattttgtcatggaaactaaccgctttaaggcgctcaacgtcttcagcaatgctgcgtttctggtcttcggcatagaagaacgctgcgtcttccaagcgcgccgttagcactttttcgttgcccgcaatcacattgttcaaatgatcgtggttgccgttacgcacgccaataaacgcattgaccattttgcctgcctgatcacgagcatagaagtaacgctggttatctttcattgacgtaatcagcactgcttccggaattgccagatatttcggatcaaacgtaccggcaaaagctgtcggccattctactaaattgttaacttcttccaataagtcactatcgagttcgatctgccattgatgatcggtggcaatttgctcgatttgttcccgaatcaactgtttgcgtgcagccggttctacaatcacaaactggtctttcaacgccgcaacataagcatcggcattaggcagcgtcactggcttaccgaggaatcggtgcccttgggtgacccgccctgcttcaacatccaataacttcatcggcacaacggtatcatctagcagactcactaaccaatgaatcggacgaatgtactcaaaatcatatgctccccatttcattcgcgtcgggaacgttaggcttttaatgacatcaagcatgccaggcaaaatttcggcagcatccttacctttaatcgccttatgcagataaacataatcaacgcctttaatcgtcttaaacacgatgtcatccggtgtcatcccttgaccacgggaaaatccgatggcagctttggtccaattaccatccgcatcttgagcgattttcttggccggacctttaacatcggtttcaacgtctgcctgtttagcggctaaatcgtgcaccagcagcgcaagccgacgcggggttgcgtaccggtcaatttggccatgctcaaggtgattggctttcaaaaaggcaacggttttgtcgtgaaattggttaatacttggcgtgacaacatgggccggcatgtcttcaaggccaatttcaatcagatagtcatgcgtcatgttattgcacctccgttttgtgctgcagcaatgggaaaccaagcttcttacgttccgcaacgaaagcgcgcgcaactttatgcgccattttgcggatgcgactcatataaccggcacgttcggtcaccgaaaccgccccacgcgcatccagcaggttaaacgtatggctgcatttaagaatgtaatcataagccgggtgaaccaaccccagatccatcaagcgccacgcttctttttcataagcgtcaaaaaacttcagcagcatagcttgatcgctgacttcaaacgcgtatttactgtgttcgtattcaggttctttgaaaatatcgccatataaaacgccatcgccccattcaagatcaaagacactgttcacgtcttggatataggaagctaaccgttcaacgccataggtaatttcgctggtcaccggcgaaacttcaagaccgccaaccacttgaaaatacgtgaattgactgacttccatgccgtcaagccaaacttcccagccaaccccagcacagcccatggatggattttcccagttatcttcaacaaagcggatatcgtgttccaacgggttaatgccaagtgccgccagtgaatccaaatagtaatcctgaatgttttctggcgatggcttcatgacaacctggaactgatggtgctggaaaagtcggttcggattctcgccataacgaccgtcagctgggcggcgtgacggctcaacgtaagcagcattccaaggctccggtccgattgcccgcaaaaaagtatacggactcatagtaccggctcctttttcaacatcataagcttgcatcaacatacaacccttatcgccccagaatttttgaagcgtctggatcatcgtttggatgtccatttttgtcgtcatgattacctctttcccggtgaatcaaagtctggcgtgggtagatgaatgtccatatacatgaaaacgtccctacgccaagatatggcgtagggacgcttctgcgcggttccaccctacttcagatagaccgaatctacctgcagctttgtcatttggttcgaaaacgccaatcacattcaccaccatcaggcttacactatccctgactcgcttgggtttggtacaaatgcgaccctttttctcatcaccgattcaatttcaaaccaattttaccatgagcattcgagctgtcaatagattttctgaaaacacctaattgcaagcacttttgccatgttttccctcatgttatctctcatgttttccctgtcgtctgtaccccttgtgccagtggagctacagcagttattttttaccggtttttaaatactctgccagcttctctgcggcctccacttcttgttcctgatggacacgggcatagatttgcaaggtgattctggggtcggtatgtccgaccatcttttggaccgtactgacagcgacaccggcaatcaaaagattagagatatagcttttacgaaacttatgcaacgatataaccggtgccaagttgttgttacgaataatggtactaagccacatgcgcggtttatcaacacgaaaacggttgcctgtcttagtagtgaacagaagttggtgatgagttgaaagcctgacatagccatatacatagtcaggttgttcaattcgccatcgctttagccaattaatagtttctgaatcaactgggacatcgcgcctacttgctctggtttttggcggattaacaatcagctttccatgcacaccgagtgaaacagttttgttgacactaattagtcgctttttgaaatcaatgtcttcccattcaagcgccatagcctcgccaattcttaaaccggcataagctaggatacgaaacagcacgtacttgtaaagttccctatcagggttaatacaattgaaaaatacttccaattgacgtctatcccagaagtcgtttgtggagccaattttgtcttgaacacgtggcaagatgatgcgtcttgcaggattgtgtgtgatatagtccctcagttcagcataggtaagtattcggttgatatgaacaaagtaccgtttaaatgccactggagactgtttaaaccatttattcaccgcagtttggacatcttgtggggtgatcttatcaatgtacatgtcacctagatcaggcaaaatatggagattgaaacagtcacgagtcttggaccatgaactttccctgactgtgagcttgtatgattttagccattcttcatagacatccttaaactttcttgcaactttaacagggttaggtgcaaccgtgagttcaccattctgaacagctttctccaaattacgccctgctttaatagcgtcttgtcgtgtgagcttacctccttttacaacatacttcttacgtccagtctttggatcaattccaacataaacggataccttccaccgtctttttccactatcaagtttgtaactcctgattgaagccataattttgtcccttcatcgccagcaggctatgtagagggctaactatttacgctgatcaacaagagttttagcaataactttaataagttctacctcagtaggcctaagaagcgttccttcccattgaaatctagtatttgcatccgacaactcagctagaagagttgcctgagcaggttgttcattaaggggtttaatacgcttgaatgctagagaaattttggactcggctgccttagtgatactacgtgtgccgtgctcatatgaattgattgatccaactgataaccccacctcttttgctaattctccctgtgtaagtcctctatcaattcttccttggtgaacttcttttgctgtcattaccacagtactcacctcttctcagcctaaatgaatattttaaacattttgtagttgacaatattcaaatcatgggctatgcttctcttgtagttaaataataacactttgtatgtggctattctacatagtaagggaagtgagaataatcgtttattttgtgtcttggctaattatgcatcaaatcacacttgcagctttatgctttgcaactttagcaggaatctttattggtgctctgattcaatttcttgaagacaacaaaaaagctaccccgcacgccaatgcgaagtagcctatagctaacttaatagccgaaacaatcaacccacgtcaatgggtcgatatacttatcccctagaaaggacaaaataagtgtatcatgattgttatgttcgtgccacagcatacctgcgcacggttgaaataaagtcaggtggtcagctagagccgatgctataaagtccagccggtaagaaatcccagtcaggttccctatcgtcaaattcttggtgtctacggccttccggactttaaatggtaaatggtaggggtggaacgtcttgacagctttaactagctgtgaggtcatccagccatgtgtattagcggtgttttcaggagttagaccgcacagttaatagctaaataaatctcaaactcatgcacatggtactctgggcaggactagagtggtaactggatgctggttattagcaacgtgattatcatgggctaataactaggctgtgtatgcaattggtggtgaagagccactcacagtcactttttgtggcaagggggaactatcagcaattcaaatattcaaaggcttgaaatattaaaaacagccaccaagagttacgataatctgtgtatatttaaagccttcattttgtcttgaacattcaagaacaacgtagtagtcatcatcattctctgccattaccacaatgccctgagatttctcagaaatccatagtggttctttaccaaaaaatttacttacatagtcatttgtaggagcaatatcaaagccattatctttcaaccatttatgccaatccaatattgccggtagatcaaacattcttgcagcctctagtatacttatttgttcttctgattctttctccaagttgatgacatatttcttggtagcatctagtgcatagccatgaggagaaacaagttgacccataccccggtttaatttcagcttttccataaaaaacctcctaattattttcagtatcagattgatctctctagatgattttgtcaactttaaagttatgaaaaaacaactattgttgcccaacaaaaaaagccccctaccatgactagtatagggctaaaaggtgataaatgttggtacaaggttaaagtaccatatgtgtagtgtttgtcaatagttgttacctgatgtacaggctttcgcccggatagatcaggctgtagattgacttgccattgttagcggccaatgtgtacatgttgacgccatacttgctggcaatgctccagaagctgtcaccagagcggactgtgtaataagtgtgactcggtgcactatagttgctagaacgtgaaccatagctttctccacccataacacctaggcatatataatgatacctgccagagtagctaagataccgtgcccatacatacccattgtggatgtacacatggtcatacatgaggctttcaccgggtgcataggtaccaattgaggcatagcttgtgtcatcaccagtgcgaatgttaagtgtcacagaaggcctaaatatgccattctgggcgtaatctgtatcactagatgtaacttgtgaaggtgtagaaggcactgtggtcgcttgtgctggctgtttagagtaaccattatcggttatacccagcaagtcaacattgccatctaggccacctacagcgtgcatgctggtaaattgccagatagctacaccggggaggcttggaaagtaactgtatagtggcaatactcggatttggtagtcaggataaccagcaacccaaatggaattaggaaactggctaagtactcgattgtagtcaacgtgggctactatgtaaggcttgtaactgtagagcatcggggtataacctgcttgggcaatccgttgcatcccataaataatggcatcagtgttagcctcaacagactcactcgccccatcctcgtaatcaagtgccacaattgatccctttggtgtctgaatacgtggcaggaaataatcaagtgcttggcgaccaatatcagaactaccaccaacaccataccataggtaactatggactctaagcccgtcatcattagccgctttgatttggctactataagttgactggttataaattgtaccgccttgggttccaccaatttgtgaaatagcaaaacggtcacactcaactgtcttgcccttgttgccttgatacactgaccagtcaacaccaatatcattcttggccgctttaacatgggtcggtaaggcaaatgaaaaggcagccataatggctacccctgtgagtactagtttagttttaaattgcaatcttaagcccccttaggataggttgcttcaatggtgttctttaggtcgctataggccttctcaactgcattttcaatggtctgctgatcaaccttggtaaatcccatggctttcaattgagtttcaacagaagctactgcttgcgatttcttaacggcccctgttattgcctgagtaacacctaactgttcggctgcggtaacagctgcttgtgctaatggttccaacacttgcaccaatgtcaaagcctgtttattcgctaataggacctttgccacccatgcacccaaaataggtatcactgcaatagcaatttggacaattaaatctttcatttttacccctcctcacaagaacttttcgatgatatacacaaatagggtgactccaatcgtcccaccaagtacgccccagattgaccacaccattttctttagactgctaatgtctctggcattatcttggctggcattgtatgccttatcggccttgtcatctgtacttggtaggccagttaattgttgcttaatctgggcaatatcttccttgatctccattagcatttttgtttgttcgtccacaatttcaccccataaaaatagccgctagcttttgccaccgacatagtccttgcctgtaatttgcttgtattgatctggtgtaatcattaccggtacataaggtgttagatcaattccccaactgtaaagtagtgcacactgatcataattagtcacttgatttcgccgccttcagctgtgctacttcaagagttaaatttgcgagtagcttctgttctgcggtcggtgtcacttgattagccgctttgtctaatgctgcttgtttatcggtatctatgacaacagtaccgtcatcagccagctttgaggcgccaatggcaatctttttcagctcttcaggagcgatcagaatggctttctcatcatcgaatggcgtttgccactgagtgccgtcccaaaattcctgctggtagccagtgatatagccatcttcatcagtgctaaaaatggcttttactttgtcaacttccatagcaacctcctaaactgcgtatacctcagtcataaccgctttagctggatatcctgttgcgttttcaccattgccaacaatatgcctatcgtcataaaacaaaagtttgtaggttgtaccaacttctctcattgtgagagttacccgcaaatagttagccccagttgtgttgtataccagtgcagcctttggtatgagagtgaaggcatagttgttatgcgttggcacgccattttgaaaataactccaagcaatgagccagccggttagtgtttgagacagtggaaccgacattgtcgcaacgtctctattctcgggcatcatagccccctgccaaaccatctggttattatttgctaattgcaagacttttacagtgtctaaagtgcttgagatataggttgcactttttcccagtccactagctaagtgtgtaaactcaagagtccccattgagattctgctaacatccatcttcgttgtaccgtcagtttgtgttatatatgacagtaagccatcggggtttaactcagtatgatatctttgaccatttggattacccttagtatcttcaattgtgccatcaatggtgtatgaagtgccattcagagccagcttgccagttgacaatatgtttccaccttcaataggagcatgagtgaaaggcacgtttattgttggagaattaatttctgcgctgtcaacctcaattgattgcaactttttgatattcaacactgcttgctgaatgctctgatcgacccattttgagccgtcgtaatactgcaatgctgtggcatcgttaagcgttttcccgtgccaccacaggtcgcctttcttggggcttgtgggtgttcccaactgaatgtacgtgtatggcacatccttgcttccgggaaccccttgtggcccttgtggtccctgtggaccttgcggaccagtttcaccttgtgggccctgcactagttgccaagaataaagtgctggattggtgctgtcagcttgcgtaaagtctgtataactaccaatgtacttacgagaacccggagtatccagcgaaaagttcgttctaccatcactgctatcggcgtatgcgatatggaagtacggtgtcttgccatcagcacccggtttccctggcaccccatctttaccatccgcaccgtctgcacctttgatcagcgaccagttatagtcgcttggattcgtactgtcgccagatgtgaagtcactgtagaagccaatgtacttgcggttaggatcagtgattgagaagtcggtctggccgtcttggctgtttgcgtaagcaaagtgagcgtaggaagtacgaccatcagcacccggtttccccggcaagccttgatcgccttgcggtccttgatcacctttgtcacctttaaaaagcgcccagttgtaatcagctggattggtgctatcggcctgtgtgaagtcgctataggtgccaatatacttttttccatcgccaccggataccgtgaacccacttttgccacttacatcatctgcccaagcggtgtgaaaatagcttgtacggccatctgcaccctttgcaccgggaacaccatcagcaccatcagcgcccttaatcaatgcccacttaccagcgtaatctgatggatcatcgcttgggactgatgtcttgttagaccaaacgattgccatatactttttaccggcaggtaaagcgctcatattggtgcccttatcatcatcagcgtaacgaacccatggatatttttctgtttgctttgccaaaccgttaatcattgcaacaattcttgggtcaagatcggattcgagcaagctgtagttaccaaaaacagcagtatcactgtttggcactgtgtaatgatttttgacttctaacacacgggcgcttaaataaactggcggatgatagttgtggtgagcaatttgcacataatccccaatatcggccttaatatcaacaacatctgcttcgtaactttcttttggcgtattgacagattttaattgagtaatcgtccggttaagcaattcgtttgggttgcttgtatcgtagctgtagttaccaacaagataacctttggttgccgatctgttttgaggatcaaaagcgcctagacgagcccatgtttttcctgccacgcgatcataaaccactttgtcacctcgagggctaaaaaatcggccgtcatcataggcaatatcagcaaatgtaattggttcttgctcttgacctgtatcagtagttgatgtaggcgtactaccatatcctgccatggcagtgtgcaacgaatcaattgtgccgctggtctttagcgccgatagattgactgcatccacaaatcgctgttgcgtctttccattgccaatctccttataggcattgacaacttgttcggtaatggtcgatccatccatcttgaccacaaactcaagctctgctccatcaaactcatttgcaatatcgccaatgcgcttcaacttggtatcttcttggccatcaaatgacaaagttcttgtgagcgtcgtaatctcattaacgcctaatgtccagcctgtatcggccaatagttcattggcgtagtaagcaaaatcgtgagcctccttgtaggtaactttgtctgcctgctcattaatgagatccatcccgatgtctgcagcgttccacgtttgtatatagtcatcgccatcgtgagcaattaacgtgcaaagctttgtttggccgtatttgtttatataagcgatgtagcctcccaccgcaagctttttggcatcagggtgagtattgtctacagtaaaagtgtatgaagacagtgcgacattattagtcaggacaatatcttcggtatcgttgtaaatcggcaaactatttcttgcatcagttgaaggcgcgcagaggacatgctgatcgcgcgataaaatgaaccattgcatctatatcacaaccacccttcacgaagctctgtagacactgctggcaaatttgcccacggacttactactattcctaatgttgactgtcctggcggcgcaagcaatggctgtgagccaatgtcgacacgatcccagtcggtgtactgattgattgtcaataaattggttgatgagtctagcgtgacaatatctcccgctttaaagtagttaggcaagtctttgtacaagtcgacatagtccttctcaaaattccactcaatcaacccaaagtagtgtggaagtggcaaatctgcccattgtaagaagttaaacgaaacatacattaccttcgtgtctgctaattcttcgcaagtatacgtttgtgcggttccgccggcttcaccaccccatgcaaaaataaattgactgccagactttctgatatagcaatggcctgtgaatcccggagtattgctaaaatcttcctcatgtacctttgtgccattcaaatcataacggacagtaaagtccgatgttgtttgtgacatatcagaatagagaatccttgccatagcatttttgcttgcatcatatatcgtcatgcaaatttgtccaacttgacgtgtatcacttggggaatccaatgacagagctcctaatcctgcgtgcattcgcagaatacaattgactgctcccacttcgccgtttgaatcagcgggcagtttatagattaacgaaggcccatgaggcccatgattatttgggccaaaatcagatggcgtggtgatacccaactggtttgtcgggtctggtttaattgtgacggtccctgtttgtgtcatcacgccctgatcagcaggtatcacggcaaaagaagggtcgttcagtatatatttgtcaattgttggtcgtgtcttaacaagcatttgagaatcatcgtaggttttcccgtttacttccttcgtattgcctacttgataatatctgccattaagtgtcagccctaaaaaaccgtcatctgaagaaaatttgctcgttactttaacagggaccggtactgttccgctatttgtaactgtgatggtgtcggaatagtattcaggatccgctgggttaggtgaccacggagaagcagtatcgtttttctctaatttgatattgtcaatacatatccaaccacctccagcatatgttttaacgaagccaaaacgataatttgtgactgtaatatcgctgtctgcggtcatcgtggcagaaaactgatgccatgtgtcttggccgccgtcagtgtctctattgccgtgacccatcgacaggccccaaattggggacaaaccgttcgttgtcaaatagtctgacgcttgtccagttgctgaacctgcggccgcatatttgtaactataggtccatgtttccccagctttgatagtaactggcgttggtagcggaaaaacgatgtattgatcggggtcgatagatgaatcactgctttggttctcaatccgaagcatataagttccaaacggcgtgggatatgaaggcatagctggattaacttcagcggttctgtcatcgtcactgcttgtcccccaaacaatccctgatggtgttttacctgattcgaatccagaatctgtcagcatgttcactggcacgtccttgtatggcgtgttgtcagccgtctgcgtggctaccgagtgcgcaatgccaccatcgggacagacgaagctgattgagattgtccctgatcgaaagccttcagtgaaggtaggctgactgtctacgatggcaagataatatttatcaggctcatccccaaagattagctgctggggttcatccgcatcaatagcagcggccaaggaacgtctcaatggcaccaaatcgtcattcataacgatcccagttaccacaatcgtcttgacgtcgcgtgacatgtattgcagcatctggccatcgctaataccaaccttttgcattgtgttgacgtgattagttcctacatcacgttcgaccatctgtacatacatccactgggtaatatctactccggcgtatgtgattttaatgcctgcttgcttcaattaaacggttcctcctttccaataagcattgaacctgtctcttctgtcgttgtactgcttaacttttggtgcaacttttggataaaactggtcgtcaccaacttgcagaacaaagctaagtttcgtgagaagatcagcaatattgtccagcttctttcctaaatcatctgtaccgctgctttcgctttcagcaaccgcaccattacccaagttgtgattgatgttggtaacagcctgtcccaatagttgccaagcacggctcgttttagttaacggcagaattgtttctggaccatcttcgccaacaagcgcatggattggctgtgtgatcaagccaccattagcgtaaccttcagggccactgacacgagcaaaagcagagcttccagagccataaatggccttcatgtagtgaataccggcaagcagatcgtcatatccgttataaacatcgttgtggccggggaacttatacgcattgaacgttggcccaatggtttgtacaagccccattgaaggtatgccggctttagcgttgctatcccacaggttaattgccctaggattaccatttgattcacgctggataactcgcatccatgcagcaacttgataatcactggcatcaaaaccattggcctttaaagcttgaataacatatggcttccaacgttgcacgcctgaaccaccgggattagcacctagtgtgtcttgcaactttgccagttcttttttaaaccaatcaacaacactgcctgtcaatttgttaataacaccactggctaagttgctaaacatttcaacaccgccggaaatgccgctaatacttgacttgattaaatcggttacttttccaatagggttagcaagccaatcaccaacggcttccaacttgtcccaagcaccagaaaagaatttgccaacaccgccaatgacaccacctaagtcatagtgttcaacgccagccatattcatgatggctttggtttctttcccattaaagacacgggtgccttctggtaatagtcctgtggcattacgctgttgactcataccgatttgtccatttggtagctggtaaagttctttccaatcaggtccagtaccatcgttgaccatgacaaggtgcatcttttgggtgacagtaccaccagtggcaaagtgaacaggtgatagttttctcagggcgtctttgccagtgaacttctcccaaacccagttgataccgctaatagcaccattgataacgttgataactgcattcatgccatttgctgcagcatctttaatgccatcccatatgttgccgaagaaagacttgaggcctgaccacagggaacgccatccggaatctattttgctgttgccatcacttatccaaccgtggactgttgacatcccattttgagcgtttttcccaacatttccccagaacccgttccaatttttagaagtgtctgaccagaagctatcccaacctttgtggatactggtattggcattatcaatccctgactttgtgctattcataccgttctgagcatttttaacagtatctgaccaaaagttgttccaacctttgcttgcattactccaaaagctgtcccaatctttctttatctgcttattagcggcatcttgttgcttttgctgttgctgttgtgcatttgaatttttcttatttacatcattccaaaatccagtccagcccttaccaacatcgttccaaaatccattccagtctttttgcgcctgcttattggccgcttcttgctgcttttgctgtttcttttgtgccgcatctgttgacttgttgatgccatcccaccatttgactacattgttagtcatttgacgagcatcccagccaaggccacctagccaactatcagctggcttttttttagcattccagccatctgtaaactttttagcggcatcgccggcccatttaccggccactttgccaattgtggcaccaattgcggcgcctaatgggccaccaaaaaaagcaccgatgccaccgccaatcagcgtcccggcagattcaccaacggaagaaaacttttggccgacagtacctcctttagaaaaggcctttgttaaatccttaatatctgaaatggcatcataggcaattgtgatagtcgccatgcccttgccaagcgcactgctgtttagtttgcttaaattcgtttttatcatgtcagcgaatttcgagttagctagtttcttaagcccagaatacatgcctccaacgcttttggtgaaacccgtgatggcagcaattggtaatactttaccggccaaattcaaagcaataaatccagcagctaaatcgccaaaaagtttaggatgtttatcggcaaaatctcccaaagactttagcaatggattaaggaccttcagtcctgatgtgagtgccgcccatgatattttagccatagctgatccagtggttgaaatcgtagtgaagaatgttttaatttgaccagcgtggctagcaattgattgactaacttttgtaacagcatccgaaagcttgtccatcattttgtccattgctttaggcccagcagatagatcaaacgcttttgcgaaagcagatgtgattgtgcttaggcctttgctcattgcttgacctaatttgccaaactctttatcggtgtttttgtcctgtgaccatcggctgatagccccaagcactgggttttgagccgttaaaaaaggcttttctatgtcgccaattagcgctgggatgcgagacttgataacccgagtcatgccggggatagtttgcatcaagttgtctgacgctttgctatatttctgccctaattcttcgataacgttagtggcgtcttgagcactgattttgcccgcactcatctgtgcacgaagatcagtcatagttagctgagaattgtgctgaaccttcttctcgtattccagcattgcatcagccatcattggaaacgcatcagttaactgattgaagtcgccaagctggacaatagatccagatagtgtatgtgtgaagtcaagaccgacctgttgaatacgatcactggataatccaatcgcatcacccattgtcagaaaggcggaagttaaagcttcggttttgggttggttatcaaagacatgataaaactgctggtttagttcgtttaccaaatcagtatcttgaccaaacttgacggcaagtttgttagtcatgtcaaccattgcttgccctttttcagcattaccagttaaggttagccaaatggcattcatttgatcttgctgcttttcgtattccataccagcagcagttgcttcttcaatttttccttttagcgtttgccagccgctcgtaatggcgttggtgattaagccaccctcaacaattttgtgaagcaaacccggtgtcttttctgcttgcttgtttgttcccgatatagcttccttaactctgttgaaaacagacggattagccttgtccatttcagcttgcaaaccggtcatagaagacttggcttttgctaaactggtagccgtttcatcaacacgcgtcttctgtgttcgccatgcgtctgaatccttgccactagcactggcaatcttgtccaactcagcagactgtttagacaactgttcattcagattggcaatggaggacttatagccttccattttggctttgttggcttcttgctgattgccttcagcctctaagcgagtaacataggcttgatttgcccgtgcagctgctgtgtattcttgctgtaagccagctaatccagacttttgatagtccatggcctgtttggcacggtcttgctgagcttgcatactggccagttgcttgttagcgccatcgatttgctgctgatactttaaaaactgttgagcaacatcggcagtattacccttcaactcagcttgtttggctttgagagcgtcaatcttagactgctgtgcttcaatagacttacccaagccgtcatacttggcttgagcagcgccaactgcatcaccagcggatttcatctccgcctcttgagctttccaagcattttggctagaacgaacaaccgctgttaatgatttgacggattcgcttgccgacaatagatcaagggcaatcttggtgctcattgttgcattaatttgttgtgccacttcaatcaccctttctcttggtattgcttccacataattgccggatcaactggccggtctttcttatccttggcggacatcatttccagcatttcaaaataatcagcatcatcaaaatcctgcattgaccagtggaaatacatgactgcctgctttttcatccatctaaagtcctgtagctgattttcaagctcataaacttttacggctggattaatctttgcttttgctggcatcctgcttcttggcagctaagtcaatatcctcatcactcatgcccatcatgcgctcaaaagtgtaattaactgcctgaatagtgtcggcaaattctaaatccccaagtttttcgatttcttgcttgttcaggcctaaaaccgtggtcaagaagtcgattgagtcatgcagcatatcgcgttgcattttaataatttctaccggttccatatcagcaacatcgtctgccttggccatcagtaactgtaagtcatacatcttttccatgttccgattactggtcttgacttcatgtacacggttgctaagttgactaactttaattttcatttgtaataccatcctctgtattttgtaaggtcgctgtggtgaatcggacaccaccaagatcaccagaaagcgacttttgagcataaaaaatagcgcacgttcgtgagccattcatcagttgttgctatgaaattgtgtcagattgcgtctgtcatcattgcttagctggagttgtagtgccagatcctgttgaacttgccggcaatacgtaaccgccgaacacttctttgtacatgttggctttatcaaacttaggatcaatatcgctataaatcttgtacggctgattgttaaaggccatagtagtaagtgctgtgtaagtcaaagtgtcatctacacgttgttctgctgccgcatcagtctgaatgttagctgcggtttcggtcatgatgccatcaccaaagccgtaatagacaaagtgtaaacggtcaatggtttgggtggtaataagtaaagctacatgagcctttaaattctcatccgtataaccgcccttgctgtcactaacaaaacccttgatttgctgcttaattgcaaagtccaagttgttaatatctagagctactgatggctctgaagtaccaacagtaacgtcctggacgttgttgttgccataagtcttagcaatggtgcctgctaagttagtaatgttggcagttttagcacctaaatctttgtgatcgacagtatagataccgtctgtgcctaatcctgctccagtaccagaaattaacttttgttgtgcatcaaccaaagctaactggatttgatataaacctactgttgccatttaaattcctccaatgttctttgttctactgaaataaaatgtgttaaaaagttgctgtgtgtcttggtctaatgttcgttgtctaaccgcggctacctgccaatgttgatgagtaaaagccttcatcatggctatctcaatggtttcgggatcagaatcaagcaattgcgagtaccaaatctgtacttctacttcctgatttaatgcccagaaatcgttgtcaccatatgcagctggatcattagcagcatcagtaatcaatacaactgtttcgttcagattatcgactaattcttgcggcaagttattgcctttaactgcattgatattggcaatcccggcttggctaagcattgctactgcatcatctacagcgctcatttgtctccaccaccattcaacttggcgataattgcttcatatttctcggcttcagcggcaaatacagcatctttggcatcatcacgagcattatcaacaaaatggtcaccgtgaattttctttgtcccatcattaaggaaacgtgcaacaaatgctttattgccaaatccagcaacggaattaccattgtgctctttatcaatatcaccagtggcggagctaatatcttcactcagatgcccatacttgccaccgctacctttagtgtctgggtgtttttctttggttgcttcttgtagcttgccagcaaatacatcagcaccagccttggtaatcttctcttggtcgctaatagacaattcggcagcttttgatacttgcttaagccattcttcaagtgcatcatccatatccacggttatgcccccttagttgtttttatgagggttaagtagtcatagcgaatagcgttgtttgaatcatctgggctaatatctgaaatgtcatacacgatgccatcaaggcgtgcctgtttctgctcaatatttcttgcatcgtgacgaacaataatcgtgattgagttatccaagcgtgtgcccacaagcgtgtactgctgtgttaaagttctcttttgctgtttgaaatgcagactgtaggctggcacaaagctagtgatattaaggccagcaccagtcgtgtgtgattttggagagccaagctcaatggttcgactaaagtcacttggtttaaagctacttaccattgttgtcaccaccactactagcctgtaggtgtgccagcatcatcagaagacccttaggcataccattggataaaccacggtcataatatgtagcttgtgtgagcgttttgatggctggaattgtcaaggtatcactatctggtgcatcacttgatctattaatgatattgattgcagtgtttaccagactaataattgttggcaattcagactcatcaaggtttaactcactcattaagtcactagcaatcttgtttggatctattgttgcttctgccatctgtacacctccattcggccgccgcttagaatcaagctactattccttttttaggcgaccagtttacttagttatttgccagaggtagtagtaggtactgtagcaactggtgcagtataggtaatgaacttaccagcagctgtatcagcagctttaaagtctgcccgcagtgctgccaaaagtacctgttcaaaattctcattacgttgccaagacaggttaatgttgcccttaacagtttcaaccacaaagtttttaacactcccaatgaatgcctttgcgtctccagacttgccaagcacatcatcagcaacaactaccagcggagcaccgaacaattgtttgccggatggagaagtgatggaatcttgtaacaggtacctaccttcagcatccttctgcttatcaattgcggcaaagaatgattcagatacaacaaacattcggtcagtgtagttgctcaagccaacgttgaatgcatccttaatatcgtcaatgcttgcagcggcaactggagtagctgtttgcaatactgcaccaatcttgtgctgttcagtttggtccttaatgtcattaatgtactgggtcagtaaactggtgatatttggatagtcttgtgtcatttcaagggaaattggcagtgaaccacgcaaagtctgaacatcataattgacctgtgttaaagaggcatttgcaagtttagggttgtcagccaattcagctgctgaaaccagttgtgcagaagccttagacaaaacaggaatcttaccagtcggtgcagaaacttgaactttagttacatagccgcctaattgtgctgggtccttaggctgactcataatgtccaatacttggctaggcaatactgcttcgccagcgttgctatcaaaacctgtggaatctctcttaatttcgccagtcttcaaaaattccttaaaatcacgtacttcttcatcttcaactttgtctgctgttaaattctttgacatatcttttgctccatctcttttattttcttgcttgacatcttgttccgcagttacctcagccggcttatcatcacgcttttcagtttcagctgtttcttgctcaggctttttctcatccaaaacaacattactgtcatcatctgggacatcatcgtccatttgtgatggcgcttgttggtctgccaattgctgacttaatgactgaatagcagcttgaagtgttgctatcatgctgaccaaatcaccagaagttggttgagcagtagtttcatcgcttgccatatctggtgtagcgtcacgcttttcttcctcaggcttgtcaataacaacctttgtttttacttgtgcttttaaatctgataactgctgttgtaattgttcaattgaccgcttttggtcatcaacagattgttcttctttttcctctggcttttctgccatcttcacaacttctttcttacttgataaaaattgagccaaatcccgttgcacttgcacacttgtttcggtatatgctgggataggagtcagcgacagttcaaacacttggtcaattttgttaattgtgtggatcgtgttgccttgtgagttgactgaccaactatctccaccaggcgcaatcttaaaaccgaacgacatgcccttgatattgccattcagtatgtttgtgtatgtgtcatgccccaactgtgtgtctggtaactgggcattaaagtgtaaaccatcaggctgaatgcttgtttgtaatgttccagcgtctgcacgggccaaaatgttagaaaaatcatgtgcataaagtagcaaaacttggctcaaatcgacgttatttagggcattttggtcaacatattcggtaaaatcgcctttaatcgatggctgattgaacgctgccgcaacgcctgaaatatccatattttgtccattttcagcctgattgttgctattttcattggctaagcccgtttcagctcgaattttaacgtcaaatgtacgtatatcttcattttccactaaatcacaccccttttcgctagcatttgttgggcttgcaaaggcgtgatggctggtgttgtgccacttagcaacttctgtatctggctaataagtaggtcattatcggcatccacagcgctagattcatcaatattcacggggacgccaaatttggcacccatttcgctttctattggctttacatatcgccttaaagtgttgctataaagcgatttagtcatatctaatgaactttgctggtcaccttgaccattcaaatagctatctggaacaccaaaaaccttgcctatctgtgtcttggaccagtcattgcttgttagaaacttgcttacgtcagcattaattgataaattttgtacatcataaagctggtcaagcaccataggccgtccagcattgtcacccgtgttggcattttcaaaagcttttcgtgttgcttctttttcttctggtgataaagcaccctcagcgactttaatgacggtgcttggattaatagcgttcttaatggttgatagtgtcaacttgtttgcataatcttgaatgttgacttggcttgcaattgattctaatgggctaataccaatgtattgctgaccattgctaccactagccatcaatcgaaagtgaagcatgtttgcactcggataattgatagtgcctctctcgtctccccagttaaccgcatagctaatatctgcactgctgtctgccaaagtgactactacctgtgccgccggtgccatctctagcctcataggaacattgttgctgtctcttgtaatggcgatataggcgtttcccgtaagcaacatctgaactacagctgattgccaaaagttaaacggagaaataaggttgttcgggttatttatcaccttgtcaaagggtgcagccacttcaaaacttgccgatgcaatatcactgcttagaaggttggtaacagcatatagatcagaattatttaaggccgtactggcatcaaccaaatgattgggtaatacttgtccaccgcttatgatgtaacttgacaggttagttgatggtatcgtcatacttcttttctgcattcgttcatacggattccatatgctcatctactaccacctgccttagatgtaggcgtgagtagccaaccgcaaaagagcaatacactgcctagtaccaacgttcctatggtgctattaaaaagataagcactggtgacaatagcaattaagccggatacaaataacactgttggcaacagttccttaagcattatcaatttgctcacactcgcacctccctcagattctttgtgtctttcattgtttttttacctctcactatatatacgtacttgatgcgccatttttgaccaatatttaccttccaatgcaaaaaaatatgtagccttttaaaaagctgcattcattaggaacttatggcgctcttcatcactcataccagacaatggggaacggttcttatcattatctgcatctgggtcgaagtctgaaaaggcataataggcacggctaaatgcatcaataactgcatcaacagcatcaatttttgaagttgcacgatccttatctacctttatgccagcgcttgagccaactataaccgcattggtcaatgcatactttaaaattgggtcatcgtcataatgaactcggccttcccgaattgctttcttgaactcatgtgttggtttatctaacttatctgacgtctgttttaaaggcatcagtggaaatggttcttcttggcttaacttatccaaaacatcgctagttccccagcggtcaaatacaaagaacttaacatttaagccattctcttctatatagctcataatccacgtggtaacactgtcttcatctatgtagccaaagcgtccttttgcaatagtggcaaaacccaattgctcagcttgacgataattaattccatcttgcttttctttttcggcaatacttccacctgtgtgagataagggtacccaactatgctgttggatataatagtgtgtctctccagccaactggtatggataaatgaaagcaactgctgtgtcgtctgcaagtttgcttaagtcgaatcctatataaacatcatgaccagaaatgctgaatggtggcttatcagctactgcattttcgatgtcatgtatgtttaaatagcgattatcagaagccttaatccacatgttcaggttcttgttcttgaattcatctaatgttccgtccagctttttcttgtctcgttctgaaactaaactaggcaacatcgtatcctttttcaattcaagaattgggtttgattttgtccatgaggatgggtcatcaacttcatcttcactatcctgactgtagttaattagcaacacatcgtctaaatctcgtgaataatccttttgcattgcttctcgtgccaacttttcatctagataaaaactgctggtgctgtcagggtaggctgtcgagatagaccaaaactggtgatcatatacttgcacctgcccacttgtaatcttgccaatgttttctttaatggtgccaatccggccgtcatcaccactctcatcagccacagcaagccgaaaatggtagctatcaaattgaccagactcatgtgacaaacggagcaactggtttcgcgtctttttacttctaacgacatcatccaaagtctttatctgctgggttttatatgttctctttacatctgtaagttcacctaatctgtcaaaggtaagttgaatgtaccgccatcctttttttgattgtgcaaccacaggtgctatatatcccatgtcttggttgtacatgccatcagatgcaatcaggtagtcatatgcaagtagaatatttgtgatgtatgtcttcccatttgttcgtgccacagaaaattgaaccctatggaatctacgctcacccttttcattccgccacccttgacttgaacagagcagtgctttctgccatagcattagcggaagtggtttgcctgtatcaacgtctggacaaatgctggcaaagtttagcacttcatgacacttacctaggtcatacgtgtaagggaagtcatcactgctaatccgtgtcaagtcttgcaaatgccgccagcaagcaagtttaatatcttgtccagccatggtagtaccttcaagcacctgaaaagcataggcagtcatagggtcatgatatttgtcagcaatcttatcgtaagcaccgttatctcgctgctgtttgtaagctcgttcaacagtccaatctggcaatgttaaatcatagtctaccaactcttgtcacctgcctttaatgcttgcttaagcgttggaccatcatcgtcatcttggttatccaagacaattgaagcacgcgcttgtggactgagacccaaagcatcacttaatgacttaatcttggtggttgcatcattcaaaatagcagctgcagggttctttctacttcccgtgcttaagccattctcatttatatcctcatatgcctgtcttgataattgaatctgttggcataaggctattaccagtggcttgtcaacttgtttgcataatcctgctgcgtttaacagaggtacaagctctcgccaagctgtataagcatatccttgcaaaaatcttggtggcgtaacttgtaatggctccattccacttgtcttctttgctagctcctcagttcgtgcacgctgatccgcacgatctgatgcatcttgtgttattttcatctttctgcccatgtctgctgtacctcctttcgtttcttttctatgtaaaagcttatgcatcaacatatatagcacttcttgcactgcctatcatattcatttgctgtacttttgtaagcatgacaaatgccggtatatcaacgtttgaaggccatgatgtgacccatataaaatatttttataattgcacattttttgagagaagaccattttgttatgtgaggtccctctctacgcctacggggggcgggcattacagattttttatttttaaatgcgttatttaatattcgctgttcattatttattgtttatgatttatcattttaaattctaatggtttaaataatggctgtgcaagatcataatttgcctcctgctgtaccccctcactatatatacgtatgaagtgcgtcatttttaccttatcaacacaaaaagagccaaccaacggctgacccttgcttatgtataaaggtgacacaacatggagctaactctctatttgcttaaaacgtctttttaaagttgtttcacttattccagttattcttctaattcttctatacgaaagatttttttcgcgaagcctaaatgcttttctgatatcatcttcagaatatgtatttggacgtccctctttgaagtgagggttgtgcgctctggcatattgttttccttcttgagttcttgatattatcatgtctcgttcaaattgtgcaaaagctgagaatactgtaaacacaagtctacctgttggagtgttatcaatggttcctaaattcagaatcattactgaaatattcttgtcaaacagtcgctgaatcacttctagtgcttctttggtatttcgtgcgaatctgtcaagttttgttacaatcagcttgtcacctggttgcatcaagcaaatcatttctttaaaaacaggtcttaccatagttgttcccgtgtacttttctgagtaaatccttattgctcctgcctgctttaacgtttgtatttggacacttagattctgtccgtcagtgcttacacgtgcatatccataaatcataaatacacctcgatcaataaaaaaagcagtccgcaatttttaagttgcagactgcttccatttcttaaacaatgaaactatatcacagaattataaagaagtatagtccctgaaaatgaatagtttcttagaaaaacgcagtctgtcatggtactattaacctcattccttgctaacagagattcatactataacttaaaagttatggacgatctcataaggaggaatatttatgtcacaaactggaaacttaggaagatccgcagctttagcgggagctgccactttacctgtaactggtgaacatatttttaactttttgccaatagttggaagtgttttaattttagctattgcactttttagtgggtacaattttttccttagaaaatggtataacgttaaatgattggttcgagtcttcaaccatacatttatagcctaaacattttcattctatgtatgagtgcattaggcttattgaggatgtttatcactttctggtttgcaaatgtgtatgactatcagtttataaaatacagatatgctcatcacaggaggataaagcgttttagtccttcaatatcagttattgttcccgcctttaatgaagaaaaggccataatccaaacactggcctcaatttgcagaagtacttataaaaaaatcagcattgtagtagttgatgatggttcgtctgataacacagctattttggtcaaagaatttatcgaagttcatcctgataatgatatcaaactgattcagcaaccaaactcaggaaagtctgtagcaatcaataacgccctgtttaattatgacaattctgtcctaacaatggttctcgatgccgattctctcctaaaagaagatgccatagagaaaatggtcaaatggtttttgaaccccaaaatagtcgcacttgctatgaacgtgaagatgttaaccttaccaacctttattggagcatgccagcgttttgaattcataagtgcttatagaggtaaatgcgctgaacacgtattgaaaacgctttacatcataggaggcattgggtctacttttagaacagataagcttaaaaatattggtggatacgacacgaacactccgaccgaagacattgatctgactttaaaacttctctctaggtagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaggtatggtaataaagataacattataggatatgccaatgatgcagtagcctatacccaacctgtgaaaaagtttaaatctttgatcaaacagagatatcgttggaaatatgggcgcttcatagcattcgtaaaatatcacaatttatttttcaacatggataaaaagtttagtaagatgctaacttttttccagttgccgcttgcagttttccaggaactatttatgcttgtagaaccttttgtgtatttgtatttattatttgttacaatttatttccaagatttaggaatgtttattgcgatggtgtcttacgtgtttgtagttatttcattatcagtaacagcttccagagaatcgttaaaatcaaagttgttgcttctgtgtaccgcaccattcaatttttttctttcttacattttgacaattgttgaatatgtttcattgattaactctatacttcacttacattctatagttgactataataacaaccatgcaaattggagtcatgtagagcgcctatgaacgcatatgaggtatgcagtaatttcctcatattttataaaactttaccctatacggcttttcaaaggaaaagccgttttttgaatatgttaaatcatacccatcaaccttatcgtcattggatgtataagttcttgtcttccattaccacttgccagccggcatcttttacctcgtccgtaagttgactaattgcttcattgtttaaatctgccagctggatagtaatcagtccagtgtcacatccacgcgtcattagcctgtcgttaattatttgcctatactccaataaatcttcactagattcaatgacggtctcaggtgtcaatatttgacccattggttggtaccctggtgcaacatattcgacatccttttcaaagtcattatccattttgcttatcctctttcttctcttttaaaacttttgtccaccattgtttgtttaagtgttttaaaattgtgtctccgtttggcttatccgctattagctgttctaactttgtcttcctaaagtgacacttgtaacacaatgtccataggtttccactgtccagtgcttgcttggatgaacacaatcggcggcagataatgtggtcaactatctttcggtcttgaacaacattgccacacacttggcaggtggctaggtctcgtgcatatacatagtccctcactgcttgccattgcttagaatggtaaaaggctactgccttagggtctcgctgctttttgtcatactcttttgatttgtttgccttgattgccattgctaactttgaccgcctgtagtcggcctttttggcctgccatgattgctcatgcatggccttatgctttgcacagtacctttcgctgattggtatgattttgtgacattgtggctcattacattcatgccaaagatttttcccctgtcgtctggtcaaaatggcaaatcactgtccttaagcccacttaatttgggactaagtgaattaatcaagtcatcactcagatttgctgatgaatcctttgatgcatcattgtgtggcttagaactgagcagatatatgtgttctgctacaacttgccatgtgtattcagtttttccgtccctttcatactgtcctgtacgtatacgcccgcttatacctatccgagttcccttagatgcataattgctaagaacttctgccatttttccgaaggccacaattggaacgaaatcagctgtttgcttatcctttgcctgactataaatcctatgtattgccagcatagccgttgctgaattgttccctgacttaacactgttggcaacatttcctactaagttaactgagttcattgctcttctccttcaattcctgttcacgttttgccattaaatttaccaatatgtatttatctttgcctgcatgtgcaaagtccttgatcaggtgcccttgaaaggcaacctgagggtcatcgattatgttgtctatgtattcttcatgttcgccaataaaggcctgcacatcgctgtcgcttgtgtctgggtcggttatgaggtcatcccattcttttagcaatttaagttcctttgtgtggctattagattgcttaggttgccgctgacgagcatacttgcacaccttaactagcttattattgaactgtctgggcgtttgatgaaatcgcaccattgtctctttttgggcaaccctgagcaaactttctgcccaacttttagtggccttattcttaaacagctcttggagcctttctaaggcctctagtgtctcagcttcattacttgcctgtcgggtcatgtgggcaaccatctgtgctttttcaacctctcttgaagcactcttggcttgctttcgaacaaggtcttttctggcgtacttaactttccatttcaaactcggcgactctgctgcgatagcaatttcaacatctttgtcggaccatttatgaagccggtgactaaggagttcaatcagaagctcctgtgaagcatcttggcggctcatgtgaagcatgccagctagctttgaagcgttactgaggaaggctggcgttgatataagctccttaattgtcttttctgaaagcaactacttttcgccacctttagtccgtaggccaatgattgctgtaactatgcccatggttacagcaatgccaagcaatgccagccagtagtttaaaatattagcccatgacaattgtgtgatacctgcaatgtttgcaattgttaggaaccaaccagctgagttaagaatgctaaatgtgtcgagggtgacattttctttgtttttcatatgtatgtactttctttcttgtctatggtatggtattaattgggaagttggaaccatttttcatctggcgaaaacaaaatggtaaggcttgttaaggtgtaaggtgccattagctgagcctgctactgatgtgttgcttaaccctacggcctcagcggcctcctttatggagctatatacctcaaacgagctgtcatcgttcacttttcgaactggtcgcccattagctcttttcattaattgccgcctatgctccttcactaagttatctctatggctaacccatcgcaaattgtaaagagcgttatttaatctgttgtcatcaatgtggtcaacatcagagaggttctcaggattaggaatccacgctaaccctagaagatgtgatagggtaacagtggtgtgtttgtttgagccgtcctttgtcacgccgacaactacataattactattgttaatgtattgcttgataggccgattggaccgaggcccaataacaacgccatttctacttatcttgtaacgtgaatagggtggtttacactgtttaaattcctcctcatcatgtgccttaatgcgtgcttttaaagttgctttgataaaaaattctaggtttgattccttatttaccgtgcttgtcatcgttattattcctactttcatatttgttctatactttaattataccacgtttgttaatatttcctgttttgcatcactcgattatctatgtctgttaaaattaccccctatttattccttacacttataaatatagtgtttgatccatttgtaagcgccttacaaaggctttttaatatttcttaaccttttcttaacatttgatgccacatgctatgtaatgttgatgtgtgctgtggctgtgaagtaaggcaaatgatgagctgagggttgtaaaaatgctcctgacgctgctagatcacattgctgacaagtttcaaattacgtcagcaaaagatgtcagcacaaaaaaaagacgacccatctctggatcgccttaagtagctagagttaatcctccattcgtctacctatgcattctcaccttaagctctttttttagcttgtcatttttgtcagccagcttttccctgcacatccttaaagcttccttagtcgttggtacaagcaacttttcagccggtttagtatccttatagcctttcagttcataaccgtatctaccagcagacgcctttgaaagtttttccatttcgactggcttaacggtgcaaacctcgtcaacccattgccttgctgtcctgtccttaacgcttgctaagctgctaatagtatccgctgctgctttggccgtcatgataggctcattggtataccctttttgagcctttatacccatgaaaaaatttatttctcgtttcccaactccgcctgataaatctggaaagtagtcacttgcaaccttctctccgaacaactggataagcatttctttgctgattggggtgtttaggttgagggtaaagttatcactcaccaagtcccagttagaagtgttgaaatcgcctagtatgtacacatggtgcgacttgactaatttactaccattgttaaactccattagcttcttccctgaatcagaaagttcatcgggttgtgctaagtgaatggaccctgcaactcgcattaacacaagtgcattagcaatctttgctttggtggctttttctgggtgctcaagcatgtccatcattaaatccttagtgatgtagatacctctgcctggttcttttgaaagctgatggcctgtaacttgattagcggcaagtaggttaactgcctgatatacgtcagccatgagcttcttgtcatcccgccaagggtcgaacttattagctggtacaaataaattcttaactgctttcgaagcacctgagcctcttccacttggcatctgtaaaatgttcgatgttgctattgaacaagctcgcttataatcaactcgctgaagcatttctggataaaattgtttaaggaatgctggcagctgttcttctggtgatcccaagcattcaaggaaggctggcaccggattagctttagaattgctggttaaaataactttcttcccatttaattcctttctctctttagcccccacaatttttcctgtgctgactgtgttaagcaactcagaaagttgcgtcttcttggctgttcgagtggtgctgtgcttggttagttcagcaaccttatcaatgttgtcagcccagtttgttagtagctctttattcttatatcccataatattctcctcattcattgcctgtcggttgctcccgattaggctttttttgttacaaatagttcatcaatatttgcatgaagtgcttctgctactcgtgttgcaacaccatagctaactcccacagtgttcatgtgagttacacttgaatagcttaaatttgttacctctgcaagctttccttttgaacccaacgacatcttgagcttggcatcaaagaagtttaaatccctgactaccattgtatctggatgagttttcttcatttttttcacctttcttcataactacacaactacacaactacacaatcttgcctccctgcctcaaacaagtaggctgatttttccgcaccagccacacttgctgtcttgaacgaggagaaggaggaaattcttcctccatatatatatatatacgtaaggtaagcgccatttttgggggaaatagctgataaatcttatttccttattccatttgtcacaccataatttctcttacaacttaagtatacactctttttacttaaaagtgatagtcaaagtctatcaagcatatgtcaatactaacctatccatttcttttacaacttaattataccacgttattaaaaaatatgagtcgttataagcaacctgtatatcctttacctgcatcacaccctttcaaagagtaatttagcattactattctaattgacaaaagttggaaaagtaacaggtaatccacaaagtttgcagaaagtgcttataaacgttgctgtgtgggcatctaaagggggtaaaagtgtggaaagtaggatggcaaaaaagtgtgcaatttgctcacgagcaaaatacatgccgtaaacggcttagtatcagtagttgtaagcgcaaacatggcctatttggcatgtacaatagtattacttatctacacatgcaaaaccagcaagctgtctttgatgtctagaacgtacaattgttttagcaagggttacaagtgtctacacatgttttccatggtcaatcagtgtcactctggcttcgccttcgttccacaagaattgaaaagtttaacaaaagttgacatggacgactgacggtttttgtcagttggttatgtcaaggtatccagcaaccatgctggcgaggggagacaccggtttttggtgtcgggggcgagtagccccaatacttaactggtaacttaatagtaaactagctgataacttaatagcattacttaactccattcagccatcgctacgctctagcttcattaacagtaagcaacctttgcattctgaatacttagcaagggtagtaatagaagcaattagcaaagaacgctaattggggctactcgccccacaccaaaaaccggtgtttccctcgtaagctgtatcagcttaagcatctgactaagcaaagaacgcttaaccactttaaaaagtctaaaagattaagatcattaaggtcaaaaccatgcacccgttgcaacctaagcattactaactccattcagccatcgctacgctctagcttcattaacattcaggataaggccttgtaactaggctaaagagacatagcaatttcaaaatggaaaagagttacaagtgttcatcagtgttaaaaaagtgtcagcaagggtttactttattccaatcagtgttaacaagtgtctaccgtgtttatagcaatttcaaaatggaaataagggttaaaagattgagtacgccttgtgaatatttgagcattatatcctttattgtctactttttaaaacgcaagttatgctcgtctattccactttagatacacgatgtataattgtgccaacctgtaacagaattgcttagagagccaatatgagccttctaggggtactgtagaagctgatggcctcttctgtgcacaccagtatgcctctttgttccccctgttaaacttcattagttacaccagcaatgaagtcctaccctgttggcttcttaatgctctagtaacccctttgcctacaatgacactaagggagcactaggacggcttagagagctaatatgagccttctatgggtatcccatggtgtctaattcaaatcacaatggtgcccactttccaatcaggtgtaacaggcagacactcttgtgatgctcactattaggccatataaggaagtatggaagaataggtacaattacacatgctgggtactaaaggcgcttagagagcaagtgtgagccttctaggggcacgtggtagttaattagcttgtgcataggggaatgaatcacagccagctcacttaatgtgctagctaacacgctattgaacacctaggtggcaaattggtatagctacttttagggcacaaaaatagccctaccacattaggtaaggctaacatgcctgctgacgttattttattttctaaatcatatgtgatctcatgttatctaggtgctgaataaaatgttgaaaatagccatgaaacaagcaactttttcagctatttgaaacaccattcaggcccctaaaccagtaaatacagtaatgaaaccatagttaaataactagatgcgcggttccaccctacttcagatagaccgaatctacctgcagctttgtcatttggttcgaaaacgccaatcacattcaccaccatcaggcttacactatccctgactcgcttgggtttggtacaaatgcgaccctttttctcatcaccgattcaatttccttattagtatagcatcgcggctaggggtgtcaagcgggttttctgaaaaggaccacggcttttccatcaaaacgatataaaataccctgaagtaacgtctaatcacgttatcgctaatcacaagtcatctcgtgtcattgaccagattgctaaatcaacttgccgaccatgaaaacaatatgactttcgaagcgttccttctatcttcatacctattcttgccatgagattcatcgattttagattgtcaaatgtatgtctcgcatacaagcgctcaccttcaagttcagtaaagaagatgtcacgtaatttgattgcagcttcagttgcatatccatgcccttcaaattttttattgagtacataacttaactctgccgatttgttacgatcgtctaagtttaagaaatagattgtaccaatcaacttttcattcaaaaaaatgccatatttgccaagcccattctctataaatattttttgaatgatgtcttttgtatcttgcaaactcttattggtttcaaacacataataggcattctccggattacttgcatactcgaacatgtcaggcgcatcgtcaatcgtaaccggtgccaacacaagcctttttgtttgataggcatgttttaatttttcgcgcatcggcttacctctttcctatccacataaaaaaaataaaagacataaacatactccgctctcgatgtaaatcagaccgttctgaaaagacggtttggtttagcgataacgataaatcaatactgaaaagaaatatgaaatcacatataaacaggcaacggcagcaacggcgacaagaaacaatgaagctttgttttggctcatcaagaaagcctgtagtttcgcggaccggatccgcggtaggattgccataagaagaaggataatgatgaaaataaacatcaggccgctttgtgaaaaagcgtacatagccggaagtaagataatgccaaaaacagaacatacaacaaaaatgatcgcggttatcccaaataactgcatcggtgacgttttcggtacgataatctcaatgataaggctcatcacaaaggcaagaaatgatgttgcaaaacaagcgatcgcatagaatacgtacctagaaccaacaatcttgaatggattcaggtgataaggcactaaaaaatctttccagtgactttgattatcaagctgaaaaagcgtctcaagcgcaacaatggcaagcgcagaagaactgaacacaaataactcggcaatgtctttgttaacgaaaactgcaaccagaaaagcgccaaacaaagaaatcatgacggggagtttaaggattcgtttcttgacaattataaagtctttaatgagaaagcctgtcatttagtatcccccacttcttcgtggctagcaaccaaaagtgacttaagaacagcctcgtctgtttctggggttaaactgaagtctgttgtgatgctgccatttgttagaaccacaaaccgattacacagctggatgacatcatctaaaatatgtgttacgagaataatgctggcaccggtttgattttgataagcttttatttcattcagtatttcaatccgagtcagtgggtcaatcccgctggtaatttcatcaagaatcaccaaatcgccgttcatcgataaacagactgccaagccaagtttggtttttgtacctttagagagatcaataaaattagtttgcttggggatttttagtttatcgatatattgtctatatttttcacgatcccagcgtttaaagattttgggaaaaatatagtcaatgtctttagctgacaagctttccggaatgtaaccatcatcaaatgccatagaaatcgcagtgccttttttaatgaagaccgttcccgaagttggcttgagaatgccgataatcgtttttaatagcgttgttttcccagcaccattactaccgatcacgcctagaacatcaccagcgttaatgcttaagttaacatctttaagcgaaaaatgtccaatctcaaccgaaagcgcctttagcatcagaatataattagcatgctgtttccctttgctgctgttcatagaactagcctcttctgtcatagaaattggcgatgaaaagaatagccagtgttacggtcattgttccaagcgtcgcagtactgccaaatcccgcctttacaatgactaagatgtctacaatgatactaatagctatgattatcttaaagaaggttttcaaagtaaaaagcctcttttcacacgtggatgatggtccagtaagcctctaataatagaaattttttggtgaagtttgtatcttttaaagatgcgtgttccggcttgacatgaaccttatttcgtttttattgacgtacatttaattgctggcatgataggaatagttttatcttatcactgctgtgtaaaataaatgtatacaatcggttaaattttagcgcgatcatttacacgctagaattgacttaaatcaagcacgcgaatagctccctaaacataaaagcgaccgtaacgccaaggtatggcgtacggtcgcttctgtgcggttccatttatttagaaagctcaaattcacccaccgcttggtcattcggccaaaagctattcccatcaagttcacactttccatgacttgccggagtttggaacgaatgtgacccttttctcatcaccaaattaattttctttgctagattggccttaaggttgcttgtatcaattcacgcctgacactaagtcgatacgttctttactgttattccaaagttcttgtggcgtatagctgtccttttcaaatagaatgacggaaccatccttttcgatgcgggcatttgaaccgagccactgccatgtcggaggcaaaatcaagtcaacccgtttgcctttaccttttttaagtgaccaagccgaaatataatcctcaatataatgtgatcgcaggtatctggtttgcccattatcaaactcgattgctaatatatttgccgccatccagactttgaccgcctttggcagtgattcacccattattaaaatccccctctcacaaaaattgattaagtgattattgtcttcggttaaagttgtcactatttccgcaagaagcatcacctcaaacgtgtaaccgcttacttataacttagcacacagagaaataaaaacaatcagttaaatcaattaaatatgtggacgatcattattggaggaatcctctgactttgtacgatccggcaaccgatcctgccaatgattcatttgatcgataaaccgcttagcttttggcgtcaccccgaccatatctacgtaaataacatcaagaattcgcttgagttcggctttggtcgcgggctttacatcaattcgcttgacttgactcaaatcaagcgtactgaaccgtcgcagataaaaaatggcgcgcggactggcatggagtcgatgcgggtccttgtcccaatgttgctgacacaataagccgccatagctttccgaaaaatccagtggcaaatcagtgcggccgtcgatgacacagccgcgccaattgggttcaacaccgtaagctttaagcatttgcacttcaaccacattggcgataatttgcgggtcaaggccggtgtcaatcaaatgcaaggcttgtttgacttgtttgaaccaaaatccgactggccgcccgtctggaaaggctaaatcgagcaagccgaagatgtaggctgcataggcgttcaaggtaatatcattggagatttgtcgatactgcgtcggattctttatagcggacaagtaggacagtccagaatcgcggacctcaccaatataatccgcatgcgtaaagggcaaaatgccagcagctaaagtaaaaccgggcttgcgggcccggtttaccagaaacatttttttaccgaactgatccgtcaaaattttgaccagcatatcggattcacgataattttgacgggacatcaccagcccctcaaaggtttgtgtttgtttgaccattaacgcagatccttcatgttataacctaatgatttaagataagcattgttgtcgcgccagttcttttgaacccggacccatagttttaagttaactttatcgccaagcaggttttcgatatcgcgacgggcgcggataccgatttgtttgagcatttgtccgccgcggccgatgataatgcctttttgactatcacgttcaacgataatgtacgcttcaatttgcagtttgccgccttcacggtccttcatgcgctctacctgcaccgcgacagcatgcggcacctcatcacgggttaattcaaggattttttcccggatcagctcaccgacaacgaaatattcaggatggtctgttagctgatcttccggataatactgcggtccctctggtaatgtggccgtcagcgaattcagcaactcgtccacattattccccatcgtggcactaatcgggaagacttgtgcaaaatgataatcatgctgatagctttcaatcagcggcaataaatcatccggtttaaccaagtcgattttgtttaaaatcaaataaaccggcttcttcacttcagcaagctggcgcaagatatacgcatcccctgcccctttttgctcatccgctgcgaccatgaacaaaatagcatcgacttgattaagcgtcgataacgcggccttatccatgtaatcatccagctcgtttttaggtttgtgaatgcccggcgtatccacaaaaacgatttgggcatcaggggtagtgtaaatcccgttaattttgttgcgggttgtctgcgcttttggcgacatgatggcaatcttttcccctaaaatacggttcatgaaggttgatttgccgacgtttggccgcccgatgatcgcgacaaaaccagaatggtgttcactcaagcctgtaagtctcctttcgaaaaagcgcctggcaacaatgcctgcggggtcgtttgaaccgtttcgccgcgcacattggtcaaggtaataaccgcatcggccgcaaaaaattcactgataacttgccgacacgccccacaaggcgctaccggtccttttgtatcagcaatgaccaacaactcatccaactgagtgtacccggcgctcacagctgcaaaaatcgcactccgctcggcacaattgctcaacccgtaactggcattttcgatatttgccccggaaaaaatccgctcacccacgcgaacagctgcacccacggcaaagtgcgaataaggaacataggcattctcacgtgcggctaaggctgcggtacgtaaaactgacaacattcaccaactcctcaaaagcgctaacagcggcggtccaaaaacataaatgccggcaactaccgcaatcagagaaacgatcaacacggcaccggcgctcatgtctttaattttctttgcccgcagatcgtaatgctcgccaataatgaaatcgaccatattctcaacaatcgtattcagcagttcgcctaaaaataccaacaaaatcgccaaaatcaaaacgaaccaagaaaatggcggcacttttaaccagatcccggcaataatgaccaacgttgcactgacaaattcgcgtttgaaattgttctcatcgacaaaaaagacgcgcagcccatcgagcgcgtggcgggcgctttgaataaaatgcttgtttttgccgatttgcttatcgggtaaggccataagcagtcagaattttcttttgcagcggaatcatcacggcttcatcttccggtttaatatgatcatacccgtttagatgcaagaaaccgtgaaccaccgtataccccagctcgcgctcaaagctgtggccgtattctttggcatggcgccgaacagtcaacggatcaatgaataagtcaccaatattttttgccatgccaggcagcagtggcaagtcatcctcgccatcttcaattgcaaaactaatcacatcagtcgcgcgatcagtatcgcgatattcccggttaatcttttgaatcgcatcatccccaacaatggtaatcgacatttcggtatcattaggtaacgccaactgttgcccacaaaaagcaaccaacttctggatcagctcatgatgctggtcatccagcaagtgatcatcatcgtaaaattctaaatccattgtttactccttcgtttgcttttgcagctgtaaatcatgtttgccataagcttcgataatcttggcgacaactgggtggcgcacaacatcctgtgcggaaaattgcgtgaaggcaatatgactaatcccttttaataactgttccgcttgcaataagccacttttggcattatgcggcaagtcaatttgcgtcacatcaccattgacaatcattttcgagccaaagcccaggcgcgtcagaaacattttcatctgggcctgagtcgtattctgggcttcatccaaaatcgcaaacgcattgtccaacgtacgaccacgcatatacgctaatggcgcaatttcgatgacgccgcgatccattaggcgatcggtgtgttctttccccaaaacggcatataaagcgtcataaaccggacgcaaataaggatcaaccttttccttgagatcaccagggagaaagccaagactttcgcctgcttccacggccggacgcgtcaaaataatccgctcgacttggccggccttcatggctgcaactgccatcaccacggcgagaaaagttttcccggtaccggctgggccaatgccaaaagtaatatcgttgtgtttgatggcatcaacatattgacgctggccaaaattcttaatccgaatcggttgccccttggcgtcgcgtaacaaggtctcactatacatatccgcaaaatattcgagtgtaccccgttttgccattgcaaccgcactagcaatatcctgaggtgacagtttgatgccttgtgctaataacttagttgccgcctcaagcagctgtagtgtcaagctgaccgcttcggtttcgccgctgatgcgtaattcgtccccaaacggcgaaatccggacgttcaggccttcttcaattaacgttaaattcgcgtcattaatcccaactaggttaattgccatatcaggattactaaaccggaaaattttctctgaggtttcctgtgccaaatattggccccctaacaaataatttaagcattgaatgatggtcttagtttagcatatttttaaagtagcgtcagaatcgtttaaacggacgtaagtgtcaactttttctcggttctactctaattaagtgatttccgttactccgagctggctccgcggtgactgggctggaacgtggtgggcacgacttcgaacccgcaaagaccgcggtttcgaagctcggccttggtctaaagcggagccgcttaagaccaatttcaccactgagcccgccaccactccgccagctcttgctttctatcttagtaatcgaacaaggtgactcatgatgcttcaacaccatcaacatcaagctgcatttaaaattgttaaacctgtttgtttaggttgaaactggcgtcaaactgcttggcaattttactaacgacaaccattcatgctttaaacaacagggttcaaattgcctcaaatgcctaaacttcaaaagttgatctgcacgccggactctcgacagaattgcctatggttacacaataaaaaagccggtgctaacaccggctttgtcgttaactaagtttttctttaaccacgctgctgacaagtgcaccatcagcttggcccttgaccttgggcatcagcgtcttcataaccttaccaaagtcttgcttgccagttgcaccgacttctttgattgttgcatcaacgatatcggcgacctgatctttgctcaactgggctggtagaaaacgttccacaaccttgatttcagcttcggttgcctcaacaagatcagaacgaccgccttttttaaattcagaaacgctttccttgcgctgctttagttcagttgcaagaacgcttttttcttcatcttccgaaaggtcgtggccgagtttgatcttctcattgaccaaggctgtcttcaacatccggacaacgctcaacgtcactttgtccttggctaacatgctttgcttcatctgagcattaagctcatccattaaagccactattcaccaagtcctttattaatacttcttgcgtttacgcgctgcttctgacttcagcttgcggcgtacgctaggcttctcgtagaattcacgcttgcggtattcagcgagtgtacccgacttggatacagtgcgcttaaagcgccgaagagcgtcatcgagagattcgtttttcttaacaactgtcttagccatgtgatatccctccctccgacacttgtgtaaccactgacggatatcatagccaatagttcgtttattagtatacaaaactgttaaccacgcgtcaataagcgatttcagatttttatataaacaaccaatgttattgcttaagtttcgccggtgagccgtctttttcgataaaatggcaccgaagcgtttatgtccttacctaataggcttggctacacgttcacaaataaattatgctatgatagcgttatctaaggtagcgaggtggcattatgacccaagaactgaatttatatattatgtcagattcggttggtgaaaccgggttgcgacttgcccaagccgttgcggcccagtttcccgaatttgaagcacattatgtccgttttccttttatccacaccaaagagaagatctatagcgccattgatgaagccaagaaggaaaatgcattggcaatcatgacgtttgttacagacggttttgcccaactagcaacgcattatgctaaagatcaaggggtcattgcgattgacgtaatgtcaccgattttgagcggcattaagtcgattacgcatgaagaacctaaccatgttcccggcgccgtccatgatcttaatgagcgttatttcgatcgtatatcggcgatggaatttgccgttttgtatgatgatggtaaagatcccaagggttttctggaagccgatattgtattgctgggggtttcgcggacaagcaaaaccccgctttccttattcttggccaatcgtaacttgaaagtcgccaatttgcccttggttcccaatgcccacattcccgaagaaatctggcaggttgatccgaaaaaaattgtcgggttaaccactgatgcatcggtcctaatggaatttcggcggcagcggatgattcaatatggtttgaatccggacacagcctattcagcccgcgatcaggttaatcaggagcttaaatttgccgaagatctatacaaaaaaatcggctgcatggtgattaacaccgcacaccgatcaattgaagaaacagcaaccttgattttggagcatatgggtcttgatgaattcgacaataccgagacgcattaagccatcaacttgcgtaattcttctggttggaaatgacccgttttaagccatttaatttctgccccgtatggtgggacctgatgctttttatcagggccgacatacggggtttcgagtatcttgggtaacttttcaagtgctggatggtgcgcaattcgatttaaggcctcaaagccaatggcgccaaagccaatatttgcatggcgatctttatggctgccttgcgggttcttggagtcattaacatgaatgacgctaagccgatcaatgccgatgatgtgatcaaattcattcaacacgccatcaaaatcgtcctttacatcatagccggcatcgttcgtgtgacaggtgtcaaaagtgacccgaagcttgtcattataggtcacgccatcgataatcgcggccagctcttcaaatgaacggccaatttcagtgccttttcccgccatggtttcaagcgcaatcgtgacatgttggttaggatcaataatgcgatttaagcccttaacaatttgagcaatcgccgcttcaggaccggcaccaacatgcgcgccggggtgaaacggcatcgtatacgcatgtagtgcatcagctcgggcaacttcttcttgcatgaattgaacggcaaattcgaagttggccggctttttagtgttcccaagattcacaatataaggagcatggatgaccgggtgactaatatcatctttagccatcgctgccaagccttcaggaattctcatctcgctagttggcttacggcgcgtattttggggcgcaccggtataaaattgcagcgtgttggcctcataacttgcagcttcctcaactgcgcctaacaacattttcgtgcccttcatactcacgttggcaccgattaacattaaacgacctccctaatcaagataaccttgaattcaaaccgatctgtataacatcggccatgcttacaatcaattactattttgattccgcctagtaaagtgagttttcagcaaaaatcttgccgactccaagcttgtgtatgttcgctaatccgttttaggctcgtaaaaatgcccaagtattttaactgaatcagtgatggaaacaaacgcatacggatcactgtgacgcatcgcttgttccaaatcgtacatctcggcccgggaaataatggtgaaaagaatcgtcttttcttcgtgatgaaaggcgccttctgcatcgtgcacaatcgtaatgccgcgtcttaacgagccttgaatttctcgcaccacctgctttggccgcgccgtcacgatcatgacctgcaaccgctgctggcgagtatacagcgagtccataactcggccattaataaaaattgccagcgctgaatacaaagcatgcggccagtcattcacgaacccggcaaaaaagataatgagaacattaaacataatattaatcgttcccactgtgcgcccggtccgtttgcgcaatacaatgccgagaatatcaatcccgccagtcgaaatattattacgtaacgcaaagcccgtccctaagccattgacaacggcaccgaaaattccgcagacaatcgggtcttttgtcaaaggggtcaaaacgcctagtacgcgaatcataatggttgaaaagatgaccgccaagaaagtgaacagggtaaaccggtgtccaatggccttccatgccaacacaaacagcggcacatttaggaagaacagtaacgtcccagttgaaaacaagtcagtcgttgccagcgaaaaaaacggtaacgcgatattaaagttaaaccacttacgcacaatcgttgccaaaagctgagccgcgccggtgataccactggcaaaaacgccacccggctcccaaaacatgttcagcgcaactgccacacaaatgctgtaaaaaaaggccgcagacaaccgcgaccaattttgatgccgacgaattagccgatcaatttcttccattaccaaaaccgctccctgtcacccattaatcatatcgtgatcaagtataacaagggcggacaggtaatgctactccattctgtgactatgagcgcgttttcgcagcagtatcaggcaggccttggtcccaagtccttatgtgcggtccccgcgactatgaccccgttttgcaaccgcccacgcccaaaatcttaaccattgagcgacacacaaattccaagctctggcatgcgccaatgaatcggtgcaaagtcagacggaacttgacctcactattcagacaagctttattgattattaaagtttacttatcaaataactgccgatacttaccgtaaccttcttcttccagcttagccaccggaataaagcgcagtgcagctgaattaatgcagtagcgtaacccaccttctgcagccggaccatccgtaaacacgtgaccgaggtgcgaggcggcttgcgggcttcgcacctcaacccgttccatgccaaagctttgatcacgatgctcggccaatttggcaatgggtttggtaaatgagggccagccacatccggcgtcatatttatcttgtgacgaaaacagcggttcaccactcacaacatctacataaatgccatcttcataaaagttgtcatattgccccgtaaatgggcgctccgttgcggcttcctgcgtcaccgcgtaagcttctggtgacaactgttttttcaattcggcttttgatggccgatttattttatcagacataaaaaaacacctccacgactattgattatagccggagatgtttcgattgtcagcaattaaattgtttgacgttaaaagtatccatttactcggttaggttctcgtcgccttcgtgttctttttccggatcaacatcagggcgaacttcaatccctaaatctttaagctgaatgtcagctaccggagatggtgcacttgtcattggttcgctggccttactgttcttcggaaaggcaatgacatcacgaatattgtcgcgacccgtcagcaacatggtaaaccgatccagcccgattgccaaaccaccatgcggcggaaaaccgtaatcaagcgcgttgagcaggaagccgaaactcttttgcgcacgctcaggggtgaagccaagtgccttgagcattttttcctgaatgtcgcggttgtgaatacgaattgatccaccgcctagttcataaccattcagtacaatatcataactttgcgcatgtgccgcgtgcggatcggtgtcgagcaaatgcacgtcctcttcatttggcatcgtaaatggatggtgcgccggaacccagcgttgaatgccttcatcatattcaaacagcggccagtcaaccacccagcagaatcggaattccttttcatcaatcaagccgagatcgtgaccaaaatgggttctgagataacccaaggcatcagcgacgacttttgctttatcggctacaaacaagactaaatcgccagtgtgggcacccacagcctgagttaatgctgcgccatcaccaaagaacttcgcaatcggtccgctaatgccatcgtctgttaccttcaaccaagccagacccttagcaccaaaacgtttaatgtaatcttgttgggcgtcgatcattttgcgcgaatacttggctgccccgccaggcaatacaatggcgcgaacctggccgccattttgaaccgctccggcaaacaccttgaagtctgagtctttcaccaaatcagaaacatcttgaatctgcatgtcaaaccgcaaatcaggcttgtcagatccatacttgtccatcgcttcttgccaggtgatccgctgaaacggtaagtcaacgtcaatccctttaacatcgtgcatcacctgcgcgattaagccttccgtgatatcctgaatttcttcagcggaaaggaagctggtttcaaggtcaatctgcgtaaactccggttgccgatcgccacgcaagtcttcatcacggaagcagcgcgcaatctgataataccgatcaaatccggctcccatcaataattgcttgaacagctgtggggattgcggcaaggcgtaaaaactgcctgggtacacccgcgatggcaccagatagtcccgggccccttctggcgtgctagccgtcaaagtcggcgtttcgacgtcaataaaaccattgtcatccaaatagtgatgcacactccgcatgatatgagcgcgggtgaaaatgttcttttgcatttccgggcgacgtaaatcaagatagcgatactttaacttggtttcttcagtaacggccacgttgtcttcaatataaaatggcggcgtcttggctttgttcaaaattgtgatatcgtgcacttcaacttcaatatcaccggtcttcatttccggatttaccgcttgtggtttacgcttttttacgacgccttgaacttcaacgacatattcggaacgtaccgaattagctactgtcagtgcatcacgatcaattgcttcggaaaagactagttgaacaatgccttcacggtcacgcaagtcaataaagatcaagctacctaaactgcgccgcttttgtacccatccttttagtgtgacttcctgatcaagatagtcggtattgacgtcaccggcataacaggtgcgtttactcatattattttgcctccgttacttgtgtataaattttactaaagtctgccaatacatcggcttgaggaaaggccttctgctggccggtcgccatatttttaacttgcacggttcccgcttctcgttcgctttccccgatcgtcaacactaatttcgcgttggctttgttggcagctttgaactgtcccttggctttacggcccatgtaatccatctcacctgtaaagccttgttgccgaagcgcggttaacatctgtaaagcttcctgatccgcaccttggtcgatggtgacgatgtaggcatccggctgtaccggctgctggtcaccttgcatgagtaacatcaagcgctcaacccccatggcaaatccgatcccgggggtttccggcccgccaagttcctcaaccaagccgttataccgtccgcctgccaagatcgtggtatacccgccgccaaagaccttatcatccgacatcacttcaaaaatggtgtgattgtaataatccaagccgcgaaccattgtcgcatccacttcaaattcaatgcctaaacctgtgagcagacttttaacccgatcaaaatgctgttgcgcttccggagtcaaataatcaagaatcgacggcgcatccgctactatttcctggtcatgtttgtctttgctatcaagaatacgaagcggatttttaaccagccgaactttggaatcttctgaaagttcatctttaaacggcgtcagatagtcgaccaatgccgcatgaaaagccttgcgcgttgccggatcgcccaaagaattaatcacaaacttaaggtgtttggcgcctaacgcttctagcaactgttttgctaacgctagtgtttctgcatctaaaaccggcgaatcactcccaaaagcttcgacgccgatttgatggaattggcgttggcggccactttgcggacgttcatagcgaaacatcggacccatatagtagaccttgtatggcttcgcgtattcaggtccgtacagtttgttttcaacataggcccgaaccacgccggcagtaccttctgggcgcaatgccatcatgcgatcgcctttgtcttcgaaggtgtacatttctttggtcacaatatcactggtatcgcctacactgcgcgaaaaaacgtcaacattttcaaaaatcggggtgcggatttcgcggtactggtattgggcaaaaattttgcgggcaacagcttcaacctgctgccaacgttcactttggccaggtaaaatatcggctgtgccttttggacgttgataattcatgaggtgcctcctgtagtcttaagactgtgatggatggtgattgagggtgttcggaaacttggtggtagatcgttgtgatgcttgttgggctcggcaggcgagtatgtatgacacattcgctgatactgctgcgaaaacgcgctcacagtcgcagaaacctccatataaggaccttgaacccaaatggctaaaacccagccatttgggttcaaggccacttatgttccggtttctaagcgctcctgttcgcgctctaaaaaaatgcacccctcgattgctcgaagggtgcggacacggtaccaccttgtgttttactttgccataacggtggcgttccggaacttgatcacctcaggagtgtcttttcgatcggtcccggctttcaccatctccgggtcgcttaaaattgatctatcctactccgtcacaggtcttagttattggttaaagcatacggtttgcagaaagttttgtcaacggcgtacggctagatttttgaagtgatgcatttagtttttctagcggggcaggaacgcttttcgtaacttactgactaaacagctagctctaacccaaccaaacttgcagcgccaatcatcagatagccgacaccggtcagaataccggttgctgtggttgcgactggtaaaataccgctgagacccgcgacgacaaagaacaacagcacggttacgatcaattgcgtccactgtccggtcttggtaacaaacccaagcaacatcgccacaacgggtaacatcaacgcccaacttagcaacggccaggccgtgaccccaagccgtatacaggtcggcaacgctaacagaattgaaaaacagcctgctaccagcaatgtcacgtttaaatgtcgcttttcggcaaaattgatggtcgtcagccaggtagctaaaccgtttcgctgttccggccatcctaattggctgaaaaataataaggcccataaatacgtgattggtaaaagcgtactccgaagacttgaggtcggtgcgagccagttggcgatccataagccagcaagaatcaaccaccaaccgactgaacgagatgccagcaattgtttcattgcttgacgccataatgccggccaactgaagtgctgaatcgaaaccgcattaaagatagcctcattagcatccgcctcaggcaaagttatccgtaaagcagaacgttggtgagtcattcttcgtgctaaaggccgccgctccaagaataagccagccaaaccaaccagcattaaacttaataggactgaaccaccgatacataaccattgtgttgaggttaacgtcaatggctgaaagactaaatcatgggtaccggcacgactcagatggtcattgccccctaaaatcatcatgctcgtcaaacggtggcccgattcaagtgccgattgcttgaataatgcttgtaacaaaacgatgccggaaaagtcgattacttgtgcataccattttgcctcaatcatcatggcataaccgatgaagagtagcataatcaaaatgcttgtaccgaaccgaccgcgtaaaccgggaatcgtttcactgatcacagccaaggcactgatcaaccctacgccgggaatgagtatggcaaaagtcgcgataaattgacttatgtgaaggccttgaccagggtattgaatgaccatcatagctaatgtgcccatcatcacgaaaaccaagatcgttagcagcaaaaggcaatttgtcagaaactctccggcgacataccggatttttttaaacggtccggttaacaaagccgacaaaatgccgctttcccgatcctgactcatgccttgccgtgccagtaccaagccaatgaagggaaagaaaaacgtcaagaccgccacaaccccgaccggtgcccacgtcgggttattcgcctgagcaaagtaatgcggatccaaaaccaaaacccgaaaactcccggtttgccgcggtgcaagcaacactgccgaaaacacggcgaaaactgccaatagccgaaaagaaaattggcgcgaacgttgccgatagtcggttaagatcatatgcatcatgcatcggtcaccgccttagcttcaaagttggctaaggtagcgtcttccaaacttggtgtgacattttgagcaccgctgactggcgccgttttagctatctgccgcacatgaatgccgtcagcttgctcttgcatgttgctgatattaggactactcggcaacgcagcactacgcgggagaacatactcccaaacgtgtccggcggctttttggagaaaatctgctggcgttccctgaaattgaaactggccgtctttgacgatgagcaggcgacttgcaatggcctcgacatcttgaatgatgtgggttgcgatcaggacgatgcgattttgggccaacgtgcttaacaggttacgtactgcaatccgctcgaccggatctaagcccacggtgggttcatcaaccatgataatttggggatcacctagcaaactggcggtcaatcccactcgttgccgcataccaccggaataatcccgcagccgcgtcggatttttgggatccagatgcagggttgcaaacagatttattatctgctgatcagcgtcttggggcttaatgccttttaaagccgcaatgtaacgtaggtaatccaacgcggtcacatttggttggtaagggacttgttgaggcaaatagcccaatacctggcgtaactttccgggatgggctaccacatcaacatgatcaagttggatggaacctgcatcgggttttagctgagtggtcaatactttaagcaacgttgattttcccgctccgtttgggcccatgagtccgataacaccacctgactcaagcgttgccgtcatgccatttaaaacctgctttttcccgaaatgcttatgaatgttttctatgtataatctcattgaaccaacctcctgtctctaatattataatctaacaataatcctatcatcattcaaaggttctaatccaggctcctaccaaagtctgattttctgctgttagtggtgaaagagcccaattgtcattgtttccaaaaatcagcaggtgtaagctgactttatgggtaagaacatgagtatttgatgaggagtgagcgttttgtggcaagatgatcgcattcaagcggccttggatggccaaaatccaatggtcatggccgaacttcccggcggctttgcagtttttggcgatgtccagtttctaccgggctacagcgtattactgccaaaacgcgaagtcggcagtttaaatgagctgtctaaaagagaacaaagtctatttttgcaaagcatggcaactttaggcgatggcattttgacggcgtgtgaaccattacgcgtcaattacgacattctgggcaatacggatcattttttacatgcccatgtcttcccgcgctaccagtcggaggcgccggaacgtttggccaagccagtatggttgtatgacccgagttattggggtgatccccagtaccaatatgagcccagccagcatgatgcgatccgtcagcgcattaccaccgctttgaaaactacgaattaagcatcaggtcgcttttcttccccacccttttgccagcgggtttgctataataaacataacgatttttcagaatggtggggctttgtcatgaaacatatcggacaacttaagaaatggccgctggtgatcttattggcgctattgtttggcgttggtgccgcaacaaccagtgtgatggccaacacccaatacatgacagtcaaagccgagagcgtcaatgttcggctaggtcccggcttggcatatggcatcatgggtcaggtgaaatccggcaatgaattgaccattatcggttccaaaaattcctggtatcaagtgcgccttgccggcaataaaatcggttgggttgcttcatggttagtcgatcaaagcgaagccgcgaccacgagtgcgaaagttgccacggtgaatcaaccggttaacgttcgcgaatatgccagccaggatgccaagcagttaggaacgctcaatgccggtgatagtgtcaaggttgtgtatcaagaaggcgattggacccagattgcctataataatacggcggcatggatcactagcagcagtgtccagctcactggtcagacaactaatctggcgcaacctgcccaagccaatcttacgcaagccaaaagcggagccgcattgaaagttaccaccaataccataactaacttgcgcaatgcggcgggtatcaatgctccatccgtcgaaaagctcgataaaggcactgaattgaccgtcaccaaacaacaagacgattggtatcaagtcactgcccctgatggcaaatcgggttatgttgccagctggaccgtcaccgccccgaataatggtcaaacccaaaaagcggcaacgaaactatccgaagccacgattgttctggatcccggacatggtggtacagacacgggtgcgccggctaacaataatcatgattacgaaaaaacttataccctgaaaacggccgaactcgttgccaatgctttgcgggctgccggtgctaacgttatcatgacgcggacaactgacacctttgtcgaccttgcgccacgtccgacaaccgctaacaatgcccatgccgacgcgtttatctccttccattttgactccagcccgtccaaaaactcagcctccgggttcaccacttactactacagcagcaaaaaggatctcgccttggctaaggcggttaacaacgcttttgatgacttaccactagaaaatcgtggggttgcatttggtaactatgaagttctgcgcgataataaacagccggcgattctgaatgaaatgggttatatcaataacgacaaagactttaagtatattaaaaacccaacatatcaatctaaaattgcgacggatattgttaacggtttaaatgcttactttaaagccggtcatcatcaataatcggcggaaagtttgccgcggcaaaagcgcaaatcgaatataaagagccgctcaatcaggcatgaaaaattgctgattgagcggctctttatttgaattttttacttgcggaacaacggcggaatttcaattaaatgatcgacttgataatctgcctgtggtgctgcattgaggccgtccacattaaagtagatcgttttaacatcagcgttgataccggcatccacatcaagcgagcgatcacctatcatcgccgttaccgcgggattgagttggaagcgccgaagtaaatattgaatcgcatcaggtgctggcttacgcggtaacttcaaatcggcatccaccccgccaagaaataaggtgtcagcttgatcgtgagccaaaatttcccaggcactacgatcacgatgcgttaaaagcagattgtgtccaccttgagctttgatggctttcaatacagccagcgcttcaggatatggatgaatatcctgaagatacgcccgtgcccgctgatgataatccgcctctaagtcagcaacggatcgacctacttgttgcccaaagcaggttaaaaattgtttgattgatgtttctttcacttggcgatagagcgtctttggttcaatctgaccgccattagccgttaccaacgccgctaacgccttcatcatcccgggataagaatcatacaaagtgccgtcaaaatcccaaattgcgttaactaacattacttcgcctccgtatcaaataaaatcgtcaccggaccatcattagtaagactcacctgcatatcgccaccaaattcgccagttgcgaccatcacgcctaaatcacgaagcttggcattaaaggcgtcataaagttgttcccctaaagccggcttggcagcacccgtaaagctggggcgattaccgtgacgtgtgtctgcatacagtgtgaattgcgatattgataggacttgcccgccgacatctgctagtgccaagttcattttgccggcatcatcgctgaaaacccgcaatttactgattttttcggcgagatagtcactatctgctgatgtgtcttcaggcccgacaccaagtaaaaccacaaacccatgatcaatggcaccgactgtctgaccggcaatcgtaactttagctgcaaggctgcgttgtaccactgcgcgcatatacttttctcctttatttatcaaatcttgtttgtgaatgctgctggcataaaaagacagcaccggatcgtgatcattgagatctgtgtctttctgatcacccgtgctgtctaaataaaacggtcatcacccatttgcccgcttcacttcataaatatccggaacatttttaacagcatccattaatttatccaaatgggcaaggttgcggacgccgactttgacgtggatatcagccattttatcgtgatcaacccggccattgatgttgttcaaggccttagtttgggcattaaggacctgtaagacatcatttaacagcccactgcgattgtaaccgtaaatttcaagatccgtattaaagagctgcttttgtaccgcttcgttttcccagcgaacgtcaatcaaacgacccgacatttcccgtgaactttgaacatttgggcaatccgcgcgatgaactgtgaccccacggcctttcgtcacatagccgacaattgcatccccaggtacaggcatgcagcactttgctaaatgaaccagcagattatcgacaccttcaatcaccacaccatcttcggaatgggtttgtggctgatgtttctcactggaaacggttgtgactttctggttcttagataaaatggcagcttctttggccttacgatccttttcagcctttgcatgacggaacttttcggttagccggttagcaataactttaggcgtatattccccgtaaccaatcgaactcattaattcgtcttcggtttgaaagttcagacgctgcatgagtccggtcatgttttccttggtcataaaatcttttggtacatagccttcctcttgtagctcatgttcaagcatatcacggcctttttcagcgttttcgcttttatcggcctgcttaaaataacgcttgatcttgttacgggcgcgcgaggtgtacaccagtttgatccaatcacggctaggcgcactgccgctagccgtcagcatttccacgatgtcgccattttttaacacgtaattaagcggcacaattttgccattcactttggcgccaacagtatgattgccgacttccgtatgaattaaatagccaaaatcaagcggattactgccttttggaagctcgtagacatcaccttttggggtaaagacgtaaacgcgatcggtgaaaatatcgcctttaacactttccatgaagtcggcggcatcgctactttcatcctgtagctcaagaatttcgcggaagatatccaattttttgccggctttatcgtactggactttactggtctggccttctttgtaagcccagtgtgctgcaaccccgtattcagccacgtgatgcatttcttcggtacgaatctggacttctagcggcttgcccatcggtccgataacggtcgtatgaatactttgatataagttggctttcggcatcgcaatgtaatccttaaaccggcctggcattggcttccacttagtatggattgcacctaaaaccgcatagcaatccttaatcgtttcggtgatgacccggattgccaacaaatcatacagttcgtcaaactgtttatgcttgtcgcgcatttttttataaatggaatagatgtgttttgggcggccatagatttcatatttaatatgcagatccgctaaggcctttttgatttcttcgattgcttcttggatataagcttcacgttcggtgcgcttactgttcattaagtgtgcaattcgatagtactgttgcgggttaagataacgcagcgataggtcttcaagttcccatttgatggtgctaatccctaagcggtcggctagtggcgcataaatctccagggtttcattggcaatccgccgctgtttatccgggcgtaaatgttgaagtgtgcgcatattgtgtaggcggtctgccagtttcaccataatgacacgtaagtcttttgccatcgccagcaacatttttcgatggttttcagctagctcatccttatgggcaacataggtcactttgctaagcttcgtcaccccatcaacaatgaccgcaacatcatggccaaacacttcttcaatatcgcccagcgtgatatttgtatcttccacaacgtcatgcaggtagccggaagccactgtttcaggatccatttttaattcggcaagaatccccgctacctgaatgggatgaataatataaggctcgccggacttgcgaacttgatctttatgaacataagcggcaaacttataggccttttcaacgaatgccaagtgttcagggttcatgtaagctttacacaacttcatgacatccggctgggtaagttcaacttcttcggccatggtattcccctcctgagcgcgagccagcgcgggtagaagtccttccaatcaacttcttcgccagtgatcgcgtcgtattgaattttccgctcatagcggcatattgcgctgatattatgagaagggcgataaacgttctgttccgacttaatcgggacaacacgcttatcgccgcttcgttacgcttcattaatcgcgtcagttcgcgcataatggctgagtctcagcgcaagaagactgatacacagcttggtacaacttttcttagactacccttaaattataacgattctctgacaaaatgctagtcctttgccatcgccaagacgccgagcagaagataaatcggtgcaaagaagtaggcataccatttgtaacgtaaaaagaccattaaagtaaacagcactggcaagacgaacagccaccaccagcttaaatgatgccgtcgaatcgttcggcctatccacaaagcgcttagcatgttaattaaaatgaacagaacccctacccggacggcggtactaatatggaacaatggaaatacccatgggaagatcaaagttataagtacactccaacaaacaaccttattgcgaggtactttaacccaattcatgacacgactcatcagcgctagtctcctttataatcaattcagttttagtttaagcaagctcagtgagaaccgaaacggcactaagcaaatatagcggcgccgtttcggtacgtaagatccgcgggccaagaccggctggcgtaaacccgcgtgcttgcaataaggctaattcagctggcgatatgccgccttctggtccaaaaacaacacataatgaagcaggatgcggcactaaagccgaaaccaaagctgcatgttcgcctttcttggcactttcttcataagccactaacttaacggctgcatcgtcccctacatcactcagcttagcatacatcgtgacttccgggactaaattacgatgactttgctcagccgcattttgggcgatcgttgcaagccgatccatttttttagcaatccgctcagccggccaccgagcagttccccattgagcattgaaaaagccgattttggccgcgcctaattccgtcgccttttggacaatccactcagctttatcgcctttgctgacgccgcaaacaacctcaaccgcgatgggtaactccacatttttggtaatctccgggccaatctcaaccgtcagcggatcggttgtctgaaccttagcctgataaacccggtgcttaggatcagccaattcaaaaacagcaccgacatcataacgcaacactttaatcgcatgtttagcaatcgccggttccaatgtgacggtttgttggctatgtaaaagatgttcggtaaaaaatcgctgcacgcacgctccccttttctatgctggcaaacaagttatcgttaagctttcaataccgcatcaaatgctacccaaccgactgcatcccggcgttgcgcaatggtaaagccattatcctgcaacgtttgccgaatcaagtcggccttctcggcaataatccctgccagcaaaaaatggccatgcgggtttagccgtgacggtacttgcggaatcaatggtactaagacttcggccaaaatgttagcgacaatcaagtcagccgaaaccgttagtccttgcagtaaatcgttagccttcacggtaatgtgactaacgggatttaaggcaatgttagcttgggcatttttgacggcaatctcatcgacatcggttgctaggatctggctgacacccaaccgttcagccgcaatagccaagatgcctgaaccggttccgacatcaatcattgtttcgccgccgcgtaccaatgattccagtagtgacaacattaattgcgtagtcgggtgagtgccggttccaaacgccattcccggatccagtgtcaacaccaactcatcaggctgctgcggtgtatagtgctcccatttaggcacaatcgttaagaagcgcgaaacacgcaacggatgataatactttttccaaacgtccgcccaatcctgttggcgcacgtcagccagtgttactgttgccgcacccggatccaatccgaattgcgccagtgctttaacttgtgacgcaagatgatcccgcttttcaattaatgacgtagctggttcaaaatagccgatgacctgtgcaccggttgccaaatgcggaatggtcgccggatcaaaccaagtaccatgtgcatcaatcgtctcttttttgaagtcggccgcatccttaatctgaatgcctaccgcgccggcctccatcaaaatgttgctcacagcttcaaccgcttcagtggaagtcgtcactgtcaatgcagtccaatcgttattcatatggtctcctaatacaattaaaataaaaagctagcttcgttttttaacctatcaatatctttttgcgttcgtaaaaatgattaatacttaggatacggcaaaaagatccgattatcggcatcgggctgttcagccaaaatcgcttcataccgcgcttcatcgaaattcaaggcaaatgtatcgtcatcggaagtgccatccacgaaatccatcaagtcgctttgcccgtcatcaagcaggtcctgtaaataaatgaacaaagcattaacagtcgccacgtcaatcccttttttgccgttaaatccaaaaatagccagataatcatctgcatagtcggcaccgtgcagccgcgtttcgtcataaaaaagaatggcatcctgataggtaaccgggccatcatcaacggttgttcccgtttggtcttccacttcaacgccggattcactttcagccgtcatcgtgatttcgagttcaatcacatgcgcgtccttatcccagttcaggctaagatcgccgtcaaaatctaattggtccattttgtcaccaattgcatctaacatattcatttggctcatgattgccatcctctcatttctaaatcctgatcacgccgcggtattttggaaacaaacggattaccagcaacgtaaaaccgcagtggggcgcttgtccacggctccttgttaggaataccgattcgcggtccaacggcaatgttacggggacgatgatcagtcggtgccaagctcagcccgctctgattcaacacagtgccgtcgagctgcttatcaatcgctagtgcttggcataatttgcccggtccgttggttaagccgatgcctatttgcttgcggcgagtctgcatggtcgccagtccactgatcggttccagtgcccgaattaaaatacactctgggacatcaaccggctgagtcacaatgttcaacaagcagtattgtcgcattcgataaacataaacggtaccagccgccagaaaaaggctatggttacgcgtggtatggcgatggttaaatgcgtgggcagcctgatcgcgcgcaccaagataagcttcggtttcaacaatcaaaccgctacaagcgcctaaacttaatttcatgcccaacagttgccgcgcagaatctagcgtcgactgggtttctaaccaaggtaatatcatgcttattatattagcctaggtgccgccgaatgcaaagaggcgaaaaggctttgcctaaaaattgtggctaggtataatagtaatcaattagaaaggaagctgaacatggcagaaaacttggcattgcgagcactcatcagccaacaaaccgacgcactggtttctgaactttacaccgatgataaagtcaatgaacgactgcaaaagtggctggcaagggtacctgatcccggtgttgccgatacttacagttatttgctggcagaatcacgcgaattttccgaagagctgctttatcgcattttaagcaagcttgctgaagacggcgcacttaaattaccgactgaagcataaaaagagaggcggataaaattgcacaatgtaaagtgcagtttggccgcctcttttatgacgcaaaggatctattttaattttgccttaactgtttgcggaagtgcctgcttcgaaatcggttgaggtgttgtcagcacccgtttttgtgctaccttggccttcacgtaactgccaggtgttaaagccttgggattagctgattcttcagatgaatagcctaagttccgagtctgaccatccttcgtcacccattttaattcgtattcataggtgtagtattgcttcccattgaccttgtaaagtgagccatcttcatttttcgaggcctctttcttaccctcagtcaccaaggcataagcttcaacaccattgtacgtaccattccaatattgatagccgaaaaagccaataacgatcagcacgagtacgccaactacaccaaccacttttttcatcgaatcatcactccttttcgttaaacatattatgccgaatcaattaaaaccgctcaataatttgtgatgtctttatatttttcttaattcgtgacaaaaatgtcatgtgtgtaagataaaaacacaataacatcagtttcatttagatggcctcaaaaagtgacgatggccttcatgtcagcaattgccagaaagctggcagcgtctccataacgcgcgcgccagcccagaaaccgggctggctcgcgctcaaaaaaagtcctgcttctcagcaagactttagcttaacgtttaattgaacgcttgttatcttttcgtggactccgcttaagtcgatcaaaaacggattgcaccgctttaaatcgttgcggatcacgacgagcatttttgacaaactggctgaaatcatggtcaccaatgccaacttcgggttcgtcatcctttttatgcttcaaccaaggcatcatgacacctccgaatctttacgcatgcgttgagcgcgattcgcccctgccagcacgaacaccatggcaacaaacaaaccgattagcgcaaagacactgtagttcggaattaaaataaaagcaataaacgcacagatcccgacaagattgccgactagcaacaatcgctgattatgactggaaaaatacgataatagatgaaaaataatacctggaattgtcagccaccacagatggttcgcccaagacatcaatgtcgctcccacgccggtgaatgaaaacccctttggcaatgtcgtaatgacagccgcaatcaacatgacaagtgcaaacacaccataaagtaaatcataaagtgctggtacttttttaatggaaactttcaagtgtcgatcatcccttgctttagcagtacctgtattatacaagtttgcggaaatcattgcacgacagacagcgcctgtttatacaaaggttagtaactctgattttcttaacaagtaattttatcaagtaagaaattaaaaagcgttacgtcagacttaagcccagcgtaacgcataaaaatgaacttatcttataaggagagtacaggatttgaacctgcgcgccggtattagccggttcgacggatttcgagtccgttgcattaccactctgccaactctccaaaacacaagttcaagtataacaaaatcaacaaactttgggaagcaattattttaagtatcgatgttgtggtttcaaaaagtgctttaagtgaacttgtcaaattgataatgctaagccgtcttttgtaaaactcaatatttaatcgtctcctcagtcacgtattccaagtatttctggcgctgttttagcgatgaatgcgtgatattaccaaagttctgccaatgagcacgcctgattccgagttgtctcaaagtatgttttataaaaaccccttgcaaagcattgccacaaaaaaggcgcaagtaaaaagttggcgaggttgacgttgttagtacataaacatgcttcagattggtgagcaatcccttaacaccacgcttagtaaccacatgacttaaccccggaccttccttcataactttatcgataaagccttttagcatcgcgggtatatcgttccaccaaaccggcgtcacaatgataaggccatcgacttcctttaaggtattcaaatactttttaacgagaggatcgtgtgtctgcccagaatgaaataagcttagttcttcttgatcataagttggctgaaatccgtcatggtataaatctagaatcgtataaccaatagcgcgattcgataagttttgacaaactgccagcaaaatcgcgtggttgaaacttttgtcatatggatgacagtaaacaattgcaaattttgacatttttatgcctccaataagcgcagaagtgtttcgcgcaccaataccgcatcgtattctgttacatcactatcaagtaacagaccataaccttgaataaatgcccacaactgaataaataaatctttgggttgtacgctcaggtgacgtttttgaatcactgcttccaccatttgcatcatttgatcgtaaaatgcaaactctccgctatcaactttcaggacattgcgcgcaatcggattgaaaaatagaaaatgcatcaaattgggttcatttttaaattgtcgaagtaaaatcgaagcaacagtaagcagttgttcttcgggttcacgaactgtttgcagcttctttgccatccgtgattgttcctgacgtgataaaagaaccgtcaccgcttgaagtaattcttctttagtagagaagtgcgtataaaatgcacccgtggttaatccgattccttttgctaattttcgtaatgaaagtgatttttccccatgttccgtaatcatgctgatagctttttccataattcgctggtctgtatcgatttttctgtcggccattctctcatctcctttcaaaataacagtgttatctcaacgattgtcttgatcataacagtgttatctggaaaaaacaaactgcttcggtctttttttacccatcacgacatacaagatacctagctttttttgaaacagtttttcttcttcaagcttcgtagcagccctctaatttggcaacactatgaaatttttcagttgatatccctaaatagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactagttataatgaaagaaataattcaacacgcggaggagattagcatgctgaaatacggcatcatcgggggtaatgagaatgcattggaattcattgacgccgcagacatttcagaaaagtggcaattaactacagcgttcacagaaacaacgcgagaaatggcagcaatcagggaaaagcatccggaaacggtctttttttccgatcttaatgcgtttttccaaagccggcattttacaactgtcttcatcagttcaagctcgcctaatatgcgccattttccccaaattaaacaggcaatcatggccgggaaaaatgtcattgttcaaccgccggcgctcacgaacccgactgaattcaaagaagccgaacagttacttcgcactcatccagaagtacacttttttgaggccgtgtatccattgcacatgcctaattttcaaaacatcctgactgcggtgcgcaaactgcctgccatccaaggagcaacatttacggctatgcaggaatttcccggttatgatgatgttttggctggcaagcggcttcaagggtttacccccgagtcagcaggaggtgccctgcaaatgctgggcttgtatcctttgtacgctgcgttttcgctttttggccacccgagtaacggaaactatttcgccaccgccatcaacactggtgcagacgggcttggcaccattttcttaacttatccggcgtttaatatcaccattcatattggtatcaccaccgactcgtttatgccttctgaaatttatggtttacgtgaaaagatcgtcatcgacaacatcaccgaactgcggctgatcaatcattacgatgcagatcatcaaaatcacttgcttaacacgatcacctatgaaaatcgattgacgggtgaggcacttgcttttgccgaaatactagaaacgccgaacgatccccaaaatcgccttcgctatcaaacatggttggaactggcacgtgacgtgaacacgaccctattccatttacgaacattagtggggctgaagtttccaactgatgtttaaagctcaaaaggcctccggagacacacctccagaggccctattttttattgctaacggtcaaactgagacgaccagacttcaacgcacgattttctacccaaattatgcgttatctttcacccgctgatcaccgataccactactgatttcttcagtgaatggcaggggcttcttttttgcatcttctaacaacgcttcccatgcgtgccaaacgtttgcttcagaataacgatctgagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaacggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttctgacagttcataagagcgatctgacatctgctgcagcttatcaggatgcttgaataagtcgacaaacttagccgccatggccttgatatcatcaaatggcacaacatagccattttcaccatcaacaattagctcattagggccatagttcacatcataagtgacgccaacgagcccattgctgatcgcttccatcaacgacaagttaaagccttccatcaccgacgccagcgcatacacttgtccttcgcgttgcaccgcgccaacatcctttacataatcatgcagtttaatcacgtcttgcagctgatacttctcaatggcggcattgatcttggtcattgcctcatcattgtcgcggtgatcgacgtacccataaacatctaatgagatattaggaacctcttttttagcaatgccaatcgcttcgataatatgatcaattcgcttttccggtgcaacccgggccgtgacaatcactttaccttgctgccggtccgccatagcaatttttggacgtgcaaactgttcatccggaatgacaccaaccggaattgtgaagagcttgctcttgggttgaaagcgcgtgcgcacgtcccttgtttgcttttctgtggcggaaataatcgcatcataatcattagcgtgaatcaagccatactcataaaaattattcatgaccgagtgcatcggatcttgcgcgtcacctgcatgtgaattgtgtaaatgcaagacagtataagccggacgcctcaagtgcagcagttgccagtcaccaagatgcgatcgatcaacaataaagatattggcgcgtttattgttccaatattgctcattcaaacgattataaaaatgaactgtcaactcgtcgatatccgaaaagagatacaccgctccattgtcttcggtcagccgccagccggttttagtaaaagtctgtttggcatcatacttgttaaaggtttcaagcaccggccgcccgtcaaccttataccagacctccgtgccgactttattatcaggtgtataccattgcgacaaggacaagaaaccgcgaaaatcgtaaaaatcaacccggtacagattgccgaaagcatcgaattgctcaaccgaactgacccgttcagttggatcatcacgataataattaattcttgccacaaattgttgaccacgcagcacaagatagcgaaattgttccggttctttttggtaactaagctgatccaagccaaagtcaatatcctcggcatgcaaaatcttggttggcacttcttcagcagcttggaaatagtcaaacatccctaaagtttcgtcatcgctgacaccgtttgcctgtaaataatcgtgcagtcgtgggttccactcacgaaaaatcattttgaacggttcaccgtgatcacgaaacaacccagcccgtttcaactgggcatgttcaattcccgagttgctttgattaaaactggaattaataaaaaatatcatcgttcggcactcctatctaagcgaagaaaaagatttgggacggtgctaagttgcgcttcccattgtttccaggcagcatcggcactaaatgtttgtgattgttgataagctgcttgaaccatttccggccacgtgcgtcctgcttccgtgctcgtcaacaatttcaccagactgtcggcagcagctttactttcacctgttggtaccaggtaaccattgacaccattttcaaccaacagtttaggcccatattttacgttgtatccgatgaccggtacgccatagctcaatgcctgaagaatattcatgccaaacgcctcagatgatgagacactcaacatcgcggcggcggttccaagcgctttagcgagttcgtcttctgattgataaccatgataatggatcgcggtatcgacaccaagttccttactatacgcaaccatgctttcatttgttgcttcgtcagagacgtaaccataaaaatccagatgcaaatccggaagctttttacgtgctttggcaaatattttaatggcttcttgtggctctttttccggtgagatgcggccgagatagacaattttattgcgatcacgactttcaatcgacactaaatcatgtgcttctgcaaaactgtcaggcaccaccatgacatgtttaaagtggaaaaacttttcaatctcttgcttttgctcgtcagtggccaccataatcccgtcaaaatcattggcgtgcgtggcaaacagcggcttcagataatcgacatagtttcttgaaccaccgacttgttccggattgtgggtatgaacgctgtgcaggtattgccacttagcgttagcgcccgtcactgcggccacctcattaatcaacgatgggcggtcatttattaacacacttggctcggcagccacgacttcattcatgaagaaaacaaagagctcactttccgaattgaaccgccatgcccggcctttataatcaagcagctgatacatggtattcatgagcgtcccattcacattcatccggataatctcaagcttaggagcaccttctggactataaaaaatctgtggtccaagctggccatcaggatgaaaatactgcgttgacgatttaaagccacgccgatcccaaacatctttagccacggttgcgttcatgtcattgtaatattccaatgaacccaccaaaccgactgtcgctggcgctaccaacgccttgcctacgactttgccatgatggacaatctgggattcattagcatcaaccccgacgatatgataatcaaacttatcaattacttcggtatagcgaatatcaatatcacgcggttctacaaaagtcgcttcctgaaaataatcatacatgttcaaaacatctgactgggttaatttaatgcgttttaaatcgtcaattaacaaaggattatagttgcgcgtcaaaattttagcaggtacatcatgatctttgaaaagtcgtaatcgttgcgctgctgaaaactcggttcctgagttcattgaaaaaatgttttcattcacaaaatagttcaccaatagtcccccatttcttaatggtcgtaccttgagtccaagatacgtcccttatgcctctggaaaatcactttcaaaaaccggcgcatcttctgacgggaacaccccggcttgatccagtgcggccacgttcttttgggtttcagcatcggcggcaactggctgactagcagataattctgatagccgcgccaccttagcttcagaatcagacaatgccgtttgcagctcctgctgggtttgctttgccgcagctaaatcggcctgagcatgcttaagatccgtttcggcaatttgagtggcaacgatttgtttacttaactcgttttgcaacgcttctttcgccgcttgggctttatcacgctcggacaccgctgcttccagatgactggacaaatcggcaacttgcgtctgtaacaattcattttgagccttgagttcttcatgctgctgatgcaaggtcgaaaattcgctgacaacctgctgatctttttcatgttcggccaggacagctttatatttagcagaaaggtctttcaaataagccgtcgtttttgtgcgataagtttgccattgttcgatttgagaagccaggcgggtgttcattttttgaaggacggctatttgcgtaattaaggtactattttgtttctgcgcttcgtaataaggcccgcgggttaagttagtgttgtctgtcggcacattcatttgtgaagctgtgttggcatcgtcatctgtggctggtgcctttgcctgaagctgggatacacttgcccctgccgcagcttgtgtttgtgttgccgattcagcttgactggctgttgctgcatccgtattatcagtcacaaccgttttgggatctgctaatgattttttatcagctttctcggcagcaggctcggccggctctggttgggctggcatagcggctgcttgtggctggcttgcgatggctttagatggggtggctggttgcagttgcgctgttgaagctggttcatctttgacataaacagtcagttgatcattggcaaaatttaattcagtcccgccagagatgttcatggaccaagtacggccgctgccggttgccggtttcagaatttcagtggctaaagaggctgcgctgttgagttgctcaagctgttctggcgacaaggttttgcccgttgtaggctcgtctttttgctgatcgccggtattttcctgctggagttcctgatttcccccgcccagtttctgccgttgctggttttcgctcaggcgttcatttaatgagttgagcacatccggcgtctccgattgctcttttcgattaaaaattcccatgttgtcctcctctgtagatcataagtcgaataagaatcctctcacgcatatacttaactcgatcaatttttcgtgagaattatcaaaagaacctgtatttgattactatcatcgttaaaatctctagaactgcgggcatcattataccttaatcttacaggaacgttctgcgactatgctattgataagctgggtttcgcattacttttcgcagtcgcatcaagttgtcccaaaggtgatgcattcagatagctgcggagttcggctagcaaagatgcattgacatacacaaaagaaatattaggtagcggtatactggtaggattcgttaacgagttggccattgcttttgctttaaggtaaaggcctaagtcggtgtaaataggcgcttcaaaggcataataatcgctaaactcagcgctacctgcagggggacggtaaaaactcacgcccattgacggcccgccataaattaaattcgcccgatgcccataatgtccgttaccaagcggctccgggttatcggtctcgtcataccaggccatcaccatgtaatatgcgatctcctgattagaccgcatatgatccgtaatgccagtgttcgtaccgatgttctccgttgcgtgactaacggcttcatgattaaaatcttcaacaatcgcccgcacgcgttgttgtgcccgacttgtatcgcgttccgaaattgtcaacgccgactgtccgttcaaagcccgcaattcattgacatattgatgaaagtagctgacaatctcagcctcatccggtttgaagttcggatcatctagcagatactcatttttaacgcttggataattggatgttgaaggaaaaaaagatgatagatttttcaccttcaacatctccgaagcacccggattcggtttcgaggtcagactactgacaactgttaccctcgccatgtttgcaatcagctgtttcagttttggatccataaaactaaaacggatgaaataagttccttcataagccggattaaccgtacctgttaccgaaatatcttcgagctgaaccggcgcaccatcactattagtagcactcacaaaattgatgtcaggtgtccatgatgattttttagctaacaaagtgtcttttgtcttgattgcagccactgtttctgaaggtgttggcggcaagacgtccccgcctatctgccgttcatcaattgcactagcttgattggtcacgttgacagaagaaaattgcgccacatcttttccggttggggcatcagtaaaagcatactgaacgaaataggtacctacgatcgctggatgaacggttccgatgacttgaatagcatcgattggtactgcctgtccgttcgagtcattggcattcagaaaatttttttccggtgtccaagaagatttttgggcgatggtaacgggtgctgttgcgatactgggcgactgattcgtatttgggtcagccgcagttaaatcgtgcttttcattttgatcacctgacaccggttccttggcttccggctctgggttattcgcagtcgccgtcttcatggtttccaagggctgaaccgttttttgctgggcgccgttagcttcgaagctattaaccggtggtgatgaatctttgctgccggaagctactgaagtgatgtcgggagaagcacgatccgatgcagctgaacttgtgactgtatgggttgctggctgctcttcattagccgttgtggaggcagtcacaggatgtagtgagctaaatgcgaccaaaacagaaaaagacaaaacaacctccgatgccttcatccattttccgcgaactttagctgtcttgaatttgccatggcggtccaacaacgcggactgcaattgtttctgcctcatcatccataccctccaaacttcagtgtcttgagtccaatcgtttttgaaagaaccattgggacaattttatgtagaaaagaggccaatcaactttgaaaattgacctcttttagtcttcagaaaaaacgactgaccagccttattgaataacagtgaccaatgctttgttttcaatttgctggttggattcaggatcagtaaagctgatgataattggataaacgcctggaatccaaggctttacttcgcctgacatgcggaaattttctaacggaacctgatgacctgaagaatcagttgcctcaacaagaagtgcttctggctggaaactttcatttttcttcagggtcagatttttgagttcaatttttgcatgcatattttttacctcgtcacggtgacgtatacttgttgttcaacaatttcattattattagcggcattggtgaagtagtacttcaggatataagttcccggaatcgagacggtcacgcttccgtcgatagaaagatcagaaatatcgacggccttaccatcgccgtccgtggcactgactaatgcctcgctaggatcaaaggattgtttagcccgaatgacaagatttttggtgaccagttttcctgcttttgaagagatcttagcaatggtcccaatcaagtcggaaatacccggtaattgtgcaacccctttgaggacaccggcagcgtcaggtaagttaagtttcacgcctactaactggagcaaccaacctgcaataccgccgataatcccaccgattgcagcaccgattggcgaaccaatcaagctggcaatcgtgtcagtcagcggcgtcacccaaccaaggaggataaattccaacgggttgacaatgggccccagtccgaggaacccggccgcaacaacgataacgccggcaataccgaagacgatcatgccgatggtgtaagaaatcagccagtttgagagcgtgtgcccgataagaccgccaatggttgaccctaatgcaaccccactgacaacggcgtcaacttttccatctttagaaaggcctggcgccatggtcgcaccgtaataagcaccaactgttgagccgacaatcccggttagccaaccggtaatcccaccaacccaaccaagttcagcagcgttaccaccgttagcaatccaaccaacgatcgggataatcccgacaattgaatctagaaccgttgccggaacgccagcaataaaccatgccgcaaagccacctaccgccgttgtgacggttccataaaacgcactaccaacagttccgccgatcacggattcaatcaattcacccacttgcccaagtccggttaaattaggaattaaacgaattggattaatattggtagctaaccacgaaaccgcgttccatataaagttggtaatgccacctaaaaccccggttaagctaaacccagtgtccgctttaaccactgattgtgcggaagcgattaacgttgaccttaactgtttagccacactgtcttgagccactgagattgctgattgcatggctttataggaatttgttgcttcaaagcgtgccatatcctgagcaaaggccgatccaagcgaagtggcgaaaaaggatgtggccaaagactgcgcaagacttgtgtttgaagcggcaacagcagaggatagtgccgtattaaaggcagcaaattcggaatttgttgcatacgaggacaaagcagcaatcatttgcttaccatcttcggtttgggcaaacgatgaaaccgcagccgcgcttgccaacgaacctgcaaaagcagcagatgatgcatcagccaagagtcgtttgccataagcagttgccatgaatgatgaagttgcactagcatcggcagcggattttgcctctgcagttgacgatagcgatgacatcattgattgaagtgccggatcactagcaaccgaagcttcaaaactcgccaatgatgccaatgcactaccttcagctgtggcattaaaagacgcgaccagcgatttttgcaaggcaacatcggacgtggcaacagcttcggaaagttgcgcctgaaacgcttttactttgggatcgttgctaagtgaagttgcggcactcaggaaattaacacctgatgtaattttatttgctgcttcgcttaacgcaatcctgccttgatcagttttagcaaatgacgtcaaggccgatttagcactggataacgcagcagcgtccaaagccagtgaaggagctgaagatgcggcatcactcaattcaagcggggtcgcagccaggctcgatgctgaggtctggttaacttgattttctagaggctgagctaacgtgtttggcttcacgataacgcggacattcttgccaagcttttcctgcgtgtaagggtcagtgtattcgtatcgtaaataataggtgcccgggataccggtattaaccgtcccaacaagattaatatcatcaggactcagcacattacctttactatcagttccaccaagcaaagcaacagctggatcaaagtgttcttttgcctgaacctgaatatcttgagtctgtagcgactgcttgctgttctggttcgtttcttttgaagtcgtgaccgaagcgctagcaggcgtaacggttggtgcatacgtggtggctgaggaaggtgacgatacagcactggatgtagtgactgtctggtatatctgagttggttcacggctggcaaccgattgaacgccagccactgacgcgatggattgtggttgcgctgcttgtgaggcagctggtgttgccgccgaactagctgccaccaccggcttacttaccggcgcttgactcacctgagcatgtgctggttcttgttgagcagccggcttttgttcatgcgttcccacttgatcaatcgcggctgccactcgaatcgtttccggtgtgactgaatcagccttaacagttttgcccgattctaaggcaccggcaccgatgaccgtgacaataagcgatgatgcaaagagccaccgttttccttttttccaagagcggaaatgtgtgcgcctcatctgaatccgattggtattatcaggcccacttccttgattgcttttcaaattaaaacacccctttttcatctacatctgcatcatcttgatgtcaccttcacgaattcctaaaaatgactcgattaatctttagttgtattagccaaacgcgtatcacccagaaaatcgcttttagccggttgtctctagaattggtgaattgacgatgctcctgtagcaaagatcaaacttgttactttgcgcaatatttccaaatcaaaaaccgttcgacaattttttgactggagcattttccagcgctcctctttgttaacgatcaagttggcaaaagttttcttagcaacaccctaaggcgctgcacgggttggatgttgattagtcttcatattaatggcttcctttcagttaattaatcttcgcgatgcttctttttgcccatggctgctagtgtccccatcagtacaatacctgctagtgcaagcaaggcagcttcttcagtttcaccagtttgcggaagtgtgtgtccacttccatctttagtttgcccacttccgtttttagcgatgatgtcagcagttgtaccaggattggttttatccccaacgctggtgtcagtagcaactgtatgaacggtgttgtcctggctgcctgagtttgcacctagttcagaatgtcctacgtcttggctttttggatttttagacgttccgtcaacatctttaacacccttggtatccacatcgtgactggcaatctgttcggcaagatcacgatcagtttgtgcccgggtagcagcactcttggccttatccgccgccgcagtcgctgatgaagcatattgtgcagcgtaggaaagtgcttgagctgctttattcggatcaacataatcgtgtgcaagctcttgcgcagctttactgagtgccgcgaaggaagcagcgtctttagccgcactggcagcaattttcgccgcgttaatcgcgtcggacttcaagtaagctaacgaagaattcttaggtttaccatcagcaaaacttgccgtttcactggccgctttagctgcaactgaagcagctaagtcggctgcggtcgttgcggcatgagccgtgcttgcaaaatcgctttgagttggtttaggcgcagcatcggaacctggcgtgtgcgctgcagcagctgttttagctttatcagcagctgattttgccaaatctgcagaactcttcgcaccggcagcggcactggacgcccgtgagtcgtcacccgacttcgctgcatccttagctgctgcggcagacttggcagcgtcatcagcagcggacttcgctagatctgccgcgctcttgattgcaggatcttctggatacttcgttgcggcagaacttgcttgatcggcactggagctggcttgcttggctgactggtcagctgcactggcataacttgatgcagcatcgcctttagcttttgcttcagcttgggctttggcatcatctttagccttcgcatctccagctgcctttgctgcagcagaacttgccagatcggctgagctcttagcaccggcagcggcactggctgcccgtgaatcgtcacctgacttagctacatccttggctgctgccgcggatttggccgcgtcatcagcagcggacttcgctaggtcagccgcgctcttgattgcaggatcttctggatacttcgttgcggcagaacccgcttgatcggcactggagctggcttgcttggctgactgatcagctgcagtagcatagcttgaggctgcttcacctttagctttggcgtcagcttgggctttagcatcatccttagccttcgcatcaccagctgctttcgctgcagcagaacttgccaaatcggctgagctctttgcaccggcagcggcactggctgcccgtgaatcatcacctgacttcgctgcatccttggctgctgccgcagacttagccgcgtcatcagcagcagacttcgctaggtcagctgagctcttgattgcaggatcttctggatacttcgttgcggcagaacccgcttgatcggcactggagctggcttgcttggctgactgatcagctgcactggcataactcgaggctgcttcacccttagctttggcgtcagcttgggctttagcatcatccttagccttcgcatctccggccgctttcgttgcggcagagcttgctaaatcggcagaactcttcgcaccggcagcggcactggctgcccgtgaatcgtcacctgacttcgccgcatccttggctgctgccgcagacttagccgcgtcatcagcagcagacttcgctaggtcagctgaactcttgattgccggatcttccggatacttcgttgccgcagaactcgcttgatcggcactggagctggcttgcttggctgactgatcagctgcactggcataactcgaggctgcttcacccttagcttttgctgctgcaatcacttttgcggcagcatcgctagcaacggttgcagctgactttgctatttctgctgcagacttcgccgcgtcatcttgaccgtctaacgccgcatacttggcatcattggaggcgcttgttgccgttgaagcagcagatcttgaaagactggttgctgctacaatgccagcatcttcaggatagtttgccccagcactttcagctaactgagcgcttgagtttgctaaacttgcagattgagcagcatcagtagcatagtttgatgctgcgacattttttgccttggctgcatcgcttgttttggcagcagcggtgctggcaacaattgctgcgctcttagctgttgctgcggcagaagacgctttggcatcatcgccgccttgtgcagcactcttagcgtcagttgcagcactcttggcaatatcggctgcagacgtagcaacatccgtattggctttgatgtttggatcattaggatacttagtagcaacagatacggcaccatcagcgctggagcccgcctgaccagcggccttgacagcgtcatcggcaaaacttgacgcagctgttgcttttgctttagccgcgtcacttgcttgtgaagcagcctgactggcaactatcgcggcactcttggcggtatctgcagcttgtgaagctgtcacatcatcgccgacttgggtggcacgctgagcatctgtagctgcactcgaagccgtatctgccgcagacttagccaattcagttaccgccccaattgatgagtcattcgggtacttcgttgctgcttttccagctacattagcactggagcccgcttgactggcagccttagttgcttcattggcataactgcttgcagccgtgctttttgcttttgcagcagcgcttgccttagcagccgctgtgctggcttcggtagctgcggttttagcattagaagcagcaacagaagcagcaatatcatcaccggttcgagctgcacttctggctgcatctgcagcacttgaagctttagccgctgctgcagatgcactatctgttgcagtttgaatttctggctcatccggatatttggttgccgcagaagtagcaacatctgcacttgagcttgcctgactagccgcttgtgcagcatcaccagcaaaactagttgccgccgctttctttgcggctgcgatactatctgctgttttaagtgctgttttggcagcagcttccgcttgatcagcggcagatttggcaatatcagcggcacttgaggcgattgcgtcatcaccgcgagcggcagcgtcttttgccgtatctgctgcaagcgatgcatcttttgcagcttgttgggctacggaactggcacgagaaattgtcggatcatcaggatattgactgcccactgccgttgcaacatcggcactggaactagctaaactagctgattttacggcactggcagcatagctcttagcgtctttgtcatgaaccacagctaagcttgatgccaagtcagctgcaatacttgcctgactagcatgactcttagcttcggcagcggcacttgatgcagccggaatgtcaccgctttgtgcagccgacttagcactctctgcactgtctgaagcctcgtcagctgcttgcttagcgacattatttgcactcgtaatggctgtgtcacttggatatttgactgcagctgattcagcgatatcgccgcttgcttttgcccgatcagcggctttggtcgcatcactgacaagtcgatcaccttgtgttgcgatgttgcccgccaaacgttttgaatcatctgcaacgcttgaggcgatagctgcttgacccttagcctgtagtgcagcgctcatggcgtcatcagctgtactacttgcagcatcggcggctgagctagcaattttggcaaagtttgaagcctgatttgcaaaggtcgaagcttgagacatattgccagctacaatagcgctgttagcttgggaagcagctttgctggcagcaagattggcactacttgttaccttcgccagactgacagcagagccggcagcagctgaggcttgagtggcatagcttgatgcttgaatcgttgcatcattggcagtctttgcaaggctggccagagaatcattgccagggaaccggctggcagcacttgaagcaattgcattttcagacttagccgtgtcagaagcagcactggcaatagcgctggcattatttgcagtggcggaagcttcttgagctacgacagaagcagataaagcactttcgctggcctgactagctttagatgaagcttgatcattggctgcggaaaccgtatccgcaatctgttttgcacgattatttgcgcttacggcttggctggctgcggagtctgctttgtttgcttcacttaatgctttaccggcggcatcatttgccttgtccgcgtattctgaagcaatgtcagctgcagcagatgcctgattattcaggttttgggcagccgtatgatcaccacgttgactggctgccgttgcctgagcagcggctgttttggcagtggcatttgctgaactgacttgatcggcaaagctacttgccgcagatgcatcagcgctagccgtcaaagcataactcgcggcaacactattagcgtctgaagcagctttggccagtgatgctaatgagttgtttgacggatagttacttgctttagccgaggcttcttgataagcagaatcagcaacactacttgcattgctggcgattgcgcttgcattgttcgcaatcgcggttgcagagctggcagtataagcagttgcactggcatcagctttagaagcgacatcacgcgccgtggcagcagcactaacggcaacttttgctttttcacttgccaagtttgcttcgtttagtgcttgatctgcagccgagtttgccttgtcagccgccgaagaagctgtcacgcctgcaatcgatgcttggtccgctaaacttgaggcattggaaaggtcgccaacatcaagcgcagtattagctcttgaagccgcagaagcagctttactgttcgctgcactggcaatcgctgcataactacttgcagcagatgcatccgagcttgctgatttagctaagtcagcagtttcactatttgcagaagatgccacagtggcaagactggttagtgaaggattgccaggataacgcgttgcaatgtttgaagcatcttgatagccggatgctgcgacactacttgcagtgctggcgatagcattggccgagtttgccttaacagaggctgtacttgccacgaccgacgccgaccgcgctgcatcgctggctgcactcgctttatcactagccgcagtattgccgctggtaatggatgaagcaagactcgaagccgcggtgctagctgcaactgcaatgcttgcagcgtcattggccgcagaactggctgcgtatgcctcactcaatgctttggtagccgcatttttacctttgtcagcggcagaagaagcctctgtagcggcctttgaagcacttgctgcatatgacgaagcttccgaaatattgccattcacataggcactatttgcaagggatgcagtttcacttgcaacgccatttgcttgtgaagcggcagtggcataactacttgccaatgaggcatcttcaattgcgcctgccgcataactggaagccaagctaaccgcattgccagctgctgtcgctagagaggcaactgactgatccttcgggaagcgtgttgcaacactagccgcaacgtcaccagcagactttgctttatttgacgcagcgactgcaattgacttagccgaattagccgtgattgatgcagcgcttgcaacaacagaggctgaagtggcaacactagaagctttttcggctgtatcggatgtggctttagcaagactcccggctaattcaatcgcactacttgcagcttgtgaagcaatcgcagcagtcgaattagcctgatctgcctctgtcgaagcctgattagccaaaccgtttgcttgactggcaagatcagctgcactagacgcagcagtcacagcttgtgctttaaagctcgatgcggcttgtaaatcaccaccggcaatggcactgttcgcctgtgaagctgccaagctcgccgctttgtttgccgcgactactttttgagccaaactgcttgcggcagcggcatcagctgctgcacttttggcaaatccagcggttgtgctatttgcacttgaagccactgcagaaaggctggtcaatgacggatctttaggataggtggcggttaacgaagcggttacattgtttgctgaactagccacactgatggcggtacttgcaacggtgcttgcattattagcaacagttgaagcagattttgccgccacacttgctgcgcttgccttgtcactggcggcacttgtttctttagtcgtgtctgacgtcaacgttgcaacccgaccttgtgctgaaagtgcggctttggaagcttcgtcagctgcggacttagcttgtaaggcctcgctttgcgcaagacttgctgccgcattggcattgtctgctagcgaactagccagacttccggcatcttttgcctgactaccaaactttgcagctgcatcattttgccctgctgctaatgcttcatttgctaaagaggcagcacgtttggcaccttcattggcagaacttgtttggcctgcgtaactacttgcggcaaaagcggccgaactggcttttgcagcgtaatccgaagcaacagcttgtgcgctagaagccgttgtcgataaagccgccaacgagctgtcttgtgggaaactacttgcagcactagaagttagatttttagcagaaagggctacggcactggcattacttgcaatggtgctggcattgttagcaacagttgatgcagtgcttgcgacaaccgatgctgaccgggcaacggtactacccactcccgcatcacctgctgcggcagacttcaagttgccagcaatccctgcagcaacagttgctgcgtcagaggcaatggctgcctgagattttgcctgcaatgcataggacattgctgaactagcagctgattttgtctggtttgccaaatctgtcgcgttcgaagctgctgttgatgcttgccccgagtacaaagcaacgccagcggtatcaccggcattggcagcgctagttactttattcgctgcttcctgtgcttgggaatttgcatcacttactcgagtagcaagatcgctagcctggcttgcaaaagcgctggcagacgtagcaaagcttgaagttaagctagctgcctgtcctactttaactgccaaactagcaagagaagcattatcagggaatgaagatgcaaaaccggtagccgcaacattggctgagcttgcagtcgtgctagctgttttggctattgcactagcattatttgcttcagccgaagccgacgttgctgctgtataagctaggctggcgtttttactgtcagctgcagtgctgccggtagtcgtgcctaaacttgcggagagtttggctgcttcacttgctgccgaggtgacaattttggcattttcactagctgcaagtgctgatgctaatgcattggatgctgcagtactcgtttggtctgctagttgacttgccaatgatgcagcactagaagcgatagtagcgtaggaagtggcatctggtaagttcttcgcggccagagcgctattagtttgcgcaactgctgaaatgaccgtatcatttgccgattttactttacctgctaagtcacttgcttgtgagttgctagcaaaagcagatgcagcgtaactagcggtcatcgatgttgcagtcgaagcggttgcagaaagttttgcaagcgattcgtttgttggataggcacttgcagctttgtcaaccacggctttggcagaagttgcggtatcatttgcagcacttgctatggcactggcgctgttggcaaccgtcgatgcaaggttggctttatcatacgctttgcttcctgtgtccgcagccagactggcattgctttttgcagctgcagtgctactggttgagccagcaatcgttgccgctgattttgccgcatttaaagcgtcctctgctgctgaagaggcagcgtttgcttcagatagtgctttatcagcggcggagtttgcaatcggtgcttgttgactggcagttgcagcagcatcagcagcctgcttggcaagtgaggttgcttcatcggtttttcctgcagcgctggcagctttggcggcggccgctgctgaagacgcagttgcgttggcggcattgacagtcgcgactgcctgtttggcaaaggcagcatctgagcttgcagcaaccgcataacttgaggctactgccgctgcactagatgcagtttttgaaagatctgcaagtgattggttgtcagggtttgctgtggcaagactggcaacttgatcactggcaccattagcagcaccacttgccgagctggcgatactgcttgcggaatttgcctttgttaatgcgccactggcagtaacagccgcactggcagcaatagcagcatcggaatcaggattgagcgcggactttaccgttaccaggaaatacgaaaatagtgtcccattgaaaggtccaactaagggttttgtctgatttgtattaatactgtattggacagcgtaaacgcctggtgttttatacgaagagcctgcgatccagattggaacattcgcatcattgggtctgccaacttgactggcgagcatatcgccgaccgtcccggcactgttttggaaggtcaagaaaggtcctaaaagaccatcagaggcaaaaggattaagtggatgcgtatagtcaatattatttgccgcggtactacccgtaatgacccaattaggtgcaagtgtaaaggttgccaaactaccattaccaaatgcggtaaagtttgaatcgacaactttatcaatggaagtatctccagcaaaaatggaaacattgggcgacgtaactgtagctgtaccgcgaggatttgttttcgtaaaaacaacggtgctaggtgttcccgcatcatccaccactggcatcgcagcaagtgtttttgatacaaccacgtttttggtattgttgttttcggtttcggaacttgcaggtgcagcagcttgagttacagcagttgaagtggcactactagtggaactgcttgctgcaacggtaataccggcagctgccgaagtagtcgcattgctggactgaaccgctgccttagcaactggcgccgcacttgatggcgctgcagacgaaacgactgagtttgtgccagaactgctcgcttcagtcttggcaaccggtatttccgcggacgcaacggcttgttgtgtctgcggttgcttttctacctttggctgtgttgttgtggtcgcaatagccggcgtagcattagtaaccgttgcggcgtcagtggccggagttgcggtagttgctgaacttgaagctgtactaggtgctgttggagcagtatgaatcgacgctgccgtttgtgcactggcagcatcaatcacccgttgattgtcatttgaatcggcatgaacggcctgattcccggaaaagacaaatccggcaccaccggcaagaaacgttaaggtgctaaaggtgaaaagccagtgtttcccagctttatacatcttgaaattagccgttttagtcgatggttttttcttaatgaactttcccatgtgttcaccccatttaaagagaaaaaataaactaacgatactttgctcatcattttttgatgctgggtgctgatagcatcaactgtcgcaaaaacttttttgccggattagcagtactatgccgacaaatgttataagctcgttattcccttgtcatcccccttatgattaaaagtgatattattaactcgaagtaccaattttatgataggcattaaaatggtcctcgaattgattctaaatatatatcatgacgattgttataacaagcccacacttttattaaattattttctaaataatgataacccctttataccggtctttaaaacggtaacattagcttttggcttcgtactaatagggtattaaaataaccattatatcattttttctaaaatagtttataataaatcgagtacaattaaagttcaccagtcttaaacttttttagcatctataatgttctaatataatagtttcaggtttatttccgcctttataatcaaccgattaactccttctacttattaaagactctcttgctgtaaaattttcattaaatataaattcaactttgtgatagccaaggaagaggtaaactaataacgaacaaaaagcctgaatccttaacttacgggattcaggcttatgccaattatcaaatcgatcatttttcttaaaacgctaaccaatatgtcatgcatcacggtactgcttttctgttaattaatgatgcttaactcatgaattgataccagctttcaataaccttaacgtctcgcgattgtcgcaactgcttagcaacacttgaaaattgttggcttattaagaacacgctggtactcattgtctgcaacgcttctgcatctgcgccatcatggacaatcggtataaggtgagattgcatttcaggtagttgcactaaggcaggaaagatctcacttgaaacatcgacgtaaagtttgcggtcggtatgcacaaaattgttaaccagccaccaaactaagatctcattcatgtctgtaaatagtttaattggttcgcccgcagaattgtttaaccaatattgttgcgtcaacggtaatccgttaacaacggcgacaccgcttcgatttaggatcagtccctgaatgctcgttgtttgaaaaagcggttcagtcaaggtcatgcgttgcagattgggcatttgcgcataatagtccgatacgaataagcgctcatgatcatcgtactgatcttcgcgcgttaaccgaccatctttaaaatagctgatttgccgaacccgctttttcctatcacgctcgatttttagcacaacttgattctcggcatccatatatcgggtgttcttgctgccaggaactgttttggccgttaagtgtgcttgtagctgacttgccaagttggcttggggactgataccacttccacgatgatgcagttcatcataaaagttatgataggacgtcggcgccaaaaatagctgcttcttgtcgcggtaattcaagaatcgtgccgtggcatcaagttcaagatcaccggttataacagcgggactgtgatggttagttttgaagaagttcatcatcactttgatcttagcccattgttcatccggcatttcttctggcaacaaatccagataaagataatcgcttttagcgtcatcgaatctaaggtcattcgtcccatccgcaatcacttcatcccctgaaggactttcttgtttcttcccaaaaaagttcatgaagctttcccccactcgttttgaaaatgtttctagtacaatcgcaagtagagtatcgcataatcattaaattggcagctattattttgacccgttcacagaagatttccttttggtgatgcttaataactgcgactcaatccgcttaaaatgccgaatgtaccatgccgtggctcagcgcaagcgacctaaaaacgccgtcaaaaactgcaatttctgctgtgcctgcttgaacacctctgactgatacgttgtcagcacttcttcgccaaaagatcggtgggcaatatattggtcataccgcaactcaatctggatcgcggtgacaccttgctgatgaccataatagcgggtaatgtcaccgccacgaaaaggaaaattgtcttcaaccgtccaaccatacgtcatgaactgatccgctaacgccaagcgaaaccttttgctagatgtccgatcatgatcattgccgagaacaatcgtcttgggcttcacgttcggataataagggtattgggcaaagctgtgtaaatcaactaaatacgcatacctaaattcagattttttctggttcagcaaggtcgtcaacatttgacgataaggccgataatatgagcaaacccgcgcctgtatttggggaatcgtcagcggctgtgcatacaggttatgatcaaacgtgttacgctgataaacggttgccgagcgatagtcatgctgcggatcataagtcaccgcccgatttggatcagcgacataccggttaacatgattgattaaagtcgtaaatccggcagcaggcaaaaagtcatataattccggtaaaaaccaatccgtgttggctaaaacggcatttggcaacaatgcttttttcatcgccaccggtatccacgttccgctgtgaggcaaactaatcacgactggagaatgttgctccgaattcagcacggtatataattgattgctaatatccatctaccttggctccttctaaaacagtccgatcatttgactgccttcacgtctataacaacctcgcaggtgccatcatgactaccactaccgcataaaaacagcaccgaacaaccacggtccgatgctgactttctgttttgcttgacgagtgtcgcccgccaattgaagttaagattcacgatgcccttcttcaggcaaaagaatcgtctgactctccccatcatcgtaggccataaccgtatccggaaaactgggatcatatggaaacggcaaatccacggacatctcggtttgtgcgccttcttcgctgaaatgaatcgtcaatttgccttgatggttctgaagatcaaaacgcaacagattatttagcggaacaacgccttgtaagttgcgatcaatgatgagccaaatactgtcgatgatctcgcccggcaggtttgaaataacgccaaaagtcgcgaatcgactatgatttgctgcaaacatatgcgactcctttcttcagtcctgcgtggcaatatccgcaaactcggcatcaacaaactttgctaaaaccttgggatcaacgccaacagaacgaccgattttaccggctgacacaatgattgacgactgactttcggcttcttgactgatgtaaatcggatacttgtggcgctcatgaatgccaataggtgtgttggcgccgtgttcgtaccctgtcgttttcatgagatctttcagcggtaccatgccgactttgcgattaccggaaaccttactcagctttttataatcaacatgccgatctaacggcacaacgccaatcaccggtcccgtcttgttccccgttagtaccagggttttataaatctggtgttccggaacatcaagatgatcaaccgtcaactgcgccacatcgccaacttcttcagtcggaaattcataaggcacataggcaatacccgctttgtccaacattttttcgaccaaggttttatctgtcttatgatgtttagccattgcgatccctccttacgaaatttccattcagacgctttcacttaaaagtctagaacaaggctcgcgaaaatgccaccatcatgcgccggtgtaagacattaacgtgaacatatcataatctttgatcttgtcgcgcccatgcaaatcactgagctcgatcaaaaaggctgtcccgactacgacaccgcctaattgctcgactagacggattgttgctgcaatcgtgccgccagttgccagtaagtcatcgcataccagtacccgttgtctcggtttaatggcgtccttgtgtaagtaaagtgtggcctcaccgtattcaagatcatagctggctttaacggttggccgcggtaatttgccttttttacgtgccggtgcaaagccgattcccagcttatacgccacaggacaaccaacaataaatccgcgggcttccgggccgacaatcatttcgacccctttgtcttgggcataggcggcaatttcgtctgtcgcagccgcataagctttaccgtcagccatcaaaggcgaaatatcgcggaaaataatccccggttccggaaaatctttcacactggcgatgtaatctttaaaattgatggtcatgatcctacctcactgtctgaatgctctgtcaccaacatcgtttcaagctgaacccgcggcatggtttgcagttggcgtgcaagcgttaaaaatgcctcgcgcgcaacataagctttggcggtttgcaatggctttttagccggtgccgtgacgggagaaataaaagcaccctctattgtaacaaaatcaagctcgaaaaacacctgaatcaccaagatcacttgatggacagtcaaatggacggccttggcaatcgccggaatatgatgcttgtcaaagccgggatgtgcttttagaaaatgcagaacagcaccaaattcacttcgcgtcggcattgccactaaccgactgggtgcaccataaaacatgaccgtcaccggcagttgaatgtgctgcataaccgtcaccaactggccacgatctttaggcaagtcaaccaaaaccgcatcagccagtgacgttgtgacttgctcagctagcatggtcggcccaccaaacgaaaattgatgttcgaattgttgtttgacctttgcatcaaagaagacgtaattccgttgcgccttgaattggctcccatcaactgtcggcatccgccagtcaacgacttgaggctgcttgaccgcataatccttcagcatgagttgtaagctggtatttccttgccaggtgttctgatccagttgaacggctaatttaatagcttgagcctcagctaatgttgccgctgcagacccaaaaccaaacccgatgacattgacgccttgatcaatttgaaatctaagatgggcattttccttaccgatcggcttcacattctgaaccacttggggacgcacggaaaaagtcggttccggattaccttgtccaaatggggctagctggcgaattaattgataatgctctagcgttaagtcgccaacttccagacgcgcagcaatcggaagcgctggcttaggcacggtcttgagcatggtggcagcggctgcttccatttgcgcatggatggctgatagttcagcggttttagccgttaacccaactgccatatgatgcccgccaaaatgaaccattttgtcctcagccggttccagtgcgttaaacaagtgatacgctgcaatcgaacggccagaaccttttgccgtgtcgccatcatcggcaatgttcataatcaaggttggtttaccggtagcctccaccactttactggcaacgatcccaacaactccttcatgccatcccttactggcaagcagcagcgttttagccgcttgattttccggcgtctgggccatggtgagagcctcttgcgcaattttgctgaccaacccttgccgctcctgatttaacttgccgacttgttgggccaagtcggcagcgacatcctcttcaaaggtagtcaacaatgtcaccccgggattcgcatcacccattcgtcccaaagcattcagccgcggaccaatcacaaagccaaccgtggtttcattgactgtgtccggtgccacgccggcttcttttaaaatggcggcgagtccgacgcgcggttgcgtttggatcattttcaatcctaactgggcgatgatccgattctcatcggttagcttaaccaaatcggcaatcgtgcctaatgctgccagatcaatgctctctagcggcggctcgccaagtaaggccgttgccactttgaaagcaacacctgcacccgaaagatcgccaaacggatagtgcccctcaggatggcggggatggacgaccgctacggcatgcggaagtgtttcaggcaactcatggtgatccgtaaccacaacgtccatgccagctgcttgggcgggatcaatgacatctgcaccggcaaccccgttatcgactgtaatgaccaattgcgtgccggttttttgcaagtaggcgtaaacttccgcattgggtccatagccgtcagtaaaccgatccggaataaaaacatcaggctcggcacctaggctttgcagggtctccaacatgatcgagctgctggttaagccatcaacgtcatagtcaccataaatcgtaattttttgattttgctcaattgcttccaaaatcctggcaaccgctttatccatatcgtgtaaggcaaacggatcgtgcaaccgactaatgtccgggtgcacaaaggcttcatactctgccttgtctttgatgccacgttgccacaacaaagtcgccaaaaacggcgggactgccaatgtctggctcaattgttgtgtcgttgccggatctggttgttctgcaagttgccatcgatactgcgtcatatgttttcgttcctttctaaccgattcagtataccaaacaaacccgtttgaattaaccgcttgcgccaagttttcgtcaacttagcaaaaggggcggccgtttccgctaaccaacccgttcaggtcatcaaaagcgtgatataattaagttgttaacaagcccaactccagtcagcgacttcaaacaggcaagcagttagtgctgtattgccgttattagacaaagcgttaccgtgtgatcttagtccgcttgactgtgaccggtcatggtggactagctctttttcgcgataacgacttaaggaggaagtaccatggcaaaatctcaagaccaattcaatgaaaaggcgggcaagaagattacagtttccgatgaggctgtcgataaggccgccaaaaaaattgaacaggtcggctacgtaaccgaaaaagacgttccggaaatgatcgatcgcgattatacgcgggcattgtcaaaaaaggtttccgctaagctgcaccaagacaaagacgatgactatttctacgaggaaccttttgattatgaaaatggccgcattgccaacatcatctgggatatggataaaatcaaaacccgtgaagaagcaatgaagaccttagcaaatgaacttggcttgactgttccaaagattgtcatgcgcaaagtcgatgaacaggttttctaaagcaaattctaaaaaatcggcgctgtttaccagtgtcgattttttattttagtttgcttgtttgctagcagcagtctttgtgtccatgacatcaattgcctccaaaaagcacctaaccaagccaggttgatttttttagtgtgacaaccatgcagatacgtgctaattatgtgataatgatgataaagaaaggacgtggaagccatggctgaccaacaagtacttgacgatttttttgcgacggcgaaagcggcattggatttacccgctgtcacttacgaggatgcctatcaacttggcagccctgaactggcagatgaacttgctgacctggttaaagcgggcaagaaaactgcgacttcaagtgggtttgagctttataccatcgagcaggacccattaccgatagccggcgtctacaacattatccttgatcgtcatgatcgaccagtggcgctgactttcacggataatgtctttatcacgccatttgaaaaagtcgatgctgtcattgccaaacgcgaaggtgaaggctcccagtcgttagcaagttggcgccgcgcccatgaagccttcttccgccgtgaatatcaggcaaatggccttcaattcgatcccgaatcctcgatggtcgttatcgaagaatttcataccgtttatccggttgttcaaacgaggtgacaagtatgcggctcaaacaacgaacaacattagctgaaaagaaagtaaccggaaaactcgaagacattccgcatccgacactagatgccaccatctatgtcctcgtttttggtctcaccgcaatcggcgggctggtctcttatggcgcgtatcaactgtttaagcctgaacgccaactcgcccacaaagcaaaggacatggttcaggagcatcgcaaagactgataaaatcagtaaatcaaaaacaggcacccagtaggctgactattttgcctcttgcgtgcctgttttgtaaccacaagtggaatattcaccataaaataacaatttattagatgtaaaactgcctacatttaaagctcatgttggcaaaatgttggcaagaaatcgctaatgattaaaatttcaccagtcaaaacttctcgagagcgctatttaccgcgactttcttcgtcgttcattttaagaatgctcataaacgcctcttgtggaacctcgacagacccaaccgccttcatccgcttcttacccgctttttgcttctcgagtaacttgcgcttccgggtgatatcgccaccgtaacatttggccaagacgtttttacgataagctttaaccgtactacgagcgataattttattcccgatagcagcctggatcgggatttcaaactgctgccgcggaatggtggttttcaggcgcgcaacaatcgctttgccgcgttcaaaggcgaaatctttatgaacaatggtgcttaatgcatcaactggatcaccattcagtaaaatgtccattttaaccagatcactttgccgatacccgatgatctcataatcaagacttgcatagcctttggtactgctttttagatcatcaaagaaatcgtaaataatttcggacaatggcaattcgtagatgacattcacgcgatacttatctaaataatccattgtcacaaattcgccccgtttacgttgtgacagctccatgaccggtccgacataatcgttaggtaccatgatcgatgctttcacataaggttcgcggatctctttaatctcacttgcatcgggcatttcagccgggttgtcgatcgttttttccgaaccatctgttaacgctacctgatagtccacgctcggtgcggtcatgatcaaatcgagaccgtaatcgcgttccagccgttcctgaaccacatccatatgcaagaggcccaagaacccacaacggaacccaaacccgagtgcctgggacgtttccggctcaaattcaagcgcagcatcgttgagttgcaacttttccaatgcctcgcgcaagtcattgaatttcgcgttatctactggaaacaggcctgaatagaccattggcgtgattttacgataccctttcagcggggctgctgccgggcggtctgccagcgtcaccgtgtcccccacgcgcgtatcctgaatcgtcttaattgaggccgtgatataaccgacatccccgaccattagaaaatcgcgtttcactgctttaggtgacatcacgccgacttcagtaacctgaaactgcttgccattgctcatcagctggatcgtatcgccgaccttaacttgtccttctttaacccgaacatcaaggacaacaccgcgataatcatcataaacggaatcaaagatcaacgcttgcaacggcgcgttaacatcgccagaaggagccggaatgtctgagacgatgcgctcaagaatttcaggaactcccaagccggttttaccactggccaaaatggcgtcagaagcgtctaagccgatcatctcttcaatctcttctttaacaacatcaggctgggcactaggcaagtcaaccttattgatcaccggaatgatttcaaggtcgtcatcaatcgccaagtacacattagcaagcgtctgagcttcaacaccttgcgtggcatccaccacaagcaaggccccttcacaggcagcaagactgcgactaacttcataactaaaatcgacatgccccggcgtatcaatcaaatggaaaatatacgtttcgccattattggctttatagtgcagttcgaccgcattgagcttaatcgtaatcccgcgttcccgctcaagtgccatatcgtccagaacttgcgcctgcatatcccgcttggcaatggtgtctgtcaactccagaatgcgatccgcaagcgtggatttgccatgatcaatatgggcaataattgaaaaattgcggatatgcttttgccgttccagcatttcttcatgattcatataaatagtgcctactttctaagcgatcgtttggttcttattatagcagagcgtatcggacacgggtagaagctggtatttaacgaatcaagcggttaaggcctcatacacttgcaagcctggctgcttaagttggcatcattataaggttcacctagacgctgatacgtcaaaagtgctcaccacattaaaaaaatcggccttaacttctaagaccgatttttcgatatttggaccagttttgtgcaattgatagtgactaggcgtgtaacctacttaccgcctttaaacgcttctttaacacggtcaaacagcgtcccattgtgtggtgtgacatcttcaccactagctgctgcaaattgcatcagagcagctttttgcttttcgtttaagtgcttaggtgtttgaatctcaacggtcacaatttcatcaccggtaccgttaccgcgcagccgtggagcacctttaccgcggagtctgaatttggtttgactttgcgtgccggctggaatttttaactcaaccggtccgtgaaccgtgtcaactttgatttcatcacccaaagctgcctgagcaaaacttaacggaatcgtcaggtagatctcggcgccatcacgttgatacttcttgcttggcgcgactcggaaaacgatgtataagtccccatatggtccgccattggttcctgcttcaccagcttgttgcaagcgcatttgctgaccgtcttcaacaccggccggaactttaacatcaatcgtatgccgttcctgttcgtgaccggtaccatggcaggttgggcacttttctttaatttctttaccggttccaccgcagacatcacaaacttggcgggtcatcattgcgccaaatgccgtattgcgttgtacctgaatataaccgctaccatgacacttgtggcaggttaccggactggttcccggtttggcaccactaccatgacaagtatgacaaacagcttcacgatcataggaaatcttggtatcttttccaaaaatcgcttcttcaaaagtcaaatccatccgatactgtaagtcggctccttgccgcggtgcagaagggttcgcctgtgcaccaccgccagcgccgccaaagaattgactgaaaatgtcgtcaaagccgccgaaaccgccttgaccgccaccgaagtcactaaacccgccggcttgaccaccattgccgaatccctgcggaccatcagcagacccatattggtcatatgcggcacgcttttggggatcagacaggacctgataggcttcgttgacttccttaaacttttgctcggcaccgggtgcgtgattaagatcgggatgatattttttggaaagcttgcgaaacgctttacgaattgtatcatcatcggcatcccggctcacaccgagcgtctcataataatctttctgatccgccatagttcctcctcgattcagatcgtgactgaaaatgccaacttagcatagcataattcaaacaaaaagccaaaaccgcgccgcggcttcggctttttgctaatgaactgatgccttatttcttatcgtcgtcggaaacatccttgtagtcaccattaatggtgtcatcatccgacttcttgtcatcagccgtaccttgggctgcgccactcgttgcgccaccctgggcttgttgattcttttgggcattttcatacaacttaacggtcatatcctgaaccagcttgttcaagtcgtcccgcttttgcttcatgtcatcaagattgttttcctgttgcgctttcttcagtgcttcttgcgcatccttgactttcttgacatcctcttccggaaccttgccgtcaacatctttcagggtcttatctgtctggaagagtaattggtcgacatcgttcttcaaatcgacttcttctttgcgcttctcgtcggcttcagcattttcttcagcttccttcttcatgcgctcgatttcttcgtcagacaagccgctggaactcttgatcgtgatgttttgtgacttgccagtaccaaggtcctttgccgatacctgaacgatcccgttcttatcaatgtcaaacttgacttcgatttgcggaacgccacgtggtgctggcggaatgtcggtcaattcaaagcggccaagtgtcttgtcatctgccgccattggacgttcaccttgaagcacgtgaatatcgacagctggttgattgtccgcagcagttgagaatacctgactcttagaagttggaatggtggtgttgcggtcgatcagcttggtgaagacaccgcccatggtttcaatccctaatgacagcggcgtaacatccagcaaaacaacatccttcacgtcaccggaaatgacaccaccctgaacggcagcacctagcgcaaccgcttcgtctgggttgatgctgtggtccggatctttgccagtccattccttaactgcttgttgaacagcagggatccgtgttgaaccaccatttaagattactttgtcaatatctgcattcgtcaatttagcatctttcagcgcattttcaactggcaccttggtcttagcaaccaagtcggcggtcatttcgtcaaattgtgcacgggttaaagtgcgttccaagtgcaatgggccgttggggccggcagaaataaatggcaagctgatttgcgtctgggtcacaccggaaagatccttcttagctttttcggctgcatccttcaggcgttgcattgccattttgtctttagacaggtcaatgttgttatcctttttgaattcggaaacaagccagtcgatgatcttgttatcaaaatcatccccgcctaaatgagtatcgccattggttgacagcacttcgaagacaccatcacctaactgcaggatggaaacatcaaatgtcccgccgccaaggtcgtaaaccaaaatcttttcgtctttgtcgcctttatccagaccataagccaaggctgacgcggttggttcgttgataatccgttgaacattcaaaccagcgatcttaccggcatccttggttgcctgacgctgactgtcgttaaagtaagccggaactgtgataaccgcatctttaaccggttcgcccagatagtcttcagaaaatttcttgatgtactgtagaatcatcgctgaaatttcttgcggggtgtattctttatcgccaaccttaactttatagttagcttcgcccatgtgacgcttaattgacacgatggtatccggattagtgatcgcctggcgttttgccacttcaccaacttggatttcaccatctttaaatgcgacaacagatggcgtggtgcgattgccttccgggttggtgatgatttttggctgattgccttccaaaaccgcaactgcagagttggtggttcctaagtcaataccaataactttactcatatttttataccttctttatttcagattaattatttagcgacaacgaccatagcagggcgcagaacccgatccttgagataataccctttttgtaacacctgcgcgaccgtgtcagcgggatgtttgtcgtccgccgccacggtttgtactgcctgttgggtattcggatcaaacttgtcgccagcaccatcaatcgcagtgatgccattttccttcaaggcgcgttccagatgatcgtaaaccatctgcacaccttttttgagtgaggccgcactgtcatctttggcttcggttgcaagcgcacgctctagattgtcaactaccggcaaaatcgccttggctaacttctggccgtcatatttcaacattttttgctgctctttttcgaaccgcgcattcatgttttgaatctctgcagctgcgcgcaaatacttgtcttcgaatgcatcacgctcttgcttcagttgttcaccatcatgcttgctggttttcaattgctcattaagatcagcaatgctttcctgcagaatttcttcttttagcgaagtctctggcgtgtcagcagcgtgcttggcgtctttggcggtatctgcagcagtctgctttgctttttgttctgccatggtatcctcccttttaaccacatctattcgcgcaattggttcacgttaacagatgcttgttatcatctatcattgatcaaagttggcgtaatagtccgtcaaccgtttagccagctcctctcggaaaacatccaacagtccgatcatcttggaatacggcatctgggttggccctaatagggcaatcattcccgtgccgtggtcaccgacatcataactggcggtaatcaagctgagattggccagatcaattggctttaactccgggcctagacgaaccgtaaccggcgtttggcgaaccggtccgccaagcagttcagtaagatcaccatgatcagcatcaatcaaggacataatctttttcaactcgtgaatatccgagtcgccgagatagtccattaaatttaagcggccacccacatagaaacgctctgaagcggcggactttaagacattaccgaagatatccaggaagccttcaggactggtcagatactgcatcagcatcgacggaacatcagtctttagccgctgagcaacttgaataagcggcaaaccgaccagctgatcattgacaatgcgaatcgccttttccagctcgtcagatgagatgctttcaggaacggtgaaaacctgattttcaacattgccgttgttcgtcactaaaatcgccataacctggtgattgcccaacggtacaaggcgaaatccggtcaatttaatgttattcacttctggccctaagctgatcgccgtgtaactggtcagattggataaaatctgcgcactttgcgccacaatttcatccatcttattgtagcgttgaccgaatgcttgcttgatcgtggctagttcacggtgggaaacacgcactggctcgaccagatgatcaagatagtagcgatagccttgagtcgagggtactcgaccggaactgctatgagtcttggtgatcaaaccggcgtcttccagcgatgccatatcattgcggatcgtggcggaactgacatgaaccggcagttcctgcattaacgtcttggaaccgaccggctgcccactttcagtaaacaggcggatgatttcttttaagacgagcaattgccgtttcgtcaacattttctcacctcacctttagcactcgttttacacgagtgctaatacactgaataatataccaagcgccgttagcaaagtcaaggtaggattgctaaaatgttgcatcaaacagccaactacggttagatttttggtcatatccgaagcatgattcatcattagaccagtggctcatcaagtaggaattgttggaaaacctcatttcccaaaaacttaccgcgattcgtcagtcgaatataaccattttggcgctcgattaacccttggctttccagctccggaaccgtctcgccataaactgcatcgaccgtcatatgatagcggctataaaaacgatcttcattgacgcctgccatggtgcgtaagccaaggaacatttcttcctcaatttgctcagaaaccggtactaaatgatgggccagaaccggtaaatggtcggcatgcaacggtgccagatactgtttgatcggcccataattatgataccggtcacgaccaagatagccaaatgcgcctgccccgaagccaaaatatttatcattttgccaataaagtagattgtggcgacattggtaccctgttttggcaaaattactaatttcatattgatgccgtccgtgagcttccattaaatcaatggcatcttggtacatatcagcttcaacgtcttgcgtcggcaaccgcagcttcccttgacgcatcagattataaaaaatcgtcttgcgctccaggatcaatgaataggtcgagtaatgtggcaagtccaatgccaaagctttttgaaggctgttcaaaaagtcatcgcggctttgatctggcaggcggaaaatcaaatcaatcgacaagttgtcaaacccgacttttctagcattgccgatcgccgtataaacatccttcgctcggtgaatccgaccaatgcgcttcaagacatcatcattaaacgactgcacgccaatcgacagccggttaaccccaaagtcgtataagacctgtaacttgtcggtggtcagtaagtcattgggattggcttcaaaggtaaattcaccgtgatcaaaatgaagaatatcgcgaataccttggcacaaaacggcaagctgttgcggtgtcagcgttgttggggtgccaccgccaacataaaccgtttcaattttttcttctggatgctctgccatcaccatgcgcatttctttgagcaacatggcgacataatcatcgaccggctgaccttcaataaacaccttattaaaatcgcaatagtaacaaatatgctcgcaaaacggtatgtggatatatgcgcctgccatgttaatccttcctcacccgaaaatattggcgaacggtttgttcatctgtctttaactgcgcaatcaaagcatcggcaccggcaaacttgacctcaccgcgtaagtagtggtaccaacggacttgaaccgttttaccatagatcatctggttaaaatcaagcaggttaatttcaagcgttaccgcccgatcatctccaaatgtgacattgcggccaattgaagccattcctaagtaccaagtatcatcaactttgacggtcacggcatagatgccaatacccggaagccgttgttgccccaaagtggctaaattgatcgtcgggaagccaagtaaacggccgcgtgcttcaccatgaaccactttgccagttgtcagatagacatagcccagtaactcgttggctgtgtcaatgtcaccacggtctaaggcatctcgaatacgggtcgaactgatcttcttgccgtcctcagccagcttagggacactgacgacttcaaagcgaccgcgcgcatattccggcaataatgccatattggccacagcgcgtttgccatacgtatagtcaaaaccggccacaaccgcagccgcttttagcccgaccaaataatcatcaacaaatgcttgcggcgataaagcagcaaatgctggtgtaaagtggacaaaatacaatagatccacgccaaattgctgcattaaggcaattttttcttcgcgtgtcgataaataccgaatcgccgttttggcaacgccacggtacacgatcgccggatgcatgtcaaatgtcatcacagcaagtggcagttttttttcaagggcaacttgtttacccgcttgaatcaccgcttgatggccacgatggaccccgtcaaagaagcccaatgttaggacaatgggctgcggtggtgccgctgatgcctgcagtggcggttgaatatcaatgactttcattcaaatatcactcattcttttcattcgttaaaaacataatatcgggtcgatactgttgatgatccaagcgataaatcgcttttaaaacccctgcataatgcagccgaatccgtggggcttgcaatttaagcgttaaaaaccgaccatgcgtcacatcttcgtattgctccggcgtcaaatctacttgcggtaacgccgcaaatgcgatgtcaatcggttgaataacagcagacagtgtcccgatttttgcgtgttgttccagatccgcaagactcactgcctgtgcgagggtaaagccgccacttttaatccgcgtcaactgactcatcacggcagcgactcccagcgtgcggccaacatcaacggctaaagtacgaatgtaggtcccttttgaaaccgcagcctcaaatttaaatcgctgcgttcctttttccgaatcgaatactggctcactggttcgtttgaattgcttaaccgttacttgtcgttttggccggtcaacggttacccctgctcgggcatattcgtacaaccgtttgccattaactttgactgccgaaaacattggcggtatctgggtgatttcgcctgtccattgcctcaatgcttggtcaagttctgcttgcgtaaacgggttagctaaaggtgtgcgcgttaccacatcgccgtcaagatcttcggttgttgtcgcaaagccgagtgtaatttcgccggtatagacctttccactggccatcaattgtgggactgctttggttgccgcaccaatcgccagtggcaacaccccatcaacacttggatcaagcgtgccggaatgcccgatttttttgatgtgcagaatcttgcgcgcatgatagacagcatccgcgctggtcatgccgactggtttatataacggaagaatgccgttcatgaacccggctcctttcaaattttaaaattaagagacacccgtgcgtgacgatcgcttagccgcaaaccatcagtttcacgacttcggtttggtatacatactgtgatgatgcctggcgtgaacggcatgccgccaccccgcccagataaagatcaccactaccagaaccgaaaacagccagtcaggagtttcaacatggatcatgggaaggctcaatccaagtttgatggcaattaacccaaccaacacataagccgccgtttccagctccggaactcggtcaatgaaagtggtaatcacctgtgcaacgatccgcatcgccagaatacccaagcaacctccgatcaagacaatcaccgggttaggcgatacagctaaagcagctaaaatcgaatcaactgaaaacacaatgtccagactttcaatttgcaaaatggttccccataaaccatgcgttttgtgcttgtgagtggccgtattgcttttagggtgacgcactgcataaaaataactgccactcatccaaacaagatacaaagctccgactgctttaatcggccaaaactgcagtaagtatgttccgagtccaatggcgatgaaccgaaacaagtacgcgccacccatcccgtacattaaggctttcttacgttccgattctactttaagctgctcggtctgcgcggctagaaccaccgcattatcaaccgacaacatacattccagaagaattaaactgaaaatcgtcatcagcccgccaatcgaaaatgctgactgccaattgtgcgcggaaaaaaatggcccgtataagtcacctagaaacgcgatcgtaatccttcctttctcaatggttatcattataccgttctaaacaggaaagctaaaggtgttgagaagaaaggaagctggcaaaaagtagcctcttaaaaagaatgcggtaaattttcggattaaattcgtcaaaaaaaagaacccccatcacttgagacggggattctttaacactactattcgagattcttacggcgtacttcattaatcaactgatcaatccgcgcaccatattggacggatttgtcctgagcaaactcaatttccggtactttaaacaaccgaatacgctgcccaacctcacgccgaatcaacccactggctttatccaaaccagtttgcgctgcttcgactttatcaggcgcatcatcgagaatgctatagaaaatggtggcatgctgcagatcaccggtcagtttgactccggtaatcgtcacgcctttaacccgcggatcattgacatctttcagcaaaatatcgtcaacttcccgttggatctgagtctcaactcgaccgatacgatgtttcatctgcactaacctcctttgagcgtgagccagcccgctgatgaaccggcaaacgcactaaaactacttaactggcacttcttccatcgtgaaggcttcgatttcgtcaccaactttaatgtcattgtagttctcaatggttaaaccaagctcaaacccttgacgaacctgcttgacatcatccttaaaccggcgtaacgaaccaagcttgccttcatacttaacaatgccatcacgaatcaggcgaacacctgcatcacgggtaatataaccggaatcgacatagccgccgacaaccgtcccgacttttgagaccggaatcgtttcacgcacggtgacggttccaatgaccttctcttcataagtcggttccaacatacccttcatcgcagcttcaacttcttcgattgccttatagatgacactgtgcaaacgaatgtcgacatcgtcttgttctgcttgcgctttagccattgcagtcggacgaacattaaagccgataatgatcgcgttacttgctgcagctagggtaacatcactttcgttaatcgcccctactgcctgatgaataatattcacgcgaacccctttgacttcgatcttcttaaggctgcctgccagtgcttcgacagagccttgaacatcggccttgatgatgacgtcaacttctttaagttgaccttctttcatcgtttcaaagaggttgtccaacgtaacgtgcgtcgtgttcttacgttcttcttcctgagcacgttttgcccgctcttcaccggctgcccgtgctgtccgttcatccgcaaagacgacaaacttatctgcagattgcggcacatcatttaacccggtaatctcgactggcatggatggtaaggcatccttaacgcggcggccatgatcgttggtcatagcccgaacccgaccaaacgtattcccgacaacaatcggatcccccgtatgcagcgtcccttgttgaaccagaaccgttgcgaccggacctttgcccttatccaaacgtgcttcaataacagtaccgactgcacgttgatccgggttggccttcaattcaagcacatctgcttccagcaagatcatttccaataattcatcgatattcttgccaaacttagccgagattttaacgaaaatagtgtcgccaccccagtcttcagggatgagaccatattcagtcaactgttccatcacgtgttccggattagcacccggcttatcaatcttgttgacagcaacaatgatcggagccttagctgcctgcgcatggtgaatcgcttcaatggtttgtggcattacgccgtcatcagcagcaactaccagtacaacgatatcagtaatatcggcaccacgcgcccgcatgttggtaaaggcggcgtgcccaggggtatcgaggaacgtaatcaaacgatcgcgcaatttaacctgatacgccccgatatgctgtgtaattccaccggcttcaccttcagtcacatgcgtatgccgcaacttgtccagtaaagtggttttaccatggtcaacgtgacccatgatggtgacaactggcggccgtggctgcaagttgtcctgattcttattttcttcctcgaacactttgtccagatcggaaatatcttcgtgaaccttttctttagcatcaatgccataatccgttgccagaagctcgatcgtatctttatccagactctggttttggttaaccatgacgcctaacataaagagtttcttaattaactctgctggttcgcgatgaagaatcttacccagctcctgagcgttcatccctacttcatagttcagaacttccggtaatggccgctctttacgctgtggcatctcttttttcggttggctctgctggcgacgtttgttcttcttgttgcgtcggttgctgttgcggttaaacccgttacgattcccaaagctgttgccacggccaaaattgttgttcccgccgccacgccggctattacggttgtcttggctaccggcactggctggtttagctgtcgtgttggccacagccggttttgtaaagcgttgattggtttgtgcagcaggctgctcggttcgtggccgctgctggcgctgttcagtccgcgctggtttctgttcggtttgcggacgttgttgggcacgagtcgcttgcgggcgctgttcagtagattccgaacgtttactcgctgcagctggtttagccgcctgttgacgcttaggttgctggcgctcggattccggtttaacaaacttgccaccatttccggctaccggacgcggattaccattggcagcggtcggacgcccagcacgcggcatcgggccagtcacacgctgattgtcaaaacgccggttacgatcccggcgattacgatcgtttgagcgattactattgttattggcggaacgattgttattattgccgcggttattgttacggttaccggcattagcgttggcagtctgctgattgctgtggttgccagccttatgcgcggtctgagtgccccgtggacgtaaaattgttgacttacttaaaatgatttttccatcagcagttttgttagacttagcaggcttgttttcatgcttgaccggcttttcggactggctctgagcatgatcttttgcagttgccgcctttgatttggctggttttgccgctgctgatgttgcaggtgccttagctgcggcagacttgcccagcacccctttgatcttagcttcctgatcctgatcgatcgaggacatatggttttttacttcgatacccaaattcttggcaatatcgagcacgtctttattatcaacgtgcatttctttggcaaattcataaacgcgttttttgcccatttcttcacgctccctgcaatttaggtgagcagctcttgcatcttcttagcgaagcctgcatcggttacggcaatcatcgcgcgatcactgccgatggcttgcgataggtccattttggaaaacattgtgaccaaaggaacttgatagtagctgcttttatcggaaaacttcttgcgggtattggcacttgcatcactggcaacaaagaccagctttgcctcgcctgagcgaatcgcacttaacaccaactgatccccagtggtgagacgactagcgcggcgggccaatcccaataaattcaatacggcttgtttttgcatggttacttgccgaataattcttgacgtgccttttgatgatctacataagcaaaaaggtcatcataaaaggccggatcaatcgtaatgccaaacgcggcgtcaatcaattttttaccttttgcccgtttaaccgcatcaggatcaagcgctacatacgcgcctcgtcctgcagctttaccggtgggatcgattgcgaccacatcttccttgttcttaacgattcggacaagttctttttttggcatcatcgtgttgctcagcaagtccttgcgcattggtatcttacgctttttcatggctcgcctccttatgcctgtggctggtcgtgggtgcttggcgtcacaggggtttcatcggcttcatcgtttgcctgatcaactccagcatcatcactgggcgcttgactggcgttatcttggtcatctgctgctgcggctgcctcaacctctgcttcggataattcatcatcgtcaacgaattcgacttctgattccggcttgatgtcgatcttgtaaccggtcaacttcgctgcaaggcgcgcattttggccttttttaccaattgccagtgacagttgataatccggaacaatgactgtcgccgaacgatcattgtcttcatcattaaactgaaccgcgatcacttgtgccggatttaaggcattagcgatgtaatcagccggatcttcttcccactgtaccacatccatattctcgccagaaagctcattgaccactgcctgtacccgtgcaccccgcggacccactgttgtaccgacagcatcaaccgcatcgttggttgcccgcaccgcgatcttcgtccgatcaccggcttcacgcgcaatgttgacaatttccaccgtgccatcgaaaatttccggaacttcctgttcaaacaggcgctttactaaaccaggatgggtccgactcacaaacacttgcgggcctttgctggtattttcgactttggtgacataaaccttaatgcgatcgtgagcttcatacttttcatttggcatctgatcttgacggcctaataccgcttcgatcttgcctaagttgacgtagatgaaccgattgtcccgacgctcaacgacaccttgaagaatctcatcttcgtactgtgagtattcatcataaacgatactgcgctcagcttcacgcactcgttgcataatgacttgttttgcggtctgggcagcaatacggccgaagtctttgggcgtcacttcaaacttgatttgatcgccgatttcataagctttattgatagctaaagcgtctttgagactgacttccagacgcgaatcaaaaacttcatccgtcacttctttgaccgcataaacatgaatgtcgccttgtttaggatcaaattccacatcgacattttgggcctgattgtaattacgcttataagcagaaaccagtgcggcttccaaggcttcaatcacaacctctttcttaacccccttttcttgctcaagggcatcaagtgcttggatcatttcctttgacatgcttttcttacctccactaaaactcgatcgccaatcgtgcagaagcgatcaattttcggtcaatgacctgatcgaacttgcggcttttatctttgaccgttaatgtcagctggtcaggcttcaaatctttcaaagtaccttcgaaaactttcttaccatccagcttcttaaataacgagacatgaatgtagtcgccgattgcctgttcataatcggtctcgcgttttaacggccgttcagctccaggactggagacctcaaggaaatattgttgcggaatgggatccggattgatagcgtccaattgctcggacaacgcttcgctaaccagcacacattcatctaatgtaatgccgcctggcttgtcaatatacacccgcagataccagccgccgccttccttcacaaattcgacatccgtgaggtaaaaatgatggtcgtccaaaatcggtttaaccaaagcggtcacggtttcaacaaccgattgcgtactcaagccaccgcctcctttattgttcattcaagactattgattctgacggcacgctaaacggacgccagaaatgacgttcgccaataaaaagagtgagcatcgctgctcactcaccgccagaaccttactttactattgttacaataccatagataggcaccacttgcaaacaagcaggtcagtgtggtaataggcttaccggccattttaatatctctgcacgataagcatcaagcaaaaacatttatgtggccgaattaaaataagccatcaaaaagtgataattgattttcatctggaagatcatctaaaacatggttggtcgtcatgtaatcaatcaaagttttagaaacctttccgcgatttgctaggtcttcttttgataagaatggcttttcttcacgggcagcgacaatctgcttggcaacgttatcgcccaatccgggaaccgcacggaatggcgctagaatggtgtgatcatcctgaatcaggaaatcatgggaatcggacttggtgacatcaatcattttgatcttaaagccacgctccaggcattcgttagcaatttccaaaacagttaacaattgcttttctttagcggaagcatccatgcccttgtccgtaatctccttcattgcggctttaacggcttctttgccgtgactcatggcagctaaatcaaaatcttcggcccgcacggaaaagtaagcagtgtaatacaccagcggataatggaccttgaaccaggcgatccgcaatgccatcagaatatacgccgttgcgtgggctttagggaacatgtatttaatcttcaggcaggaatcaatataccaatccggcacattttcattttcgcgcatcgctttttgccagtcatccgggataccccggcctttacgaacgtgttccatgatattaaacgccatggaatcgtccatcccccagtgaatcaagtccatcatgatgttatcacgacaaccgatgacttccttcaaggtgacaatgccttgcttgattaactcttccgcattgcctaaccacacatccgtcccgtgagacaatccggaaatctgtaataattcgctgaaggtcgttggcttggtttcttcaagcatgccgcggacaaaccgggtcccaaattcgggaatgccaagcgtgcccattttggaattgatttgttcaggcgtcacacctaaactctcggttccggaaaaaagcgccatgactccgggatcgtcagttggaattgatttcggctcaacccctgacaagtcctgcaacatacgaatcatcgttgggtcatcatggcccagtacatccattttcaaaatattatcgtgaattgaatggaaatcaaagtgggtggtcatccaagcagcattttggtcatccgccgggtattgaatcggtgtgaaatcataaatatccatatctgccgggacaatcaagatccccgccggatgctgaccagtggtacgtttaacgccagtatcgccttgtgccagtcgatcaatttcagcaccgcgcaactgttgaccggtgtcgcgctcgtaagctttcacataaccataagcggttttatcggccaccgttccaattgtcccggcacggaaactatgatcttcgccgaacatcactttgatatagttatgcgccacaggctgatagtcaccggaaaagttcaagtcaatatccggcaccttatcgccgtggaagcctaagaacgtctcaaatggaatgtcatggccgtctttatgcagctcggttccacatttcgggcaggtcttatccggaaggtcaaagcccgatccgacttcgccatgcgtaaagaattcactgtactggcatttcggacaccgataatgtggcggcaatgggttcacctcggtaatctcggccatcgtcgcagctaaactcgaaccaaccgaccctcgggaaccaaccaagtacccgtctttgttcgactttaataccagccgttgcgcaatgttataaatgactgagaatccattcccgataatacttttaagttctttatccaagcgttgcgcgacgatttctggcaacggattgccgtaaagctcataggcagtcgccatcacatcatgtttgagcttttcttccaccccaggcacttccggcgtgtaaagcttatctttaaccggtgtgatattatcatcaatccagtcggcaattaaattcgagttggttacgaccagttgctgcgccttttcttcgcctaaccaactaaaatcatccagcatttcccgggttgagcgaaaatgaacatcaggcagactatgacgattaagcggattggccccaccttgactgtgaatgagaatctttcgataaatcgcatcgtgttgatccagataatgaacgtcaccggtaacgacaaccggcttctctagttcgtcgccgattttgacaattttttgcaaaatatcttttaaatgcgactcgcctttaataagatcggcttctagtaatggctggtaaacggctggcggttgaatttcgagataatcataaaatgctgccttggcacgtgcttcagcctcccctttttgcatcatggcggtgaaaacttcgccgcttgagcaagccgaaccgacgagcaaaccttcacgcaacttctgcaactgactgcgtggtactcgcggcacccgatagaagtatttgacatttgacaaggacaccaacttgaaaagattcttcaagccggcttgggttttggcaaatacaatcgcatgactcgggcgggcagccttataagcctcaccggcacccacgcgatcatttaattggttgagtttggtcatgttgtacatcttggcagcttctttttccaaggcgtatagcaaataaccggtcgcctcagcatccgcgttggcgcggtgatggtgttctaggctaactttgtattgcttagccaaggtatccagtttgtgatttttgcgttcgggatggagcatgcgcgataactcaagcgtatcaatgaccggattgtcaatatcagccagcccgtgccgctcataaccattatccaagaagcccacgtcaaacgtgacattatgtccgaccatgatcgcaccgtcacagaactgctggaaaagccgaaacacttcttcttcagacttggaaccgtgaaccatgtcgtcggtgatatgcgtgaggttaatggttaattctgacagcggaaaaccgggatcgatcatttcttcaaactgatcaatcacctgaccgtctttcattttaacggcagctaactcgatgaccttatcgtaaactgctgaaagaccggttgtttccacgtcgaaaacaacatattccgcgtctgccaacacgcgcggctcgtcagctcgataagcaaccggcgttccatcatcgactaggttgatttcaacgccgtataacattttcaaaccggctttagcagctgcggtgtgggcttctggataagcttgcagcccagcatgatcggttacagcgatcgccttgtgtccccatgctttagcgcggttcacgaaatcggtaattgagttggtcgcatccatctggctcatgtttgtatgcagatgcagctcaacccgtttttcgccttcaacgtcatcggttggatcaggatgggaaacggtttgaatatcttgtgcattgatcgtgagttcgcgcgaatagttgtcctcttgcacactgccgcgtacccgcaaccactggccttttttaatgcgcgcaaacatcgcctcatcgtcagcaccattgctgaatttcttggcaataaaactggagctgtaatcggtgattttgaaaatcagtaattgccgtttcgagcgtaattcccgtacttcgacatcaaacacatagccttcaacggttactgaacgttcttcttgggtaatcgtgaccatttgctgcggcggatcactcatttttaactgccgccccatttgaaccggaccattcgtgggctcctgtttttgtttagccgcttgccgcttcaccacttcagcagctgcctgggccatcttcgccgtttgcgctgctttttgcgcttcaaatgccgccaaagactgcgccgcttgctcttcgtctacttgggcctgcatccgtaatccggaaaagccgacttgctgataggttgcttcaagcttacctaatccttgattaatcaggtattgccgaatctgttcattttcagctgttatcaccgcgcgattattcaccaacgtcggtacctgtttttcgcacagttcacgaacgatcccagtaccgatttctgaattttgcaccacatatggccaatattgcgccaatagttcgtcagtaatcgtcggctgagcaaccgcaatggtcaaccgtgtcgccgcaatttgtttgaaagcaattggcagttgcgtggcgatggtattaaaaatctggaatggcaaaatcgtcggaaacgccaaggtaaagtcatagcgttgtgactgctcatggattgtcactgcttgaaccgacccatctgccagtgatggatcatgtcgcacatctgctggtaaatcgagctgatccattaatttttcaaacatctcatgttgggataaagccaaatcgtgcacccctcttagatggcagaaactgggacaaaatgctgccaactcttcaggccacaaactcgccgccaaaaagaggatgggattagcaattttgccccagcgccttagttatcaattatgcttttgcctgttcttgtttatgcaactgggccatgaggatcttgatcgaactgatcaactcttctttcttgacttcaattgtttcgccagtcttacgtaacttaagctcaacaatctcatcaaccgcttttttaccaaccgtcacgcgcaacggaatcccgattaaatcggaatcggcaaatttcacacccggccgttcgttacggtcatccaccagcacactatagccggcatcttcaagcatcgttccaatcgaagcggtcagcgtcttttgttcctcacgcttcagattaaccggaatcagatgaatgtcaaaaggagcgatcgtggtcggccaaatcaagccgtgatcgtctgcctgctgttcagcaattgccgaaagcagtcgtgatacaccaataccatatgatcccatgataatcggctgactacggccattttcatcaaggaaatcagcgcccatagtttcagaataccgggtaccgagtttgaaaatatggccaatttcgatcccgcgcgtaaacttaagcacaccctggccatccggtgacacttcgccttccttaacaaaacgaatatcggcaaaagtttccggattcacatcgcgctcaaagttcacgttcagtaaatgtgtgtgcgctttattggcacctgccaccaaattcgtcaagccgctcagactattatcggcaataatccgtacatctttatcgacgtttaccgggccgatattaccgacttctgcgtgcatgaccgattcaacctgttcaggagtcgccatttcgaggaagtcagcgcctaagatgttcttaagcttggtatcattgatttcataatcaccacgcaccagtgccagcaccggagcaccatccgccataaataaaacggctttaattaacttttgttccggaatcttcaacaaagcagcaacttcagcgatcgtttttgcatctttagtatccacccgggttaattccgcctgggcttcaacgccttgcttcggcagcgccatgctcgtggccatctctaagttagcggcatagtcggaactgtcggaatagacaatggtatcttcaccaattgacgcaatggcggaaaattctttcgagtcttttccgcccatcgcgccgccatcaccgataatcgtccgataacgcaggcctagacgatcaaaaatattggtgtaagcatgttccatttgccgataaatggtatcgagatcctgatcattactggtaaatgaataagcatcctgcataatgaactcacgcccacgtaaaacgccatagcgcggccgatcttcatcacggaatttatcctgaatttgatacaacactaacggcatccgcttgtaagatttcaattcattgcgaaccagatccgtaaaggtttcttcatgagtagggcccaagatcattttacgatcctgacgatttttcaacttaaataaattgggtccgtaagtttcataccgtccggattcttcccagagctcggctggcaataacgccggcatcttcatcttaaccgcatcgatcttcgtcatttcatcgtcaatgatcgcttcgattcgactcaagacgcgttctgctagtggtaaataggcataaacaccggcttgcacctgacgcacaaagccagagcgcaacatcattttatgtgactttgcctctgctgaactgggtacttctttttctgtaggaataaacatccgtgattgtttcatgtcagcctccaaagctagattatttaaaagtaacgcataatatcattaatcgtcacggcgagcatcaggagtaccatcaacccgaggccaaccatggtgacaacaccttctgtttcaggcttcaacggtttgcgccgaatcagttcaatgagattcagtaaaattttaccaccatccagaaccgggattggcaacaaattgctgattcccaagccgagacttaagtatcccataaagaatagcaatccctgcaatccacctttagcactttgactggtcatggtataaattccgaccggcccagctaacttattaagcgaaaagccgccagtcaccatggatttgaggacatcccaagtgcgcacagctaaatcccaggtttgggtgaaaccatacgtaaacgcccgtgccggtgatttttcgatgagtgcttccacaccgatcttgccatccttgttaggcttgatgaccacattttgcgttttgccatgctctttaactgtaaacgtcaccgacttaccggcctgtttgctgactttgctggaaagatcagtaaaagaatgaatcttttcaccatcaatcgcctgaattgtggcatttgacttaagcccggcttgagcagcaggataaccgggcagtaccgttccgatttgattggtatttaagacctgcacgccaaacatcaacccgtaaataataaaggtcaaaatggcaagaataaaattattcatcggaccggcaaagttaacaattagacgccgccaaaccggggcattttgaaattggacatcttctggcgcaatttgaacttcggtgccatcttcttcaataatcgtggcatcatggtcaaccgaccaacgctccagtttctcttcgtcgccattagggtagccttcaatcaccaagtctttaacgaggtctacgcggcttacttgtaccggcatgccacctgccagcgttgttttatcactggcattaatccgcgtcactgtaccggcatcattcaggataatactcagcatggtcccaggcttgatttcatcttcctcatcctgccagccagccatacgtacatatccgcccagtggcaacaagcgcaaggtataggtcgtattattcttatgtgaggcccatagcttaggccccatgccaatcgaaaactcacgtactaatattccgctgcgcttggcaaaataaaaatggccaaactcgtgaaccaccacaagaatgcagaagataacaataaaggcaatgattgtggtcatatgtgctccttaatggtcagacaatgccaaacaaatgcagcattggcaataccagtagtaaactgtcaaaccgatctaaaataccgccgtgccctggaagaattttaccggaatccttaaccccgtaaaatcgcttcaaagcggattcgattaggtcaccgatttggccgataaccgacaggcacaaggcaatccccatcattggccaaaaagtataatattgcgggaagaacattaagtaaatcgcagccgttattaatgcaagtacaaccccaccgacactgccttcgatggttttgtttgggctgatcgccggccacaatttatggcggccaagtttgcgaccgatcatataggcaccagtatctgtcaaccagacaatcagcagcgcaaacatcaacgtatccagccccgcatcgttgcgcacactgatcaaataatgaaaccctgtaccgatataaaagaatgacaacaccgatacaccaatatcatcaaacgtcgtgcgattcttggttgtcacggttatacaaagcaacaaagcaaccgcaatgtaaatcagatcaatccgccctaaaaaggcaggcagccaacggaaaaagctattcggcaaaaccaccgccaagataccaagcgatgcaatcagaaaatctggcgaaagaatgatgcgcttccgcatgatatacacttctgataacgcaattagcgctaagactgctccggctgtatcgatccaaccgccaccggcaattagaattggaataaaaattgccaaagcaacgacagccgttatgacccgttgtttcatgataacaaatcctccatcaccatttatttagttgattatttttttaaaccgccaaaacgccggtctctagcctggtaagttgcgatcgccgcctccaatgcagcaggcgagaaatccggccaataatcatcgacaaacaccagctcactataagcgatctgccagagcaaaaagttggaaatccgtaactcaccacttgtacgaatcaataaatccggatcggctaaatcaccaaggaaccccgtcatcagtgcagcagaaaaatgctgatcatcaatatcttcaggatctaattgaccatcacgcaccgcgcttgccagtttccgggcagcgtgaaccagttcgtcacgaccaccataattcagcgcaaagttaagaatcatgccggtgttgttggccgtatccgccatagctttttcactcgccttgcgtgtcggctcaggtaagtcggttaactcacccataacttcaactttaacattttctttgattaaatcaggcataaaatcgttaaaaaagtcaaccggtaagcgcatgaggtaattcacctcagaaccggggcgcttccaattttcagttgaaaaagcatacaaagtcaaaactttaaccccgagacgacttgctgccttggtaatcgttttaacattttgcatgccttgtttgtgtccggcaacccgcggcaacaatcgccgctttgcccaccgaccgttaccatccatgataatcgcaatatgcgcgggaatccgtgccggatcaagtttcactttcgaacccttggctatggccaaactggcgcctcctcacaacgtctacggtgcctcatgcaccaaatgtctttaacgattgtagcagaaaaaaaggcagagcgcgaataggcgcggttagaaaccggagtgtaagcggccttaaagtgaaatgaccgggctttggtcattttgctttaaggtccttacattccgatttctgcgcctattcgcgcgttttaaaaccgaggccaggcgcagttagaagtgaagtcgcaaatgcaaccatttaacaggacaacttttaccactagtttcctttgttagcatgattacatggcgccaaaaagtttattaaaccagaaaaaccccagatctatgaagtgccccataattgttagacagatactctaatgatagtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagctggccgtggtagactattaccaaaccagtggtgcgggtgtggtatctgcggctgctcatttcgggatcaatgcctcgcaggtggctgtctggatgaagatcttcaagactgagggagtggctgggttgcgtccgaaaccgcgaggaaggcggtctacagtgaaacataagaaacccaaacaagttaagaagcttgagcttagtgagaaggaagcttaccagcaagagatcctgaaattacgcggcgagttataccatacgcgaatggagcgtgactttttaaaaaaattaggggccgtatcgaagaacaatctgccgcccaaaaaacagcagtagttgacgcgttacggcatgactatccattgaaggaattattggcattggcacagttgcctcgggctactttctatgaccgcttgcacagcaagaataagccggataaatatgccgccttgaaggtatttatcaagaagaccttccatgactcatatgagacctatggctatcgccgtattcatgtgatggcacgaaaagccggctttaaatgctcacccaatacaattctacggttaatggggcaattgaatcttagtgtcacactgtattctcgccatactagcggctatcactcctataagggaaaagtaggcaccgtgaacgacaacctgttacaccaacaattcgatgcccaggagcccttcgctgtcctgcacaccgacgtaacgcaagtcagactgcttgaccacagctggggctatatctcggccatcattgacgaggccagtcgagaggttattacagtcattgtgcgcaactctgcgaacaaagaacaactccacctaacgcttgacgatttggccaagaaactccccgctggcgtcacacccatcatgcactctgaccaagggtggcaataccaaacccgtgaataccagtctcaggtgcacgccatgggcatcgttcccagcatgtctcgtaaaggtaattgccatgataacgcaccaatggaaagcttcttcaacctactcaaacgagaacggctcaatcggcaaccaatcaaggatcttgaggaactgaagcaaatcgtagatcattacgtcacgtggtttaatcatgaccgtatttcactcaataaaaatggcctgaccccgattgaatatcggaatcagaccgctgcgtaactaattttccaactgtctaacttttttgttgcacttcactactctgaggttttcattcaccaattaaaataccacgctaaacttcggtaatttccttttccttagctgcagcaatttcatcgatgcgtttggttgcatcgtcagtggctttttgcatatctttttcaagtcgatgcaattcgtcttcggtgatgtcaccgtctttttcctgtcgctttaacttatcaagtccttcacggcggatattacgaactgcgattttggcgttttcagagaacttgccgacttctttggcaatttccttccgccgttcacccgtcagctgaggaatgaccaaacgaatcacatcgccgtcattggcagggttaatgccaagatcactggcgttgatagccgtttcgatgttcttaagtgatgatttgtcatatggactaatctgcaaaacccgtgcttccggaaccgtgattgccgccatttggttcaatggcgttggcgcaccgtaataatcgaccgtaatctgattaagcaagctggcattagcacggcctgcacggatgttgcctagttcacgctgtaatgattcttcggttttacccatattgacttttgcttgttcaataatttgatttgccattagcttctcccttcgattgtggtgccgattttttgaccttccacaacccgtttgatattgccgggctcgtttaagttaaagacaactaagtcgatatcgttgtccattgacaaggtgctggcagtcgagtccatgacttttagatccttgttgatgatgtccatgtgtgtcagactctcatacttgacggcattggtgtctttatttggatcggctgaataaacgccgtcaacattattctttgccatcaggataacctcagcgccgatttctgctgcccgtaacgctgcagtcgtgtcagtgctgaagtatgggttaccggtgccgccagcgaaaataacgacgcggcctttttccagatggcgaatagctttacgccgaatataaggttcggcgatttgccgcatttcaattgacgtctgaacccgagtcggtacaccttggctctccaggttatcttgcaaagccaacgcattcatcaccgttgccagcatccccatatagtcggcttgggcgcgttccattcccatctcggcgccggtttcaccgcgccagatattgccgccaccgcacacaatggcaatttgtacacccagttcgtgcacctctttgatctgttgggcaattttggcaatgactggtggcttaatgccaaacccagcctcgcctgccaatgcctcaccgctgatctttaaaatgatccgtttatatttgaccatgtatcttatacctccgttggttgctggcactattttaccatagtcgcagagtttctgcggcaagaagctgttgctaaccgctaagttttaccggcaattcggctgaatatcaaaaacattcataggctgtcactgtcaactttttctcagttttactctaataggtaaactccaatagtctgagctggctattcgtcctcacataacgcgctcccccgacgcaaaagtctgcgtgtaaggacctcagtcgcaatggccaaagaccggccatcacgcctgaggccacttacactccgacttctatccgcgccggctcgcgctcagccataacgcgctcccccgacgcagaagtctgcgtgtaaggacctcagttgcaatggccaaagaccggccatcacacctgaggccgcttacactccaacttctaaccgcgccggctcgcgctcagccataacgcgctccccggcgcaaaagtctgcgtgtaaggacctcagtcgcaatggccaaagaccggccatcacgcctgaggccacttacactccgacttctatccgcgccggctcgcgctcagcaaaaaaaagacgctgccacagagacagtgcccttttcttgtcattaacccttgatctggtccatgacttcatctgcgaagttttcttgtttcttttcaatgccttcgccgacttcataacgaacgtagcctttaaccttgccgcctttagccgcaacgtacttggcaactgtctgatccggatccttaacgaattcctgatcaaccagtgagatttcactcaaccacttgttaacgcgaccttcaacgatccgcggaacaattttttccggcttgccttcgtttttggtttcttcagtgaaaatgtcggtctgatgttgtaattcatcagctggcactttactacgatctaaatattcaggattgatcgcagcaacatgcatagcaacgtctttggcagtggcatcatcggcgccatccaaaaccgtcagcgctgcaatttggccaccattatgcaagtaggcaccaaaatgttcattgtcggtcttggtcacaatctggaagcgccgcaagctgatcttttcaccaataacactggtcaaggcgatggcaccttcatcaatggtctggccgtcgctcatcttggtggccttggcagcatcaagatcagctggcttattagcagcaatcgcagcagctaccttgttaacatagtctttgaactgatcatttgaagcaacaaaatcggtctcagagttaacttcaacaattgcggcagtattgccgtcaactgcgatttccgctaagccttcagcggcgatgttgccactcttcttagccgcttttgccaagcctttttcacgtaagacatcaattgccttatccatatcgccatcagctgcaaccaatgccttcttagcatccatcatgccgacttgggtacgatcacgtaattctttaacttgtgcagcagtaatttgagccatggatctgatcctccttgattgtaaaaaagctgcctgcagatcttgcagtatgcgaaaccctcagacagcttaatgtttaattaattagttagcgcgcttgttgtcgccttcgacagcttccacgatatcttccatggaatcagccttcttgtcggcagccggttgttgttcctgatcatcttcttgatcttcgccttggttaccttcaataatcgcatctgccatcttggaagtaatcaaacgaacggcacgaatcgcgtcatcgtttgaagggataatcacgtcaatgtcatcaggatcggtgttggtatcaaccatcgcaacaatcggaatgttcagcttttgggcttcctgaacggcaatcttttctttgcgtggatcaacaatgaacaatacgtcaggaatccgtggcatatcttcaatcccgccaaggaacttctcaagcttgtcttgttgcttcttcagaagagaaacttctttcttaggaaggacatcaaaagtgccatcagttgccatcttcttgatgtctttaagccgtttgattcgagtctgaatcgtgttccagttggtcaaagtgccgccaagccagcgatggttgacgtaaaattggccggcacgggttgcttcttcggcaatcgcatcctgagcctgtttcttggtcccaacgaacaggaaaaccccgccgttttgtgcttcttctttaacgaaattgtaagcatcgtcaatcatcttaacggtcttttgcagatcaatgatgtagataccgtttctttccgtaaagatatacggcttcatcttagggttccaacgacgggtttgatgcccgaaatgtacaccagcttcaagaagctgtttcatgcttaatactgccatgtgtttgttcctccatttggttttattcctcttgacgacgtcgcctcgcagatggacttcaacagaagcaccccactcacgatcagtcagtcaatgtggtttgtgcataccgcactcgataaagtataccgacttttcatcactttgacaagccctgccacttgacatgatgcgccgacaaaaaaagttctttacgacggcggctctgatgtttaaaatgccattccgccgacagcgcttcgtgtttgtccgcaaacgcttcatgatacagtaagcgcacggggcggcgagaagccgtatacttggctcctttgccagcgttatgtgttgccacccgggctgccacgtcatccgtaaacccgccataaaacgtcccatccgcacatagtaaaacataaaagtaatacggtttagtcgccatgtaacagcctcctgacaaacggcgtataaccgccatcagcttcatgaacaatcagcggtggcataatccgcaaaccatccggacgaccggctttaatcgcggcaatcaagaccatattggcttcccggtcttcacgcggatgaatgaattgcagctgtttaggtgccaatccgaccgcggtcagcgttgccaataactcagccagccgatccggacgatgcacaaagtaggctttcccttgatatttcaacaaatcagcgcttactctcgccaccgttgcaaaatcagtcgtcaactcatggcgcgcgatggccagatgatcattaggattcgtaatactccgggcactgatcttgaaatatggcggattacaggtcaccacatccactgaatccttggccacaaacttggtagtgtccgccaaatcaccttcgtggacgtcaacgttagccaatgcattcaacgccacactgcgacgcgccatgtcggccagccgcggctgcaactcaaccatggtcacgcggttatccgttttacgcgccaagaaaagccccaccgcaccattgccggcagccaagtcaaccacccgactgtgccgtttaatctgggcaaaatttgccaacagcaccgcatccaatgaaaaagaaaaaacggccccgctttgaataattttaatgtgccgactagcaagcacatcaacccgctcaccaggcaataatgacatctccaacacctttttcctaaaaagctaaaattcggcaaacagccttccgtgaatcgcgataacagatgaaatcatagcacacacaaaccgccactagctacagcttttcagtctggtggttcgcgctccattataaaacgggaggaagccaatgctaaccgattaatggtataatctacatcaaaagtttaaccacgaaggaagaataagccatgttttatagttttctgcgttacgtcgttgccagtttaatctggctcataaacggacactctcaaacccaggagaaacaggaattgccggatgggccgtttgttctggtcgcgccacatcgttcctggctcgatccggttttcctcgcacttgccgcttggccgcaccatttttcatttatggctaaaagtgaactgtttaaaaatccattgctccactggctactggtgaaagtcggggcctttccggttgatcgggcgcatcccgggccgagtgcgatcaaggttccggttcgcgcattgaaacaggaaggcaaagcgttgatgatctttccaaccggttcgcgctattcggcagatatgaaaggcggcgcaattttaatcgccaaactggcaaaagcaccgattgttccagcagtttatcaaggtcccgggacgttttggtctctgtttaaacgcaaaccgattatcgttcggttcggcaaacctgttgatccgccaaaaggaaggctgactgatgaagcgcttgctgctttcagcgacgagctacaggaaaattttgctgctttggatcatgcgattaatccccattacaaatacgttcctgataagaaaaagtatctggaagaaaaagaacacggagaagtataaggttcgcttgtcgagcctttttcctttgttaccaaataaaagaaagcgagtaagttaatgaagctttggaaacaaatgacccgcaaaccggatttgcaagctgctcttaaagccgatgacttgttgacccgcagcctgacaacccgcgacttgattgcacttggcattggcgccgttattggtaccggtatttttattttacccggcaccgtggccgcaaccaccagtggcccggcgatcacgattgcctttattttggccgccatcgtatgctcactggctgccatgtgttatgccgaatttgcttcggcgctgcctgtcgcaggttcggcttatgcatatggcaatattgtgtttggtcaggtattcggctggattatcggctgggcattgattcttgaatatatgttggcggtagctgctgtctcgactagtttctcagcttattttgccagtttgctttccgggtttcacatcacgctgccgactgctattgccggtccattttcacctagtcacggtacgtacattaatctcattgcggtgatcgttgttttgctgatcggcatgatgctctcgcgcggcatgcagtcatcgatggcgattaaccggttaatggtactggtcaagttgctcatcatcctaattttcgttgtcgttgggttcttttatgtgcagcccgccaattggcacccttatatgccgttcggggcaaaaggcgttcttgccggagcggccttggttttctttgcttatctcggctttgatgcggtatcggcctcggcacctgaggttaaacagccgcagaaaacgttaccccgcggcatcatcggtaccttaatcatcgcgacaattttgtatgttttggtcgccattgtcttgacaggcatggtgccgtttaccaaactggacgtagctgatccggttgcttttgcgctccgcgttgttcatctacgcggtctcggcgggttcatttcggtaggcgcgctggctggcatgttcaccatgatggtcaccatgatttatagctcatcccgcctgatttatgcgatcgggcgtgacggcttgttaccacgctggttcggtcatgtcagcgggcacttaccggaaaatgcgctgtggacagtggttacggtgattgctttgatgggtggcttggtgccgctaaatcagcttgtcaacttagttaatattggaacgttaattgcctttgcgtttgtttcaatcggcatcatcccccttcgtcgccacgaagccattaacaatcagggctttcaggttcccggctatccggtgacgccgattgtctcatttctcttttgcttgttgctgatgacccaactaagtgccgagacgtggctgatgagtctggcttggtttgcgtttggattagtcatctatttcagctacggcattcgtcacggtcacgtgtctgaagccaaaatccggtaaacgttaaagaaaggataatgaacagtggtcaataatcaaacggcaacctgccttgttgatggtcaagtttacgcgatcagtgatggccttttcttaagcgatcttgaaaccaaactggtcaatatcattaaaaacgactatccgcgcgcgaccaaaaacagcttcatctgcaatgcgcatctattaaattaccgacttgagcgcatgcgccggcaacaacgccaggatgaacgggcacatgaaaagatcaatcgcaaaatgtcgcaggctttggttaaagatgattttcagctgactgatgtttatgacaacatggagtccacgatcacatttggcgaacggattgccgatgcggtggccaaatatgccggttcatggccgtttatcattatcttttccagttttatgattgtctggatgatcctcaatacggtcgggattttcggtaaacggtttgatccgttcccgtttattctgttaaacctatttttgagtatggtcgcagccttacaagcaccgttaattatgatgagccaaaatcgggcagcggagtatgatcgcttggaagccaaaaacgattaccatgtgaatcttaaatccgaagaagaaattcgcctgctgcattcaaaactggatcatatcattgctgacgataaccctaatctgttcgaaagccagcgcctaaccgtcgaagtgttaggcgaaatggttaatcagctaagtgaaacgcggcagcagctggccttacttaaagccagtcaagacgaggcaaaccgtacgcaacttgacacgaagataaaaaaatagaacatccgctactttgtgcaaaagccaaaagtagcggatgttcttttatatctaagctgccattaccgcgatgcttcctcaccctcgccaacttgcaggtgatacatttcgtaataccgcccatgctgtgcaagtagcgattcatgtgtgccgcgctcgacaatgcgaccggcatctaagaccaaaatcaaattggcatcctgaatcgtggacaatcggtgggcaatggcgatggtggtgcgaccttgacgaatccgccgcagtccttcctgaatcacggattcggtttcggtatcaatgtttgccgttgcttcatccagtaccagaattttaggatcagtcaccaccgtgcgggcaaatgaaatcagttgacgctcgccactcgagaattcacttccgccttcaataacccgcgcgtgataagtgtcgggcaatttattgatgaagcgatcagcctgtacaaattccgccgctgctttgacttgctgatcggtaatctgatcattaaacaggcgaatgttgctgctgatatcgccgtaaaacataaacgaatcctgcaagactaagccgagctttttgcgcaactccggcatcggataatcgcgaatatccacatcgtcaatcaaaatctgtccttggccaaactcgtaaaagcgcatcatcacattgataatcgagcttttcccggaaccggtatgaccgactaacgccaccgtttcgccaggattggccacaaagctaatatcgtgcagaatgtcatgttcaccatcataggcaaaactgacatggcgaaattcgattttgccttgctgaataacggcatgtgcatccggatgttgtgcgggcgcgtattccttgctgtcaagaatccggaaaatgcgactgccggcaacaacgccatcctgcagaaacgacaggttatccatcatgttaaccatgggattgaagaaattggcagtgtaagtggtgaacgcatacaccaagccggcctcgacatagctatgcatggaaatcaggccaaatgcccacaaaaccgcaatcagagccagtgaatatagaaggttaatcaccgaggacagcaacagcgagtttacgcggatcatcgctttgcgggcatcgagatactcctgattcgtcgcttcaaattcccgactaatgcgattctcctgccgaaattgctgaataatcgcaatgccttcaatcgattcattcagttgggtattcagctcagacaatttttcacgcatgtggcggtataccttggaactataagtgctgtaataccagaccactactaacagaatcggtaagaatgccgcgaccaacaaggcaattttaggattagccgcaaacataatcgcaaagctgctgatgaccgagaataacccgacaatgacggccaaaatcacattccaaaagtcggaaaaagtcatggtatcgttggtgactcgcgatacgatcgagccagccggcgtttgatcgaaatagcgcatccccagtgtgtgcaatttagcaaacagttgccggcgcgcatcttccagtccacgttcagcgcccatgttgaacaagaaggtttggaagaactgaaatacggccttaaccagagtaccaaatgcataaagcaccgcaaacagcagcagaatctgaaccgttgcactttgatttgccaaataacgatccatgaaaacctgcagaatctttggcaacagaacattcatccctgccagtaacgccgctgcgacaattgcgccgataaattgacgtttatacggccgcgtataacccatcaaccgccgcataatttttagctgttgccgaaccggaatgctttttgaccaagcgctttcgtatcctttacttgccacgcatttcaccttcttccgctgcttccatttcctgcttagcccacatttccgcataccagccatgcttagctaataactgtgcatgagtgccgcgttcgatcacttggccattttccaacacaataatttcgtcagcatgcatcacggagctcaagcgatgagccgcaatgatcgtggttttgtgcgcccggtcacgtttcatgttggcaaggatctcttcttcggttttggcatcaaccgccgacagcgcatcatccaaaatcaacaattcaggcgcattaatgaccgcccgtgcaatcgccaaccgctgcttttgcccgccggataaactgacccctttttcaccgaccagcgtttcatagccggctgtaaatttctgaatatcatcgtgcacggcactttccttggccgccttttccacttccggctgacccttttcaaacgccgaaaagcggatgttgtccgcgaccgtggttgaaaaaagaaaattatcctggggtacgtagccaattgaatccagcaatgcatccagcgagtaatctttgatgttgtgaccgccgaacttgatgaagccgtcgtagttatcgaattcccgcaataaaagcttaaaaatcgtgcttttaccggcaccgactttacccacaatgcccagcgtattgccttctaataaggtaaaatgcacccggctcaaagccacttgctgatcattagggtagctgaatttgttaatctgataccgaatatcaccatgtgccggtgtcgtaatggcatctttggcttccaaaatcgtggaacgttctttaagcaagtcgtccacgcgatcatagctggcattaccacgttcaagaatattaaatagtcggccaattgcaaacatcggccacaccaaagcggaaacgtacgtcacaaacgaaaccaactgcccaatcgaaatttggctgtgcaccacttgccaaccgccataaataatcgtaatcacgtaagtcagtcccatgatcaaactggtcgtcggatcaaacaacgcatcaataaagttaacccgccgattaatctgaaccgtgtgatcgacaatgcgattgaaatcagccgtgtcctcagcctcttgcccaaatgtcttaatgaccttgatgccactgacactttcttgggttttatcattcaaccgcgaaaaagcagcctgcgactccgaaaacgcagcatgcaaccgcgttcccagtttacgggccatcaccgccaacaatggcatcggcaaaatggcaatcaacgtcaagcgccagtccactaccaaaatcatggcaataatcgtggtgccgccagtaataaatgaatcaaataaagtcaaaatgccggcgcccgcgacattttggaccgcatttaaatcgtttgttgcatgcgccattaaatcgccagtacggtgtttttgatagaaggtggcatccattttcataaaatgccaaaacagccgggtacgcaacgtccgctccagcttggccgccccgccccaaatagcgttgcgccaaccatagcgaaacagatactgcgaaatcccggaaaagagcaaaagccccaacatgaatactaagtgactgctagttaatcgcgatttgctcatcgcatcaactaaatcaccaatcacttttggcggaatcaaattaaccaatgcaactaacagcagaaaagtcacacctagcaaatatcgccgccattcctgcttaaaataccaccctaattttttgaaaattcccacaacacttgctccttaaatcaacgttttgatccaggtttaacaaaccggatcagctgtttatgaaataaatggcttacaatttctcataagcttcggcaataatgaacatcttctcatgatagcacaaacatcgccaggacgcgaaaacgcgacgacaaaaaagaattctgtcatcgcgttttcttagtaattacttagcattacgttgggcttgtttcatttgcgccatcatctggttgagtttcttagcagatggtttttgtcccatttgcatcatcatggtacgcagcatctcttcgttcacaggcggattatcttgaaaatacttcttcatatatgcccgtgcgccgaagaatccgcctgctaagccgaccagtaacgcaatgatccccacaagtattgtgactaacaatgtgcggcctccttcaagtttcatttctcattgtactaaagcgcttcgatgttgaaaagactaatcttcgcgccaaccgtgttcgcgttgaattttttgaacctttttgctcgtgatctcatggccttttttatcaaagacctgggtatgctcgatttgatcacgcaagcccgcgcgaaaatcttttaaataagcttcacgcaatttttgccgctcgattttctcttcaggcgtcaaacccacgctccgatcttttttggcgagttcattaattcgatccaatcgttcttttggttgttctgccatcgtgctacctcctataaacgttctaaactgcaaccggtactattagaaattagcactgaattaattgccggactttggccttgacactatctgcgtatttccgaccggtaaaacgttcgatcatcagttttggtgcatcctgcttagttcagttgaaccgcggtgtagtgataatgtgcggcctcatgattaggataaggcgcattttgcaacatcgcaacatattctgcggcacgccgctgggatgagaaggcttttaacaactcaatcggcgctgactgatccgcatagtagacaacgtatatccattgatcatccataagccttcacctcgagtctgtagctgggtggcttgaatgatgggggttaaaagggtgcttcaggtgagtttatttgtgtttcaccagcgcgggagcttgcatgtaaggacctagaccacaatgaccaagcttacattccagctgaactggagtcctatgacactcccataacgcgctcaccggcgcaggagcttgcatgtaaggacctagccccccaatggccgcgccctacattccagctaaactgggggagtccctgggggagtcctatgatactcctataacgcgctcaccagcccagaaacctgcacataaggaccttggtcgcaatggcaagccacttttctgttgagcctgagtcctatgacactcccataacgcgctcaccggcgcaggagcttgcgtgtaaggacctagaacccaatggcaaagaacgccattgggttctaggccacttacacttcagctcctaaacgcgccggttcgcgcttccaaaaaaaaagaccgtttccggccttttccatattaacgacgcttttcgcggatacgtgctgctttgccgcggagtgcgcgtaggtagtagagttttgcccgacgaacttggccgtgacgggttacttcgatcttttcgacccgtggtgagtgtaacgggaaggttcgttccacgccgacaccgttagagatcttacggacggtgtaagtagctgaaatgccaacaccgtgacgcttgataacaacgccttcgaacaactgaatacgttcgcgttcgccttcaacgatcttggcgtgaacacggacattgtcacctgcgcgaaaatcaggaatgtcgtcgcgtaactgtttcttagtaatttcttgaatcaatgggttcattggtctttctcctttgccgacattcataatcatcccgaccagcggaatgccgttgatatgtgacgtatcacagtcaataagtttagcatgtccgtcttggcgtgtaaaggtaaaattctttacctactcgcaaagtgtcgatcgtaaagaaatggctgccttgtcaacctacactctttttattggctaaagacacgccattccttaatcaacgtcttgattgcttattgttccttttaaccgcttttccgcagcttttgtcgcttcttccgtcttgacttcacgtaacaagcgcatcgcatcctggtcaaggtcggcagcttgtaaaagatcgggtcgccgcaaataagttcggcgcagactttcctttaaccgccagcgggcaatgagttgatgattgccgttttgcagcacttccggcaccttcatcccgcgatattcaggtggtcgcgtgtattgtgggtattccaacaagccattctcaaaactgtcggtatgggcactttcgtcgttacctaaaactcccggcagcaggcgcacgatggcatcaatcatcaccatcgctggaagctcgccacccgtcaagacatagtcgccaagtgaatattcatcggtcaccaaggtgcgaatccgctcatcatacccttcataatgcccacaaataaatacgagatgctctgcttgcgaaagttcccgtgcggcttgttgatcaaacttcttgccagccggatccatgagaatcacccgtttcggtccgggatgccgctggttaacgccatccatcgcctcaaaaagcggttccggcttcaacaacattccggccccgccgccataaggggtatcatcaacatggtggtgtttatcgtgactatagctgcgataatcaaccacatcaaaatcaagcagatggcgttcaagtgctttaccaatcatgctttcccgcaatggttcaaacatattcggaaataggcttaaaacatcaatctgcatcgtcaatcaacccttccggtacgatgacatgtgcctctttttgctcaaggtcaattgtttgtaccactgattttaggaatggtaaaagcaactcacttttgccaggacgcggaatcacccaaacatcattagggccgggacttaagatttcgctgactttgcctaacgtctggccatgttcatcaatcaccgttaagccaataatgtccttataatagtaactgccttcttcaagtggcttcaatgccgcctcggtcacttgtaacttcttgcctttaaacggtaacacctgattaatatcggtatagtctttaaacgtcagcatcgtgagtcccttatgctggcgaaccgagttaatcgtcaaggctgtcttcggcgtggttgcaacatagaccttgttgccaactttaaaccgctgttccggaaaatcagtcgtcaccagtacgcggacttcacctcgaatgccgtgcgtatttacaatcgtaccaatatcatagtaatctggcattttctcacctctgtgtgctgtcgtttctttcaaaataaaaagaccagcgcaatatgcgccagtctttttattttgcatgcggcgcgtccaaaatattgagccgcacccgtttgctatacgggctttttacactgtatacaatggttcgaattgcctgggcaactcgcccctgtttaccgatgacgcggccgacatcttcaggcgcaacagccaaatcgaaggccatatactcgtctgtttcgtgtgccgtcaccgccacggcttctggtttggtaaccaacggggtaacgatggctttaattaagctgccgatatccaccattaacaaccgcctttatttcttggcaaagcgcgcttcgtgatacttctgcatgatgcccttgctaccaagcaagttacgtacagtatctgaaggctgtgcgcctttttgaagccagttcaaaatatcttcttcatttaactttaaatcgactggattagtcaacgggttgtaatagcccacggcctcgatgaaacgaccgtcacgcggcgaacgtgagtctgctacaacgatccggtagaaaggcttacgctttgaacccatccgctttaaacgaattttaactgccactaagtccacctcctgctcatttatcaaccttgatagcatagcaaaaatattttaagctgtaaagccttttttctttacacaggaaattgttctgattatgaatggaatcgcttggcctttttaagccgttttttcttgttccgcttttgcttgcgaaccatggaattcatggccattttgcctagtttgccggaaacaccgccacccataagtccatcaaggcccttcatattgcctttgctcatttggttcatcatttgcttactttggttgaactgtttaatcatgcggttaacttcaacaaccggacgaccggaaccggccgcaatccggcgccgacgactgggattgagcgaatcgggatcttcgcgttctttgggggtcatggaataaacaatggccttcatatgcgcaatatctttgggatccattttgacgtttgctaaggccttgttattggccattccggggatcattttcatgatgtcttccagcgggcccattttgctgatctgatccatttgatcgagaaagtcgttgaagtcaaacgaattttcgcggattttctcagccatttcctgagcttgtttctcatcgtaggtcttttgcgccttgtcaatcagcgtcagcatgtcacccatgccaagaatacggttcgccatgcggtcgggataaaagacatccaaggcgtccatcttttcgccttgcccgatgaacttaatcggtttgccggttaccgcacgaattgacagcgccgccccaccacgggtatcgccgtctaatttggttaaaacaacaccggtgatatcaagttgctcattgaaccctttggccacatcaactgctgcttgaccggtcattgcgtcaaccacgagtaagatatcatttgggtgcgcaagttctttgatgtttttcagctcggtcatgagcttttcatcaatttgcaaccggcccgcagtatcaatcagaacataatcgtttttgttttctttggcagtggccagcccttgacgcacaatttcaacgggatccgtgtccgtgcccatttcaaaaaccggaacattgagttgtttaccaatggtttgcaactgatcaatggcggcaggccggtagacatcagccgcgatgagtaacggccgcgccttttcattctccatcaaatacttggaaagcttgccgactgtggtcgttttcccggccccttgcaacccggccatcatgataacggtcggaatgtgcggtgccttattgagcggaactgccgcctcgcccatcgttttgactaactcatcgttaacaatttttataatctgttgcgccggcgtcaggctttcaagcacttccgagccgacagccttagtccgaacattcttgatgaaggtcttgaccacatcaaaattgacatcggcttccagcaatgccagtcggatctcacgcatggcatcgcgcacatcgctttcactaaccttacctttacgtctcagtccgctaaaggctttttgtaaccgttctgataatccttcaaatgccatagtatccccctgttatttcgcagtttgatccgcgactcgttctaataatgtacttaaattcttgtcacttggataatgcgtgcggacgtagccgaccagcgcatccaccgcctcattttgtgcctggtagttggcaaaaagatgtagtttctgctcatactcttccaaactggcttccgtgcggcgaatattgtcatacaccgcctgacgtgacacgttaaactccgtggcaatctcgcctagcgaataatcatcaccatagtacaaggcaagataagcatgctgtttatcagtcaataacgggccataaaactcaaacaacgagttcattcgataatttttttcgatttccatgatgtcattcctttaatcccatgattgccggtctatcaactacccggccgctcgaacatggtccttgtataaggataccggtatcatttgaaatggtcaattaacgtttttattttgtgagcgtgagccggcgcgcttagaagtcggagtgtaagcggccttaagcgtgatggcccggtcttggccattgcgcttaaggtccttacacgcagacttctgcgccggggagcgcgttatagaaagtgagccggcgcgcttagaagtcggagtgtaagtggcctcggacgtgatggccgggctttggccattgcggctgaggtccttacacgcaggcttctgcgccggggaacgcgttatagggtgcatgtcgtggcaactgagcccgccaccgctccgccagctcttgctttctataagtgccgtacaaaacaaggtgacttgtagggtatctaatcaggcgcaaactcgtcaggatatgaaaccgattacataatgtgctattatacctttaaatatacgaggggtgaactttatgccaaaaacaacgctaactttaacaagcacagattcaaaaaatattgatgatctaatcgttgcagtgatgcagaagcttgatcaaactgggtacggattcttggcgattgcttttgctcaagagctggcttaccaccagagtgatgccgataagctggcgttgatcaaggaatacgtaacaatccaatagttcgcgatttccagttttcccctatttcgtggtacactgaacatgtgaaaaattggagggaagaatatggtcgcaacctttatttactgggccgtctttgctgttcttgctgcttggggattgtggagtttggttttctcatgtgtttacctgagcaaccatgaaaacggcaacttatggttctttgctattatcaatgccatctttggccttttgggctggttgttcgcatggatcatgagtaacaccgcatggcagcaatactggtttgcaagtaaggttcagccatctgcatggtttacttacctgctgatcggttaccttgtcttgattgtcttgcaggtcgtacttggccgagaaaagcaagtccagacagcttaatcattggttcacgaaacgcaaaaatcgtcacacctcaaactcgggtgtgacgatttttatatgcacgccatttaggcatcaacttgaattagacccttaaatagcccagcgacaaatttagtcggatcaaaggcttgtaaatcatccatcttttcacctaagccgaccagcttgaccggaacatgcaactcattccggattgcaagcacaatgccgcctttaccagaaccatctagcttggtcaaaacgataccggtaatttgggttgtttgattgaactccttggcctgattcaacgcattttgccctgtcgttgcgtccagaaccagtaaaacttcttgtggtgcatcaggtaactcgcgaacaatcacccgcttaattttgtttaactcgttcattaagttgactttattttgcaagcggccggcagtgtctaccagcacaacatcataaccttcatctttagcccgtttaaccccgtcaaagacaactgcagccggatcaccgcctggattcgttgccacaaccggcacttcaacccggcgaccccattcctgcaactgttggatggcaccggcacggaaggtatcggcggccactaacaaaacgcgtttaccttcttctttgagttgatgggccagtttgccgaccgttgtggttttgcccgcaccgttgacaccgacaaataagaaaacggttggcccttcttcggcaaaatgcagctgattgtcctcacctttgcctgcttcaccatacatatcgaccaacttttcaacgattactcgcgaaaccgccttgggatccttagcatttttgagtttcacttcttcgcgcaactcatcactaagccgcaccgccgtttcaaacccgacatcggattcgatcagcatttcttcaagatcctcgaaaaaatcttcatcaaccgttcgaaagttggcaaacagtgcattcagcttttcaccaaaactactacggcttttttccaggccttcatcatatttattttcttcaggcgtctccggttcagtaccggtgaacgcttttttaatcgcatcaaaaagtcccattaacttgtcgcctctttctgtgattggtccaaactaacggccataattcgactcacacccgactcctgcatggttaccccatataagacgttggctgcaaccatcgtaccatgacggtgagtaatgacaataaactgagttgcactggcataatggcgtaggaattcgccaaaccggttcacattaacgtcatccagtgaggcttcaacttcatccagaatggaaaatggcaccggccgcactttgagaatcgcaaataacaacacgattgccgtcaatgcccgttcgcctccagacaacagcgataggcgggttaacttcttgccaggcggctgtgcagaaatctcaatgcccgtcgtcaacagatcatccggattggtcaggctcaaatgcgcgtgaccgccaccaaacatctgcgggaagatagcttcaaatgcactatttgtctgatcaaacatggctttaaatctggttttgaccgtttcatccaattcgtgcattgtagcgactagctgttgtttagccgctaaaagatcatcctgctgcttagtgagaaattcgtaccgttcattaacttctttaaattggtcaatcgcatttaaattaaccggacctaattcatctattcctcgcttcaacagtttcaatttgctcttaagctcaggaatcggggcatgatccgccgcaactgctgctttagctgcttcataagttaactgataatcttcagccaaagtattcagccgcgaatccagtcccagtttcacgcgattaagcgccactgcttgctgttcagaagtcgccatcgcctgatgctgctgatcataagtggtcgtgatcctggctgaaatgtcgcttaattttccgcgattagccgctttttcctgcgtcagcttagtttgatcggctttaagctgcgtcagttcttttttcaagctggcaattgttgcggtccggctttccttttctgcggcagtttccttggcggttgccgtaatgtgcgcaattcgttgttgaaactctgttgactgggtttgcgcatcgatcgcttgcgcctgccattgctgctgctgatcatggagcgtttgcagatcattcgcgatgacggctaacttggtctttaaaccattaacggctgctgcttgcttagaacttgagtcagctgcagcaacagcggcttccttaagctgatcaatcttggcctgcgcatcggcaatttctttggcaatcttttgacctgcttgatgcaaatcagccaatttggtactcaaatcagcctgtgcggtattggcctgttgcgcggctgccaattgccgctgcgcctgccgcaacgtctcagcttgggcattatgctgactggtaatggcagtaagatcggctgctaatgcttgcgcttgagcagtggcagtttgccaggcttcctgagccgcgttttcctgtttcgtcaaggtcgtcaagtcagcttgcttttgcttcaaatctgcaactagatcctgcaattgcgttttgagatggcgcgcttcttgattacgcgccagtggtgatgcttgccggccttgcttaacctggccacccgtcagcgagccgcctgggtttaaaatatccccagcggttgtgacgatgcgataccgatgatgtgttgagttggcaataacaatcgcatgtggcaaggtgtccacaattaacacactacccagcaagttcgccatcacggctttcaaatcagctggatactgtgccagttgcaaccctgttcctaaaaagccgtctgcactttcaactaactgcaaaaccgcacttggtaattcccgcggccgcatcaccgcagccggcaggaaggtcgcccgaccagcgcgttgttgtttcaaaagactgatggcgcgttgtgcggctgcctcatcacgcgtcacaatggcctgcaaattactgcctaacgctaaatcaaacgcttgttggtaagcagatggcacctcaagtaattccgcaaccgctccgatgacacctggtaaggaagctttatgttttaacactacacgcacaccattataaaagccggcataatcttcatttaattcggacaaggtttcgtatcgagcccgcgcgcgctgataagtcgccatctcatcttgataagtccgttgctgatcagttcgtactttttgaatttgtgtcagcttgtctttggcttcttgtgccgccgcttgttgttgatcgactttggtttgaagctgctgctgttgattcaatagtgtattaactttggcttcctgatcctgagcctgtttactcagctcataaattcgacgatcatgagcggcattttgactcgccgccagttgctgatctttttgtaaagcggcctgcgcatttttgttatccgcctgggcttttaacaaatcaatgtaatgattctgcaccgtttccaattgccgattaatggctgccggatcttggctggcttgcttttgttgggccaattgcgttttgagctcaagctgtttggcttgagccgtttttgcttgcttagccaaatccgctagccgctggttggcttcggttaacgattgctgcgtatgggccagacgttctttcaaatcagccagagtcgttgctgcattagccgaccgttcactggataaattagcctcaccgctgagattctccagtttcatcgaacgacttaagacttgatcattaaggtggttcagctgttcttcatactggtgatcaaccgcactcagctgttcggattgatgctccaagtccttaaccttagccgtcaacgccgcaattgttgctttggtaaccttggcctcaccttgtgttttctcctgttcagccgctagctgctcaatttcaagtgccaacaaggtttgatggattcggtgataatcagctgattgctgttggtaatccttggccaacgaggcttgttcccgcaacggttcaacctgatgtttcaactcgacaataatatcgttgatccgcgccagattgtcgtcgttgttagctaactcgcgctctgctttggttttttgctgcttatatttataaacgccagcggcttcttcaatgatgccccggcgttcttctggtttgctattaaaaatggcttcaacccggccttgcgaaataaatgaaaaactttcgcgtcccaagccggaatccataaacagatccacaatgtctttcagtcgcacatcctggttatttaataaaaactccgaagtgccgtcgcggtatagtcgccgcgtcactgaaacttctgccggttgatttttaagataaccatcactgttgtcaaaagtcattgtgactgctgcccgatttaaagcaggacgactatccgtacctgcaaagataacatcacccattcgttcgcctcgcaaactcttggcactctgttcacccagcgcccagcgaatcgcctcggtgatgttacttttcccgcttccatttggcccgacaattccggttaagccggaaacaaaatcaatttcggttttatctgcaaatgatttgaagccattaatgatcaaacgctttaattccatgatgactccattctaaatcttactttttaagacgggccaaagccgccttagctgcagcttgctccgctgcttttttgttcttgccaaaccccgtgcccaaaacgtggccttcaacttcaacatcaacgtgaaattgacgctcatgcgcgggtcctttttcgtctaacaggtgataaacaatcgcgacatcaccattttgctgcaaggtctcctgcaaggccgttttatgatcctgatcggccgaaaactcacccgcatcgattttaggaaaaataatccgcttggcaaacttaatattagcttctcgtccttgatcgaggtacaaggcaccattgaaagcttcaaacaaatcttcaagcagcgtcaaccgttgtcgggcaccggctttttcctcgcctttacctaatttaatataacgatcaaaatgagcttctttcgaaaaagcagaaaatgccgcggtttgcactgccgctgcccgaattcgggtcaaatcgccttccggtttatccggaaatttacggtacaaatagtctgaaaccgttaattcgagcacggcatcacctaaaaattcaagtcgttcgttatcttttagtcctaattctttatgttcattgacatacgaagaatgcgtgaatgcttcatccagtaagctgagatcatgaaactcaatcccatagcgttgacgcaattcgctcacaaactctgaggcaaccatgaagagccctcctttttatcgcactatctaattatactagagcgcaccaaaaaagacacctgcgattgcagatgccttaatggtttaacttttaaaccgaattactttgttgcacggctattacttgtaaccgtcattttactccagttcaggtacttcgctgaagcatagtcaacactcgcattcttcacacgtttattaacagggaagatttcctgacgataaagcgtagggatgacaaatgcttcatcgttagcatatttctgccatgccttcaaagccttagcacggtaggcaggatccattgctttttgactatcaatatcattcagcaacttggtgtttttagcagaaacgaaccgagtgtagttaaacggtgctttctgtgagaacaagtccattggtgaaggatcagaagagaggctccaagcagcagcataaacatcaatacccttggaatcattttgaaccttgtcatagaaggaattaaactcgattggacgaccggttgtcagcttgacgcgcagaccgatcttcttccactgctggatataatcctgtgccaatggttgcgccgttgaaccgtcagccatggttgcaaagtaaatcgttaacttcttgcctttaggatcggttcgatagccatctttgcccttcttataacctgctttatccagcaagctattagccttgtcaatgttcaaatcatagccatcgatatcagcgtgaacatctttaccaaaaacaggtgggatcaatgtcgttgcacgagaccgcgtaccgttatagaacttggccgcgacttgatcgttgttcaacgcatagcccattgcctgacgaagactcttgttggccatcttcgaatttggatcataaacgttttcgctcttcttatcatcccatttaccgagtttgaaaccaaggtaattataagcaaggctttgatgacccagattcgtgtaaccactaatgttcttccagtcactataactgtcggaaggcatgccataaacgatatcatacttgtggttctttaaagctgaggtgattgaagcagatgaaacattttcaaatgtaatctttgaaagactcggcttgcccttccaatagtattggttcggtgtgtattcaacgctttgtccagcgacaactttactgatcttataaggaccaaagaacaatggttgtttacgaaccttatcactggattccagtttgtcaaacgcaacatcatgtaagtaatgatatggcgcagcactttcaaggaagtacccgttcccagaagtgttaaatgacggcttcatctgcttaaagtgaatcaccatggtattaccattatcacccttaggcatcgttaaaccagaaatagtatccgctttgccgtcatgatactcggtcaacccctcaatattctgaagtgattcggtgtaccgctgactcttagtcgctttgttagccatgatttcataagcataaaccaaatcacgggcaacaactggctgaccatccgaccatttaacatttggtttgatagtcaccgtgatggtcttggcactgttgtcctgtttgattgttgcagcaccattattattaaatttaaatgtgctgttatacgcaaacaagctctcagctgccgggctcatgtagtcattatcatacgcatcagtgtatagttcttcgttaaagacccccttaaatggagagtcattgacgacagccacattgacattaccgcctttgattgcctttgcagtgttattataagaaactgggaacttcacactcttattagctgtacttgagctggagttcgagctcttattgccacaggctaccaaggtgattgataaagcggtagcgagcgtgatcattccgagcacagaacgctttttcatactttttcccccttccgcgtcgtcatcgcgatatgtagcgaagcaacgcttcatgtgagttaaatgatagcataattagaacaaaataaccaatgtttcgtcatattttttacattttttcttcaaaaaaaagagccactctgatttctctgagtagctcttcattattttcaggaaattgtcaatgtttcaaccacgccgttgccgcgaatcggctgcccgtcgcatcgcttgaccgacaaaattaattgataacgacaaagttaacagaaccaatactgctggaaaccaaacccaccagcgattaaaaatcaaatccgggtttgacgcgtatccaatcagtgtccctaaactaggagtttccatgggcaaaccaaagcccaagaaagacaacgccgtttcgatcccgatggaactggcaattgtcagcgtcaagtccgtaataatcaaagaactgatatttggcaagacaccggtaaacataattttaaggttcgatgtccctgacgtttttgacgccataacatattcacttcgagcttcagacaacaccagtgaccgcattaatcgcgttgtcgtcatccaataaaaggccgccatgatgagaataatggtgatgacgttgtattgcggaataatagtaaccaaaacaatgatgaccaataaagatggaatgatcatcataaagtcaacaaaccgcatgatgacagcatcaaccaggccgccaaagtacccggagattgttcccagcacaaccccgacaaactcaataatcaaagcaaccgaaatcccgatggtaatcgagttacgggcagcgaagaaaagatacttgaacatatcgcgtccgccttcatcggtaccgagaatatagccgcctgtccccggagccatgtaccgatccaaaatgttgacctcagtagcgccaccaacattaaagagcatcgagccaataaacgcagcaagtataatcgttacagcgagaaaaagcgaaaccacagcaactttatcttttcggaattcattcagaatcaccttgaagttagaaggtgattgttcaattttagtggtatctgtcgccacctcattcgcattattttgcataagctttccccaccttctattcaatccgaatccgcggatccacgatactcatgatgatatcagataacaaattaccaagtaacgtcaagaatccgaatagcaacactaacgatataacgaccggatagtcacggctggtcatagatgatacaaaaagctgtcccattcccggataactaaagaccgtttccaaaataaccgacccgccaagtaacatcgtgatttggttacccataaacgccgcaatcggcaataaggaattacgcaaaatatgtttattgaagataacgcggtctggaaccccttttgatcttgcggttcgaacaaaatcctgatgggtgttatcgataacgccggtccgcagatactgaatcgtactcgatgtcgtgataatcccagaaaccagcgcaggtaaaatcatatgatatatccgatcccagacatagcccaaagtaccgggattataagtggacgacacgctaccaccggtcgggaaccactgaaggaagaacccgaagaaaataaggcccaaaagatagaaaacaaacggcggaaccgccatcaagatgaaggaagcaatcgagatagcagagtcgcgtttgcttccttcataacgacctgcaatcacgcctgcagggattgcaatgacgtatagaataacggttgataacaaagccaaccaaaacgtgttcgccgcacgttcgccgatcaaaccagtcaccgaacgtttgtaaacaaaactttgacctaaatcaccatggaacatattaccgatccacttcacgtactgaatgtaccatggatcatttaatccatactgttgccgtaatgccgccatctgagcagcactttgtccttgcgaaaaattacctgccaatggatcgcccggcatcattttggataggacaaagactaacacactcagtaaaatcaactgcgggatcatgattaagatccggcgtagaattgttttccacattaatcatgcactcccttcatggttgaatctggcagcgcaacgtaatgtgtatcggaaatcttctggagatccaaaacgcggccttctttggaataatatttagattcttcttctttaaaaatgcgttccacttcccggcgatgttccttgttttgcgcgcgatcatcaggattaacatccggaatggctgacaaaagacgcttggtataaatatgttgcgggtgctgataaatgtcttcccgagtaccgatttcgacaaagcgaccacgatgcataatcgccatcttcttacacatatgcttaacaacgcctaagtcatgggaaatgaacaagtaagaaatattatattcttcctgaatccgcttcatgaagttgagaacttgagcttgaaccgacaaatctagcgctgataccggttcatcggcaataatcagcttaggattcgttgccatcgcccgagcaacaccgattcgttgccgctgtccaccagaaaactcatgagggtatttatacaatgcatcgcttggcataccgacaatatcaagtagttcctgaacccgatgccgttcctcatctttagtcagattctgaaaattacgaatcggttcggcgataatgtcctcaattcgtttgcgcggatttaaactagacaaggagtcctgaaaaatcatctgcacgtctttattatattgcagtcgttttcgcacgctgcgtttggtaatatcttcacctttgtagataatcgatccggaagtaaccggttcaagtccgacaatcgctttaccagtcgttgacttacccgagccagattcgccaattaagccatatgtttcgccttgctcaatatcgaaattgataccatcaacggctaacacatgatcagttacacgattaaagaaacccgaacggatcggatagtggatttttaaattttttacctcaatcattgccattattactcaccttttccagccgcttgtttgtcatccgggaaatagaagtccttgtagcaagtacactgaacaaaatgatccggtgcgacttcatgcatggtcggatgttcttcgtgtgccgattccggaatccatggaattcgtggagcaaagcggcatccttccatctgcatattcttcagtgacggcaccacgccttggatcacgtgcaattcgtcatcatcagaatccgcttgaggcatggagcgcaaaagactgcgcgtatacgggtgagtcgggtgcttgaaaacatccatcaccgagccgctttcgacaatctgcccggcatacatcacggcaactcgatcagccgtttctgccaccacacctaaatcatgggtaattaaaataatgcctgaatgcatttcccgctgaatatcttcaagcagatcaagaatttgagcctgaatcgtcacgtccaatgcggtggttggttcatcagcaatgataatcggcggcttgcaggcaatcgcaattgcaatgacaatccgctgacgcatcccgccggacagttcatgcggataggagcgtgctgtccgctccggattaggaatgccgacttgactcagcaattccaaaacccgttgttcgcgttgttccttgttcatcttggtgtggtagacaagcgtctcttcaatctgctcgccaatacgcatcaatgggttcaaagcagccaagggatcctggaaaatcatgccaatatctttaccacgaattcgatcaaaaagcgtttcgtttaagccaactaggtttaggttattgtacaaaatatcaccagtgacctttgtgttacgtggatcatgcaggccaatgatactggttgccaaggtactcttaccagaacccgattcacctacgatcgccaaaatctcatcttttcgtaacgtgatgctgacatcatcgacagcatcgtaaaaagcatctccaagtctgaatccggtgtgcaaatgttgcacatccaataataaatcttcaggtttatccaagcgaactcctcctttgcgccctaaacgcaagattaaaacaagatgagattttcgaaataattgtctctaagtataaagaaattatagtagttatgcaagcgaaaattgcgttcctgcgcgatttatccgtgaattctcccgaaaagccccttcatgttttgcttacaagaatatgcttgcttgacgaaaagaaaaaaggcttagaagtcattttaaaggctcattttgcagttttggaacgccttcaggcaaaataaaaaagccgccatgaatgacagctctttgtacattatttttgatgtgccttgatataatcgacggcatcttgaactgtcttgatattttctgcatcgtcatccggaatttctgaaccaaaggcatcctctagttccaaaacgaattccacaatgtcaatcgaatctgcatcaagatcttctttaaagttcaaactcgggctgatcttatcaggacttagttgaaagtgatcctgaatcaagccggcaatcttttgataaatttcgtcttcactcatactgctcctccattcatctgccaattcagtttacttgtttgctcaaagaatgtctacgctttctcagtagttttcgcttcggcaatttccgggtgggcatcaaagtaatcggcaactttagcaacggtgccgtttttaaccatcgttgctgtttgcaataacgtgtagtagacggtgtcggcatcagcagcgccatgggctttaattaagggtgctttgagccccagcaaaactgcgccgccatatgacgaaatatcaaatgtttgggccatggatttcagattgtttttcaggaacaaaccgcctaatttgccggagacgccgccgtcataaatcgcgccttttagcatatgcatgaccgtgcgcacggtaccttcgatcgcttttaaggtcgcattcccagtaaagccatcggtcaccaccacgtcagccgggccgttcaaaatgttactagattcaacattcccgacaaagttaatccccggagcggcggccaaaagatcatgcgcctcctgatgcaacttatcgcctttgtttgcttctgtaccgttattaagcaagccaacacgtggattagccacgccgcgcacgtctttggcatagtagctacccataatggcatattgcaatagatgatacggacggttttcggcattggccccaacatcgagcatgacaaaccctttcccatcgactgtcggcagcgttggtagcaagcccggacgttcaatggcgcggattcgaccgatgataaacagtccggctgcaagcagcgccccggtggaaccgagtgaaaccatcgccgctgcttcgccttgcttgactgcctgagctgccagtaccatcgaggcttgcttcttccggcgaatggcacgtaccggttcatcatcactattgattttttcggcagtgtgaataatcgttagccgatcttgattgtgaatcagcggcttaatcttagcttcatcaccgtaaagcaggaattctaaattggcatcatggtcgcgggctttttcaacgccggcaatcacaacttcgggggcatgatcgccgcccattgcatctactgcaattttcatggagtttatcggtcctttcgagtttaatccaaactgccttgcatcaagcgactcgcggctaagtatgccgctagcggttgatgctccggtgccagcaagtgaggatcagttttaaaaattttagcaacaatctgttgagccgcttccagagtcggaaagtccccgaccggatcggccactttaaattccggcaaacctgattgcttatcaccaaaaatatcaccggaaccgcgcatttccaagtctttttgagctaacaaaaagccgtcattggtcttggtcatgatttgcattcgtgcaattccttgttcatttttcggatcggcaatcaacaaacattgggcagccttactgccacgccccactcgacccctgagctgatgcagttgggataagccaaaacgatcagcgtcaaaaatcgccatcaccgttgcattcggcacatccacgcccacttcgacaacggttgtggaaactaacactgcaatgtcgccatggctaaaggcgcgcataatttgatctttctcatccggcttcattttgccgtgaagcaaggcaacttgccccacatcccccacggccttttgcatatccgcaaagagctgctcggcgttttgcaaatcaactttttcagattcggcaattagcggcgtgatggcaaaaacctgactgccggcttgcacctgactgcgaatcagtcgataaacctgtcctacctgattcttacgcagccaagtggtcgtaatcggcttccgtccggcgggtagttcgtcaatcgttgaaacgtccatttcaccataagccgtgattgctaacgttcgcggaatgggcgtcgctgtcattgacaagagatccggtttttgccctttctcctgcagaattttccgttggttaaccccaaaacggtgctgttcatcaatgacaactaagccaagcgctttaaaatcaacgcctttttgaatcaaagcatgcgtgccaatgattaaattcaaggtgccatcgcgcaattctgccaacatttcccgccgtttttttgccgtggtcgatcctgttagcaatcccaacttgacaggaaaatcagcaaataatgcctccagtttggcaaaatgctgttctgcaagcacttcagtgggtaccatcagcgctgcttgatagcccgcagtcaccgcagcgtataatacgatagcggcaacaatggttttcccgctaccgacatctccttgtaataggcgattcatgtgattgggtcggcgcatatcggcacagatttcgttaaccacacgcttttgggcattcgtcagcgaaaatggcaaggttgcaatcaacgcccgcaacgcatgattatcatacggaattgccaggccgttattggcattatcgttcagctgtttcagcgcctgaatctgtagctgaaacaggaagaactcccggaaaacaccgctgcgccgggctgcttttgcttcctgcggcgtatccggaaaatgcatgccatggaccagttgttcgtcagacatcagacgatagtgcgcgcggatactagccggaatcaagtcatggatattttgatgatcccgtgcccacgctgccttgattagctccagcaaggtccccatacggacatttttattcaccgtataaatcgccgccattgacggttgattctgagactgggttgccagaatcttcatcccggtaagactgcgccgctgagcatcccacttgccaaaaaccgcagcttcatcgcccatttggaaccgatcttttaaccatggctgattatagaaggtcaccaaaatcacgctgcgttcgacttgcaatttaacgttcacccggctgcgatgcggaccaaagcggctgataaccggatcagccaccacgacacctttaatcgtcaatttttcctgatcagctgcctcagcaagatctttgactttaagatcgtcgtagcgaaacggaaaataaaaaaggacgtcgcccacggtatgaataccgagactggccaatccttcttctcgttttggccctacaccaggtaaaacccgaaccggatccgtgagcgccatcttctacctcctttcgcgttgatgccttaacctcatcacggcatggatcttctgtcagtctcgtaaaaaagtgccccgcatgcgggacaccttggcaagtgaggcaaacgctttattcaaccgaaacaaaataaggataaaccggttgatccccttgatgaatttcaaattcaaggtctgggtgctgatcgcccaccgcagctgcaattgctttggcttcgctttggctggcatctgccccaacaataatggtgacgatttcactgtcagcgttaatcatcttattcaccatcgcaatcgccgcaacttcacgattctgatcggtcacactgatcgttccgtcaatgatacccatccagtcgtggttcttaatagcaagtccattgatggtcgtatcccgaatagcctgggtgatggaaccactgacaacatttggcaattgcgcggtcatttcactttgattcgtcgccaaatcggcatccggattatagccaagcattgcggtcataccttggttaatcgtcttacttttgacaacggccacttcaacatctgtggcggccttggctgcggcttcagcggccatgaaaatattaccgttattcggtagtacgataacatgcttggcatgggctgacttgaccgcatccaaaatatcattggtgcttggattcatggtctggccaccgttgagcacatacgtgacgcctaaactcttgaatagctcaccaagcccctgtccggctgcaatggcaaccacgcccatttcagctaacggttgcgtatcggccttagcatccaaagccccttcacgttcgatgatactttcttgttgcaaacgcatgttatcgactttgatctttaacagatcgccaaactgttgcccgtatcgaaaaaccgttcctggatgttcggtatggacatgcactttaacgacttcttcatcggccacgaccagcgttgaatcacccaaagtattcaggtaattacggaatggctcgtaatcaaagtgtttaaactgatcgccatgacctagctcgaccatcatttcggtacagtagccgtacacgatatcagccggatcaagttgagtctgagcgctttgatgatgcacggcgttgatcatttccgtcatttcttcatcggtcacatcatgtacatctgaactgatttcaccggacaagccttcacggaaaccttcataaatgaaaaccaatccttgaccgcctgaatcaaccaccccgacttcttttaataccgcaagaagatcgggagttttggctaaagcacgtttggcgcctttaaccaccgcggtcatcacgactaaagcatcgtccgagccgttagccgccttcagccccgctttggctgcttcacgcgcaaccgtcaagatcgtgccttcaaccggcttcatgaccgctttgtaggcagtctccaccccgtggacaaaagcatcggccaaatcctgtgcgctcagattcttcttaccttcaacgcttttggcgaatcctcggaaaagctgcgaactgatcacgcccgaattaccacgagcacccatcagcaagcctttcccgaggcgtttagccagcgcaccgacagcgtcttcatttgactccaatactgctttggcaccggtctgaaaagtcagattcatgttagttccggtatcaccatccggaaccggaaaaacgtttagtgaattcacaaattcagcatttttattaatacgatgtgcggctacccggatcatgtcctggaatttagtcgccgtaatttcggttactgccacgaaacatcctcctcgaagaacttcattatctgatcaccgtcgcaaaacggtgcgttaacgtcagtcgcctaataccttgacgccttggacgatgacggtcacttcatcggttgtgacccccaacatcgtttcgaggttgtattttactttgtcttggacatttcggcaaacttcggatattttggtgccataactgacaatgatattcacttcgattttcacgccattgtcggtttgacgtaccacaacaccgcgcgcataattctcgcgcttcaaaatatcattgagattatcccggatctggttacgactggccatcccgacaatgccatagattgacgttgccgcaccgccaaccactgttgcaatgacactattggaaatgtcgataatcccatatttggttttgatcttgaccgccatgctgtatcctcctagccattaacgatgctattttcaccgcatacaattctaacagatagtttagcatagggaagaagtcattaaaagcgcgcacgattcgaaaccacggtcgactaagctaatcatgctgcctgtcattgcttccctgatgacctgacacaaaaagatcctgacaatgaaggatgcatcacattcattgtcaggatctttttaatcgttatgggatcaaacccgggtcactttacctgatttaagggcacgtgcagaaacccatacccgctttggtttaccatcaacaaggatccgaaccttgtgcaggttggctttccattggcgccggcttgaattcaaagcgtgagaacgcttgttgccaaacgtggtatgacgaccagtaataacatctttagccacaatatgacctcctttttttcaaggtcaccctcgaatttttcactcaactaacttatcataggcccgcggtgaatgcaagaagttttgcaaagtaaaaatacttgacaggctttaaacaacagctcaatctgctcttttttccgaccttaccgcgttaattatcgactttttgtccgcggcgatcgcggctatagacaatcgcgacgacaccctttgtccagctcaccgtaaatggtttagtcccgacaaattcattggaagcccacgaaaatggcgaagcattgtcccacgcctttaacgggtacttggcgccagtaatcgtcaggtcggtgataggggttaaattgacaactgccacatagcgataatctggcagcggttgaatttcatggacacccggggcatagtaatcgacccgattctgcacatccaaaaggtgaatgcgttcaatcgcgggtaggaatcgcgactggagcggcaaaaacaaattggacaagaaatgatccagtcgcccaccggttgcccccagtatgatcacgttaccagtcgaaaaacattgtaaagcagctttgacggcaagctctgtatcggtatcatctttttctgaagggacttgccgaattttcttgacgtgttcacggacggcgcgtaactcgctcaaggttaatgagtcaaaatcgccaactgccagatccggctgaatgcccgcttcaacaagatgcaaggttccccgatcgacgccaatccatacccccggcaactcttgccagtcagtcggtaaatcatcatgcgggccgccagccatgatattgatagttgtcattgaaccgcctcacgtaaagatgagatggccgcaccgacatcactggcaccaaagacgtatgaaccggccacaaaaatatcggtccccgcatctgctgcagctttcacggttttggcattaatgccgccgtctacttcaatatcaaaatgcaacccgcgatcctgacgtaattgatgcaatcgggcaactttatccaccatggcagtcaaaaacttctggccgccaaatcccggattaacggtcatgaccaatacctgatcaacaagcggtaaaacttcttccaaactgcttaaaggcgtgcccggattcaccacgacccccgcacgcaccccggtcgctgcgatatgctgaagaacgccatataagtgatcagtcgcttcctcatgcaccaaaatcgtatcggctccggcttcggcaaaggcaggcgcccacgctgctggatcactgaccattagatgaacctctaacggtaagttggtaaccgggcgtaatgcctgcacgactaatggaccaaatgtcagattagcgacaaaatgaccgtccataacatcaacatgcagcaagtcggcacctgcctgctccactttttcaacatcacgggctaaatgagcaaagtcggcgcttagaatcgacggggcaattttcatgagaatccctccattttaaaagatgaactactttttcttatacactgggcgcttgccacttaattcttctcgaaactgtaaataattttcatagcgactggccatgatctttccggcatccaatgcggctttgacggcacattgcggctcgctgacatgctgacagccccggaatttacagcgcggggccaaggcaacaaattcaggaaaacgatcccgcaagtcatcaagcgtcacatccaacaaaccgagtgaagaaaatcccggcgtatcagcaactagcccgccatgaatcggatatagatcggttgtgcgcgtggtatgcttaccgcgatttaacgcccgactaatggttccggtagccaaatccaaccccggtaccaaatgattaatcaaggtcgacttcccggcaccggtttgacccgtaaaaatagtcagcttgtcagcaaaactagcctgaacttgatttaacgtggcaggatcaaaggctgcttcgggcatgaaaaccgcatacccgatggcctgataaccggctaaagcttcttcaatttgcttcaacagccgtccaggcgccaagtcggttttggtgaggtaaatttcggcatgaatcgcatgcccttcaagataaaccaaaaaccgatcgagcagattcaacgaaaaatccggttcaacggctgagacaatcaacaaagcctgatccacattggctactggtgggcgcaccaacgcattgtgccgtggcagtatccgcaacaaatagccttcatcatcaccttgacccggctgaaatacggcaaaatcgccaactagtggcgtgatcttgtcattccgcaggcttccgcgaccacgagtgcgataaatcgcaccatcaactgcaagatcataatacccgctgatttgtttgataattcttccggttaattcttcactcattgtgtaatattgtactcctgtgcgacaacggtgccatctcgtaccacccgataactacccggatacgtcttgttgacttgcaaggtaatggtgacctgattatccgcggtaatattaaacgtcttgttaaccgaattaatgttatgtgtcttatcgccgatgaacacctgaaccccgtttggcgtcggtccactgctgctagcactgccactactgcttccgctgtcgctggatgtgcttgaagatgccggcgcctgataagggattgaaatggttttggtaacggttttgagttcatcgggatccggaccttgagaaatcgtcacattgaccgtatcgcctgcgtgaacctgcgtgccagcagccggattctggctaattaccataccggtatcaacggtgtcggaatgactctgagcaatcacaatcttaagtccgacctcatttgcgtagtcacgcagactcttttccgtataaccggtaagatcccgcagtgcaaaggccgtattgactttcttaatcggctctgcaacatcaaacgtaatcgtggttttacttgcaatgacttttttgccgggtttaatgctttgtgccgtgatttttccggctgcgaccgaatttgttcggaccactttttccttgacggtaacaccgcgtttttgcaaatcggattttgcatccgtataatcctgaccgacataattatccaaggtaatgcgcggctgtccgcgactcagtatcagatcaaccgccgagccttctttgacactgacctgccgcttaggactagagtctataaccagatccctatcgactttggttgagtaagtatagcgatactttccgaccttcaatcgcgaactggttagtgccgttttagcttgcgtcttggtcatcccgcgcaaatcagggaccgtcacatcggctttttgattggccgtcaccaatccaattcctaccagtattaacatcacgatcaaggcgctcaggccgatcatcaaccatcgccgtcgtttcttcttagcctggccatctggtgaatggtgttcagcaggttggtctgcgtgatcgtcatcatcatgcggtggcttggggccgttgggaatgaccggtacaatgcgcgtctcatccaaatcatcttttggaatcacatacttggcttcgtgagcccgggcaggactgagcgccgtgctgagatcgcttgccatggcgtcggcacttgtataccgattagccggattcttcgccgtggctttaaaaacaacattctctagtgcctgaggaatatggggatcaaaggcgcgcacggatggaatttcttcttgaaaatgtttcaacgcaatcgaaaccgccgagtcgccttcaaacggcaccgaaccggttaacatttcaaataaaataataccaagtgcataaatatcgctttgccgtgtgggcatactgccgcgtgcctgctccggtgataagtaatggacagagcctaacagagagttggtcatcgtcattgaattttccgataacgctaccgcaatgccaaaatcggtaatcttggcgttgccatccggatcaatcaaaatattttgcggttttaaatcacgatggataatattgtggtcatgcgcggtctgaacggctgacaagatctgttccatcatatcgacaacgcgttgataaggaatcgggaagtgttcaacgatatagtgtttcaaatcagagcctttgacatactccatcaccaaaaactgttggccgtgactttcacccacatcataaatcgacacaatattgggatggaccaattcacttgtcgccatggcttcacgctgaaatcggcgcaccgtatccgggtcattttgaagatcgagccgtaaaactttgaccgcaacatcacggtcaaggatcagatcgcgtgccaaataaacgttggccataccgccttcgcctaacgttttgatgagcttatagcgttcatttaaaatcgtccccggctcgatcatgacggttccctccgatcctgatgaatgatcaaagcagtgatattgtccggacccccggcagcattagcccgtagaattagctcctgggccttgctgccaattggcatatcctgacgtaaaacagccgcaatggcttcattatcgatcatattcgttaacccatccgagcacagcagcaaataatcatcaaattccatatcataaattgtcacatctgcgtcaacatcgctgctaactcccagcgaacgggtgatcacgttgcgttggggaaaacgtttggcttcttcaggggttaattcaccatgtttgaccaattcgttaaccaaactatgatcctcggtaatctgaaccagatgcccgttgcgatataaatacccgcgcgaatccccgatattggcaacgacaaaacgggtaccgctgatgatcactgctacaaccgttgtacccataccagataagtcagtatattgtttagccttttgcagaatcatgtcattttcctgctgcaactcaaaaataagccagcggacgatggactcaatctcggcagtgtcggttttctcaaaagcatagccgagatgggaaacggccatttcactcgccacgtccccgccgcgatggcctcccattccatcagccactaaagcaagggtggcctcagactgattcttaaagatgccaacataatcctggttatttggccggcgccgaccaatatcggtgcgataagcaaactccatacatacccctcatttacggcgaatcagactggcgatgaaaaagccatcggtatcataatcgtcgggaaataattgcaaagctggtgcgccatgcgttttggcaagtggttttagcgtcaaaacaggtacctgttcgaactcgggatgcgttgctaagaagtgggccaccacatcctggttttcctcttttaccattgtacatgtactatacgtcaagcggccaccgatttttaaagtaggtgcgacactatcgagaatcgccaactgaattttttgcaggtgttgcaagtcttcaggctgttttgtgtacttgatctcgggtttacgccgaatgagccctaacccggaacaaggtgcatctactaagattttatcgaaagactcagcagcaaagttagccgcaacctgacgcgcatccatcacctgtgccgccacgcgatcatcaaggtctaaccgcttagcattttgttgaatcaagcggactttattggcgtgcagatccaaggcagtgacccgcccgccttggtcaggatccagatactgggcaatgtgcgtggttttgccgccaggagccgcacacgcatcaagaacctgatcgcccggttgtacatccagactcggtgcaacaagcatcgagctttcatcctgcatggtatacagaccgtcagcaaattcccgggtgccggctaaatgcccccctggcgcaactagtccaactggcgtgagcggactttcttttaacgctggaaattgcggctgcaacgccttcaataaagctgccgccgttgttttcgttgtgttgacgcgaatcgaagcatgggccggctggttaatggctgctagaatcttggcggtctttgtctcgcctagctgtgcttgcagcttttttaccagccaaaccggcgtactgctggtaatcgccaaacgttgaatcggatcagcaattgtcatcggatcagggtacccactgcgctgtgcctgccttaaaacaccggtcacaaatttagccaccccttgatggcctaattttttagcgatttccgtactgtcaaagaaaaccgctcgtgccggcactttatctaaatactgcagctgatacaccgccgtctgcaacagacaacgcacccaagtatccaattgtcggtttttaacaaacggcgccaaaagataatctagcgttaattggtgctgaatcacgccatagacaacgtttgtcagtaaaccggcgtcacgcgaatccagctgatatttggtgatcacgtgatcgagcgtcaggttggaatagccgcctttacccatgacgcgggttaaggtttgaacggctaacagtcgcggattattcggggtcatcggtgatcacctgctgtcccacggttaaatcgcggccagggccgtttaaatagtcggcaatatgctgtttgcttttcccggctggctggagctcatcaatttgaaaggtgctctgttcgcccgccgcgatgacgagttgatgcttgctgcgtgcgaccacgctgccagcaggcaagtttgtagtcgcggttaatggtgtgatggcccaaagcttggttcgttggccgttcatataaacatacccgccgacttctggccgcaagccgcggacccattgatccaatgcttgcgccgacaagtgaatatcaaggtgctcctgctctttggtgatggtcggggcaaacgtgactttctcgggatcctgtggcgtacgggtggcggtttggtcaataatcttcggcaaggttgccaataacaaatcacgacccaataaagataatttcgcaaacacagtgccagtatcgtcttggcgggttaacggcaacttcgcctgcgcaaacatatcgccagcatccatcttcttaaccatttcgataatggtgacgccggtttcagcatccccgttgataatgctgtactgaatcggtgcgccaccgcgatacttcggtagcaacgaaccatggacattcacagcagcaattttggctgcttgtaaaaatttggtcggcaaaaattgcccgtacgctgctgtcacaataagatccggcgctaaggcaatcgcctgcgccagctcaggactgccgctaagcttttctggctgtaaaaccggaatgttatgagcgacggctgcttgcttgaccgggcttgcggccagtttctgcttacggccgactttacgatccggctgcgtcatcactgccaccacgtcataatgctgggcaatgagtccttcaaggatcgggacggcaaaatcaggtgttcctagaaaaattactgaagtcatgttttcctccaaacgatcgattcgatatgatgcgtgatacccttcgttgacaacaacttcaaacaaatgatagcggttcgggatcaatggttacctgaaatccttgccggctgctttgttgcgtctcttcaagaatatgttgcaaggttttggctaaggccggttcatgtttatattttaaaacgatctgataaatatagcgattcttcaagcgtgcaatcggtccgggcgttggtccaagcatgattacctgatctgacagctgtgcgcgcaattccttagccaaggaaaaaattgccttcgctgcctgcgtctcatcaggatgactaaccccaatcttagttgaaaagaaatatggtgggtagttgccttggtggcgcactgccatctcctggcgaaagaagccttcgtaatcctgacgtttggcatactgaatggcgtaatgatccggattaaacgtctgcacaaacacttcgccgggtttatcggcccgccctgctcggccacttacctgagttagcaattggaacgtcttttcactggctcgaaagtccggtaatcccagcgatgtatcagcattaatgacgccaaccaaggtgacatcaggaaagtccaaccctttagcaatcatctgggtgccgagtaaaatatcggcttgatgagcgccaaatgcattcaaaatccgggcatgtcccccttttcgccgcgtggtatcaacgtccatacgtaaaatgcgcgcgtttgggagtaacgtctgcaattgagcttcaactttttgagtgccggtgccataatagcgaatcttgtccgatccacactgcgggcagcggcgcggaattgcttcttcatgaccgcaatagtgacattttagcgtgtgcgtatccatgtgcaacgttagactgatgtcacagttaggacactttgcaacgtaaccgcaatcgcgacacatcacaaaactggagtatccgcgccgatttaacagcaagacgctttgttcatgccgctccagacgcaccttcaacgcatctaacaacggcgccgaaaagtcttcctgagccccctgcgcaaacgcttcacgcatatcgacaatgtgcaccggtggcaatggctgatcgttaatccgctgcggcaaacgtaaaagcgtgtatacgcctttttccgcccgcgcacgggattccaacgatggcgtggccgatcctaatacaaccggtgcatgatgaatctgtgcccgcttgagtaagacgtcgcgagcatggtaacgcggtaccgaatcctgcttatagctggtttcgtgttcctcgtccatgatgaacaccccaatatgcctgagcggtgcaaacgcggctgaacgcgcaccgacgacgacttgtgcctcgccacgggcaatgcgccgccattcatcatatttttccccatcagacaggccggaatgcatgacggcaacatgcatcccgaagcgtcccttaacccgatcaaccatctggggcgtcaaagcaatttcgggcaccagcatgagcgcggtttgccccgccgccagcacctgcgcaatcacctgtagatagacttcggttttacccgatcccgtcaccccttcaagtaagaaagttttcggctcttttgctttcacggcttgattgatcgtgtccacaatctttttttgatcgaccgttaatggtaggggttgcgttaacggttgatgccgaagttgcggataaggatcgcggtacgtttcatgggcttctaattttaaccagcctttcgccgcggcctgattaatcgttgctttcgttaacttagtgcgatgttccacatccgtcagcaatggtcgttcatgtttggccgcccaggttccgatcaggtcaagcaattgcaattgtttcacggcatttttgcgtgtttgttgtttttctgcggcaacttgctcagctgacaactgaggaatgaggtagaaaacctgtttaactcgggcgcgatctttcttaacgtaagaaatggccactttttcagcctgtgccagtttcatcaaagcaacctgatcctcatcagaaagcgtgttgaaggcgacgctatccgcctgaccaaaatagcgggcttgctcctcagcagacaatgcaatcggttcggcaatcttaaccgcatcgatttttagcatggttggtaacatggtttgcatgcaggcaatccaaaaagaataagtggtttctgccagccatttcgatagcgccagcatttcctgattcaagaccggcgcgggatccaaaacatccagcagcggcttgagttcaccggcatactcactttgatcggaaagagcgacaaccatcccgctgactttccgcgctccttttccaaactgaacccaaacacgcatcccgggttgaagcgcgccatcgagtcttggtggcacaagataatcaaatggccggtctgtttgcatggtcggaacatccacaatcactttggcaatggttgccaagcgctcaccccttttgtttcggtaacatcgttgttaattgctcaattaaagccatggcgactttttgcttcgtcatttccggcagcgtcaccggtggctgatcaggccgcaaaaaggtgaccgtatccgtatcggcattaaacccatgggtcgcatcgactggattggcaacgatcatgtcggccttttttttcgtcagtttggtttgggcattggctaacaaatcattggtttctgcggcaaaaccgatgactacctgatgggttttcttttgccccaatgtcgccagaatatccggattctggaccaaggtcaacgtcaagccgctgttagcatcgactttttttattttgtggtcgctaatcgtcggcgcgcgataatctgcaaccgccgccgccataataactgcatcggcatccggaaaatccgccaatattgcatcagccatcgactgggcgctggtcaccggcttcacggtcaccccagggacaacaggcagctccctagtggtcactaaagtcaccgctgcaccagcaccagccgcggcgttggcaatggcggtgcccattttacctgatgagtcattcgttaaatagcgcaccggatctagtcgttcttttgtcccaccggccgagacaatgatacgccggccttttaaccgcggttccgcaagattttcaagaaacagcgcgatctgatccggttcaggcatccgtccgactccggtataaccttcagccaattgtccggtagcaggtggcagcagacgatagccttgtctgctaatcagccgcgcaatattacgctgcgtttgtggattttgccacatttgatcgttcatagccgggaccattaatttaggagcagtcattgctagcagcgtcgtggtgacaacgttgtcagctaaaccagctgccagctttgccaaggtattggcggttgccggcacaacgacccccaaatccgcccagtgtgctaaagcaacatgcgccacgtgttccggatggtcaaactcatgtccgtccgtcaacacagcatgtttactaacaatggccaacgtttcaggggtcacgaacttctgcgcactggccgtcatcgcaactcggacgtcatgcccggctttgactaacgcgcgcaccaacagtggtattttatatgccgcaatcccgccagtaacaaacaaggcaatatgttgctttttcatgaggcaccccttttacatttcgtagtagctttattatagcaaacgtgagccaagtttccggtcatggcgattaaaccaacccggcaaacgcatatccattaatgtttccaaaaatattgccataaaaaaagagcaaccggttgttctgcttaccgttgccccttacttcaatggtttgtcttttaatccttaatctttgtgatcgagtttttcggcatcccgttcaagcatctttgattttggatcaataatcacgtcgccagcagcaatttcttcaagcgctttgccgacactcttatctgatttatagtcggacaacattttcaaatcgcccgcttcaagttcgtgtgcacgcttggctgctaaaacagcaagtgaataacgtgagggcaccttttccaataacttgtcaattgaaggataaataatcatgtgatgagactccttttttcataatcgccaatttgccaagtcgcaaattggcgctccattatctagctaaatcggcactcgccaacatacctttgtagcggtcgatgacacgcggaacacgtaaatgttcactttcaatgatgcgctcaatccgcttgacggccaaatccactttgtcgttaaccacggcataatcataattttccatcatggtaatttcggaagccgccttgcgaatgcgcttatcgatggtctcgtcgtcatccgtaccgcgacctttcaatcgatgacgtaattcacttaaatctggtggggtcaggaagatgaacaccccattgggacacttcttgcgcacctgcattgcaccattgacttcgatctcaagtaacacatcacgcccggactcaagcgtttcattaacgtatttcagtggcgtaccgtagtagttgtcgacatacttcgcatactcaagcataccacctgtcgcgatttcgtgctcaaactgtgctttggttctgaagtaataatcaacgccatcaacctcgccaggacgcatttggcgcgtcgtcattgaaatagaatattgaaaatcccggtagttgccttcaagcatggcttgtcggaccgttcctttgcctacgccgctgggaccagacaaaacaatcagcattccccgttcgtgcatgtgtgaacctctttcgttaagtattactaaacattttgcactttttcaccgccgatttcaactgcttcaagaccgcggtaatgaaaacgtcatatggcgtaaggtcatctcggcatcttttttccccaaggccatcatttcggtaatcgctgcgggacgaaagttgaagagacgaggcagtggccgactaggtttcagataaacatcgccgtgatcagacccgatccggccaatccccgcgccactgatggccacaacaaaatcagcgccaatatctcttgcaatgtcaacgggcagatcattaaccacgccaccatcaacaaaactggtgccatgccggtcaatcggtgtaaaaatccccggcattgcgctggaggctagcaaccactctctggcatcagcaaccgaaagttcatctatgcgcgtcacatgggcacgtaagtcgggtaagcgcgtggtaacggctaaaaccgcccgttgatcacgttttggcaaccgcaacatctgctcaagtaatgggacaaagttacgtctggcaaagatcggtccccgcgtctttaagctggtcaaagactgccaccaatgcgccagttgttgcggcgccatgtgagccgtagcagcagcgttaatggcaccgattgaagaaccgatgacaaacgcaggcgccagtcgcggacccagcacgctccagacaccggcttgataagcaccatgcgccgccccgccaccaaaaacaactgccaataccaactttgccacctccaattctgtcacgagcttgccgttgttacaggtcgaataaatttcaaaaagtagttgcaagtttgaacacatgttcgtataatgaagttacaaacaaacgttcggaggcgcgatcatggaaaataaatcgtcagcactgcaaaatgtgacccatcaccttgtagcttcataccgggaattattcgatctggcagcacccacgatgcaaatgcccgcccatcaagtggatcttttcattgatcaggcgatgcaacgacattaccaaattgcactgtattttaaccatgaaaccgcgccatttgtgggccacattgtccgaccacttggtgaaaaacgcttcctggttaaaggataccacagcaatattttccgcatcatgactagcaccagtgtcaattacattaaacgattcaaatagctttttctgaatacggctcctgtgaccaagcaaaaagcgattcaagtaagaccgatgtctccttgaatcgctttttgttatgccggaaaaaatctacgaacattgaacttttagcgcatccaataccgtcaccagttcacctgactacgatgacgctttgccatgtttaaactcatcggccattcttaatagttcttcggcatgttcaatcgtcagcttagtgattttttcgccagccagcatccgcgcaatttcctctactcgcgctttatgggttagtttattgacttgggtcgttgtccgaccgtcatgaaccgccttgctgataacatactcatgatcggccatggcagctacttgcggcaggtgcgtaatacacaacacctgcgaccttttggcaattaagctaattttattggcaatcgcgtgcgcaacccgtccggaaacgccggtatcaacctcatcgaaaatgatcgccgtgaccccttccgagcgcgcaaaaatggttttcatcgcaagcatcagccgcgataattccccacctgacgcaattttggctaacggcttggcttcttcacccggattagtctgaatataaaagaccgcttcgtttaacccgtctgcccgaaaatctttggccttagtaaaatgaaccgaaaaaaccgttttatccatgtacagtgacgccagctgctcgtggatcgctttggtcagttgtttggcagcagcgtgccggcgttttgaaagtgccgcaccgagtttctgaagctgggcttgagattcttttaggttgctgtctagatcttcaaccgatgtttcggcttgttccatctgattcaattccgccgctgcccgtttgccataagcgatcacttcatcaagggtttcgccgtatttgcgtttgagctgattaaataaatcgagccgtttttcgacttcatccagccggccttcgtcaaattcctgatcatcgagttctttcgataaatcattttgaacatcctgcaaactgtaatacgcactctgcaagttgtcggcaattgccgcaaagtcaggatccaaatcggcaatgctttgcatactcgacattgcttgaccaatttgatcaagtgcattgacttcctcatcactcaacagggcatagctttcttgcaatgcagcattgattctttgaaagtttgccaaccgatcgcgttcggtgcttaaatcggtatcttcatgcggttgcagatcggcgctttgaatttcgctcacctggaatttcaacatatccagtcgttgcgcccattcctgttcatttgcctgtttttgcttcactgcttgtaaggtacgctgataattttgataaacttctgcatattggtggcgaattttcagcagatcatcaccggcaaaggcatccaataaacctagatgcgtttccgaatgcatcagctgctgatgttcattctggccgtgaatatccaccaacgtttcgccaatcgctttcaaggtggcggtgttgaccagatgaccgttaacgcgacaaacgttccggccgctgcggaataattcgcgctgtaacaagacggtgtcgttttggtccggatccatcaccccgaaagcctggagtttggcttccgtcaatggatttgcctgcgcgtcaaacaaaccttccaagcttgccttggatgccccggttcggatgaaatcaaccgatccgcgcccaccagccaacaaacccaccgcatcaataataattgacttgccggccccggtctcaccagtgagcgccgtcatccctgactgaaagctcaacgccaggttatcaatgatggcaaaatcatgaattgctaactcctgtaacatcttttcaccccaccatggcctcaagttccgccaatacatcggttgcatactgtgccgagcgacaaataatgagaatggatgcatccccgctaatcgtcgcaaaaattcgccggtcgtccaattgttcgatcaacgtctcaaccgcggctgccgtccctggcaaaagcgccaaatggacaaaattatccattgcttcgccccacttcatcgcggtaaccaatgtccgccgcagtttatccgtagcgggcagctgcttttccgcgggcatactgtagcgatagtgtccctcacctgccggaatcttgaccagttgcatttccttaatatcccgggaaatcgttgcctgagtgaccggaattttcatctcggtcaaacgggccaccaaatcttcctgccgttctatcggctcactttgaattaaccgttgaattgtcgcttgtcgttcgcgctttcgcatgtgctcacctctgtcatgaatgcatttttaacgtggaaaaatgctttacccatagcatagcgcagacgcaccaggcttaccaaatttttgcataaatattcaattaagggcgttttaatgcagcatacgcatcactaagggttcgctcgatatcaacagttggtgcgatttctccaggggtttggtcagcattttgcaaatgaattaaaaattcaatattgccttcgccgcctttgatcgggctatacgccaaacctaaaacgttatagccggtggcgctggcaaagttaacgatcatcttcaacacatcccgatgaacctggggatcgcggacaatgccatgcttaccaacatgcgcaggcccggcttcaaattgcggcttaatgagtgccaccgcgtgaccgtgcggcattaagatggcttttagcggcggcaaaatgagtttcaacgaaataaaactaacatccgtcatggcaaattccacggggccatcggtaaaatcttcaggcttgctataacgaaaattcacccgttccatcactttcacgcgcggatcctcacgaagtttccaagccagttgattatagccgacatccaaggcatagctcattttggcaccattttgtaaggccacatcggtgaaaccgccagttgatgcgccaatgtcaagcacggttttacccgtcaaatcaatcgcaaatactttcagtgctttagccaatttaagcccaccacgacttacatacggcatttttttgcctttcacatgcaaaatggcatcgccggggattttgacccccggcttatccaaacgttgattgttctgatcatagacttcgccagccatcaccgaacgcttggcctgttcgcgtgactcaaataagccttgctccacaagcagtacatcgacccgttctttttttacctttgtcatgcttgtaacaccgccaaaatcgattttaagtcggctgcatcaacggtcaggctgtttaacgcagcagtggctagctgaaactgggtcgccaatgcttgtttggcaccggctaatcccagcagttcgggaaatgtatttttgtgttcggccacatccttatcggcagtcttacctaattccgcggtggttttagtcacatcattgatatcatctttgatttgaaaacccagaccaaaagcagccgcaaaatcggctaaggcagcttgatcggcttcgggaatcgcgacaaacaaactacccattgccacaccggcctggatcagcgcgccggttttagcctgatgcatctgtttgagagttgctaggtcatattgcgtttgctcgccatccatatcaagtacctggcctgcaaccattcctgaactgccagccgcttctgccagaatttgaacgagttcggcaccttttcccggatagtgctggcttaagatagcgaatgcgtcggttaacaatgcatccccagccaaaatcgcgagcgcctcgccaaactgtttgtgattcgtcggctgaccgcggcggagatcatcattatccatagcaggcaaatcgtcatgaatcaaagaataggtatgtacaaattcaagtgcagctgcagccggtaatgcctcggcaaccacaccatcgtacatagcaacaacgctcaataacagcaacggccgcaaccgcttgccgcctgcatcaaccgaataagccatcgccgcacgcaaatggggattgaccacagttgccaattgttcgtctaaagtatgattaattgctgtttgccagtcggttagcgttggactcattgttggccttctttgggctgaaatggttgggtggtaccatcatcactcaccatttccgtcaccgtcttttctgctgatttcagcgttttttcgagttcctgactcaatttgaccccgactttaaattgatctagggctttttcaagggggacatcgccttgttctaattgattcacaataccttcaagttgtgcgagtttttcttcaaacgttggttcagccatgttttttctcctttgtcgtcacacgggcgccaatttgcccatccgcaacgtgaatatgaatcgcggcatccacttgataatccgcggtcgttttcaacatttttcctgcatcatcggtgacaaacgcaaagccgcggcccaatattttcaacggacttaaatgatccaagccaagtgccgcattggccaccgcttgatgcttagcggtcacaagtgcgatcattgcccgatccagccgacgccgatcatccacctgctgccgctgcaggttggcgacttttaccagcaactgccgaccatccagttgggcagtcgccattgctaaccgatgcttgttttcgcgtaactgattgttaatgctctgctgcagccgttgtcgtagttgatcgacacgctgaacatattgatcgtaaagccgatccggttgggttaagacaacgctttgggcggatcgttgtaagcgtgttgctgcatttttcaagcggttatgcatggcgtttaccagtcgcacctgatcttctgagatgcgattcaaggcatccaccaaagtgactggcgtgacaatttctgcagctgcggtcggggtagcagcacggcgatcagccacaaagtccgcaatcgttgtgtcggtttcgtgaccaaccgagctcacaatcggcattggcatctcagctagtgcccgcgctactttttcttcattgaacggccataaatcttcaattgacccgccgccacgaccaatgatcaccgcatcaaatccggacattgtcttaatccgattcaactgtttcacaatcgaatcggccgcctgatccccttgcacgatagccggaaataaggtcaactgcagtatcgggtatcgccgggccactgtggtgataatatcttgaatcaccgcgccacttggactggtcaccaccgccacgcgtttagggaaaagtggcagtggccgctgatggcgttcaaataacccctccgcagccagttttttctttaattgttcaaacgcctggtacaaggcaccaacgccatctggctctaatcgctctacaatcagtcgatactcgccgctgggttcatacaggctaacgcgaccaaccaccaacaccttcatgccttcttcaaggttaaattgaagtttgctgaatgcgttacgaaacatgagagccccgattttggcatgatcatctttgagtgaaaaatattgattgcccacgcgtttgcggtagttggaaatttcaccggtcagataaactttggctaaatacggatcggcatcgaattttctttttaaatactgcgtcagtgcggtaacggttaaatattgacttgtctcaaccatgtaaccgcctcttcgccaaagccaccgtttgggccatgagcgatgcaatcgtcatcggccccacgccaccgggtactggggtcaaggcgcctgcaatcggtgcgaccgtatcatcgtcaacatccccatgcagttttccatcggcaccgcgggaaattcccacgtcaatcaccgttgcgccgggtttgacggcatcagcgccgataaaatgtggccgtccgacagcaaccactaaaatatccgcttcccgcgtcaactgtttgaggtttcgggttttgctgtgagcgatggtaaccgtcgcatcatgattaaccattaatccagccagtggccgtcccacaatattcgagcgcccgacaatgacaacccgctgcccggcaacatcaatatcataagcatccaacagcgccataatgccataaggggttgacgccacaacggttggctcattcgtccacaaccgtccgacactaaccggactaaagccatcaacatctttattaggatcaatcgcatcaataaccgcgcgttcgtctaagccagcaggtaacggaagctgtaccaaaatagcatccacatcaggatcctgattcaactcggccaccttagctaacaatgtcatctgagaagtgtcttctggcaatcgatacatcaacgagcgaacgccaatttcttcagcccgccgctgtttgttacgaacatagacttcgctagcaggatccgaaccaactaaaacaacggccaacgtaggcgtgacgtcttgttgtgccagttttgctaccgtctgtttaagttcaccaagtattttctttgacactacccggccatctaatcgcgttgccacaaaaaccactcctcatttttgacgctgctcgcagcagacgcccgatgttgtttgttaccttgatcgttaaagattcgcggataaattaaaaccggtcaaagtaattgcctttgaccggttaacttacgcttttggcgctgcttcgatgaagtttgccaaaatgccattgacaaacttcgccgactgctcgtcgctgtaacgtttagccagattaatggcctcattaatcgctgcagcttccggcattgcttcttcataacgaatttcatataagcccagacgtaaaatgattaaatctggtttcgttaaccgactcagcgtccagcctttttttagttgcggcgtcaaagctgcgtctaaggctgcttgatttgccaaaacgccttcaactaatgccgttaaatatgacggtacttctgtatctttaggtaaaacttcggcgtacaccgcatttttatcagcttccggattcgttgccaaggcaaagagcgcccgaaaggcagcttcacggattgcatgtcgtgattccatcttattcgtcatcctgtccgctttttgtcgctgcatcatccgtgtcatctgtgtcgtcatccttaaacaggtcttccggattgactggctcggtcttttcgggaatcacaccaacgacatgaacattcacttcatccaaagtaagatcggtcatgaatagcaattgctcgcgtaactgctcttgcatcgccaatgcaaccttgggtaccgaaacaccataatccaaatagacgtacacatcagccgtaatcttatcatcggcaactgtcacactcacacctttaccgtgattagcccggccaaaccaggcattaatggaagatcctaatgtgccgcgcatttggtagaccccgtccacttgactggcagcgatgcccaaaatgacctccaaaacttcaggaacaatttcaatcgtcccttgtgcatcagtccgatttgctaatatgatattggtttcttcagccattatgagatcctcctagccttagttgttagcacgtgagatataagtgccatcatcggtgttgatcgtcaacacatcaccgttattaatgaaaaatggcacttgaacaaccaaaccggtttccatggttgccggctttgaaccgccgctactggtgttgccgcgaatacccggttcggtttctttaactgccagatcaactgtttttggcagctcaatacctagcgtttcattaccgtgcatgataattttaacattcatgttttcttttaaataattcaactgatcccgaatttcgtcacctgggagtgtcagctgatcataagtatcggtgtccatgaatacatagttgtcgccatcggcataaagatattgcatgtttttgctatcaatctgggctttttcaactttttcagtcgaacggaaggttttttcctgaacggcaccggttcgcaggttcttcaaagtcgaacggacaaatgccgatcccttacccggcttaacatgctgaaattcaacgatccgccaaaggtcaccatcgacctcgatcgtcaagccatttttaaaatcattaacagatatcatgaacttcctccatacattcagtcataaactaaacctattctagcaagcagcggagacgcttgcaacagccaccggcgaactaaccccaatgatctgcagtgcatcaccacacaaagcagccgtctcgatacgaattttgccttgatataaccacccatatcagagataggttcgaaaaagcggtcgaataaactgcgaccgcaacgctattcaatattcttatcagttatgcctttgactatctcagtagcaaccggcgacacttttaaatgttaaagtaccaataaatcagccggtgctggttgactgagtgattgattaccgtcagccgttaccaccagatcatcttcaatgcggacaccaccaagctctggaatatagatgcccggttcgtctgtaacaacattaccttttgcggctgggacgtcaagatatggcccccaagcacccgggccttcatgaatcgataagccgattccgtgacccgttccgtggccaaagtactgaccgtaacctgcatcattaatggtgtgatgcgccaaatcgttaatcgtccgtccgagcacacccggtttcagcgcttgttgcactttttggttagtttcgtaaacaatcttgtaaatcgtcttcagcttaggatctggctggccgactgcaaaagtgcgggtaagatcggacatatagccatgataaatgcagccccaatcgagcgtgaccacatcacccttcgcaattttcttttcggttgccgcaccatgaggcatggccgagcgggcacctgaggccacaatcgtttcaaacgagacgttgctggcaccgagtttgcgcatataaaagtccaaatcattggcaatatcaatctcccgcatgccgggcttaatggtcgccagcacatgttgatagcctttttccgcaatggcaacagcctgtttaatgagagccaattcatcatcgtctttaacttcacgctggctctcaacgaaatcgcgagttggcaccaaggtcccttgggtcaacaagtcaaacgcttcataatctgcatagttgagatgaacggcttcaaaaccaatgtgcgttaattgcaaccgattggccaattttcccgccgccttaaacagcccatcttgatgcaaaaccaattcggcgtgctgcacctgctgtttaaattgttcggtaaaccgcgaatcagtaataaaataagctttttccggcgtcaccagcaaagcactttcatcgccggtaaagccggtcaaataagtgacgttggcggcatcggtaacaaaaaagccatccagtttcttatccagaatccgtacctgtaatgctgtcattcgatccatccaaatcgctcctttttgacatttttccaaactttgaaaaaaagacgccccgttttaccgggacgtcatcaatctttattcagcagctgctgccggataaactgaaaccttcttcttatcacggccgaagcgttcgaacttaacaacgccatcagcggttgcaaataaggtatcatcgccgccgcgaccaacgttttcaccaggatggatcttggtaccgcgttgacgatacaagatgttgcctgccttgacgaattggccatcggcacgtttgctgcctaagcgccgaccagctgagttacggccgttggatgttgaaccgccacctttatggtgagagaagaattgcagattcatctttaacataacgtacacctccgagaattaattttgctctaattgttttgtcgtaatcattaagcgatcagggtattgatcttggatgctttgaagttcaagcaataaattttccaacaaaatttgactaatatgcaactgttcaccggtaataacggatttgagcttcatttgcaagtggccaccatggacctcatctgcaatgacatccggcttgaatcccgctaaggcttcaacaccgttaaccgcaccgatactaacagctgaaacagcagcgcagacgatatcctgaccggttttaccggcatcggcatgaccaatcagctcaaaactgacaatatcgccatgctcgtcgcgatgaaaaattgccttgatcatagcctaacctcttatgcgttaatcgcgtcaataacgacttttgtgtaaggctgacggtggcctttcttctgatgagagtgcttcttaggcttgtacttgtaagtaacaacctttttctcgcgcccttgtttttcgactttaccggttacggttgcgccggcaacggttggtgtgccaatcttggcatcgccttcgccagcaaccataatcacttcgtcaaaagtaacctgcttgccttcttcggcatcaagtttttcgacataaatggcttcgccgacttctgctttatattgcttgccgccagttttaataattgcgtacactgtgtgcacctcctgttttgcctctcggcttttcccctgaagactcgccaagttaggtgcttgcgcttaaaacctaacgatgtgcggttgcataggaggggtgccaaatacaacggattaatactaccagagactggggtaagttgcaagcgtctatgtaagtaagtaaacaagttcattttatctattggcttcgcgatccaatcccaatatcaggactcccaatgccatctgcttaaacggaaatgccttacgatgccaaatgccgtttacgataaacccagattccgcaaatgagggctggcatatagagtgcataaataatagtaaataacgtgagccacccgccgaaagccgcattaactaacagtaacccaacatataaaatcccgtcgataatccagttaaccggttctatcagttgcgtggtcaccgtgattagcaacgccccggtgactaataaaataagaatatcgagcaaaataatcatacgcgccacctcctgcaagcattatagccaagcgtgccggtttcaacaagaaaaccttgaaatctgacctccggcgttttgttgcatagaaaaaggcccagaacgaatctgagcctgcccctgccaagatacctaatatagcataaaaggcgccaatgtaaccagcaaatatttaaaaaggcaggggctaaaaaacaatatcttagtgaccttaaacatgcctcaaggaagtgaaacatcaggccaagcttcacatgcctgccccttatcccctgaaagtagctaaagaaaagccgctgatcattaaaaaatcagcggtgatgagtcaacgtttcaactgttgtaacgctttttcaatcgtatcgcctttgccaacatgtttggcatttttcggatcaatggcgataaactcttgcgttttcatattaagttggattcgatatgccatctgaatccctccattcttaaagatgtgaatggcctttggtagcgaataccgtcatgctactcacttttaatcagtaagtcaagccatccaacttcaaaacaacccattagcaatcagggtctcgttatgatgacatccgggtttgaatttaacctaaaagtccaaccggccgggcggtttcattgacttgaccttctggctatggcattaatggattaaagctttttatagtttagtcagtgatagcggattatcaatatttttatttttaggggcgtggaaattttgaaaaaatggatctggggttcaatcggcgggctaatcgttttaattgttgttggcattggcggatggtggctttatgaccattttcattatcagcaactagttgatcagcctgctgacgttaaaaaatgggaagccgacccacgcccactgcaatctgaacaaaccgccgttaagcgaatcacggaaatcccccagtcggcacaattaggcaatcggatcgccaaggggacaaagttggttgtgattcccgggctgcgtggcgcctggtcaattaacgcaaaaaccaaacgcgccggctttggcacaaactgggtccctcaaggcgttacccagtcaaaagacagcctgttcgtcagtctatacgatggcgatcacaagttaaattcgctgatcttggaaatcaacaaaaaaaccggtcgttaccgtaagtcgtttattttaaagtccaaagcacacgtcggcggcatcacctatgatcgcgaaaaaaagcggctgttatggtcagacgacaactccaaactcggtggcgccgggattagttatgcctctcaacgagcacttgatgcgtatcaagctcaggttgaaaaagcgcctctcgattccacgcgcatcccactgcacttggctaaccggacatcggccatcacgctttatgatcaccaacttgttttcgtcaaatatggcaagaacgccattaatcggtcgctcattgctttaccagtgaacgatgacaacctccctgctgccattaccgaagcacaatttaaccgcttgattcgcgaccttatcccgcaacttgaaggtaaaaacgatacccaaagtttccaaatcatttctaagaagctcatggatgacaagatcatcaattccgtcaatgcaggctgggatcgcattcaaggtattgccattgccaagaccggcctcacctttgtcagtcaatcaaatggtgccaagcccggcaaaatctggatccgtattccccttgataaaagttggtctaagctaacctttgccacgccgaaatccggagacaaaattattaacgttcctaattcggtggaagaaattagtctaaacgcggatgacagccagctggcccttatttttgaaagtggtgccaaagcctatcgcgaagaaggctcgttctggaaacgcccgcactacatggatcgtatcatgctattgcccatcagcgtccaatcaaatacaaagaaatgacctgattatcggcttatcgcttcatggcaaaatgcaagaacccgttgacggtctatcccggttctcgtatacttaacaacgatttgtaccagtagctcagttggatagagcaacggtcttctaaaccgtttgtcccgggttcgaatcccggctggtacattattaaagtaaaacgggaaaagctaggacaaagagcaggaaaagaattttttgccagtgagctaaaaaaacatgcgagaatagtcctttctatcacaaaaatagcaccggctgtacaccctgcgacataaggtatacaaccggtgctattttgtcattttttcaactgcaacgtatgatcaaccaactcgtaagtttcaaccccaaactcctgcgccagttccgcattataatgatgagcaacttcgatcaccgtcaccggcaaggcataaataagcttatgaatcttgtcggcatttgcctgatcaaggctggcagaaatttcgtctagtaaaaagaccggactttgtcgcaagaggccgcgggcaatcccgattcgttgtgcctggccgccggataaattgctgccgttatcaacaatttcaaagtcaagaatgccaatacccagttccttatccaggcccacaacctgcaagacccgtaaaacggcttcatcgctgtattcctgatacaaggtgacattatcccgcaacgtaccactaaacagccaaacgctctgtgaaaccaacacaaagtcaccggcatgcagcggcttattgttaaataaaaccgttccctgcgcagtaagctgaccagtgatggcttttaaaagcgttgattttcccactccagaaggcccggttaccagaatcttagcatccggtttaaggttcaaattgaccgcgtccaaaattaagtgctgatcacggacaacggtgaggtttttgattgttaaatgacctttaacgctttcaggctcagctagcgttactggtttttcatctgcaatcggctcagaaaatgctttaacgaccggcaactcgcgtagttgacgcgttccgataatctggctttgatactggctcaactgacgaacaccgtacacaactgcatcggctgtcatcgtcaatgtcaggatgacacctgtcgtcaccccaaaccatccctgcgccatgaacaaaagaccaataaaaatcggtaacaaatttgctgcaatcgcaaacatccaagaaatgaactgcaagaaatactggaaattgttcagtcgttcgtaatcttcttcttccttggcaagatgctggcgaaagcgattaaagaatgcctgccatgcttcaaagttcaaaatttccattcgtccttgaaatatatctttcatattcaagaccaatgacgcattcgcccttgaccaagcacgcgaatttttatctaaccgtttacgaccgaaatgactcggcaacaacgataagactgaaaaaaacacataaatcaaacttaaaatcgcgttgatcttcagaataaagatgaccaccacaatcacgccaaaaacttcctgaaacatatccataagcgtaacaaaataattttgctcaatttgcttgccaacactggtgacctgattaatggtgtcagaaacctcggttaccttggtaccggcctcagccattgacgttgtaaagtagacggttttcagcgcctggttcaataatcgaacagcacgctgcctaacacggttgtatagatagagcgaaagatatgttgaaaaatatgctgctgttgccatgagcacatagcggccaacaattcccatattatgaaaattaatgtctgccaactggccgaacacccagccatttaatattggttcaaacgtacctacagcgccaaaagtaaccagtgccaccatcaatgaaaacggtaattgtttgataacccagcgcacaccaatccgttgtgcttgatgatccgccattcagttcacatccttgtccttgagtaacttcaatcggcaactcgcaacttttaatcgtgtcgcttaaatgcgaaatggcagggtcaaggtacttttggccaaatccagctgataatgggtgacttttgtcggccgaatcgtttgcgccatatcagcaccatgaataatcagtgccagttgccgcccagccggtaagtgataatgcgttggctgcaaatcgagactcacatggaaaaactgtccaggcgtgatggtttgaacttcatacgcattttttgggttttgcaaattaatatgacccagcgtgatcaatttgcttggcgtttccttattggccggtttaaattcaacaatatccgtggtcttaaaatcaaatcccaactgcaagccacttgcccccaccgttgcggcattttcctcaaagcgcttggccttacctaaatcaaccagccgcacactgagaatgccggttggcgcatcaacggctagcgttaactcaagatgcggaatgccttctaagacccgatcatgctctaggaccggctgagtcaaccacagacgactgttaacataggcgctattaggcgtaataattgctttttcaaaacttgcactcgtatcatgttgggccgtgaatgttgctgtcgcatgatccgaaaattgatcggttgcgctttcaaaatcagttttcaaattagccgtggttgtcacatgctcagcagctgggttcgcaaagtccgaataagctgaccatgtctgcggcgtcacgttatcctgaaccaatacattcggcaaaacctgctctgcctgattggcaactcctaataattcatgagtcagccaaagattcatcatgtccagaaggtccaaggaacgaacattgtgcacgtagacatgctgaccttgatgcaggatcaacttcttttgaatcggtaaatccgcaattgcctgccagaaccgaatggcgttctttggtttaacattccaatcatttagcccgtgaatcaggaccacatccgccttgacattagccgcgttttttcggtaattccgcgcgtcccaccaagcagtgtaagcgcctgttgtccgatcctgatcctgggtcatttgtgccagatgctgttcccaggcctttttaaggcgaatcatatcgccaccggatttttgccgtgaaaaagtatcaaccgccaatacgtcggcatcttcaccttgatagccacccggtgccacaacgagaccattttcgcgatagtaatcataccaactcgaaatcccggcatcagcaacaattgttttcaaaccttcgacgccggtggttgccgctgcaatggccagtgtcgccagataagacttaccggtcatagccactttgccactcgaccaccacgccttaattgcaaccccatccgtgcgattggtaaaagcccggcgtttacccgtcagccattcaatcacggcaactgccccatctgtttcttccggtccgccaattgtgcgaaagccatccgaataacgcgtcccgacaccagctgaataaacaaccgcaaagcctcgcgccagaaaataatcattgaaggcatatggactattttcctcagcgtatgccgccgcctgtttcgtctcacctgtcaccggtcgcgctggcagttctggtttggaagccggcgctgcggtgacttccgccttcgaagcgccatgtggtttaaccgccaaaaccgtttccggaacatgcgtcgccgcggtgacatcgttggttccatgaaagtaagggttagcggtaaaaagcaccggaactttcagcccgcgatcggtggctttgggacgataaatcgttgcctcgagcagatcacgttggccgtcatggtcagaatctacatctgattcgatccagacaacctcccgaacagcttgacgcgcatcaaacacctgttgcaccttgccattaaagagcaaatgagccggttgcgaactttgagcctgaaaatccttaaaaaaaccgcgattggctaaatcatccagaaagctaaccaagtgcttggtgcgcgtggtcagtaacaggtagctggcctgaagcaaatcagcagtatgtagcaaatcatgcgcaacactcggtagttttgttacagtcataaatgaaatcggatcgcttaaatcaaagtccgaaaacgcctcaaagcccaagagctgtaacgcaacattataaaagtctgcccgcttcatttgagtgggctttgtcgccaaccactcagcaagattctggtgtgcattaaccgcaacctgagcaaacttatcctgttgcgccgcgggttgatatgcctcagggaaaaaggctgcgtacatcgcagctgcagtatccgcaaagggtgcttgcggatcggcgggtaacccaatgcgtgcgagttccttcaattgttgatcaatatcaggcgttaaccgagcaaactgatttaatttcatgcgaaaaccttccttttatgagagtgagcgcgagccagcgcggttaggagccggagtgtaagtggccttgggcgtgatggccgggctttggccagtgcgatcaaggtccttacacgcaggttcctgcgctggggagcgcgttatgataagcgcgagccagcgcggttaggagccggagtgtaagtggccttgggcgtgatggccgggctttggccagtgcgatcaaggtccttacacgcaggttcctgcgctggggagcgcgttatgataagcgcgagccggcgcgcttaaaagtcggagtgtaagtagccttgggcgtgatggccgggctttggccagtgtgcgaccaaggtccttacacccaggctcctacgctggggagcgcgttatggtgagcgcgactcagcacgtgtatgaacttaacaaagcaccaagttataacagcgtaagatgagagaaatgtgataaacacagtgtagctatctcatttagtgttttcaactctaaaaatattttaaattaaatgcaaaagaaggcttcagacgtgtttttctgtctgaagccttctcaatattgttaaatgcttgactgttttagctagccagcagttcgggtgccaacaacagcttttgggtggctgaacttaatataattccaggtattgttgccgttcccattcagaaacctgctgacgataagcagaccattcgaggttctttgaatccataaagctttgatacaaatgtttacccagggcagccttgaccacgtcatcagccgccaatgctttcaaggcattgtgcagcgttgatggcaggtcttgaatatggttcgctttacgttcgtcatcttgcatccgataaatgttacgatctaccgcttcttccggcttcaactggttcttaaccccgtcaagaccagcttgaagaatggcagcgatcgctaagtatggattggcagtcggatcaaccgagcgcaattccaaccgggttgataagccacgtgattgcggtacccgaatgagaggtgaccggttcttgccagaccaagcaacataaaccggtgcttcaaacccagggactaaccgcttgtaagagttaaccgttggattattgatagcagttaacgcataggcatgtcgcaacacaccggcaagaaaatgcatcgccgtctcactcaattgatcgcctgtatccgggtcaaagaatgcattgcctttgtcgtggaaaagactcatgttaatatgcatcccgctaccgttgataccatgaagcggttttggcatgaaggttgcatacagaccgtgtttgcgggcaatcgttttaacgaccagtttgaaggtctgaatattatcagctgcttcaagtgcatcggcatacttgaaatcaatttcatgctgaccaggcgcaacttcgtgatgagatgcttcgacttcaaagcccatcttttccaattcaaggacaatatcacgccggcaattttcacccatatctaacggggcaaaatcaaagtatgaaccacgatcattcaagtgcgttgtcggattgccgtcttcatctaatttaaacaagaagaattctggttcagggccaatgttaaaggctgtgaatccggcatctttcatttcattaacgacccgaatcaagttattccgcggatcgccgccaaaaggtgtgccatccggacggtgtacggagcagatcaggcgagcaatcttaccgtgatcattctcccaagggaacaacagccaggtgttaagatctgggtaaagcagcatatcgctttcttcgattcgaacaaaaccgtcgatcgaggaaccatcaaaggtgatcttgttattgagcaccttttccaattgtgaaatcggcacctcgacgttcttaatgatcccgttaatgtcggtaaacatcaggcgtaagaacaaaacattttcgtccttaactgtctggcggatctcatcagcggtaattgcttttcttgccatatacgtgaactcctatctttagtgtgattgtcggaagccaatgaccggtcctggatccgggctttgattcagtcggctttgattcagcagttcatcccgcaacaccttccgaacttctgcatcactatcttcacggtgacgcggatgttttagccgcttgacatcagccaacgtaaaaccgtcagccatttgactgcgaatctcaagtaattcgtcaacatcatttagcgagtatgttcggtgattaccggcgttgcgttgtggcttgaccaacccttgagtttcataataacgaatctggcgggcggtcaaatcagtcaacaacataactgtaccaatcggcaagaccgatcgcgttctcagatcagcgatctcagccataggcatcctcctttacaacgatgtcagcttatcaaaccacttaacacctgtcaacgccacatgtaaggttttcttacatttatggttaaattcggtatatttttatttttctttttaatcagttatagaccaatagcgaaatgtcaacgcgataaaacttccctttttccggtaaaatatttaagcacgtgcgaggtaagtccgctatcagtaccttagttaaattttttggggccagcctctaggtatttttagtctcggaaagtatgataactatagtctgatcattcttgaaaggaagttacttccatgacgttacatcttcacgttggttataccgccagcttatcatccccggacataccggctgattggctgccatttgcctcgcacccacttgcggcatttgctgctgtcgttttacgggctaccgatcatcaggcgctagcacagttaaatgccagcgcgctccctttgcctgtttttgtgatcggtcatcttgagtacgctcctgaaagtcaattaaaaatcaccccaatcgagcggttagatactacgagtctggctcagattcagaccgctgcaaccgagtatgagtctgccatggttcccggatttttacgcgatttactcgcctatgctgcggctgaccccacaagttttgcaacgccgggccatcatagcggtcattatgacgaacttgcgccagccggttatctattgcaccaagcgtatggcgaaaccttctttgccagtgacaccagtgatgtggtcactgcacttggcgatatgctaacacatgggggaaccccgttagcagcagagcaggccaccgcgcgcctataccatgctgatgaaacctactttgtgaccaatggcaccaccggatcgaacaacattgtggccagcgcgttgttgacacccggtgatctggtcttattcgatcgcaataatcataagtccttttacaacgcagctttagtccaaaatgatgcccgtccggtttatttggacacactgcggacgcaacgtggcttgattggcccggtcgatctaaccggcattaccggcgagcgactacggcaactcgcggcaaccgttgaccccaaaaaagcaaacgaaccccgaccatttcgcctggcgattctcgagttggaaaccttcgatggtattgtgccaaacgtgcggcaactgcttgatctgattggcccgctggttgattacattgcatttgacgctgcttggggcgggtatgaaccgtttatcccggctatgaaagcaatggatccgctgcagttgcaacttggcccagcagatcccggtatcatcatgacgcaaagtgtgcataaacagcaatccggctttggtcaggcttcccaaatccataaaaaagacgcccatatcaaaggtcaagcccgctacgtcagtcatgagcagttcaatcacgcctacctcaaacacgtcaccaccagttattcctatccgctttatgcgtcactggtgaccaataccgcaatcaatcaaggcccgcgtggcaaaaagatttgggctgatgcgatcacggcttcactcgaatttcggcgctccctaactgactcccgattattttcagcctatgaaaatccgcagttagcaaaaacaccgccaaccgctgcactaaccaccagtgacgcgtgggccatgacccctgacgcttcctggcaccagcttccacgcctacaacccgatcaagcgtttcttgatcccggcaaagtgacggtcttgctcccagcgaccgcggaattaggcgtgagtggctggctagttgatcgctatctgctagatcatggcattgttcctgaaaaagcagatctgaacagtttgttgtttctggtgacgcccggttctgacaaggctgattggcaacggttgcgccaaggattacgtcagtttgaagcagattattttgcaaacaaaacggttgccgagacattgccaaaactggtggcggaaactggtcaagcctacacaaacctgactttgcgaacactcggtcagaaaatgtctgactttttccgccaagcgaggttagccaagcagcagcaactccttttcagtgcgaccaacaacattccaacggccatgacggcgcaggctgctgatcgctgtttcgttcgcggccagtttgagaccattccgttgcaagctgcggctggacggatcgcagttgccggggccttaccttatcctccgggaatttttgtcgtcgtccctggtgaacgttggcgaccagaagcaatccagtatttcgaaaccttatttgccgggatcaaacgcttcccaggatttacgcctgaaattcaaggggttgtcacaggtaaaaacggcgaaccctatgtgcaggtcgttgcggacaaagaataaccgcttgtcaatcgcacgagtcgcaatagcagcatctagtcaaaaaaaacgattccagcctgcgcaatttattgcaaggctggaatcgttttttagtgtcctgtgttttatattagtcagctttgtcaaagaaggtcgattgagccgcgcccatcgttgcaagtttaatgtgggcgtaggttaacccaccttgcagataaagcgtgtacggtggtcgcagtgggccatcaccggaaaattcgattgtcgagcccgcaacaaatgtaccgccagccatgatgacttcatcttcataaccagccattttctcgggaatcggggtgacgaaactgtcaaccggcgaattggcctgaaccgccttggcaaacttgatcatgtcgtcacgattgccgaaattaacggtttgaattaaatccgtccgcggggcatcccattttggtgaaacgtctaggccaagtttggcaaacaaggctgcttcaaaaatagcacctttaatggcattgcccgtggtttgcggcgaaatgaaaaagccttgatacatgtcagccagcgcgccaaccgttgcaccttctgcaccgccgaggcctggcaccgtgaaccggtagctaatgcgctcaatcagatcttgcttgccgacaatatagccaccggtcttggccatgccgccgccagcattcttgaatagcgatcccgccataacgtcggcgccgacctcaagcggttccttggtttccgagaactcaccatacgcattgtcgacaaaaatccagacgtttggcaacacactgcgaaccaccttgatcatcgctgcgatttggtcaaccgtaaacgaatcccgagttgcatagccgcgtgaacgctgaatagccactaccttggttttcgcattaagccgggctttaaccgcctcgttatcaaccgcaccatctggcaaaagatcgacataatcaacgccaatcccgtattctttaggactcccaatgccattgcctgccagcccaagtacttcttgcaacgtatcataaggtttgccggtaatatagagaatctcgtcaccgggacgcaccaaccccagcaaagctaccccaatggcatgagtgccagatacaaactgtgggcgtactaacgcgtcttcaccgcccaaaacgtcagcgtaaatctcttcaagcacatcgcgcccttcatcgttgtgcccatagccggtcgaaccggttagatagctctcagcaacatggtgtttttggaaactggtaagaaccttgtcctgattttctaaaatgcggccatcaattgcggccagttgcggtgcaatttgcgtatcgacttctttaaccatttttaataatgcgggatcaaatttatctgtccaactcatgtttttctcctttagccggttgctttagccaatcacgaaccaaagcaacgacagcagtcttttcttctggatgggcaaccaagtcaaaccaatgtgttggcatctggttgcgaaaataggtcagttggcgcttggcaaaatgacgtgaatgctgtttaatcaaggccacacaggttgctaaatcagcttgcccgcgaaagtacgggatcaattctttgtagccaattgcctgcagcgcctgcgcatccgggggaaccgtttttagcaggttggcgacttcattttctaagcctgctgccatcatagtatccacgcgcgcattaatccggtcgtacaaaacagggcgtgctgtcgtcaaaccgatcaccaacgtctcatagcgtggttgcggctgcggctgctcggaaaagcgcgtacctgtcaattcgatgacttctaaggcccgaatcacccggcgcgtatttgccgattcaatttggttagctgccactggatcttgctgctgcaactgctcccacaaccagtgttcgccattttctgccaatgctgcctgccaacgctgacggactgcagtcggcggtgccttgccacccagcggtaaattcaggcgcaaactgttaaggtaaaagccggtgccgccaactaaaatcggcaggtggcgccgactgctgacgtccgtgatggctgcctcagctgcggctttaaacttagcaactgaataggccatctgcggatccacaatattaagaagatggtgcggaatgccgcccatttcatcaggcatgattttagctgtgccgatattcatatgccgataaatttgatacgcatcaccattaatgacttcgccttgcagttgttgagccaagtagatgccaagatcgcttttacctactgcggtcggtccaacaatcatcacaatgcggttagccggtttatccatttcattaagctccatgagtatagtataattacagtagtatcacagatcaccaatcaggggggattttcatgaaacataaatttgcacgtggctttttcgtcggctcgctcatgactattggcgctgttgccggcagtgttttcgccttcaagaaaaattatatcgaacctgttgaaaccaaggttgacgaaatcaacgaaaatcggcgcaaagccaatcgtaaacgtttttcggcccaccaaggctaaaccattgattgatcatttttaccaaaaaagcaatcgacttgagcgattgctttttttgctgtctatgtacggactaataattagtcggactttttttgattttgcctgaccaattatcatagccgccttttaaccagctgattttttcaaagccgtttttacgtaatcggcgtgctgctcgcaacgacagtacacccgtcttgtcgtatagataaaccggcagatctttgcgcatttcacctagccgttcccgcagttgggtatatggcaggtcacgtgcccccagaatatggccggctttgaattcgttacgttcacgcaaatcaataatctgagccttacgcatggtgtgttcgaatgtttccggactgatttcgccgccgattgctttaaacttcgacttttggtagtaactccacagccagctaaagccccagtaaattaagaataatccaacaatgatcagtaaataagttaacacgtctctgactccttcttccgcttacttcagtgccaagcttgcagcaccgataacgccagctgtattccccagtgtcgccaaccgcaaactagtagtttcacgaacattcgggaaggtgttttctttgaagtacttgtcgactcgcgtcagcaagaattcaccggccgcggagacaccgccgccgataacgatgaatttcggattcaaaagattgccgacattggccaaagccaaaccgaggtaaaaagaaacccgatccacaatcatcaacgccagacgatcgccttccttggccaagtcgaaaacaattttgctcgaaatctcatcgccatcgtccaaggtttcttttaacttagagtcgccggcaaattcttctgccatgtcacgcgcaactcgaactacaccggtcgcactggcaactgtttcaaggcaaccacgtttaccacaggtgcaaagatagccattaaccggatcaacggtaacatggcctagctcaccaccggaaccggcaacaccatgcaagagctcgccattggcaataatcccgccaccaacaccggtacccagcgtgacaaacgtgacatcaggatcgttttcaccggcgcctttccagcgctcacctaacgccgcaacattggcgtcattatccacgctaaacggaatgccggtccctgattcgattatttttctggcttgctgcaaggttttccagtttaggttgtaagcaccgataattgtgcccgcctcactgtccactgatccaggcgaacccatgccaataccgacaaaatcagccggggtcatcttgtataaatccagatgttcattaatagatgtaacaatgtccggtaaaatatggctgccttcatccaaaatattggtgtcaatactccacctttgttgaatctcgccatcctgcgttaaaatggcaaattttacggtcgtcccgcctaagtcgacgccaatcaatttttggtcattcatgttgatcattcctccgttgatccgaatgcaacggcaattcatgatttaaaggatcccgttcttcctgttcatgtgcatgacgcagcacaatttttgcattcagatacaccttatcatcaatcaattttgcctgatgcaagcggtctaattcaagtgccgcaagttcaatatcccaaacacgtttaccaacatggatatacgtgccaaaaccttttaataattgcaagacatcatagtaagttttcatacgattccgcgctgaattccaaataaaagcaaagcaaccaatccaaagatcaaggttatcgtagaggccagtcgccggccggtgctcatgcgacccaatgctggcgctcctaacatcccggcagccaagaacccgccaagcaagccgccgatgtgcccataaatatcaacgccgcttgaaaacaaattaaacgccaggttcaaaaccacgagcagcaaaaactgccgtgccagctgacgaataaccggattctcccggtaagtatcccctaacatcaagcacgcacctaacaagccgaaaattgctgtactggcgccagctgccaacgtattgggactgaacgcaaagctcgcaacattaccggcaaatccggcaatgaaatacagcaagaaaaagcgccagtgaccaaataacctttctgtcatttggcctaggaagtataacgagaatccattcattaaaatgtgcgtcaagccgatatgcacaaataccggcgtgatcaagcgccaccattggccgtacaaaatcagcggattggcccgcgccccatatgtcaccaaaacagcattgttagtgctgccacctgaaagtgtctctagaatgaagaccaaaatggtaaccgccaaaatgccgttcgtcacataggctgaattttgaaagcgagagcgccagtttgcgtaattcattaaattcctttctaacttcactgcaatagcagcaagtgcgtttctgactgccgaatagttggcttatatcgctaaaaaaacaacaggtgaacctgttgtttttccccgccaccgctgaccatcaatcttctttggtcatgtcttgtagtagtttagcattttttgcacacgctgccaacagcgttaaccgttgactgtcttttgatgaatcgagtagcccttatcttctttaatgtcattcatcttgtagaagtcgctaaacatttccttagcaatttgtaactggtacggcgtggttgtttccgcctttaggttcggaataatgacagcaatcgcgattttagggttcttggccggggcataaccaacaaaactttcagtaatggtttcggttaatgccgagtcgtctgattcgcgcgcaaagccttgcgcagtaccggtcttaccggcaacgcctggattaagcgtatttaaggaagtcgcggtggtccaaccattcgtaccatggacaacctgccacataccttgcttgaccaaatcaatttgggcctgcgtattttcgattttcgaggtcaccgatggctgtgtggaactcagcaccggccctttgctgccatcgcttaacgtttggctgatactgttaaccaaataaggccgcatccgataaccgttattggcgattgcgctgatatattgcagcatttgaatcaatgtatagttatcgtagtttccgtatgacaagtccaaagccgacccgaccagcaaattacccgaagaatcatgggttttcccttccaacccggcaatttcaccgggaagatcaattccggtcttgatacctaagccaaactgactgaaataaccgcgcattttggtgaaaatgttgtcgtccattttcagataattgttcggcgaataggcatagtgaccttctttcatggccagccacatcatataaatgttactggaaacttccaaggccgaggcagcatccagtgagctgaaagtgccaactggataaactgacttcttcactggggttgcaggcagataaatcggggtatcttcctgggtattatgctcaacactaataacgccatcttgaagtgcccctagcacagttgcccctttgaccgctgacccgacaacaaaagcgcggttaataacccccagtgcatcgtcttcaacttttttggtcttaacatcctgatgttgcccggccatcgctagaatccgaccggtgttaggatccatcgctaccgcataagccccatcggataatccgcctgcgccagccgaacgaatcgaactgaaggtgtcttcaagcgctttttcgaccttcttttgatattcggaatcaattgtcagattcaggttagcgccttgttgacctttaaatttcgacactgactgaacaatctgattgtcattgccaatttcaacttgggtctgactctttgaccccttcaaaacattctcgtatgccttttccagataactggttccgacacgatcattacgcgcgtaaccgttagccagataagcctgcaactcgtcagccggcaacccgcttttttcattggatacccggccaatgatggaggtcattgacgtaccgttgggataggcccgttcccaatcggtgcctaaattaacccctggcatttgcgtcagacgttcacccacaactgcaacttcatgtgccgttacattctggtttttaagatagacagtcgatagttgggtggcaccgttcataatcttgtaaagaccggctgcctctttttcaattggggtcaacgttggcatatgtttgcggacataggcgacttgatatttatacaattcatcggactttgatgacggtagatcctgaatttttttaggtaactgcttcgtcacctgcttggcaatcttggttcgcgccaaatagtaatcaatgtaatcacgcttagtcagattctcggccggcttgtcaattaacttggccagttgattggcgatctcgtacatctgctgcgatttggtacccacacttttggtataagtaatcgcattattggctttattggtcaccaatgctcggcctttactatcaaaaatcaagccccgcggcacattcccggtcaccacggttttattcgttcgatcgacttcggcagctaatcgcgggccatttaaaatctgcaaataagccagttgggcaactaaggccgctagcaaaagaaacgcaatgaaaaataataagtttaagcgaaacggaatgcgactcttattccgcttcggctgcggtgtacgaatgtacttcacctaaaattgctccttcgaaatttctatcttttaaagtgtagcaaagaacccgccaaaacgctatgtgtcttatgatatggacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatgtatgatatgcttgattcacagtaacagcttaaaaataagctggaattaattttaatttagaagttggtgagggcatgtgcgacaagtctggtcgaaaaagtatccgttaatactgagttttctattaccggggctattggtggctttttactttgccattcgtggtgcttttccatttgggtccagtagcgtcttaaccgttgatctcggccagcaatacattgatttctttgcctacttgcgccaaaccttattaggcaatcccggacaacttttttacgccttcaataaagggctaggcggtgatatgttcggggtttttgcctattatttattgagtcccttcaacctgttagttgtgctgtttcctgccgacctgctggatgtcgccgtttttgtcatcatgatcttgaaaatcagtacggcgggcttgacgatggggtggtatgccaaacgtcatgcgattacgggtttaatgatccccacatttgggctggcttatgctttaagcggctggatgttggccaatagttttaatttgatgtggcttgatgccgccattttgttgccgttaatcatccaaagtctggagacgctgctcaacggcgggcgcgtttttgcttatatcggttggttaacggcggctttcattgtcaacttctacacagggtatatgatcgccattttcctggtgctttataccggttactggctgggcagtcatgccgtttcttggcggcagacagcacatgcaggtctgcgctttgcctgggctagcatcttggccggtatgaacagcgcagtcgtgttgctgcctacctggtttcaactcgcccaatccaaaggcacctataccgtcaaaaccatccaatggcggttcgaatacgcgccggatcgactgcttagcaaaatgctgcccggaagcttcaattttgatcagatgccttcaggataccctaatttttatatcggtgctttaggctttgttttagccattcttttctttatatcacgacaccagacatggcgccaaaaaatggctgctgctttggtgaccgctttcttagtgctttcgtgcatgtttgagccgcttgacttaatgtggcatggctttcaattcccggtttggtacccgtatcgctttacgtttatcttatgcttttggttactcagtctcggcatcagcaccctgcagaagcatcaatcggcgctttcatttcggacgctagttattttattaatcgtattcgggctcatagatggggatgttgcgcttcaccttaaccattacaactttctaaccatcggccacctgatctttggcattggcaccttgttgctcgtcttggtctggctaagcctggatcaccgccgtccgttttggttcggttttgccattgtgttggtcgatatgagtggcagtttaattttaacgctaaatcaattggcgtatcttgatcatcatgcttaccatgattacgccgcggcccttatccaaggcgcacgcaccatcaatcaaacagataacggcttttttcgtattggcaaaacaacgattcgcacccgtaacgatccgatgacaggcaattaccgcggcgccgatcaattcaactcgctacttgagccggccacacctcaattcttcggccaaatcgggcaaccggaagacgatggctcggtcgcatacactaacgggacattgattaccgacagcttgcttggcattaaatattttttaacgccgactcatacttgcgctgccttacctgatgccggacaacgacctgatttaaagtggtatcaacagctgcgacaagtcggtccgtggcaggtgctaaaatccccatttgcccaacaactgggttttgcggcggacaaagcgttattaaatcagcagctttacagcgacaccccgcttgccaaccaatcctttattttgcaagcagcactgggtaaaaacacaacgccttattttactgctttgccacttccttcaccgactttaaccggcgtccgccgcgtcaccacgggtacaaacccaacttttgccaaaagcggttccggtccgcacacggtgacatatcaatttcaaccgcaaactggcaaaacctatgtactcaccctcggaagtcattttgccaatcatttggttaccttgaaacaaaatgggaaaacggtcacgttaccagaaagttttaatgataccatcaccgttaacgtcacccccgcaaacgcggcagaaattcagacgttaacttttcaactcaacaaaaaagaagcctggtttgaaaatatcggtctgtatcaagcgcatacggagcagctgatccaggaccttacgcaactgcaaacaggcggctggcacgtaacccatgtgactgccaccacacttgccgccaatatcaccattcacaagcaaaaccagatgttgcaaaccactattcccactgcacctggctggcaagtcaaggtcaacggacaaccggtgaaacccaaaaccagtttaggtattttcatggcgcttccgttaaaacccggccattaccacattaccatgcgctatcgaccacccttgttaggctggggcagcttgatcaccatcgccggtgtactgctgacgttttgctggtggctcgtgacatctcgcaaaaaaagaacgggaattattgaagcaaaacgccgcaccataattggaaaataaagtgtccgcgagttggtaggtaccaacttataattaaaagtccgccaccagtgaaacaacgacaattcgctggcagcggactttattattcttctttaaattcgtacttaggctcgtcaagatgtgcatcatagtcaaccgtcatgaccagattctcaaaaaaccacgcatctgtcgggttaacgaaataagtcacgccatcttttttaaccgccataattggctggtcagggtggtcatcgcgcgtcatgcccacgctaaaaccatcatgcacctgggttttaccataagccttgccaaagaatcgaatgccggcaccttcagcaggcaaatctaattcgcggtgaaaccattgactagctttatcagtgatcgcgagttgcaaccccatcatctccttgatcattttttaccagaccatgcttaagcgcgtaaatcgctgcttgcgtccggtcttcgacatccaatttggccaatatgtttgagacatgcgttttaacggttttcaatgtaataaagagctcggtcgcaatttcctgattcgacttgccttgtgcaataagctgtaatacctcacgttcgcggttcgtcagctcgtcatattgcgactgcggatgattcatccgattcatcatcttcgtggtgacttgcggctcaagtacccgttccccgctggcagtctggcggatagccttggcaatttcttcggccgttgcggttttcaaaatataactggccgcgccggcttccatggcaggatagactttggcatcatcgataaaacttgtcaaaatgatgatacgagcttgcggccatgcttttagaatttcttttgtcgcttcaatgccatctttaaccggcatcaccaaatccatcaaaataatatccgggcgatctttcagggccatttcgaccccttcttgaccattctcggcttgatcaacgacttctaaatcgggttggacgccaatataggtggacagccccagtcgaaccatttcgtgatcatcaacgatcaatactttaatcatgcgcaacatcctttgataacggtactctgacttcaacactggttccttggccgaccacgctaacgacctttgccgtaccacccatggctgccgcgcgttctttaatattggccagtccataattgccattactactggtttcttttggatcaaacccgacaccatcatcaaccatacgcaaaataaccatatcttgcaaccgcttcagatagacttcaagactatcagcttttgcatgccgcaacgtattgcttaatagttcctgaacaatgcgaaaaagattatcctccgcagctgcattcaactgaatatcgtccagttgccaagtgattttgatggtgatcttagtttgtaattccttcagcaactggataatgccttgcttaagtgactttccttcaagattcgtcggacgcaaatgcagcaataaggcgcgcatctctgcctgggcctcattaattactttttgaatcgtatccagttgcttattcaaagcttcttgtttgggatcgcgggccgccacactgcgcaacgccgacagcatcatcatggcagcaaagagttgctgggaaacagaatcgtgtaattcacgcgctaatcggtggcgttcgccggttaaaatggcttcccgcgtctcgccggaaaatcgcaccggtgtgttactataacgttcgatttcacgttgcaagcgtatcattttttgccgtaatgcttcaagcaaggcagccggttgttttcccaatgcggcttcagcctgttgcgatcgattaaaaatcggtgcctgatactgtccagcgtttaattgggctaaacgactatccaactgactacgcacgacccgctggcgccaaagcacaatcaccgtggcaccagaactaatcaataacgcgccaatgagcaaataaaccagcagtggcgccgacaatacattggctaataaaaggcgtagaaaatcgtgctgagtaacttttgccagcataaaaaccaaacaggcctcgactagaagtgtccagaccagcaagatcataaaaaaaccgactaacattcgtcgcctcataccgccagcacctccaagtcacctaccactacattcgtaatgatatggatacgccgtggtgcatcgtcataatcctgcgaatacatcgttacgctttgactatgcagcatcgagtccgcattttcaaaatggagccgcccgtaaaatgtcgcatgttcaaccgcgacgccaacgccaatgggaaccagaattctggttttgccaaagcctttgcgaatcataataacactgtcgcctttaggcaggaaagtatcccccaaatcaataatggtatcgccagcaggaacgaccatattgatgtcatcccagtcgtaactcggcgcaatggtttgccggttgccccatgaatgaaccgtgcgccgacccgcttttttcccaggctcctgcgtgaccggtgcaacgtattgtttgcggtcccacattgaaaaacccatccccggcttggttaacaccatgattaggaacacgcctgctaccatgagaatcaaccagactgccggattaataaagattcccagtaccaacaggataccaccaaatgtcacattgaacgcacgcattcgatgccaacgcgcacctaaaaagagaaaaagaacgccaaacaggatcgttgtcaacgccattggattggtgatgatctgaaaccccagccagaggatcaacgcaaattcaattcctaaaaacagttgccagcggcgcattgcgatccctccttatctaaaaatcgttgtgaacttagagcacactatccgaaaaagcctgctactattcacgaattattataacgaatcggaacgcaactcgcttagggcgtaaggctgatattcattggaaactggcgggactgagacatagttctatctcaggatgtgatgctcactaaaatccgaatactacagctgagaaagtagctaaagtagttccgggccgtgccaaactacgcaatctccggccagatggggtggcgacgcgaagctagagcggagacggcgcttggagcctgcaagcccggcagtctccaagtcgcctaacaacatcagcgacaaagcccggtcgctgtgttgttccacggctgagccccatctagcctacgattgctccgctttggcactgggatcgttaaagctcattcatacaaatatgaagaagccaaaaagcgtatcatttcttacaaaatcgagaaatttctcaatcttagtgagaaatggtacgcctcaattttgaagctgtgaattatgaccctgctccattattcgcgagtaagaacaaaaaacggcaatcactgctcttgcatttgagcgtgattgccgcttttgccttacttacaaaattgaagcctacaagtccgtcaaaaactcgcttacccttcaaccttggtaattttaacggtcatttcaccaccgggcgtgttaatggtgacttgatcgccaactttacgcccgatcagtccttgagcgatcgggctttcgttgctgattttgccgttgaaggcgtctgcttctgccgcaccgacaatttcataagtttcctcatcgccgtcttcttcaaaggtgacttttttaccgattgacacttcatttttagcgactgccttagcgtcaataatttcggcatagcgcaacatcgtttgaatcgtaacaatccgattctcaagggttgattgctcatccttggctgcttcatattcggagttttcggataaatcgccaaaaccacgcgcgactttgatgcgttcaatcacttctggccgcttcttggtttttaattcctctaattcgttttcaagtttcttcttaccttctgctgtcatcggatagcttttgtctgccataaaatacttacctcacttcttattttccttagtcactttattaagccagcaaccatttgtcaatggctactcttctaaaccgcgctctgccaaaatacttttgatctttgtgaccagcaaatcgatggcgacctgattctgaccgccttctgggacaatcagatctgcataacgtttcgttggttcaacaaactgatgatacattggcttcacggtttttaaatattgattaataatggattccagcgtgcgaccgcgtgacaccatatcccggcgaatacgtcgaatcacccgaatatcgtcatctgtatccacaaacactttaatgtccatcatgttgcgcagcgcttcgtcatcaagaatcaagataccttcgagaatgatcacgtcttttggctcaaggtgaaccgttttattcgaccgattatgaatcttgtaatcatacaccggctgatcaacggcatgtcgatgaatgagttgctccagatgatgtttaagtagcggcgtgtcaaatgccaacgggtggtcgtaattgatcttcttccgctctgaaaacggtttgtcacttttcttataatacgcatcctgtgccagcaagagcaaggaatgaccggaaaaatgattaaaaatagcccgactgacactggttttgccactggctgagccacctgtcacaccaatcacaataggtttcttctgttgcattttagccttcctcactcagtatataagatctgcgcataacacagccttggaaataacgtccgctggttggacactgcttccaaggccgcttaacctgaaatttgatttagcttccggacatgattttatcatatccaaaattagctgcatgctgcgctgtcaggacgtcacgttgttgattggattggtggacgaccgcggtgccttcatcaacggttgcgcttatttatcggcagcggcattatcgcttgcaaacttagctgtattagcatcatgttgctcgcgagtcgttgcatacagcacttcacccgtcttcagatttgcaacaaagtacagataatccttactgcgggcattcggactgagaacagcagcaatgctttgttcgctcggtgaatcaaatggtccggggccataaccggtgtgcacatataggttgtacggtgaatcaacgctggtgtctttgttggttaaatgtgtcttatgcgtattcaaggcatacatgacagagatatcggactgcagtggcataccggcatcaatccggttcaagaagacgcccgcaatggtacggcgatcttcttgggtcaccccttcacgctcaaccaacgaggccaaggtcatcacttcctgaacagaataaccttgtttcttaacgctcttgtaataactttgcatcacgctatcagtctttgccaccattgcctcaaccagatccttggtggtttcaccggcgctcacgctataagtggctgggaaaagatacccttccagacgataccgtacccctttagccgaggctgcagcgctaagtaacttaggatatttcttagccagctggttgaaaaaggtttggtccttcatcaaggccaggaattttttgctcgtcagattttgattggatttagccaatttattaacggaagtcgcaatttgctcaaccgttgcgccttcttttaccagcaactgtcccgccgcggctgctgaagtgccacctgcacgcaacttttgaatcacctgatccatattgtcacgttgcgttagttgatagcgtcctgcttgaaaatcggcaatattgtgaaacttcacgtaatagttgaacaccatggcacttttaatcacatgcttggcttctaatctgctcgcaatttgtttcgtgctagagccagccgggaccgtcacattaatgcttgttttgccattagggttaactggctgtaaggctgaattgacataccggtagcccatcagtccaacaatcacaagtacagcaaataaaataccgagaacccaaccgacgattttttgcgatgcttttttctcatgttgccgctggcgtcgtttacccgccacgtccggggatcgcttgtccaaaaagatgcctcctttttctcatgccaacgttaacctcatccgttatgcttgcacacaaataaccgccaagcataacagacaaagttatgacaacgccattatgtagcaacgtcaccgtcagatcatgcttgacggtgacgcgatacagtctgaatgttactgagtccattgaccgttgccagtgactatcataccgaaccaccggctaaaatgcgactaacgattaacgaatgattgcccctaaatcagattcaagtgctgctttgacccgatcaaaagcctgcgtaacttcttcttcggttaaggtttggtcatcgcgccgataagtgagcgtataggccagactcttttggcccggcgccatatgcgaacctgcataaacatcaaataaggtaacgtctttgagatatgcgccaccgtgttgctggaagatctgcatcacttcggcattggtaacggtatcggcaacttgcagcgcaatatcgcgcgtcacagccgggaacttcggtgcaggctgggcaatcttctcctgacgcggcgccgcaaataaggcatcaaggtcgagctcaaagacaaaggttgcgggtagatgctgttcatgttcaaacgccgggtgcaaacggcccaagaagccgactcgctgcgtcccgaccaaaatatcagccgcctgacccggatgcagttcactcaccgcctgagtcgctgcaaagtgcaccggttcagccaatgaataatccgccaacaaatgcgtcacaatgcctttgacatagaagaaatcaacgctgcgtgcggcttgatgccaatttttggcggctacgtggccagtgatagcaccgcctaaatactcgatttcagttggccgtacctgatcaccggttttggtaaagatccgtccctgttcgtaaatggcaacatctgtttctttacgggcctgattatatttaatgacatctaatagacctgtcaccatattcattcgtagtacggcatggtctttggtcatcggtgaatcaacctgcgtcggctcgccgggttgcaacttaaacctagttgccgcttgctcagtcgtcaggccataagtaatcgcttgattaagacccaacccttcaaggagatggcgggtacggcgaattcgcttttgcgccggtgtatactcgccaatcgtcatcgtagtagtcggaagtgtacttggtaaattgtcaaagccataaatacgggcgacttcttcaaccaaatccgctttgatatgaatatcccaacgccgaggtggaatcgcaaccgcaaataaaccatcagcaacttcaacgccaaaacctagttgttggaaaattcgtgtcacctggtcttggcttaatgtcgtgcccaacacgtgattaatatgatccagcgaaatatcaaccacgacatcttttgcgtcaaccgcagtcggacttacggttcccttggcagcctgtccgccacccaagtcgctcatccaggcaactgctgcatctaaagcgcgattaatatcagctaagttaatccctttttcaaaccgcgatgatgcctctgagcgcaaattgtacttcagcgctgttttacgaacgttaaccggattaaaactggcagcctcaacgacaaccgtggtcgtggtttccgagatctctgaatccaagccgcccatcacgccagctaacgcaactggcacctgaccatttgtaatcacgatatcgctgtcatctagttcgtgttcgccaccatccagtgtggtcaacggttccccattgcgcgcccgccgaacctcaatgtgctgactaccgagtttagcatagtcaaacgcatgcaacggctgaccatatgccaacatgatgaaattagtgatatccacgatgttgttaatcggacgcacgccagcattccataaccgccgttgcaaccaaagcgggctctctttaatggtgacgtggtcaatcacccgtaactgataactcggggcatcctgagcgtctttaacttcggcactgagataatccgctaccggacgatcaccttctgtcagcggcttttcttcaaagtgcggcttttcatcataagtcgcgcccacttcccaagcaacgccgcgcatgcctaaagcatcggcacgatttggcgtaatctcaaaatccaacaccgcatcatgcatgccaagtgcggctaaagcatcagtaccaggttttaaaggttcattgaaaacgtaaataccatttaaatacgctttgggaaccacattttcattaaaaccgatttcttgcaaagcgcaaatcatcccaaggctttcttcgccacgcattttgccttttttgattttgacgttatcggcaatccgtgctcccggaagcgcaacgatcaccgtttggccagccgcaacattgggagcaccgcaaacaatctggcgcggttcgtcttcacccacatctacctgacaaaggttgaggtgatcagagtttggatgaggtttgatcgccaataccttaccaacgacaatctttttcaatccggcatcgggatgtttaacatcgtccacttcaattccggttcgtgacactttatcggccaattcttccggtgataccgggatgttgacaagctcttttaaccaatcatatgaaacgtccatcttaaccctcctgactgaactgcgtaaggaagcgcaagtcgtctgtgtaaaaactgcgaatatcgtcaatgccgtatttcagcatggcaaaccgatccgggccaagaccaaatgcaaacccgccatatacatcggcgtcaatattagccgcacgtaaaacattcggatgcaccatgccggcaccgagaacttcaatccagccggtatacttgcaaacagggcagcccttgccaccgcagcggaagcaggaaacgtccacttctacagacggttctgtaaacggaaaatagctcgggcgcaggcgaatcgtccgatcagcgccaaacacatgctgacacatggcgagtaacgtccccttaagatcagccattgtaatatgcttgtcgatcaccaggccttccatctgatggaactggtggctatgtgtggcatcatcatcatcacgccgataaaccacgcctggactgatcattttcagcgggcccttagtaaagtcatgtttctccatcgtccgcgcctgcatcgggctggtttgggaccgcatcagcaactcattggtaatataaaaagtttcctgcatatcccgcgccggatggtccttggggatgttcatcatttcaaagttgtaatgatcctcttccacttccggaccggttagcacttgatagcccatgcccataaagaagctttcaaggtcatccataatctgaataataatatgtggtgtgcccgccgttaccggatcgcctggtaatgtgacgtccacggtttcagacttcaatttttcgttgatgactgcctgctccagttgagatttacgcgtctcaatcaccgtactcagttcatcccggactttattggcaaaggcaccgacttttggccgttcatctgctgataaatccttcatgccgcgcaaaacgctggtgatggggccttttttccccaacaactggacgcgaatctgatttaattcgtccaacgaggtgatcttttttatcacctcattattttgctgaaaaagttgttcaagtttcgtttgaagatccatgttcttcctccttgactgctaacctgagaagtccgccgttgatacgtttgaaggcataaaaaaagtcccttctcaaaaaagggacgaagcatcgcggtaccacccttgttcatgattaaaaaacctcatgcactcaacaaggtaacggccaggccggagctttctaagtgttgccacctcaaaagtcaactcagaaagtgaagacaaacattttggtaacagacgtcttgcagtctcgtgaacgtcattccctgatttaccagcctgtttgggctttcgtcattgtttttacatttttttgataagacaagcttagcaaattcagcgcagacgtcaagagctgatggctaatagttgggtaattaggctctttttacttagggtctctcacatgtgttctggccaatgatcaacaatggcataagaaaaaaacgcgtcttttacgcgtttttttgcttttcattggcatggcactcttcatcggtaacccatgcgtcaccccaagcgtgtgcagcggccatgactgaattcaaagcccggcctttatctgtcagggcgtattcaattaaagccgagtccttgtgcgtcagacgatcaatcaagccctcgccttcaagttccttcaagcgttcgaccaaaacccgatccgaacaccggggaatcagttgcgcaatatctttaaaccgagaattgccattgtttaacaaaacttccagaatcaaaccgttccacttcttacccaaaatttcaaatgtgtgctgaaacttaggacaaagagcgacttgttgactttgacattcggttttactggttactgttgcatccactctactcacctcatcatacccgcttacttacatttagatagtgttagcataacacactcccaaaatattacaagtcatgcttatcatcaacaactcaaaagctaattgatgcgtctaaaataaacgaaaaaaactcacaatacgtttcaaagcgtggcactgcatccaaagctgaattttgctctcacaatttaatatcggctcgtgggggaaaatatacccgtcaaaaaagagccgcgggacaccgcccacgactctaatatgacgacaataacagtgcactgccgtcaatcacgatcctaatttaaagcttttaagtgagtgtgaatcggatgccggagcttgtgcatccagggtacaacgacctcatccatcgcagcataatcatcaactagagaaacaacaaaactttccttatacttcggcaagccaactgttgcaccccacatgtgcttgatgataatgtctttttccatcggtgacaattcggttaacttctcagcattccgtaaagcaatccgaggatggataaaggcatgcgtccccaagtcgaacttggttttgcgccaatcatagtaaaacagatcgtgcaacaagccggctcgggcgatcgcacgaacattcagatgcaggcgcttcccaatcaaataactctgataggaaacactaattgaatgttccaatcggttcgaataatggtgttgcgggtgttctgccagtcgctggacctcgggcttagccaataaatcagccacatacccaacgtactcagcatccgattgccaatcgcgttttttgctcaagacatctgctccttttgtggtttgatgaacacacccatagtataacagcttcccaccctaaaaagcacgttcgtaacacattcttaatcaccgactaagtgaaacatcatgatggccgctgcgacagcgacattcaaagattctgcttgtccccgaatcggaatatacaggttcgtatcggtttgctttaaaagaacaggatccatgccattgccttcattgccgacaacgagcccgaactgtgcgctcggttgaatactgcgataacttttagctttatcattaagctccgagccataaacgggaatccctgcccgttgcaaggctttaataacgggcatcaattttgccgatacgatgcgaacatgaaactggctgccttgcatcgcgcgcaaaactttcgggccaaaagcgtcggctgttccattaccaaaaatgacggttttaatgcccgcagcatccgccgtccgcaccaaggttccaacatttccgggatcctgaatcgcatccaacagtaaaaactgcccacttaaaagatccggcaattgcccggcctgacgcggcataaccgcaaaaattccctgtggcgtttcggtgtcactaagatgctcggaaaccgactccgaaatctgcgtaattttgtcataaaacggcttaagcgcacgatcatcaacatacttttcggtagcataaatatcataaggcgtctgcccactcgccagcgcctcttgaaccaagtgccgcccttctagcaagtagcgcccagcatccttttgatgtttcttaaccgttaatttcttggccgttttaatgcggtcattttttggtgatgaaatatattccataaaaatctccttttaaaaagtgagcgcgatccggcgcggttagggatcggagtgtaagcggccttgggcgtgatggccggtctttggccattgcgaccaaggtccttacacgtagatccctgcgccggggagcgcgttatagaaagtgagcgtgagccagcccggttagaaaccggagcataagcggcctcaggcgtgatgacccgggtttggtcattgcgtccagggtccttatgtgcaggtttctgggctggcgagcgcgttaatgtgagcgtgagccagcgccaatcaatctcagccgcaccatccacaaacaaaaatccgacttttgcctcttgtcgcgttttctatataccttatgctacactagtatggactgtggagaaagcaaagatgaagatgttttcatcacctttcgatccaaatcttctacacgaaaggaagtgtctttttggtcaaactcgctaaacaaatcgtcgttcggggacgggttcaaggcgttggttttcgctgggccacgaagatgattgcggataatctcaatatctgtggcaccatcgaaaatcgcgctgacggctcggttttcattcaagcagccggtgaaccgctcaatctagccaaattcattgcacaggtcaaagccggtccgaatccttacgctaacgtgtcgacttttgaagaaaagccgctggaaaatgtgcccgacttcaacggttttcgtgtaaccggttgaatccgcttggtccatacagtatagttaaacccgatgacattttgaagggaaattattcatgcacaagtcgaaaaaaatatttgcactaggagcggtaggcattctgccgctattattatcagcgtgttcgccaacgaaacaaggcgtcacactcaagccgccgacagatccatttttcggtactttctataagataatcgggttgccgttgcagcatttgatggaatggattgccggattcgttgggtcgaccagcagttacgggattgccattatcgtcattaccttattggttcgcctaatcgtgttgccactcatgctgcgccaacaacgaaccatgacggcttatcaggaaaagcagaagattctccaaccgcaattaaaaattgtccaggatgccgttaagcgcgcaaaaacaccagaacaacaaatggctgcgaataattacatgcggaaaatttattctgctaatggcaccagcatgatcccgtcaatgggttgcctgccaatgctcattcaatttccgattttctcaggtttatatcaagccattgcgtattcgcctgagatttcacacgcaactttctttggcattcagctgggacattctagctttattgtcaccattttggccacgctgccatacattattgtcagcctgatcatgcttcaaggtgtcccgccggagcagcgaaaggcaatgcaggcaacggctttcctgagcccgatcatgacatttgtgttctgtatgatgtacaacgctggcttgggtttgtattttggtgccggtgggattattctgatcatccagcaagccatcgtcacttacattgtaactcccaacatccggaaacggcttgatgccgaaatggaagaaaatccgcctgttgaagttgttaatgaacatacctttgatgactggggtgccgtcacggccactgccggatcgaccggaacccaaagccgccagcaaccagtagacccagatgccattgatcatcaacaattacgcaaacgaaacgccggcaaacaacaacggccacgtaagtaaattaccaacacattgaagtcgtctttattaggcggcttttttgattgtcgaaatctaaatttgccataaaagcaaaaatggtgtacacctgtctgctcacaactggtaaagtctcctactggcagcgcaaaaatatggccacacgccaaaaaccggtttcagagttaacaagaatgctcacactccgaaaccggttcatttattgattgtgttccgactacaaattgcttttaattaacgtatcacttttcggcgcagcagcctgctttgctgcttcttggcgttgaagtgctttggctttgtccgccgaaatcgttggcaaatcaatccggaagatcgacccatgacctaaagcggagtctacttcaatttgaccatgatagctttcgatcagttgctgagcgatggatagccccagcccattgccgcctttttcccgactgcgagccttatcaacgcgataaaagcgattgaacacgcgacgccgatccttttcggcaataccttcaccaaagtcttgaacggcaactgcaatcccattgccactgttttgcgccattgagacatgaatttccttgcgatcagtcgaatacttgacggcgttatcgaggaggataatcatcacttgctccagatgattgcggtacatgcggacaaaagtcgtctgctctaagtcatcgtctagcgtgaacgtaaactccggatgaatcatgcgaaaatcggcaacgacctgctggacgactttatggacatccacaaccgcattggggaactgaacatccacctgatccgcgcgcgtcagatccagcatttcctgaatcaggctcttcatccgggtgatttcttgaagtgaagcagccagcgactcgttaagcacttccggatcatccttaccccaacgattgagcaattgtaaatgcccttccaaaatagctaccggagttcgtaactcatgcgaaacatcctgtacaaattcaccttgctgatcaatgtaacgttgaatccgatccagcataccgttaaattccagcaccaaatcgccaagttcgtcattgcgcttcaatgccggaattcgaaccgtgctttgcggctcctcattgacaacatcaatggcattggtaatcagcttaatcggacttaagaatcgggttgccagtacatagccaatcagaattgaaatgagaatagcagcaaaactcaaaccaataattagcaaggtaatttcatgcatggtcgcatgaaacgctgtcagtttgttcgtcacctgaacgtaaccaatcaaatttgaactttcagccgaataaatgggtgcagttccgaccagtccgttaaaatcaccgatatgactttcctgaacttcaaatccatgaaccttacccaacgtgatcggggtgtcacgcgactgaaaaattgtcgtccgatcacgcgaaaacaccgacacgctaacgtctgcctgagccaatttctgaataacggaatcggaaaaaatccgcgtgtgtgactcgctgggagtaggcagtgacgactgatcggacggcgttgtcccttccaatcgcggaactacctgggccatggtcaaatcgccaccgaccggggaaagccgttggacgactgtgttaagggtatcggtgacggttcgacgctcctgattaatcagaatctgccgcatcgcaccataaaggatcattgaaaaagtaacaaaagtgacaaaaatcccgacaccaactgtgacggcccatttgaccttcagtgagatgcggggattcttcttttgcttagtactggtttgcttgatatgcattatgaccgcataacatagccggttccccgaaccgtctgaatataactaggttcaccgggccgatcaattttatttcgaatgtagcggacataaacatcaacgacattcgtttcaacatcggaattataaccccagactttagacagcaaaacatcacgtgctagaacaacgttgacattttccattaaagtcaaaagtaattcgtattcacgcttggtcagttcaatgatgtcatcgccacgccgcacaacgcggttttccttttcgatgacaagatcgcggtacttgatggtcgtttgcttggcagtgttgttttcgccttcaatactaattcgacgtagtaaggcgcgtaaccgtgccagcagctcctcgatggcaaacggcttaacaatatagtcatctgccccatgatctaagccgctgacccgatcaatcaccgaatcgcgcgccgtcatcatgataatcggggtattcttcacctgacgaacacgccggcagacttccaatccgttcagttccggcagcatgaggtccagcaagatagcatcccaatcttctgctagggctgcttccaaaccggtacggccattaaaatgaacttcggtttcgtaaccttcatgctttagttcaagttccacaaagcgggcaagattcttttcgtcttcaataattaatattttactcattagcgtctccttatactttcggtgcatgaacacacaatctgaatctatttttagtttctcataaaaacatacgctaggatagtttagcacagttttctcattttgactatcagccccgcgctaataggcatcaaagctaatggaaaagcctaataatcaaggctctcatttttcaattcggctaattctcataataacctgcgatactttctaatctgtctttacgaaacatataccattttttaagtctgattgtcaaagcctttgtgacaatgatacattaaaaaaaccaattcagatgcgacacttaatcgcaggtgaattggtttagacttaaacttcaatgaattaagcttcgtcgtaccaggtgtaatggaaaatgccatcacgatcagtacgttcatatgtgtgggcaccaaagtagtcgcgttgagcctgagtcaggttggccggcagaacaggggcgcgataagagtcgtagtaactgatcgccgctgagaagcccggcaccggaacaccggctttaactgccaagccgaccaagtcacgaacactttcctgatagttcttagcaatattcaggaagtaatcgtctaacaacaagttctgtaaatctggcttcttatcgtaggcatcggtgatattttgcaagaaacgtgcgcgaatgatgcaacctgcacgccaaatcttggccaattcaccgtactgcaggttccagtcgtagttatccgatgcaacgcgcatttgttcaaagccttgagcataggacatcagcttgctgaagtataacgccttacgaatcatctcgatagcttcttttttgtcaatcgtgacatttccgaccggctttggcagaactttacttgccgcaacccgctcctgcttcatcgcactaatgtaacgcgcatagacggattcggtaatcacactttgcggaacacctagctcaagagcagattgtgaagaccatttgccggtccctttgttgccagcgcggtccaaaatcacatcaacgatcggcttgtcactaccaagatcgtctttacgagtcagaatatctgccgtgatatcgatgaggtaggaatccagttcgcctttattccagtcactgaaaataccggcgatttcttctacgtccaaaccaagcaaatgacgcatcaagttgtaactttcagcaattaattccatatcgccgtattcgatgccgttatgaaccattttgacataatggccggcaccgtttggcccaatgtaagtcacacaaggtgcaccgtcatccgcttttgccgaaatagcctccagaatcggtgctaccaagtcataagcctctttttggccgcctggcattaaggatggtccgtgtagtgcgccaagttcgccaccggaaacgcccataccaatgaaattgatcccggatttatccagttcggcactgcgccgcatagtgtcttcaaagaaggtgttcccgccatcaatcaaaacgtcacctttatctaacagcggcaataattctttaatcacggcatcggtaccggcaccggctttaaccatcatgataatccggcgcggcttctctaatgaagcaacaaagtcctcgattttatagctcgggaccaatttcttgtccggatgttcttctacaaccgccttggttttacttccggtacgattgtagattgcaacggtattgccgcggctttcgatattcaaggcaagattcttacccataaccgccatgccgacaacaccaatttgtggtttatccattaacatggacctcctcattcattcatcatttactcttttcatgttagcagaaaccgcttgggtttaacagtcaacagccgagctagaggcctgtaaattttctttgattattttttgttaattctgcaaccgtcacgaacagagcgccgcacccaaaagtttcacagtcaatcagtcagtttgatcaggtaaccgctttcttaatgagctatacttgttataaaaaggagttccattatgaaagcccccacacaaccaattgttgttcactttccattacgcggcgaatggttggcacccaatacgcctgggtctaaggttccaagccatggttctaacaaattcgggacgcgttatgcgtatgattttattcaggtcaactggcagaaacttggtcgtcctgcctaccgcggtagtttgttgaagtatctattccgcggcattccgattgacgactattattgttatggccagccgatttatgcgccagccaacggtttggttgtccgcgcagaggatcattatcctgaacggaagcggaccagctttttaggcgacttacttcgggcaagaaacgctgcccggcattttgacccaaaaagaaacaacgttcaggcagttgccggaaactttgttatcttacaaatacacgatcatgtttacgccgccttgtgtcatcttcaaacagactctattcaggttgggcgcggacaaacggtccaggcaggtgatttgcttgggcgcgtgggacattccggcaactcatttggcccgcaccttcattttcaactcatgaacaacagtgacattgaagttgcggctggccttccttgtgcatttgccgaatatgagcttttcgccggaaattcatggctaacccaagaaaacgctgttcccagcaaaacagaccgaatttgctttgtgtcacctaagtctggacctttttaaaagggtacgcttctttgtgggccgtgatgaccgtgaagctgtttgcgtcaactacccgtcgctaaagtatcgggcttgtgactcacgctgctcaaccggcagcagtagtgcaaatgcctaacggctcctacttatgtggtcacatctcagatcgtgtttcaacggtctcgggggcagacaactcccgcagatgcatagttttctctacccagtctgcttgtgcgcgtaacacggcttgacaatcccggccagccactggtttcccagttgctggatgttcatggcggctgactggtcgtcattggcatggaagccacagacacagacgtattcatggcgctcgtgatcccgctgctgtttcttgatcacgccacactgtggacagcgttggctggtataaccagcaggcactttcagcacgcggctgccttgcgcagcagctttgtatatcagaaactgttccaactggtaaaacggccaactgacctgttcatagcgtcggtcttgagcaacttttgcggttgcacaacgaacatcagtcagatcttccagcacaaacagggtatttgccccgcaacagtcggcgagtgccttagccgcacgatggttttcgtttgacatccagcggttctctcgctgacggattcgtttcaggacgcgttttgctgatttcgttcctttggcttgaagtttggcccgcaggtacttgtaccgctgccgcttgttgagcgctctggtccctgaccaataggtggtccggccggtctcgtcaaacgcggtggctaaaaaacgcagtcctcggtcaacccccacaacatgagtggtctggtcgcgggtataatctggcacttcttttgtcgcgctgatgtgcaaataccacttgccgccgctggtcaacactttggcggtgccgagtttccaagtaccgtcaaagtagtcgcgccagtggttcaataccggccaaacaatgaggcggccttctaatgtgttcagagaaaaggagccatctttgcggatggcccaatcccgccgtcggaccagatctagctgcggccgccgaaaactgattgggtgccacagccaagtcagatctttagcttgtctttgccactgaccagcttcgtcttgataccgatacggtctttgtttcaactgagtgtgcactgctcgatagcgagcgatcacagttcgcaggactgactgtgccatttgagctttcagtccaaacctagcccgcagcgagcgatacaggaccatttgcagtttcgtggtgttgagcacaaagtcatggtcaaacacatagcggctgacgttatcacaggccaagcggtactgatccatggtttgacgcagcaaagccgcatctgctttcgccaccagtttgaactgtattttaaccgtcttagtcagttccatacgagtgccaccttagtcgaatgtttgttcctatcagctgagcaaattatatcagagaaggcagggtcgaggcaattcctcctatgattgaaatcatgggtttccttgcctcatttatcatgaatgttgatcgtgatagccgcgatcttgacataccaatttttgccttttcgtttgatgattgcttgaagattcaaaattttcttcttgcaataatcaatgatttcgccatttatcagcgaaagattgtgtctgatgcggtcacgccctaatttggtagtgtgtaacttgtccaagtttttgattaactgatgagccgaatctatcatgacggtcaccacggcaagagccatttttagccctgcttccttcctcaactttttctcaaattgtgcgcgccaagatgggcactcaaaaaatggcaaccgcgcaagctgctaactgacgaggttgccattcttcaataaactcaactgctttgtcgttagtttccagcggccgattcatcagccttgatcgtcgttcgggaacatccccttcaatttcgtgaaggggttttctgcctgcttttctttcttaacggctttgtcaaaatcttcttcagccataacttcccagtcctcgcctgaaggcatctcgccactggcggcttcttctggcgttagcacttgcatggggatacttaataacaaatgatcctccactgccggcaacaaatccagctccggatcctcaagcggcatcagaatttcgccgtcttcatattgatcggcatggccatcatcggtcagatagatctcgctaaacgtgaaatcctgcggcagcgtgaccgggttcaaactgcgcgtcgagggaactaccaaagtaccctttaagttgacactaaccagaaaatcaccgcgatcataaacaatatcgccgcttacctggatgggactgacatcaagaacctctggatcacgatcctgcaaatctgccttgacatccaacgtggtactaaaatgcaacggttcctgatcgtgtttcattaattcctgaatcgtccatttcaacatgttattttgcctcctttagacgcgcacactaaccttaagatggagttatgagcgcgcttcacatcaacggtcggcggccataattttgttcaacgccgctaatcgtggtgattaatcgatccgcacgatgggtcatcgcaaggatcccattcggtgcaagcatatcagcactgacgcgagtgagcaagggccagccaacttggtgtttaacctggcgtaagtattgctgaccggctggcgtaaacccgagcacatgcagttgcggcaagtgccgagccttttccaccgccgctgttgtcatattcagcgtgattgctaaagctaatcgccgcagtctggcgtaagtgtatcgcttggacttgacccgctttaaaaagctcgtcatatcaatagcgtcatcaatctgctgggtgaaacgatattccagcccttccgccatcgtggcaacctgccgcaactgcgccaagtctgctgtctgcagacgatatttcaaccatgggaaatattgcggccacccatattgttgctgcttcgtataaaccggaatcagatctgcaggaacgatcttcgcgagcgattcacctccgcgcaaccgctgacgaatcgctgacgcactggccagattagctgtcaaatggagcgcatcatgggccacgccttgccgaccgaacggataaagctgcatcggcacttgcaacgccaaaaccgcttttgcataactcaaccccaacatgaaattcgggtctgtctgcgtgatgccggctgtttttgcataagcggcattaagctgggtcgcataagtctgggtataatccgaaaatcccggatccatcaaaggggctttttctaattgtcgggcaaggtccagataggcaagttcggggtgttcggttccaaatgccagtgcggtcacgcgtaacgccgctaacgtcgcaaccccggcttccgcaaattgatccgccgcttgcaccgctccggttaccggcagctcaatgacaatatcggcgccatgatccaacgccgcccgcgcccgcacccacttatcaaaaatcgcgggttcgccacgctggacatagtttcccgacatcaccacaaccacaacatcagcctgcgttaattttcgggcttgtgccagtgcatatgcgtgaccagcatgaaatggattaaactctgcaatcataccgaccgcttgcatagacgcctcctaataaatttgcttattcatttggctcatcacggctactttttgcgcgcgtggaaaaaccagcgcgtactttcaggtcccacaggctcgttgccaaaatcggcggtaacctcaattttttcgaacccggcattctgtaaggctcgcaaataatcagccaacggataagtgcgttccttgtgtgtttctgtcaaaggcttataggcatccaaggcttcatcgtacataaaaaaggtgaggtcatgctcaatgctatgcggttgctcgccaataaaactattccataagaacgcaaagtcatccgtttgatagttgtacatataacccggaaagacctgatccatttgataaagcgagtgagcatcaaaaagaaagtcgccaccagtcggcaaccgtgatgctacctgtgtaaagacctgttgcacctcatccagattctgcatatagcaaatcgaatcgtcaaaacaagtaacaattggaaattccggtagcgtttccagatcacgcatatcgccttgaagcagggttaatgcgacccctgcagcatcggctttttcctctgccaaggtcaacatttcttcagataaatcaaaatccgtaacttgatagcctgactgagccaatagcacggccaaaaagccggaaccgccagccaactcaagcaatggctgatgactcggcttcactcgcttgaccacataatcacgccaccgttgatacaatgactgatccatcaattggtcgtaaacttcggcaaaggtcgtgtagatcatgcctcaacccactgatccactttaaccagcggtgcatcttgccataacttttccagattgtagaattgtcgctcttctggcataaagacatgaaccaccacatcgtttaagtcaatcagcatccacttggaacctttttgtccttcaatccggcgaatctcaacgccggccgcttcttctttttcttcgatttcatcaacaattgcctgaacctgacgatccgaagtgccgctcatgataacaaaataatcggccaacagactcacaccgcgcatgtccaatgcaacaatgtcttcagctcgcttcgaatcaccggctttaacagcaatttccaacatggtttttgcgtcgatcataaattactcctttgataaaaatgcattgtaggttaacagtgttttcggataaaccaattgacgcgccccgatcagataggtcaaggtgttttcaagctcaatgcggctggcttcttccaagttagtttcggctgccttgcgtgctttggcctcaaccggcaatgaccgttggggttcaataaagtcaccgacaaacacacattcatccagcttggtcatttccggatcaccggttgtatgccgcgcaatagccgtcagcacttgtttatcggtaatgccgacttcggtttgaataaaatgaatgccaacaacgccatgccagacaccacgaccatactgcagtaacttgggatcaaagccatcttcgataatcacgcgtttatatgtttcaaccgagatttctttaccataatcatgcagtaagcccgccaagcctgctcgatccacatcttggtcaaagcgctttgccaattcgatagccgttgcttcaacccgcaaacaatgttcatagcgaggctgatcaagccgattgcgcaggcgattcagaatttcttttcgactcaagccatgcgttagacttgctggatattgatgttcattcacgatataatccctctttttgaatatagtcaatcactgggtcaggcaccaaatactttaagctgcgccccgcttgaacgcgatcccgcaccgctgtcgaactgatatcgatcagcggcgcgtcaacccataaaattggatagcggctagccggtgtatacccgcgccgcttaacgccgacgaaggtcactaattttaccagttcatcaatgtgcgcccactttggtaaatagtcaaccatgtcggcaccgatgataaagtagtaatccgtatccggatgaagtcggtgcaactcctgcatggtttgatacgtgtaactaatgcccccacgccgaatttcaatgccttccaacccaaaaagtggattatcggcaatcgctaattgtaccatattcacccggtgccgagcagaaatggccgttttggtatcgacatgcggcggcatattatcgggcatgaaataaactttctccaagcccaattcggtgcctgccgcttctgccataatcagatgaccgttatgaatcggattgaaggtcccaccgaacaaaccaacctgcttgcgacgatgcgttcccagaatctgttcgcgcatcgcaacagaaataaccggttgcgtcaacgtgacattctgcatctttttcatcacaactcctaccgcgcattgacttcaagactgatgcgacgatgttccggcttttctgcctgcttataaacgatcacggtgcgcccaataatctgcgccacttccaaaccggcaatcgctgcctgtaacgtatccgcaacttcttgcggtgtatcgtcagcagtcggtaatagactgatcttgactaattcacgggtttcgagggcatcctttacgccagcgacaaaagcatcgcctagcccatttttgccaacttgaattaacggtttggtcgtcattgccagactgcgtaaataacgtttttgtttaccagttaacatgtttttaacgctcctctgattcagttgtgccgcccttccaccacccacaccgtttttttggtcgctgcgggttggctgcggctcgtttagataaatgctttacgtaataaaacatccacgcctttaggggcataccctgcaatggtgacgccagccggtaccgtaatccagccaagaccggcaaaaaccaaatccgatttttctttcggcgtgaattcaaagcgaaccagcggcggaaaatctctgacttcatcagcttgtggcggcgctagaagacccccgacatgcctctgataaaactcatcagcgttgatcaattttgtccggtgcagcggcaattgcgtatcggcgtaaatgacaaagctttggcggccgccgcgaagataatcgaaccgtgcaagcccgccgagaaagattgtctggccttcattcagttgataagtcgccggtttaatcaccgaagtcggggataccagtttcaaatccttggggccgacaaaatgtgccatctggtggcgatgaatgatgcctggcgtgtcaattagcgactgcccatcatctagcggaatcataatgcgatcaagcgtggttcccgggaagcgcgatgttgtaatgagatcctcgacaccggttaattgcttaataatgcggttgattaacgtcgacttgccggtgttggtcaccccaacaacgtacacatcacgatgttcgcgatacttctcgatagcggtgagtaactcgtcaaccccaaacccctttttggcactggccagcaaggttgttaccggccgtaatccctgggctttagcttgctgctgcagccaattttttaatttattgggattcaacgacttaggcaagacatctgccttattcccgaccaaaatgacgggattatccccgacaaaacgatgcaatccgggaatcacgctgccgttaaaatcaaaaatatcaatgacattcacaatcaatgcattactttcaccgattgcattcaggaggcgtaaaaaatcatcgtcagttaacgtgacgggtgcaatctcattgtaatgccgcagtcgaaagcagcgttggcaataaatgtcatcgtcagcctcggcttttgctaatgtcgcggctggcagatagcctggctttttaggatcggttgtctgcaaaatagcgccacagcctatgcagcggcgctctgtttcatcattgatgatgtccatgaatatcctcctgataattcagttgccttttcttggctaaggctttaaacacaaatccctcaaaaaagcgattaatccgcgtgttccaggcgtcactttgcaccaacggctgagttaagatggtccgcacgccggcaagattaccggcccagatatctgtcagcagctgatcccctaccatgacaacttcagaacgcgtcagccctaattctttgcgcgctttggtaatcccgactggcaaaggttttaatgcccgggcaacataagccacttgcagctttgccatcgctttatggatacgattggcgttgttatttgacacaacaaccacctggatgccgccgttacgtaaatcagaaagccactgggtcagcttagccgtaccttctgggtgatcccatgccatcagcgtgttgtctagatcggtcaacaccgctttaataccttgctgctttagactagcaggcgtcaggctaaaaatattcgttaccagccaagtcggctcaaaaactgccacaaatcctgtcccctctccggttgttcatatccctatattataacggaaaagattggtcggcgcgagtcagactaagtaacagtaatgtcaactttttctcggttctactctaattaagtgatttccgatactccgagctggttccgcggtggcaccggctggcgaccgcgcagctagagtggtgggcacgacttcgaacccgcaaagaccgcggtttcgaagctcggccttggtctaaagcggagaagcccactccgcttaagaccaatttcaccactgagcccgccaccgctccgccagctcttgctttctatcctgatactcgaacaccttgaccatcatactgctgtaatcgcctaaactgatgcgctcgtgtttgatatccacatgctccaagagaaactttacactaactatgtaacaaccttcgcagtggcggtgccaaaaatgtaaacgttatctttaaaaggcgaaataatcgcgttatcagaataaacagggtaggatgaatttgatagcaaacgctcgcatttcgatattaagcctgttatacttatttttagtaagtgttataaagaaggaggctcatcatgactcgtttgcaccatgtgtcgttgctgactggcgatgctgccgcaacgatccgattctataccgatgttttgggattgcgattggtcaaaaataccgtcaatcaggaaaatattcatgtacggcacttatttttcggcgattatcaaggaacacccggtagtgtcgtgaccttcttttccattgatcgactggggcatcgttatgatgggccaaatcaattaggcgggattgatttggcgattcctactgagtcgttagcattttggcataagcggttgcaacaagcgggttgtgtggtgacgaaaacggctaacctgcttgcgttggttgaccccgcagatacaccgctacgactcatcccctaccaacggactttgccggatgcgctaacggttcccaatgatgttccgggaaaccagcagatcactggcttaattaacgttgatatccctgttgcggactgggatgccgaagaagccttttttgaaacgatgttggaacaggcgccggagcagcatcaatttaagctggcggctggcaacacgctgaccattcgtccaagtctgccaggcgagaggaagcgttttggccgcgggagcatggaccattttgcgctgacggttgaccacgaagaagtgttaccgcgattgggcaccatcgccgctcaacatggttacgaaatcgaggaattcgccgaccgcggctggtttaagagcctgtacgtgcgtgatccggccgataaccgaatcgaatttgcaactcaagcaccgggcttcactttagatgagccgctggaacatttgggtgagcgccttggtttaccaccgaaatttgaagaccggcgagccgaaatcgaaacttatttcaaaactaaaggagtggatttccatgattgaacatccattattaggtatgaaccacgtgaccgctatggcaagtgacccacaagcgatttttgattttatgagtaaaacgttaggcctgcatttaattaagaaaacggtcaaccaagacgccttggacacctatcatttttattttaccgatgaccaaggcacggccggcaccgacatgaccttcttcaccttccctaatcaggaaaaaggcaaaaaaggcaccaacatgatctcgcgcgccagtttccgagttcccagtgacgccgctttggactactggttgaaacggtttgctgacaaaggggtagcaaatgacgggattagcacccaatttgacgcgaaaatcatcaatttccacgaccaggatgatcaacaatatcagttaatctcggacgaacacaatcacggggtggctggtggaacgccatggaagcataatgatgttcctgaagaattcgcaatcaccggtctcggcccagtcaccgtcacgatttttaacctcggccatatgcagtatgtgctgaccgaaatcatgggctacaaacagattgccgaagatggtaactggtcgctctatgaagttggtgaaggtggtcatggtgcgcaagtgattctagagcatcgcgaggatctgccaatttctgttgaagggtttggcaacattcatcacgccgctttttctactgataatcgtgagactttgggcacctggattgatcggattaagcaatatcggctgccacaatcaggttatgttgatcgcttctattttaagtccgaatactttcgggccgccccgcaaatcctgtttgaactggcaacaaccggtcctggcttcttacaggatgaaacttacgatgaagccggtattcatcttgaattgccgccatttttggaaagcaaacgtgcggaaatcgaacgcggtctgaccccggttaaaaccgattggcgcggccgctaagcaacggaggttatgatggcagaagaaaacgtaaattatacatttgtcaaaggcgatcccagtgtgtcaccattattgttactgcatgggcaaggtggcgatgaaaatgatctgctgccgattggtaagtatctctcacccaatagtccgatgctttccattcgtgggcgcgttcaggaacaagggatgaaccggtatttcaagcattccgaaaacggcggcttcgatctgaataatcttgaacaggaaaccacttggctgtttaaggtactaaatgagctttgccagaaattcaacattgattatgagcgtttcattgtggtgggctattcaaacggcgctaatgtagtagcccgagcccttttaactcgcagtgacacttttcacaccggaatctttttccaccccatggcgctttcaaccgttgattccaaacaagatttaagcgatgtgaaggtttggatgtcccatggcgatcaagatccgattgtgccggcgcaaaacttcaaggtgttggatacttatcttgaagaacaaggcgccgaggtcaccattttccgccatgatcaaagccataatttgaatgaagcagagttagcaaatgccaagtcctggttagctaatagcggccgattgcaggattggcaacggaggtgatttagatggaacgttttgggtttgaacaatatggtaacccaagtgtctttgaaagcattgaggcgcctgtcccggagccaaaagccggtcaggtgcaattgcaagtgttgggctttggccttaacccttatgacgcttcgttgcgccgtggtgaacaggcagcttttcgcaaggttaagtttccggtcgttccgggtacggatgtgcttggccgcatcactaagcttggcgaaggcgttagtgagtttgcagttggcgatttagttatgaattatcgacccattggcggttacagtgaatttgtcacggcatcaacttctaagatctataaaaagcccactgccttgagtttccttgatgcagcagcgctcccccaagtcgggttagccgcatttaacattttgcattacatgttggcacttaagcctgggcaaacgttagggattgtcggtgccagcggcggtgtcggagcgatgttggtacaactcgccaaattcgagaaactcaatgtgattgccgtagcgggtgagcagcatcgcgagtatctacgtcaattaggcgccgatcaaatcttcagttataccgatgaattgcctgagaatacggccgatgcagtgatcaatgcggtttttggtgcagcagatcatggcgcggcattgaagctggtcaaggctgatgggcagtatgtgacgactgcctatgccgacgttgatctcatcaccaagccaaccgttgaacatctgcagttaaatccatccaagacctactcagtccacgatggctttgcttatctcgttgacgttgcccaaaaatgggggctgcaagttcgcgttgcccagaccttccccttcactgtcgccggggtcattgccggccatgaaatgctagagacccatcatgcgccgggcaagctagtcgtcatgcaagagcggcatgtaacgcacccagttcgaaaagaaatcaatcacctttaaccagcacttaaaaactgcttgcgactcgccaatccgcgccgtatgataagcgcgtgactggaaaggcgggacgatatgaaaattgcagtatattgtggtgctaatcgtggtgttgatgacgcattcgtgcaagccgcaacacgtgtaggtgcatggattgcccaacgtggtgataccctgatttatggcggtggcaaactcgggttaatgggcgcagttgcccaaagcgccttgaaacatggtggcaaagtgattggcatcatccctcaagtgttagcagatcgcggtctggctctaccgaatctgacccaattagaagtcgtcgaagatatgggcacgcgcaaagcacgcatgattgcgttagcggatgctgacattgcccttcccggcggtcctggtacacttgaggaaattaccgaagcgatctcgttttcacggatcggattaaacgctagcccgacgatcctatttaaccaaaatgattattaccgtccgctacagcaaatgtatcaaactgcggtaactcagggcttctttgatcaggacgcctttgacaatgtattgttctcgtcggatttgccgacaatcagcagcttcattgccaactatcagccacttggcgttcgtcaataccattagcagctggttcttgaatgctatttcaacttgatacaaaaagcacgccgttccattcacaaagaatgaaacgacgtgctttttaactacttaggccaaagccttcttagcagtgtctgctaatgctttgaagccatctggatcgctgactgcaagatcggcaagcatcttacggttcatgtcgacattagccaccttcaagccgtgcatcagcttgctgtaggaaatatcgttcatccgtgctgctgcgttaatccgggcaatccatagacgccggaagtcacgcttgcgagcgcgacgatcgcggaaagcataacggtatgaaaccataacttgggcattagctgccttaaacagcaaatgcttggcaccacgataacccttagcgagcttcagtaccttcttacgacgcttacgagtaactgttccacctttaacacgtggcattagaattcctcctcaaatcaaatccgattgctgattatttcatctggctgagcatctggcggatccgcttcatatctgagtgggataccaatgctgacttgcgcaattgacgacgctgtttcttcgtcttgccgtggaaacggtgtgacgtatacgcgtgaccgcgcttaagggcacctgatgcggttttcttaaaacgctttgcagaagcgcggtgggtcttgaattttggcatgtctttttcctcctctaaacatcaacgcgcgcacagccggttggggctgtgcacgcctttgtatcattaaccgatcagtaattacttttcggctcgcggtgcaagcatcaagaacatgctgcggccgtccatttttggatgggtttcaacagcagcgatatccttaacggcatccgccatctgctcaagaaccttgcgaccaagatccttatgcgtgattgcccgtccacggaaccgaacgctgactttgactttgtcgcctttattcaggaacttagttgcgttcttcaaacgggtattgaaatctgcttcaccaatagttgggctcaggcggatttccttgatggtgacagtcttttgtttcttccgagcatcgcgctctttcttctgcagctcgaaccggaacttcccatagtccatgatgcgggctaccggtggcttggcattaggcgatactaggacaacatctaagtttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtgtgaatttcagagaaaaaacaaaaacagcgtagccacaaaggccccgctgttcattaaataccgaactaatgagcctagaggtctaaagacttgggcgagaagcgggaacttctgctttttctcaacgtaaataactatacaggaattcaggagtaacgtcaagccactgtcgaagatgacagagagcagttcttctacaaaggcatacagggaattatttctcaggcataaatagctctgataatgtccttctttttaattctttcaacattgaactttgggccatgtcaaaaatttccttgctctttaaaagcatatattctgcttcctgccggtggataaaagtgttggtatcaaagtcatcatactgcttgaataattttacgtcgccttcaatagcctcaaaaacatcatagaatcgaattgactttgctggcatcgctaaagcaagcccaccgttaacacctttctttgattcgatgaagcccttgttttttagcaaagcgactaatcgcttaacgctgggaacgggtatcgctaatttctctgagattgcttggattgttagatacttcgcctcttcgtactttgttttcaactcaatataaaataagatttccaacgactgagaaaagccaactgaatatgacatttagacctgcccttttacttcaaaatatttcccgacagttttcaaaccatactgccctatgatttaaatactcatagcggctaaaatctgttaatcgttttattttaccataatcgggttagcttcagggttaccgattcttaaaacaaaactagattagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactagattaactaattcaccatactactcgttcattgtttgttttgcagagattcggaacctttatagctaaatttgatcttcatcttcaaccctactttttctcaaaacaagggtcatgacaaataaaatccccataatgagcaagattgctgccaaaatcataacattttgaaaaatgtgaatgacactcgttgtcccggacgtaacaaccaaccccaaagcaagccccaaagccgcaccgaattgtctggtcgtattatagacgccagatgcggctccgctaatgttttcagggatatcagccattgccgaagaagttagtggtgttaaagccaaggcaaatccagcaccgaacgtcaatgtgaatggaaaaatgtaccaatagtttgtcaaacctgcgaaaacggccaacccaactgccgaaacaaacacaagaaagaggcctacaagcataacttgactattaccgaataattgcacaattttccgcgcttgtaacgcaacaaagaatagcaaaattgacatgggtatcattccgatggcggcaataaacgcagtataatgaaattctctttgcatgaactgaggaatatagaaccagaaaatcactcctgccgccgaaaataaaagtgagccaatgtaagaacccacccgcacccgattcttaaaaatgacaagaggcatcatcggcttagttgtgcgtaactgactgataataaacatgagccaaaacattccggaaagcgttaacgttaagattggtctatgactgccagcaagactataggttagtgagaccatagcaagcacggacagtagattacctacccaatcaagttcgacggttttcttttgacggttcgataaaaccctcaccgcaacaactcccattatcaaagctagcggagcattgattacaaaaccaagccgccatgaaacaaacgctgcacagaaaccgccaaaagcaatcccaactaccgcaccagctccaatgacggctgcatagtacccaatcgccttttgaagttcctcgcccctgaatgtgtccgttatgatggcaagacaggttggttgcaaaatagcggctccaataccctgaattgtcctgaaggtaataatcataggagcgttcaccgatagacctaccgccaaactacctgtagcaaatagaagtaaactgataataaaaaagttttttctgccgtacatatcgccaagtttgccacctaacaacataaaaccagcgtatgtgagaacataacccatttgaacccaagaaagctgactaggtgttaacgacaactgtgctgccaactcgacggttccagtatagagaatgcctgtatcgagaaccgttagaaatgctccaataagtgcaaccatcatgataacctttttcttcactgtcaatacttttccttctttcattgctaccttacgaattgcaccataagattattagatataacctaaatatacctattaatctaaaaagcacctgttaatctcagtttttacctcgtcacaaaataaaacgccactggatttctccggtcacaagccaacaactaatggacttaaatttcgtgctacatcaatacaacgcgtggtatttctctgataaatcaatgaacaaatcgtttatattttgattaatcgtaagcacaccatcttctggggaagccgattcactaacaacaatctttttaatagcactcgggaagctgcttgcccgacgtttcgttccaagaatgagaagcaaatctgccgactcgatcattttctcaccgtttgccacctcatttggataagtccttagatctcgataaacaaaatccgggataatgagtcctccacagatacgacatttgggaatattctggttttccaagagactccagtcataaagtcggttacaatttacgcaacggttttttcgcatatcaccccaatactcacaaacctgccgactgccggctttttggtgtagataatcaatattcatagtgacgacaccggctaactttccagccttttcaaggtcaaccaaaaaatgatgacaactgtttggccgtgcatctgggtgaaaaaatgtttttcgataaatacggtaaaacgttgctggctcacttcgcgcaaaacgttgactaacaaggttataagcgtccccatgatagtcactgtctcggtttaaaatacttaaaataccatcgacatcgggaattcccgaatcggttgaaactccggcaccagtaaaagcaacaatgcggtgactttctgcgattaattcaagcattttggatattttgcacataaattcttacctccttcaattaatgttaaaagtatattccaattatacttttaaaacaacgcttttcagtcttttatctatatccatcttgtcgctgatactacttttgttagtatcttttccctacctgactaacaaaattttctggaattgaccacggccgtttaaattgactatctttataaaaaaagcagatgcccaaagacggactctgcttaaaataaatcattgacttcactttcaaaaatcaaacaatcgtcaacgccgaaatagtgttttctccagctgttaccgttgataaaatggttcaaactcaccactcacataccgaccaagctcattatcagccggactgacatgaaattgcagcgtctccggtaaataggcttctgcaaaagcaacaagcgcatgcaagtcggcgttttcgtcagcatccactaccaacaataaactcttggcatcgttggctcgaatcatggttgctaaatatgcagcgtgaatcgttgccattttcggcaagtacgtttgcagacgtgaaacaagatcagccgcttctttaggcggttcagaaagacgaacagcctcgccatgttcggcttgatccggtttagcaacataaaacaggttggcgcgggttaagaccatgttttcgccatacggattgattacaacgccctgaatatcgtggtcttcatagagaaaattcgcacaatcgtcaatggttgcaaccgcaaaatggtcatggtcaggactttgggcaaaactggcctgatcggtaaaaatgggtaaaaaatcgtggccattatcatccgtcaacagtaccactgtcggatcccctgtccgcgccgtgccaaccggtaacataaatttagctgtttttaaccccgcgtaaaaagctgctcgcgtttcatcattttgatcctcacgtaataaatgcatcaggtgaatcagttggggatttttaacttgtggttcatcactcatcatggtcatctcctttatcctgctgttgatccgcgttaattttttctcgaaaagcgcgtaattttttaggtaatccaagtagccaggacaacaagacgatcccgacgctaccgaaaaccgcaacgccttggggctggaattcgatcttgccgaaccaccaatttgcaatcccatatgcggcaaccgcggttaacaacatcacgaatcccatgatcatcaataatccgcggccacgatgagcgattagccagtagccgcgttgattaggggtgcgccacggcagtttcatatagatcagcaagacagcgaagtataagaccgctgctaatattttggtaacgaagaacaagacgagccaagaagcccataacgcaataaacacctagtcaccctttctttgatgtgggttttaaatgagtttagtgtatcatacatcacaaaatgtcgtgaaaccgcgagatctttatcctaagattgcgctaatccttcaacggcaattaaaaagatctgagctaaattgcccagatcttttcgttggaactaaatgaattagtcacctaaaaccttattagcttcgcccggcttggttttgccgtcgcgactgtagttcttaacctcagctaccatcgcatcgatgaacatattacccgcttcttcttcagtatgttcatcgccataccgccgtacggataccgccgcatcgttgagttctttgtccccgacaacgaccgtgtatggaatcttcttggtttgggcttcgcgaatcttataacccatcttttcattgcggtcatcgactttgacgcgcaacccggctgcctgcatctggcgtttgatgcggttgacatagtctaagtgcagatcattgttaaccggaatcaaaacggcctgtgttggtgccagccaggttgggaaagcacccttataaatttcggtcaggtaggcgatgaaccgttccatcgtaccgacaatcccacggtgaatcatgacaggccgatgttcctcgccatccttgccgacataagtcaagttgaagcgttccggcaacatgaagtctaactgaatcgtggacatggtttcatcgttgccaagcgcggtcttagtctggatatccaacttcggaccataaaaggctgcttcaccctcggcttcgtaatagtctaggtgcaagtcatccatagcgcctttcaacatgctttggctacgggtccacatttcgtcatcatcaaaatacttttcggtattcttaggatcacgataagaaagccggaagctgtaatcggtaatgttgaagtcttcataaacatccatgatcagacgcagaatctttttgaattcttcttggacttgatccagcgcaacgaatgtgtggccatcgtttaaagtcatttcgcgaacacgttgcaaaccagacaaagcacctgatttttcataccgatgcatcatccctagttcagcaatccgcagtggtaattctcgataagaccgaatgtgatggttataaatctgaatatggcttgggcagttcatcggacgtaattcgagcatttcgccatcgcccatgtccatcggcgggaacatgtcttcacgataatgatcccagtggccggacgtcttgtacaagtcaaggttggcaagcacaggggtgtaaacatgttcgtaaccatcggcgatttccttgtcaataatgtagcgttcaatgacccgccgaatcgttgcgccatttggcatccagtacggcaacccagcgccgactttaggatcaacgaagaaaagatccaagtcgcggccgataacccggtgatcacgttcagccgcttccttacgccgcttggcatcatcttcaaggcctttttcgctccaataagcggtcccgtaaatccgctgtagcatcggattgctgctcttaccttgccaataagccccggcaaccgacagcagtttgaaatgcttcaaatccttaagactcggaagcaagactttttcttcaaaatcaacaaaatcgcctagcttataacccttaatcggatcgccggcagcttcgaccagttgctttttgaacggatcgtccttaaagcggtcaaaagcctctgcccgactgagcaccactggctccaaagcagcgttagccttaatgatttcttccattttcttttggactgtcggtaaatcatcaacactgacttgtccatccgcacgatcggtatcatagtaaaaaccgtcttctatggcttggcccttgccaaaatggatatcagggtacaatgctttgagtgctgctgctaaaacaaatgccgccgtctgccgcaaaaccgtgagcccttctgcatcatctttggtcataatctgcagcttgccagaatgggcaatcggttcattgtatgcaatcaattcatcgtccagtttgccagcaacggccttttttgccagactattgctaatgccttccgtgatggcttttaccgttgtaccatcagggaattgtttgacactgccatctggaaacgtaatatctaatgccataagtaagactcctttgtcgttttttcgaagaaaccattttaccgagtaccacttctgagttggggaggaaaaccgcgctggctcgcgctcacaaaaaaatccctgatatctcctaagagacatcagggacgatttgtgatcgcggttccacccaggttgccgacagtcttgctgcgggccacttcattggcgcgtaacctgcgcaacagggccattagggcaatctcgagaagtggttcggatcagatcttgcaaggctttcagccacggccttactctctagtagatgatcctttattgcttccgtcttcgatagttacattgaaccacaatgtccgctttggtgcaagtaattttctgaaagggtaaaataccaagtccacttggtataaaataaatatacttctccggtacgattattgacaaatggggaggcatataccttggaaaacgaaaagcaaattatccaaacgagatttggaagtgctctgatgcgacttcgcctggaccaacaccttactcgtcaaagcgttgtcgatcataatgacctttcacttaacgccttagctagcattgaaaatggtcaagctctcgtgaaattagacacccttatgatgctgctgaaatactacaatatgtcattaaaagatttttccgaaaattacgtaaatgtagccaacaattcagatttcagtaccttgatgagtcagtccatcacaccagatacacgattcttcattcttgatacaaagggcgcaacttcagcaaataactactctgaccaagatttctctcaatatcactggaactcccgtcaatttaacaaggtgcgcaccggagactggttcatctaccgtcgcccaaaaggcagttctaagttttggtatttctttggtgctggtcaaataggtccaatcactcacgatgcccagaacaatcaacatgccaagattgtcaacccaattgcattcacatattatctcacccctgaggacttaatagattttccctggtcgtttcgtcgacgaactaggcaagattggttgtactttttcaatcaatacggcatgactgaaattcaacaaaccgatttccaaggacttctaaatgttgtcttaaaccatatggatagtcagacttcgttacctctcactcctgaaattctccaagaagacgttgctgtataccaacacattcaacgccatgaacccgagctaacggagaaagtcgagcctcgtaaagagagaatcggacaaaatcaactcgccgaattggtgcggctgaactatggttatcaatgtgcagtcactggaatccatactcgctcgttgttaattgcatcacatataatcccttgggcgtcttcaccagaaaatcggttagatcccagcaacgtaatctgtctatcgccactgtgggataaagcttttgaccaagggctgattacatttgatgcatttgatcacactatccgattatcatcacaagttactgaagacactcatctttaccaagaactagccccttttaaaggaaagctgctacgccaacccactaaggataaaccccaaaccaaatttcttgcttatcataatcgaaatatttttaaaggctaaaaaaactatctttagcaccagttaccgctaaagcccgatcccctggaaagctcgtctaagcagagtgatctgtattcaaacatgtcattgtagcatttttcaatttagggagcatattttactacctagatccttaaactagtggtatctaacatcgatatttgcagtgataatagtaatcagcaatcaataactttttagcaacactcactgtccatactacttcagatagcatgtcacttaacgttttgctgtttgtcgttgccccgatgctggccactaaatctagtactcgcggatagggtttttgaaattcgaattcgccgagccattaaatacaacgcattgttcatctctgtgatttcgtgtaaaaactagcgcccttctataaataattatttcaattttgaagattatcaaaacgaatcgccccaacatggcatctagtgaatgaatagtagcgtctattgaaaaaacctttaatctgccaaagggttccggcgattttcaccgtcaacggtaatttcttttgccaagaaccgtacccgctccataatgcgtttggcttttaacatttccgagttgccacggtccgtccctgccaatgactcggttaattcggccatactcttgtttgaactgaacagcgtcggcattttctcctgcatgcgatattgcagaataatgcccagtacgtcatcccgaacccatggactgatgctttcggcgccaatatcatcaagcattaaaatcggtgcccgcttcacgctatcaatctttttcaacacgctgttattgccgattgcgttcttcatttcaacgacaaacgtcggcacatgaattaatgtggttgcgataccgcctttgcttgctaaatcgttggcaatcgcacctaacaagtatgtcttgccaaccccaaacggcccacttaaatataatccctgatgaaacgccttaggatcggcaacaaccgctaaaacaaaccggtttgcggccaaaagtgcatcaagtcggtcatcggttggatcataactgtccaagcttgcatcgcgaatatctttaggcatgttcaccgaggtcaccaatgaggcttgcttggcttcttcgtctgccgctactttcgcatcagtcggttcatacgccacgtcaatcaaaccgtttgccacgacaagcttgggttgatagccaggcgccaatggtaattcgcctcgggcaatcttgttacgctcactgacaaattcataaatcttggcagttccgcggtcaatggcatcattggctaaatccgcttcatgctgcttcaggaaagtctggacttccggatcctgcaacgcttctttgaccatcttaaaataccgctcccgccactgtcgggaatccatcaacatggccagacgcttgcgcatatcttccattagttcttacctcctttatcaccaagctgccgaagtttctccaattgggcagccaaggtttgccgatcagcttcactgaccttccttttctttggctgataaccttctttggcccaatccggtagtttttcttgccgcgtgccttttgtttgagtttgacgacgtttttggccagtcgccttttgatgctcaaacgcatggatctggtttaaggcagcttccgggctggttacattggcttttaaccagctgttggcaatcgcatccaacaacgcctgattaatactgtcgttggttctgagaatataatcaatcagaatattaatcgtcggtgcgtcaaaaacattgcgctcactcaattgctgaatggcgcgcagttcgttgttagccggatacatgcgcgcgtttttagcctgtttcgccgcagttaaaaactgccgcggtggcatacttttggcccgcttaagcaatgcctcatcagcacttgctacttttggcgtctgggttggagtttgcggtttggcatgtggctgctggcgcgtatagctttgttcggctagccggcgcagttgattcaaatcgatttttcccgtcataacatcggtcgcgcgactgatcaagcgggcaaaatcaggcggttgcaagccgtaaaatgccgctacttgataaagtgccgcttgatgtttagtcagttgtccggtttgcagattgctattggccaacaacgattttaataagtcccaatcgtagccatccccgcttcccaaccgtggacgatttgccggcttttgggtcacggcttctttagcggccacaacagccggtggttcctggctgaggtcatggtcaaagcgaaacacatccaagaagctggcggtaatctcttgccattccggacgccgcaccggtttcaagctaaacttggctaccaattcatcgtagcgattctcgcccactttgtcatacagcaggagtcctaacaggtcatctttgaaaaaggcatcgggactcaccggtgggtaaagttcatacgcataataacggcccaatgagtcaacttgcgaataagtgcgtaataaccccactgcttccaatttcacgcgcgcaacaaacagctgctcaatgtcaatatccaaaagatccaacagccaaagttgcggccgccgatccgtgaccaaggcgcggtctttgacttcttgccataagctcaggtaaagcgccatcggaaccgggccaactaagggttgataaagcgaaactgccactttttcgtcaaagtcgctaaaataacctgctttggtcaacacaaacccggcttgcggaataaacgtatcagggcgctgcatgacattcacctcttttcagacaacggacctgagacaatcgcctcaggtccgttttgttgattacttcaatcacatttacttcttagtcttttccttcttcatcatatcctgaagctcttgcatgaagacggacatatccttaaattggcggtaaacactggcaaagcgaatataagcgacatcatcgacatccgctaatttcgacatgacatattcgccaatagcctgactggaaacttcattttcaccaatcgcgcgcagttgattttcaaccgaatccacgatcccttgcatttgttccatggtcaccggccgtttttcagcagcccggatgagccctttaagaatcttctcgcggttaaattcttcccgcgtgccattctttttgatgaccaataacggggtctgttcaacgcgttcaaaagttgtaaaacgaaacccgcagttctcgcactcacgccgacgccggattgcccgaccgccgtctgtgggacgcgaatcgacaacccgcgaactattatgatggcaatggggacattgcacgactccaccttcttaatcaaagtttgatagcttattatagcacgtgcaagccgcttatgatagttgctcaagccggtgaatcaaggcttttgcctggtcaatcgtcgcggcttgtgtcccgttgttatcgatcacaaaatcagccattgccgcttttttggctaatggtatttgggaagcgatgcgttcttgggccgcttctttggtcaagccatcgcgcgtcatcaaccgcgccaactgcacctcgggatcaaccgtcaccaccgcaacgccatcaaacgcatcggcatagtcagcttcatacaaaagcgggatatccccgacaacgatggcggcaccgcctgctttggcttgagcaagcgcttgattaatcgctgcacgcaaatacgggcgattaatttggttcaatgcttccatacgtcccggctgcgaaaacacaatgtcgcccagtttggcgcgatcaagggtcccgtccttgcgtaagacccccggcccaaacgcttggacaattcgcgcaagcaccggttgacccggttcaacaatgcgccgggcaatcacatcggcatccaccaccggaaacccagccgctttaaatgtccgacttaccgttgatttgcctgacgcgatgccgcctgtcagccctaacaaaaaggtcatgccagttgcccccctcgatgtagcggctggcaatgcgggcaataatgcgtgccgcgttgaccgactttaattttgacaattgtggtgccgcaacgatcacaaggcgtcccttcacgatcatagacatgcaaagcatcctgaaacgaaccgcgattgccttctgcatcaacgtaagtatgggcactggtaccgccagcggcaatggcgtcgtccaattccttgataatcgcatcatgtaacgtgtgaatctccgccttggttaaggtattagctggctgcaggggattgagcttgctgagccataaaacctcatccgcgtaaatattaccgattccggccacaacagtttgatccagcaaaaccgatttaatggctttatgatgccgctttagcttttgggcaaagtcactttcgctaaaagtagcagcagtcggctccggccctagcttggccagtgctggcaccaattgctcctgaccagtgtgaattagccgcattcggccaaacttacgcagatcgcggtaacgcaactggctgccatcctgaaaggtaaacgtcacatgatcatgcttatccagcggcgttttggcatccgaaacaacgtaatagcggccttccatgcgcaaatgactgacaatcgtcatgccgttgttaagccgaatcagtaaatacttaccgcggcgatcaatcgtgttgacagcagcgcccacaacctgtttttgaaaggttgccagaccattaattaggattttctcccagtttgtgctaatcgcggtgatttttttatttttgactaacggtaacaaggaacggcgaaccgtttcaacttcaggtaattcaggcatgagttctccttatttcgcatcaaaccaggtcggtccataatgactttcgactttcaaaggtaccgccagtgaaacagccgagtccataatcttaggcactaattggccaagttgcgccatttcagcagtcggagcttcaaaaatcaattcatcgtgtacctgcagcaacattttcgcctgcagatgggcctcatccaacgccttttgcatgcgaatcatcgcgactttaatgatatctgcggcactcccttggatcggcgtattcatcgccgttcgttccgcaaacttgcgcaagttgaaattgcgggagtgaatctggggcagataacgacggcggtggaagagcgtttcaacatagccgtcttcacgcgctttcttgaccatattttccatgtaatcgtggactttcgggtattgttcaaaataaccgtcgataaacgccttggcctgtttccgcgaaatcccgatattttgtgctaggccatagtcactgatgccgtatacaatcccaaagttcgtggccttggcttgccggcgcatatccggcgtgacctcatcaggtgaatcgaggccaaaaattttcatggcggtatttgcgtgaatgtcaacgccgtgtttaaaggcttgctgcatattctcatcacccgaaatatgcgataacacgcgtaattcgatttgcgaataatccgagctaaaaatctgccaatctggatgagaagggacaaaggctttccggataatcttaccttcatcccgtgctggaatattttgcatattcggatcaacggaactcaggcgcccggtttgcgtcagtgtctgtaaataacgggtgtgaattttatgatccggcatttgtgctttcaacaaacccaccacataagtcgagtttagtttggcccagccgcgataatccagaatatcctgaacaattggactagccgatttcaattcgtttaaaacatcgacactggtggaataaccggttttggtctttttaatcactggtaaattaagtttttcgaataacacttcgcctaattgctttggagaattcagattaaatttaacgccggcttcaccataaattttttcttccaacaccttaatgctttgcgaaaattcggttcccatgtcctttaaggtttgagcatttaacgtaataccttgaatttccatttctgccaaaacccgcgccagtggcatttccatgtccgtgaaaagatccgtctgttcctgtttagccaagtcttcggttaaatcaggacgcaaggcgaataaggcctgagacttacgagcgaattgttcaaacagcagtttatcttcaggcacttgacgcttagcacctttaccatatacatcttcatcgcgaggcaagtcatgataatcatggtcttctgcaattttacccagatcattgctattttcatctggattaatcagatacgaggccaacaaaacatcgaaggcaatgtccggcaacttcaggccaagacgatgagcagccacaatattgcgcttgccatcaaacaccgttaagtcgcggtttgaatcaccaagccacttagcaacttccggaatcgtcaacaatgacacatccgtgctgacgtaagtttcttctttagtcccaatgaaaaagcccacttgttcagcggtatgataattatccgctaacatttcaatctcaaaggttaacggttcggttgttttcgtgagcgccaaaattgattggtcatccaaaacggaatagtgtacaggctgtgacggttttgcaacatccccgccaattttcttcaacagggaattcatattcatcttagtatagaaatcgcgtaacttcgccaaatcgggaccgttatactttacgtctgcaagatcgatggtcacaggtgcatcgcggtcaattgtggctaactgcttgctcaggtacgctttgtctttgtcattgatgagactttccttcattttggaagtcttcatcgcatcaatgttggcgtaaaggttttcgatactgccatattgctttagcagttttaaagccgttttttcgccaaccttggtgacccctggataattatctgacgtatcacccattaacccctttagatcaataatctgagtgggggtaatgccaagcttttctttaacgtgttccggcgtgtacgcctcaagttcattaacgcctttgaccgtgacctgcaccgttgtttgatccgtcgttaattgcgttaaatcacgatcaccagtcacgattgttgtctgccaccctgcatcatcagctcgcttagccatcgttccgataatgtcatcagcttcataatccttgagttcataatgctgaatgcccatatcgtcgagtaattccttgatatacggcagctgctctaacaactcgcttggcgtcttcgcccgaccgcttttataatccgcgtatttagctgttctaaaagtcgtcttgccagcatcaaacgcaaccaaggcagcatctggtttaaccgactttaaaacaatctcgagcatattgttaaatgcgtagatggcattggtgtgcagcccatcttgattggtgaaacgatcgagttgattgtacagggcaaaaaaggcacggaatgcgattgagttgccgtcaatcaacaataatttagtttgactcgtcatatatgagcttccttttcttctcaaaccaccgctatcgatgacatgagttaattgtcatcattattgtaccaaattctttgcctttgtgacggcacgttcctagttaagggggatcatctcatagccgttgcggtttgataggttgcagtgggtggtggccgtccattgatacacgtttcttcgtgcaaaagcttacgtgtaaggacattgaacgcaatggcaaagaccgggccatcatgcttaaggccgcttacactctgagtccttgacactcactttctataacgcgctccccggcgcagaagtctgcgtgtaaggaccttaagcgcaatggccaagaccgggccatcacgcttaaggccgcttacactccgacttctaaccgcgccggctcgcgctcacataaaaaaagccggtttctgaccgacttttgcttttattaattgttgttgtcgccaacgcctaggatctgcaagatggcggtgaataggtttaagaaatcaagataaagcataagcgccccgacaacggctagtgagctggtggaaatagctgcttgtccatcgctgccagccgtcaagtataagttcttcaggcgctgagtgtcccaagcggtcaacacgatgaagatgatcaagatcgcataagaaatcaacatctgcatgccgcttgaacccataaacatgttaaccaacatcatgatgatgacgccaaacaatgcagacatcgcgatatttcccgccttactcaggtcacgcttgccaaaatggccaaccatggacatgacgaaaaagactaccgccgttgttgccaatgcaactgcaaggttagatgtctttgcaaccatcgcaacggaagcaaaagtgaaaccaaaacttgcggacatcagataaaacattaaagttgcataacccggacttgcctgggcccgccgtccagtcacaaagaaggacaggatcagcggcaatgctgtcataatccaaaagataattggatgagcacccacaaagttgatgtaatcattcttaagggtaactcctagtaaataacttacgagcgccgtcacaaccagcccgctccccatcaaggtgtagatgcgggagaagaactgcgtcaagccggcctcgtttacaacacggcgttcttgcatattgcgttcattcctttcaactatctataactattataaccagatcaaaacattttgtcagtcaggccaaagaccgatttgcatcttggtgagtcaaaccgtcaagccctgatactgactttatcatgctagtgctaacattaacagcccgacatgcgcttgtccactggcttgtatagatcgtcattgctttattgcatatgtgtgaatgcgatctttcggaggacaagcaagggaaaatactagatttatttataattaattactattaatttactaaagttcacatccgctcgtaaaatcattgaccggcatacgtttatctgttaatttttaatcatcgaaagtctctctcttaaaataaaggatgtgaataaataatgctcatgtttttttatggcaccctagctatcatactgattacgatgctcttatttagaaagaatccagcgattaatcgaatctcaagtgctatcatctcgtcatcaaaagtgggagcgctatgtcgaacttgctttttaatcgtgaatttcattttcttttatctgtttgtgacccgcgacttgttgactttatttacaatcgcgatggtcgccatcatgtatcttgccgttgactggagtcgtggtctacaaaggagttgaacgcatttcggttaataaagtacgccttgaatgccacaatgagtcgttttttttcatgcaaaatcgagatgcgaaaaaagctaacccgcgatggattagcttttttgtttaaccgcagatctggtcataaagcccatttcttctcagagataactgaattgccatcacactggcaacacagaacagatgtcttgaaagccttcaaattaagcaccgcgatgatgccgcgcataacgtttgaacgcaattacattaatggtgaggagtacgactaaccctgctaaaatcattaagcgccagtcaatcgcattcgcttgggcaggtgcttttttaacagcggcagcattcaggtcatcggcctctttttgcgcgaccataaatgttttcttgaagtgccatgttctaccgcctgcctttgcgaccccctcaaaacgatattttcccggttttaacggttcatcattgagatcgaccttaaaattaaagtttgagttcggtgccatcttgagttcgtgcttgcgcgtttgatacagtgttttgcttccgtctgcctcaaagatcttcccttctacagtcaggtctttgagcatcgccggttcaaagttttgaatattggcttgaatggcgttgtgaccatgatcactgaccgccttcacttcctgcaccctcaagttcggtggcacgacttgatcagattcggttaaaacaacaccgagtgcgtagacataacgattagcaactgcgccactcgttgtcgctttttcatctggtttagccataaattgcaggccaccaagaaccgtcccggcaaatgcctgcgcgggcaactttaattgcaaaggtactgtttgttggcttaaagccgggatcgtcacttccgttggggcctttaataacgttttgagattgacctttaatgacgcatccgttcgacccacctgttcgccgtattcgaccaccccattatcgtttgtgaaggcggggttcaccttgatgagcacggtcacgggatcagcttgacgattttgaatgacaacgtttaacgtctgcgcttgattcggactcacccgtaaatcaaagtagctcgcacttgtaccccgctgattttccggcaactcagctttgaccgtaaacccttcgcctgccgcttgtgcagattgctgccacatgccggaaaagagtaccatgacccaccccaagagaccaacgatccatatactttttttcatcttttgtgtggcaccatcgacgcaaacgtgcaacggcgcctcctttcttagtgttttagttttcgagattgatgcagataatatgccagtaagagacccagccagaaaaagacgcctgctaagacagttatcagatatgaagcttcttgtagcgctggcagttttgcaggcttagtggctttctttttgcttatatcggccattgccggcttctggcgagaggtaggcagccgatcatcgcctggcgaatccggcgttacaaccttcacaattttgggatcgctcatcggctcaaccagaatgcgaacatgagccacggaagtcttttcgtcagcatgggtcatcgttgccggtgccgcaacaacaatgccaattaagactgccacccacactagcctttgatttgctctcatttggttttacagtggcgccctggtcagcgtccaagtcagcgtggtggaaaaatctcccgacttgagcccttccgttgcataacttttggctggcaccgtcaaggcaacccctttatctgcttgtttctgattaaacagatccatgaaggttcctttagccgtttgaccgtcactaacactcaaaatatcaaccgcttgcgcatcgccagtgtagaccttaatcgctttgttgagtccgaaacgcgcactcgcatctttggcttggccatcgataacgctgctttcaagcaaggagattgccgcgtttggcaagaccacggttttggtcactttgccggctttatctttttcttcggacttcaaatcagtcgcttttaaactgactttccaacgatcgctaccaagtcgcttgtcagtgacctgaatgtgattaggcgccgctgttttcttgccgtctttagtcacccactgatcggcttcggcgtatgccacggcatctttaacggcatccagtttcaatggtccaaaattgaagcgagaaacatagtccagtgttaaaccttcgccgccagcatgagtcgtgttatccaccccggcaaaggttcctggcgttttggtttgtggcgctaacgggtttaaaatatccggtttggtgtcggtttgcatgattttaaccgttccttgggtggtaacggtccgcgcatcgtcagcactgacggttgtggcaccataagccagtagccctgccgataatgcaactgtcgcgagtaaagcttggtatccatgatgagtcattggttgattcctccataatttctaaattaagttaaagtggtgcatcgcttagggtccactgcagaccaaaattgtacgtaccggccgtaaagtcaaagtcattaggcgatattttgagcagtactcctgcttgtgtatcatacgtaaacgtgtgttggatcgtttgagacgcaaccgccttaacttgctgatcttgcttaagtttgatcggatagtcatggccgtcttgtctgaaaaagagtaattcttgttttaattcatgctgatgacgatcggtaaacggctgactttgttgaatcaaaagttgccatggcgtcttttgactgcggccgtccttgatccgaatcgtcatcggcgcatcaccaattcgcggaacttctagcgtttggccatcaattttaacggtgccgaaattgagtgctgccggcgcttgggtaaaactcaaggtgccttcagtgacttccaaagggatttggtagtcataggtgatgcgcttgttagcatctgtcaaacttggctggctaacggttaccgtgacggttttatgccccacggttttcaaatcgggaaacttaatattttccactttcaagtgtgactgttgctttttgacggtattcgtcaccgcctcacgaatgggctgtgggtcgctgtgattttcgatggttaaagatttgaagctgacttgattcagtgtcaaaaacttgtaacccgaagccgtcacctcaaacagggactctcttttgttggcgcgctttttcaagggttcgcgtttgcctgcatgcgccacacttaccttgtcttcacgatgattcaccaccacgacatccccaagtttggctttgaccacgcgcttgtctccccattgatcaagaaattgctgcttaggggtatcaccctgggctgccatgctcgtgacttgttgcttttggtcctgcaggttaagcacatcaccagctgctccgtacagactcacgcttaaatacggttcaccggcaaaaacatcgtggacattgcgattgtcatcttctgcgccatcagtagccacgatcaaccagtcgttgccttccttcaccaacgccaaggcaccaccggcattacgcgtgaatagttcgtaaccgttgaaaacaagtgcatcgccatagtcggtcagcaccggactcgttgataacaccgtgccagtgctggcctcaaacttcatggtcacgtcaattggtttgctgatctttgtcaatcgctttgtgtccttgcgcaagagcttatccaacttgtcaggcatggtgacactcagcgctttatccccccattgaatgcggcgatcatcatactcacgcgcatcttttagcatgttgcctaaagtatccgttgtaacgacttcacctaacttcaaagtttgcgattgggtcgaaaatgttgcgcgtttcaccacggccactggaacatcatagtcagcttcgattgttttatctttgccatacttctgggaaaccgtcactgtagccgtggtatccccaagttttgaaacatctggtcgttttttaaaacctttaatcttataggttgatttatccgataatttaaagaactgcgatagtcgcaaatccatttccgctgctgaagcattaattggaatattggctttttgcggtactaattgattcacccgcaacaattggtagccttgatccgtaatttcaaaataaagttcattcttgttggccaaatcgttgaggggctgctcttgtgaatcatgggtatacctgatctttctttcaacgttgacaactttgataatatcgcctgcttctactggctgaacccgatccttcccccacgaattgagaaagtcctgtttgcctacatcaccagatatccattttagcggcacttcggataaatttttaaccttagcgtctttcatcggcacgtgggtgatccccagatacggctcgcctggaaaacgctgatgaatagcatggttatcacgaaaaccgcctgatgttgcaaccacctttagtccatcatcattgattaaagcaaatgcacccccggcatcgcgtcctgaacgcaattcatagccttttaaaatgatcgcatcgccgtaattagcagtcgcggtcggccgggcggttagatgtccggttttggaatcaaactgaattgggactgcggcatctttaaacaattcgtcaatccgttgcgtacctggttgtaagtgtttctcaacttcagacgcttttaacgggtaaagctgcttatccccccaagaaacaggcgtgccatctcgttgctgtgcctgatcaaacatccgctgaatactttgcatcccccagcgctcgcctaagacgtattttccggattttgttgtcaacttgccggcagggatcacattcaattccacttcataatcaaacttggcatacttgccgtcatacagtttttcaattgcccgtacgacggctttcgttttaccaggcttgctgacatctgggcgttccctaaaattgtctgcagtgatattgttattcaggtttaacgccttgggataagcggcatctagttcagcatccgttgcattttgcgggacatcaactggacgtgttttcagctggttcacatgtaacggtacgaatcccactggcgtcatttggaaaaagatggcctgatcaatgttcggaaaattttcctttttcagttgataaactttagaatcacgggcaaagctaattttcccttcagcgttgcagaccttgatgatgtcacccattctggcttgctgaacccggttaaggccccattgattcaaaaagtcctgtttgcgggtctttccattggcaaccgcatcattgatgttaaaataactcagattgatactctggtgatcacgcatctgaacgtattcgtaactaccatagaatcgatcaccaaattcaggcgcgattggcccattgtcattgcctttaccggaagtcgcaatcactttggaagtgccatcttcatcgcgatcaatgaataccaaagcgcccattgcatcccgaccatttttaggatcagatgcaccggaaatgacggcatccccgtaatgcgtttgcactgagccttgaccggttgttaccccaaatcttgaatcaaatgtcagatcaaccggtgttctggcaagaattgtatcaatacgcggatatggttcatttaaccccatcgaccgcgttgcttgcttaaacgcatcaggcacgattgcccagatgcgattatccgtaaatggaaaatttgtaccatcaggatcggtagcctgcttgaaaaacctagcctcatatcccgactttaaaaactcaccaagtgtaaaagcactgtcttgaccggtaatggttgcttttggccgctctgtgtttttatcttcggcttttggcttatcatcggctgcatacacacgagtatcggttgaatgaaagaaacgtttaatatccggctgggtaccgccgagaacggcaagcgttattacgacgctgatgccaatcaacccactacaggcaattttttggatcacctgccgtttatttctaaatcttgacggcacttctgacaccccctttttaaagtcctagcaactatataaaaaaatattgattgacatggatttcattctaggggagtagacgttctcataattctcacatttttatgtgaagctttgagaacttgtagcaagaatcgaatttgtattattttagacttatttattacattatatttcgttgataaatcctgtgcggacaggtcttttaacgaacgactttctgccatcacttatttctattacagctgttttttatcaagctgaaattttcctttagcgtgtcaatattcacaaataatgcataacaaaaagcgaaaaggtttcgcaacagctacgaaaaacctgctcgctttgaaaaattttaggcgttagctcttacaaccttgacgcttccagtttaaagatccgcaacactctcattgtttccttttttggtcaattgttgctaacaatgcccttatttgttctaagtcataacgattttcaatgccagttaataaatagcgttcctttgcctttatttggttagcagccgttgcggagtttgtaatcaataaatcgtacacgcaatcagccacggcattgtcaatgatgacgtgataataaccagctaatgcaacgcgcaaccgagctaccatgcctgctgtgatggaccagtcgtcatgcatacagatcccgacatacaacggcgcatcactttgtacgtgaatcaacaacaacacattcaaataccggcgcttcaaaaaaagcagctgctcagggctaggtgactgctgtgcatggttaaaagtcagcattgccaattcaccagccatcttttctaaatgttgtaacaccgctggatcaacctgatagttaatgcgctctccatcaaacagatgaaaatggcccgaaaaaaagcgggcatgcatctgaatttggttcaggatgtaccgaattcgcagttgcgtgtcgcctgtaaatcgccgtttgaaagctgggtaagctaattcaattcgagccattaactgtgcgcgaacctttttaatttcaggagttacctcgtccaaatattgagcaaccggtgataaatcacgatcatccaggtccagaatctccatactcgtcataaagatataaaggctggaaacttcaaattcgtcaatgacaagtgcatattggcgggccaaatcaaacagccaatttctaatcccgcggtaaaggtggttgtgattcagactgagcagcggttctttgctcgtcttaacgcggttctgctccgatgcaaaatgccgcttgagtgcaatgtccagccagatacttaatttgagtcgtccgatcatcgaaaatttcaagtgttcccgagcctcaaatgccgcgataaactgccgcaacgaatacgcttccgtaaacgaggctaaggtgtcataatcatggctatttagtagcaaccgataatacaaatagcgcaacgcaatctcgggaccaatgagggtaccacccttaatctgtaatgaaaatgctgccaaagcctgattcaagagtttgatccgacgaaaaacagctggcttactgatgtatagcaactgtgccagttcatcagcactcactttgcctttttgcagcaaggttagtaaaatccgataacttttcgattggactaacaattgccgatagagctcactaaaattaacgggtgtacgtgtttgcaaacaaatacaacgctgaccgcctgaatcagtcacgctaatatcagcggcagcatcgaagcctctaatccgctgctgaagtgcggcgacggttgttcccattgtgcttgctgacactcccagcgttgtgatggcggttgtgtacaagcaaccggcagcccccgcctttagcaataactgcaacaactgaacctcccgacgttcatcgttctccagaaaatcatcaagattcatagcctactccccctcatcaatagattccctgaaaaattcataacttccttcgttcgacactgatattagatgaatcttaacataataattcgttgaaacaaatagaaatgtaagcggattcaaatcgcctaaaatttagtccttttatgattacaaaacaagcatcacgcattttactaccacgttttcaggatcaaactgtgaccactcaaaaaacggtcccagaacaagcacttgctccgaaaccgttagtcaaacacagcttattcaattgtcatggccgctcatactgtctcagtatcatttcacagtcagcataccggcttgccaacaaagccgcttatcttactcctggctcagcaagtcttcataagccttttcatacttctgaatatcgcctgcgcccataaagacaaccacagcatgatggaatttcagcaacggtcgcatatccgcttgctgaatgacagcggcacccttgatttgcgccacaatgtcttctgagcgaattttgccattcttttcccgcgcagagctgaagatcggagtcaggaacgtctgatcggcttggctcaagacttgaacatattgcggttcatatgcctgcgtccggctataagtatgaggttggaacacagcaataatcgccttgtcaggatatttctgccgggccgcatccaatgttgctttaatctcattcggatggtgcgcataatcatcgacaatgatcatgtctttaagatctttttcggcaaagcggcgtttaaccccactgaagttaccgagttcgcgcgcgatcaagcctgcatcaagtttctccatatgcgcgacagccacaactgccaaggcattcaggacgctatgttcgccaaacaatggcacaaagaagtggccgatcaattcatcatggaagtacgcgtcaaaactgctgccttttgtatcacgcttgacattgcgggcctgaaaatcatcacggtcactggtgccgtaataataaacaggaactttagcttttagtttgcgcagccaaggatcatcgccccatgcgacaatcgccttttggacctgatttgcttcggtttcaaatgcatcgtaaacatcttcaaacccgtgataataatcggggtgatcaaaatcaatgttcgtcatgatcatgtaatcgggatggtaggccagaaaatggcgccgatattcgtctgcttcaaaaacaaagaattttgaatcgcgaacgcctttgccagtcccatcgccaatcagataactggttttagcaaccccgcttaacgtgtgggcaagtaaaccggtggtgctcgttttaccatgcgcacccgccacgccaatgctggtataccccttgatcagctgaccaagaaattcatgataccgataaatcttaagccccatcgctttggcttgcttgatttccggatgctcatcggtaaagctgttaccggcaatcacagtgtaaccgggctttagattagctggatcaaacggaagcatcgtgattccggcagccgccaagcctttctgggtaaacgtatattgggtaatatcactccccaacacttgatgccccaaatcatgcagtaccaatgccaatgcgctcatgcctgaacccttaatgccaataaaataataagttgcctctgtcatcacgaatgttcctcttcctttgcttgtgtgtagtaaacttcgcgcggttttgccccttttgctgcggagaccagatgtttggcctccaacgtatcaatcaggttggcggcgcgattatacccaatagaaaagacgcgctgtaacttagatgttgaaatatgccgttcaccagcaagataatccagcacctcaggcatcagttcatcttcatgcgtattgctagcctcagcggacttgactaaccctgccggatcaaaaagataccttggaccgcggcggcttttgacatacgcaacaatgctatcgatttcccgatcaacaaaggtgccttgtagccgaattggctgactgtcaccattgcctaagtaaagcatatcgccacgacccaacaaccgctcagccccagccgtatcgataatggtccgggaatcaatttgactcgccgtcataaaggctatgcgagtagggatattgttcttgatagtaccggtgatcacatcgacacttggccgttgagtcgcgacaagtaagtgaatgccggccgcccgcgctttggctgtaatccgggcaatgtcatcttgaatctcactacctgccgccagcatcaaatctgccaattcatcaataataatcaccagatatggcatcacctgcgcaaactcatgatgccgcttagcctttgcattgaactgttcaagattacgtacgcctgctgcagctagttttttgtagcgatcattcatcgtcgtaaccacccacttcaatgccgcgctcgccgcttttggatcagaaatcactggcgagaccaggtgcggcaaaccgttataaccggctaactcaactgctttgggatcaatcaaaagcagtcgcacctgttccggagtcgctttatacagcaacgataccagtaaactgttaataaagacggatttacctgatccagtcgctccggcaatcagcccatgcggcattttagcaagattcgtgacaaccggctgaccaaaaagatccacgccaagggcaatggttaacggcgacttagcttcctgaaacgccggcgtgtccagaacttcccgcaacatgaccggacgcggtttcaagttgggaatttcgatgccaactgtattcttaccgggtatcggtgcctcgattcgaatatccttggcagctaaggctaacttcaaatcgtcattcaggtttgtaatcttgctgactttaaccccactggcaagactcacctgaaattgcgttacggttggcccaatcgtatcggcaacgacatgcgcatcgacattaaatgcctgcaacgtttgatccaaccgctgccgctgatgatgcacccagtcttgctgggcggcttgatcagcaacaactggtggtgataataagcgaaccggtgggattgtttcagaagtctcaccttgatcaccgcttgaaacgggcgtggcttccggcgtcgtcatcgaagcaggcagctgtgagctaaccgcctgctgcttggttgtttctgctgacacactgcttgtcgttggctgtgtgactgatgccgtggtgccagccgtactttgcggcctggaaaacgccttttgggaattgtctttctgatccgatgcggattccctagctttttgggcggccaatgctttccgcaactttttggcttcgtgcttacgccttaatgcctcaatgcgggctgcttttcgactattagggccatgagatttgcccatcgatgtcaaagaagtagctatttccgcagtatggcgtgatgcttcgctgccgctcacactggccaccgattgcatcggcggatgcggggcactggtgttatcggatgccgaggagctcgatgttgtttcattggaggcttgttgtgttgcgccatccgcttccgtttgttgtttcgagtcgctcgcttctgaatgctcatcagggctctcagttattgacgccatgctgcttgcacttgtctccagccactcgcttgaacgcgtctcctctggtgccgccactgacgaagccacggcgatcgcaaccgggtcagtggcggcctgcgaactgggactgaccccgtgtccggcaaaaagataaaggctttgttcatccggtttcaataccgccgcaatttggcgatagtccgtttgatcccgctgcacgtttctgacagtgctgttgggtgttgtcagccgcgctaacccattgcgctgatggtcggctcgcggatgtgtcattgcgcgcaaatccgcctgtgcctcagcgactttttgcggattcacttcatgcgtggcttcatgcgtaatctgcggtggcaattgatacgcgtcattttctgattgctgccagttcgcggttgtttccccggattgcgatgctggcgatttattctgatgtaaaaatgccggcccatcataatgcgccatgatcaaatcccctttttatcgtgtttcgacagtgtctctattttagcataagcatcagttcgccgaatcctggattgaaaaataactcggcaaaatcagcgttagtttgaaaatagcctgattctggcattgccttttaacgttaataaaggtaaggatcaaaacgacaccggtagcgccctttcccggaaaaacgtcggcttgtacggaacaggaaaaatgattgacacttaatctataatggagcagattttagttgctataaaaattgtcgttgctacaaacattcattggaggctgacaacatgcttttcctaattcttgatgttctactgatcatatgcggctttgttctattggtatcctgttatcggttctctgaagaagagatcagggaggccttgaacgactgggcattagatgtttttgtattcgctcctattttgggctggattggcaaaaagatgaatgttaggtctccttatcgaaaagccctgttcttactgggattagctatgaccgtcatcttcgcatttaatctgatcgcagaactataggtattgatgccaatatcgtcactataaccgtctaagactcgaaaaaaggctcgtgagcttatctgcccacgagcctctctttaaaattttttgtattttcaccgtagcaattacgcctgagccgcgaccacggccgccgcttccttggcatcgaacggacttccggcagccagattgtccggcatcaccaaaatgccacgccgctgtggtgcccctggaatcgctaattcacgcgcactgctaatcatgccgtaagacgcgaccccacgtagagaacccggccaaataatcttaccatctggcatcatggcgcctggcaacgcaacaaccaccgtctggcctaaggcagcattcggcgcgccacaaacgatttgaacctgttcatcaccaatatcgacctgcgtgacatgtaagtgatcagagtcgggatgatctttgaaatcaacaatcttaccaatgacaaacttgggcttttcgtcaacttcaagctgacccggtaaagcagcttgctggatggcaacatttaattgagccacctgttcagcggtcaattgaatctgcccatgtccatccacggctcccaaccactgactgacattaaaaaagttgtagccaatcacatgattctgatcatctaaaattgccacaatatccccgctgcgttgcgatgtctgggtctcagtatccggtcctgtgatggcaataagcgtatcaccaaaagccggttgattataactggtaatgagcatttgaacctccaaaattaattcaagccggtgatgaaatcctcgacttgttgttttgttttacgatctttgttaacaaagcggccgatttctttaccgtctttaaacgcgataaaacttggaataccaaaaacacccatctcctgggcaacttccagattcttgtcccgatcaaccgcaacaaactcataatccgaaaagtctttttcgatctctggcattgctggtttgataaaacggcaatccgagcaccaattagcagagaagaaaagcattttcttaccaggcttttttacctcatccaaaatcgctgcatttgaacctaattccttcatggccaacatcctttcgcttactaattataagtagactatagcaggaaaactttcgcagcgcaatgccgctcaccgtcttttacattatacttaaaacagcggtgtggcaatccataagcaacagagcgttcgccaaggctggcgagcgtgtttcagcgcaacgtcatcctgcgcttatccaagataggcatgtaaaggttccattttcagcagtcaagacgtgaacacactgaaattacaatggctaaacgcaccagctcacgtcaaaaggaggacttcacgatgtccatttcaaggtctcgattactttccggtattgggctgtcattagcatttattgccactggtacggcgcttgccgggtattggtgtcaccgcaatcaacgaatttccaaccgcattttaaccaaggtaaaacgtaattttgccaaggaaggaaccattgaaacaagttggatcgagctgcaaccactcaccatcaatgaccatcatcagcatatccaagtgtatcgcggcggtatgatccttcgtcattcgaaaatgcaccaagaaatagcatttctagccttggctgatggttcgctatggcgcatcaaacagcagcccatcaccactgcctagattcatgataaaggctgcacgccttagttgccacttaatctattatcaatgcacgctcactcaggccttaaagcgcgcaaccagttcataaattcgaccaccatcagcgctgaacttttcctcgtactctgtcggcacattatccggaatgcgttgatcatgatgaacatcaagcgagacgagttcaaaagtcatgccgaaattgttcatactaaccagcgagtattcaaataagccttgattgtcagtcttaaattgcagccgtgcgtctggcttcatgatcgtttgatattgttgcaagaaacgccgatatgtcagccgccgcttttcatgccgcgtttttggccaaggatcagaaaagtttaagaacaaaccgctaatttcagcttcagcaaaataatcggttaagtcggcaccatcccccaaaaccagttgaagatttgggagttttaagactgcctgtttcttcaggatcatggcaatagcagcctcttgtaattccaaagcaataaaattgcagtctggatgagcctgcgccatcgcaacaatgaattggcctttgccagaaccaacctcaagataaagcggttgattctgtttaaatcgcgactgccactgtcccggcatcttttccggacgaaccagaattagctcaggatgctcggctattaatggtttcgcccaagttttgttacgtaatcgcatgaatgtcttcctttatttcataattgtgatgattcttcgcggtgatcgtttttcccgtgtcgacaatcaaaaggcctgagacaaaaccggattttgccacaggccctttgccacgcgcttacagcttccattcaatgggttgactgcaacgtctcaaattgttgcaaaacttgtgcaacctcatctgttcgctggtgctgtgctgctgctttcatgtcgttcaataaatgcaagtcgccataccaataaagccgattttccaaagattcatcattgttggcaccataggctcttaagaacgctggccatgaattgcgatgaccataatgcgccatgacatcagcaagatcataagccggatcacctaatgccacctgctcccagtcaactaaataaagtcggccaccagcacgcaaccaatttttatgattgagatcgccgtgacagacactttgaaccgtcacccgcggtaaccactgttgtaagtcgctcaaagcacgcttaacccgcggctgatttgtaaggtcacggggaaagtcttgcaataaatcgtggcgtaaccgcgctgggtcaagaatttggccaccgacttggcgaagcattcgttttaataaacttgaatggtgtacctgcgccaacattttggctaccaccggctgcatcatttgctcgcgggttaatgtttcgccgtccaaccattcttgtgccgttaacacatcaccggtgctaacccgacgcgtccataataggcgtggggtaatatgctcgactgaaagtgccgcaagaaatggcgaagcgttacgttttaggaaatacttttgattggcataaaccccaagaaacgcactaccggtggaaccgcctgcaggttgcagggaccacccggcatctaattcaaactccataggcactactccttatatctggccgcaggaatggttctaatcgtcaaaaagacactcccaggcgctcgtgcgtccacgttcaatattactaacttgagaaattcacgtcaagaggcaaagtgagcgcgagccagcccggttagaaaccggaacataagtggccttgggcgtgatgggcccgggcttggccatcgcgttcgaggcccttacacgcagattcctgcgctggcgagcgcgtgatgacaggcgcgagccatcgcacttaaacaagagagctgtccaaaaaccactcgcctctataccaccacatgatgctgcttaagtcgcattcgtgcataccaccgtgtaaagccccagacgaaaaccacgccgcaaatgaaaatagcccctgctgtcagccactgaagccgcaacaatgtcaccaaggtgaacgtcgccacttcgattaaaagcaacaccgtcaacaaccgctcaaatgcagccggtttttggtcaggcgcgaccggatacagatgggtaaagacaatctcatcatactgataataaaaaggtaacagctggaagccgaccatgtaaagaaacaagatagcaaaacccaaagccagccaccatggcgacaacaccgccacgatgacagcaccgatcaccagcaggcgaagatataagccgagatactcaccgccacgtaaaaagccgcgtagatacaatgagagccatgttgttgcctggcgtggtttgactaattttaataatccatccaaataacggcgccgatgcacactattggctaatcctggtacatcggtaaataagttatagaaccgatatacccgacccattcgatcatcttctagtttgatcaaggccatgaaattcaaccgtccttgatccaaaatggttcgcaattgccatctgaaaacaagatccagaatcaatgcaaccaaaagggtcactgccggatgcaaataaaacccggcaaaaaacgcggccccgctaattgccaacaacagtaaccgttgatgatgccactgagtcggtaattgatatcgttttagtaactgcaaccacaagtcaagatccttaaatagccaaactgccattagtaaggtaaccgtcgcactggccgggtctttacccagctgcgcaaacaacggccacatagcaagactggcaaaggtcagcaaaacgcctggcagcagcaagctataatggcggctctttaataaatattgccgaaacgcctctgcttttggtagcaaaaaaatttgatccggtgcttctgcaagggtcgctagctgaccgaagctaagtaagccggtgaaaataattgccaagcataaagctaaccaccaggaaggctgcaaggttttgacaatttggctatacacataaagcgcaccgccaaataaaatcagtaaaatcaagacaaagtgatcattaaatacaaggcgtaaatacttttgttgtgcctgcacatgttggcggaggcgcgtacgccacaagtcaatcatgcttcttcctccgtcatcttcatataaatgtcatccagactgccatcttttaagtcaaattgttgctttaatgatgccatatcaccagtggcacgcacttttcctgctttgatcaaaacaaactcgtcagcatattgctgagcggttgccaagatgtgcgtcgacataagaatcgacgccccctcctgttttttttcggtaactaaatttaacaagtcgtgaattgccagcggatcaagaccggtaaacggttcatcaataataaacaatttggcttgggtcatgaacgccgctacaatcatgactttttgctgcatccccttagaaaacttagccggaaaccaatctagcttgttatctaagcgaaactttttaagcatccgatccgcagcctcccaagccgctttggcatcaagatcgtaagccatgatggtcatttcaagatgttcccgcaacgttaattccggatagagtaccggcgtttccggaacataggcaaggttagaccgaaagtcagtgggattttgcttcaatgttgtcccgtccaagtcgatcgtgcctgtctgtggcgtcaacagtccgataatatgtttgatagtggtcgattttccggcaccattcaagccaattaagcccacaattttgccggatggtactgtaaaactgacatcgcgcaaaacggttagattcccgtagccgcctgttaatccttcaatttttaaagtcatcttaccagttccaatctgtataatttcagttagggatatgatagcatgaaatcaaggttcctataacaaaagcacaaggagaaacgaggtaagagcatgaacgattgcattttttgtaaaattattcgcaatgagattccaaacgttgcggtctatgaagacgatgtggtcaaggcattcctggacatcactcaggtcaccccgggccatacgctgattgttcctaaaaaacatgtgccggacatttttgcctatgacactgagttggcagctgcggtttttgagcgcgttccaaaaattgcgcgtgcgattaaagccagcaatccggcgattaagggaatgaacattttaaacaacaatggtaaagtggcttatcaaagcgtcttccattcacacattcatttaattccgcggtacagcgatcaagacgatttcgggatgcattttggcgatcacagcgctcaatatgacaccagtaagcttgaagaagtagccgacaaaatccgcacccaactggaggcttaagtatgaaatttcgggatgggctcttgttaggtgctcttacgggtacgatttatggcttattgaccgccaaaaaaaccggacgacaacggcaacaagcgatcgctgcttattttaacggcatcgctaccggtgtcggtcaggttcgccaaagtatcaatcaagtcagcgcggcgttaacgcaactatctgccgaagtcgaccaaacccttaaaccggcaatgaaagatattacggccagcgttgagacattcgaatttgaaaccgcaccgcgcacggaagccatcaaagaacatgtggacaatatcaatgatgcgatcaccggacttgaagaaaatcaatctgcgcatccgaccaaaccttaaccaaaacattgaaaataactaccgttggctttatacaagccgtgacggattcttgaaagttatgtgaagatccgcgtacggccgtaagttatggtatagtagacggcagtgttaaccgaaactttttagattaggatgtgtgattacatgaaaaaatggattctcggtgtcgttggcttgttcgtagcagtgaccctagcaggctgttccagcagcacggttgcaaatatgaaaggtgccaaggtcaccaaagacgagtactatgacgccatgaaaaagaccacaaccggtcaggcaacattgcgtaacatgatcgtcttaaaggctttagaacaacaatatccgaataaggtatcggataaaaaggttaacagccagttcaacaagctaaagaagcaatacggctcttcatttgattcaactttggaacaaaacggctacaccgaatcaagcttcaaggatcagattcggacaacgctttactctgaagttgccctcaaggatatgaaaaaaccgacgaccaagcaaattgaaagtcagtggaagaagtatcagccaaagattcaggttcagcatattttagttaagaccgaagatgaagctaagcagatcatttccgattatcaaaaagatccaactgaaaagaacttcgaatctctagctaagaagaactcgattgataccgggaccaagaataaaggtggtaagttagctgcctttgacaacacggacaccagcttggattccactttcaaatcagctgctttcaaactcaagaaagctggcgacattacgacaacgccggttaagacgcaatacggttaccacgtcatccgtgttatctccattgccaaaaaaggtacgatgaaggaacacaagaaggatcttgaaaagcagatctacacctcatggcaaagtgattcaaccgttatgaacggtattattaccaaggtgcttaaaaaagccaacgtttcgatcaaggacaatgatcttaaagatgtgctttcaagctacctcagcaccagctcaagttcttcaactagcaaataagtaagaaattgagtcatgcaaaaacgacctcgcatcatgcgcgaggccgtttttttgttccggtaaaaccataatttaagtttgacgaaggctttctaatcgcaaacagtttgcctttagctcttagtgcggatccggatatgtttgaccatttgtcggccggtagaaacgccgattgtccatgccaaagagtcgttcagtaaaggtgcctggatcgacatgttggtaggcagtcgtcatcatgttgattgaggcatccatttcgtccaaatcgtgcaacacctgggcttcaagtagttgcggccgcaccggcgagccatattccaataaaccatggtgcgctaatacaacatgccgcagcaatagcatatcctcactattaatatcgatctttagttgatgggctgccaacacaatttgttcatcgatcagaacaatatgcccaatcagattcccgggtactgtgtattcagttgaaatcggaccacttaattcaatcgtcttgcccaagtcatgtaaaatcgcacccgcataaagcaagctcttgttcaaacttgaatactgggcaaccacatttttggccaagcgtaaaatgctcagggtatgaaaagcaagcccaccagcaaaggcatgatgattcgacttggcagcaggataactgaagaatgcctttttatgatcttgaatcagtttacggacgattcgattccaattggcattagtaatctcgaaaatgaaactgttcagctcttcttccatggcattgggcgcttccggtgcacgttcaacgaaggtacgcggatcatttccttcttcttgggttgccaaacgcattgagtaaatcttgatctgcgggttgccttgatacaattcccgctttcctgacagctgcaccacttcgccggctttgaactgggcaatatcattttcggttgcatcccagaatttacccgaaatatggccggaattgtcttgaaaaatcatggcaataaatttcttgccattttttgctacccggacttccgctgatttaattaatacaggaagtcgcacatcttcttcattatggtaatcaaaaagccgttttgccacggtcgtcaccttttcctttactattcaagctaattaaatcataccgatgtcagttggaaagtacaaggaagggatcgttcaggcacatggcagcatgaacacagacacgattcttcgttttcaattcctccaccactttgagccgcttgcacgtgtttttgtgggattccatcgcataaaaaagcggttccaaaaagacaagccgtctaaaataaaacgagctttgtcttcttagaaccgattttacttgatctttatcgacatgccacttcgctaacctaagttggtatgttgtttaaagtgagccaataacttatggcttgctttgataaacgtcaataattggttgggagatgatcttattcaattcgtccatcatctgggaaaggccttgttctttagccatcaagttctggatcggttgaatatcacgcatcttgtcgccaagtgcctgcagtgatttcacttcttcatcggtaaaatcctgtccctgcattgacttttgttgcatctcatattgcttttgttggaactgctggaacaagccatatgcaacggtgtccaatttcaaaagatcaaatgccttcttaagatcttggaattcctgagttgtcttgatatctgccgccatttgatttgcggtgtcgtaaacgtttgccatgctttacctcactttttgagcctatttgaaccagctcttaatattatcataccattttcccacagtttccttggcactgtctatacctttatcgatactatcttgaattccttgccaagtgtcatcactttttcccggtgtttggatgctggccatttgggcggcatccttggtgtcaaaggcagtttgaggtgtattgggcatcagcttcgacatttcaagcttgaacaacggtgcgacaccggatgtgctggtaccttgcaaaaagtgctgactatccgttgtcggataaccaatccaagttgcattcacaatatccggcgtataaccaactacccactgatccttggtgccataaccccaactgctaggaacctcggtactgccggttttacctgcaattgtatagccagaaggtttagccgttttcccggtaccttcgttaaacgtaccgatcatcatactggtcatttcctgagcgacttttttggacatgatctgacgcgttgccggatgggaattatcaaccaccgtttcgccgctcgcatcaacgattttccgaataaaatgcgtggtcggcagcttgccatcgttagcaaatgccgcgtatgcccgcgccagcatcaacggtgaaaccccgttttttaaaccgccaagggctgcggctagattctgatcactcgatttgagctgaatgccaaaacgatcaaggctggcaacgcctttttgcaccccgagtttgttgagtaaccaaacagcaggggcattgatcgaatccgccagtgcttgatacatcggaacggtgccaaggtatgtgccggtcgcgtttgtcggggtataattatttttgccgtagctaagcttttcgtctttcagaatcgaatcgtagtgatacccgttttctaacgccggtgtgtacaccatcagcggcttgatagtcgatcccggcgaattacgcagctgagtcgcgtaattaaaccctaggaaggtatgttcgccccggttgccgacaactgcgcgcacgccgccagtcttgggatccagaataatcgatgcgccttgaacctgtttaccatctgctgcattagccggaaatgcccagtcctgttcaaaactggtttgcagattctgctgataagtttgatccagattggtgtagatcttatagcctttattcagaatatcatcaacgctaatcccctcactgcgcgcttcttcgatgaccgaatcaaagtaagatggatatttctgtgcgttggcgtttgaaaaagcatccaccacctgaaccgattgcgctttggctgcatttgcctgcgcctgagtcaatttgtggttatccaccattagctgcaaaaccacattacgtcgcgaaatcgcgttatctttatgatcagccggattataataactcgggttacgtaacatccctgctaaaatggcaccttcactggcatccagttgactcgcattcttgccgaaataacgttttgcagcgtcctgcacgccccaaaccccattaccaaaataggcattgttgagatacatcgcgagaatatcctgcttggagtaaactttattcagttgaatcgccatgaatagctcttgtgccttacgcagcatggtctgcttttgcgtcagtaacgtatttttggctaattgttgcgtgatggtgctcccaccacccataatttgaccatgatggataacatagttcaacgccgaccgcaaaattcctttaatggaaaagccgccattcgagtaaaacgtccggtcttcggttgaaataaccgcattttggacttgcggactaatcgcactgagttcaacatacgtccctttttgaccgtacaatgtccccgcttcttcattgttggcatcgtaaataaccgttttggtctgtaaggtgctcttgatattttgaacatcagcggtttttgctttataagtgaaccaggcagagaagattaggatgaccgtcaacccaagtaaaatgagccagcgaatgacctgaaatcggcggaagaaccaccgaatgctctgccagacacgtgatagaacctgcatgtccttcctcctattatgaatcttatttattgtagcataggccgttgtcagccaagtctcgaccggctgtttttaagcaaactttatgaccgaacgaatcgaggaatccttttgttatttcaaacatccgccattgcccagaatcatgccagcctccgggatcaacttcaagactggctaatcccccggaaacgccagcatcagatgcgcgtggcacaaaccattcaggtcaacggccactaccgccatcttaacgagcccgttaaaaatggtgaccttatctcgctgacttatgatgagcttgtccatcgaacctacgtcccggaaacgccgcatcttaacatccgttatgaggatgacgacttattgatcgtggacaaaaccgccggcatgaaaacccacccaaatcaacctggcgaaaccggcaccttaatgaatcaggctgctgcttatttggctccttttccagcgcttatcacccaccggcttgatatggcaaccagcggcctattagtcattgccaaaaatccgttagcacaagccatcattaaccggcaactagcaacgaaaaccatgcaccgtgattatctcgccgtggttccgcgcgggattccggaaaaaggaacgattcaagctcctattggtcatgatcctgacgataagcgtaagcggatgattcgcgctgatggtgcctttgctgtcacgcactatcatcgaattgccgaaaccgcggatactgccacgattgaacttaatctagaaaccggacgcactcatcagattcgggttcatctagccagcatcggcttccccatcattggcgatcctttatatgcagccactgaaacggccactcggatgcagttacatgcatttcgcgtacgtctgatccggccgctgacgattgagcctctaacggtcaccagtccaagcccgtttcgtcaataagctatacgatcagcgctctttgaatcctcgacccatcatgtcagttagaacctgaaaagctcccataatcgctagcgtttttagctaaccattatgggagctcttttaaaccacaacttacctcaactcaccgatcaaaagcatgacgataagcctcttcaaaccattttgcctgtttttcatcagggctaataacgacaatcgtatcgtggccggcgatggttcctacaacttgatcaaaatcgatatcatcaataatggccgccaacaaattaccattacttggcagcgtcttgatgacattcaggaattgaacccgagtgatcgtcaagccgacttcccgaatcgatcgccccagccgttcaagctgtgactcctctgacccgcgaaaaatcgtatagcgcaaagttcctttggcatcttgggctttaacaatttgcatttcccgaatatcacgcgaaatcgtcgcctgggtagcatcaataccagccgccttcaatgccgccaaaagctcctcttgcgttgcgatcggtttttgattaataatccgtgccaatgcagcttggcgttcactcttattcattcaacaacctcctaagcgcgacccggcgcggttagaagtctctgccgggtcgaccgcgtcatgaaacaagactcaattcatccacacaagtgactacatttcttcaggtgccgccactcctagcaagtgcagggcattctccaagacttgagtcgtcgcggagaccattgccaaccgagccggcagttcactgtcttcaaccaacaccttgacgttggcataatatttgttgaatgccttagccagccttaatgcgtattttgcaatcactgaaggctcatactctttagccgcccgcaccacgatacttggataatcacccaaagcccgtaaaacatcccacgcagccggatcactcaaggctacttccggcgccggtgcaatgttggccttgcgcaagatgctgtgtgcccgggcattggtgtattgaacgtacggaccggtttcgccttcaaaacgaacgacttcctctaggttaaagtcaaagttatccagccgttcattcttcaaatcatggaaaataaccgccccgacaccaacttcatgggcaactttttctgcattcggtaaatccggatgtttctcatcaatttgctgctgggcaagtccgactgcatcttttaagactttttcaagcaaaatgatgttaccgcggcgggttgacaacttcttgccattggctgtgatcaagccgaatggaatgtggtgtatatcattggcccactcgtaacccatttccagcaagactgcttttaactgttggaaatgttcgcgctgctcgttacccacgacatagaggctctgcacaaaatgataatgttctttccggaaaatggctgctgctagatcacgggtcatataaagggtggcgccgtctgattttttgatcagcgccggattgaggttgtatttacttaagtctacaatctcggcaccttgactggtttttagcaaatgcttatcttccagggttttaaccacacgatccatcttgtcgttgtaaaacgcctcgccattatatgaatcaaaatcaacgccaagaattttatagattcggttaaactcagccagtgaaaccgtccggaaccaccgccatagcgtgattgcctctttgtcgccatcttccaatcgcttaaaccatgcccgcgcttcatcttccaactcaggatcggtttcagccacttcatggaacttaacgtaatactgcaacaggtttttaatcggatcagccttaacatcggcttccgatccccattttttataggcaacaatcagcttgccaaattgggttccccagtcacctaaatggttaattttaatcggcgagtaaccgaccttctgcaagatattagcaagtgcattcccaataaccgtcgaccgcaaatgccccattgacattggcttagcgatattagggctgctcatatcaatcggcacattgccttcaccaagcttagcatcgccaaaatgctcgccggattgggcaattgcttttaaaacttcatgggcaaaactgatcttgtctagataaaagttaacatacccgcccactgctttaacctgctcaaacggggacgcgtcaatctttgcaaccaaatcactggcaatcatcttcggggcctgatgcaagatctttgccaatgaaaacgttggaaaggcaaaatcgcctaaatcagatgacttgggtgtttcaactaacgcggtgatggccgcctcatctagctgaccatccaaaaccggaacaagcgctttaacaacaagttctttgaaatccataatttcctcctaaatcatgatgccacgaaaaaagacccatctctccctttacgaagagacgagcctgcacccgcggtaccactctgcttgacatgagtccactcaaaacactgatcctcaaaagcgcgccaacaggttagacgtgatcgtttgcactagccgatctcacttttaaacgtcaaataacctgaattcctctttctcaccggatctatacagcggtcgacgagaatcgaactcgcgacaccagcttgggaagctggagttttaccactaaactacgaccgcaaatcaacgcatataagtgtatcacggcgaagcaggtttgcaaagactcaagcggtacttttttctatgattttaatgagaaaacatcttaaaaatgagtacgggtaattttgttgttaatctttctcaccgtgttataataaaaagaaagaagaggagtggttgagatggcaaagacgggacgccactattattttgtggcgcgcaacgagaaaaccaaaactggttatcacattagttttcctaatattcctaatgctgaggcggtcgggacaacgtatgaggaaactgtttattattcatatcgcgttctggccgatttcctaagccatctgccaaagcaagaagctgaaatccgcgcttacacactctctgatattcccgacaccgtggcaagcaacgttttctactctttggttagcgtgacaccagacttcgatccccataaaatggaaacgcactttacgcttccgcaaacgccacccgccgacattcgtcaaaaagcggctaaacttgccggtctcgtgacccccaatgacaatttggctttgtaggcagacattagcatgcaagttattcgaattggacttttgattattttcattggtgcgagtgttctgactctgattggtttattaggctggctcattttaatactcagtcatcatcatccagaaaaaatgcggcgtttgacactaattagcggtggcattgcgttggcggcgttaatccttaatgccttcacctagcatgccggctgatcatgaatttgcatacaactcaaaacgttcctttaaacttcacgaacaggagtttaagggcgcttttttggttacgccggggtgagtgactggtttctgaggcttttctatgcttaaatgggaacagcaaatattgaaggagtgggcaagtttatgactgatctgcgtacaagtattgatggctttaaatttgacaatgtatttatgaatgcaagcggcgttcgctgttacaccgaacaagaattagacgaactggtgcaaagcgatgccggcaccttggttaccaaaagtgcaacccaagcaaagcggctaggtaacccgagtccacgctatgcccgtctggaactaggctcaatcaattccatgggcttacctaacgaaggcttggattactacctcaactacgccttgaattttcaaaaagcgcaccctgatcagcccattttcatttcagttgccggtttgtcgatggaagaaaatctggcgatggcacacacgattgaagattcggattttaacggtttggttgaatttaatctcagttgccccaatgtgccaggtaagccgcaaaccggttatgattttgaccgtacgcaagaagttttgactaacctgtttagcttcttcactaagccagccggggtcaagttgccgccttatttcgatttggctcagtttgaccaaatggcagctattttaaatcagttcccgttgaaatttgtcaactccatcaatagtctgggtaacggtttgatgatcgatccagaaaccgatactgttttaatcaaaccaaaaggcggtttcggtggtgtcggcggtgcttatgctaagccaatcgcccttgccaacgttcgcgcttttgcccaacgacttaacccgcaaattcagatcatcggcaccggcggcatcaccaatggccgcgatgcttatgacttaatccttgccggtgctagtctggttcaagtcggtaccctcttacaagaagaagggccagcggtgttcacccgcctcaaacgagagctagcggcggttatgcagacaaaaggctacactcaaattagtgacttcaaaggacaactcaaaaccttatcatgaataaaaaaatcaaagtctggtctttgtttacccgaaacaccaaagactttgcccatcactggggcgcctactttctactgatcagcgtaaccaatctcgcagtcggactggcaatcatcccgctgctgacttttagtgcgcaacaaatcctgcgtctaggaaatgttccctacatcactttaaccaacttaggcacgattatcgtggaaaagccaggtaccgccgtcttactcttgctaattggcttactattactgctgttcgtctattggcagtttgcgtttctaattctcggcattcaaaacatccaccgccaaacgcatttaaattttcgccagttagctttagcaacgatcaaaaagacccgccgcttgacgcccacaaccattatgattttgattgcctattttgttttggtttttccgttctcaagtatcgtgtttaaaaccagtttattggccaaattgacgattcccgatttcatcattgatttcattttggaccgctggtatttggcaattctggttgttttgttatatctggttggcacctggttggctgtgcgcctattaccacttttgccagctttaatccttggtgatgagcatcccgcagcaacggttgttcgcagctggcgagcaacacgcggtcaggcttggcgaacactcttttcaatcatcctcattgtcattccggtgatggtactgacggtgttgctgatccttggattatatgggtttcagacatacctagaccagcaatggcagcagtggtcattattaggtgcaaccattaatcttggtttattgcaggtcacacttttgctgatcacggttttctttactgtcatgctgtatcaattagcaaccgcccaagcagaaacttttcaactcatttccgtgcaaacgattgatgcgccagtgtcgaaacggcggcggacggtactttttcgtctcagtgctttggcgctaattttgctggttgtcgctagcaccagtgctttttaccacgcttatctaaccggagccttaacgacccagccattaaccatctcacatcgcggagttgacaacggaaatggcgtgcagaatacgatcccggcgttggaagccactgctaaggaaaagcccgattatgtcgaaatggatttgcacgaaaccaaagatcaccaatttgttgtgatgcacgatgaaaatctaagcgcattaaccggacgtaatgctcggccgcatgatttaactttggctgaactaacacagctaaccgcgcgtgaaactgggcacgccgccaaagtcgctagtttcgatgactatctggccgccgctgaagcagcccatcagaaattattggttgaaattaaaacaaccccctatgacagcccagaaatgatggatcgttttatccagcgatatgcgcaacgcttattggcagatcatgatcaagttcattcgctcgactatcatgtggtcaccactctgcgtaagaaggtcccgacactcaagacgttctttattctgccatatacactggtttcccctgcaacgccagcaagcggttatacgttagaatcaaccaccctttcaacgaccgtgactgatcaagcccatgcacggcatcaggcgatttatgcatggaccgtcaacgatagcgatgatatgcagaaaatgacgtttatggatgcagatgggattatcactgaccaactggcaacacttaagacgaccttacgtcagatgaacgatcaccctagttatgccgatcagctgctgaattacatgaccagtttctcctctggggataatagtccgttttaaatgattcgcgtcatgttttcagagatgctaagtttaagaacacgaaaaaatccactcatttgagcgggttttttaaaccatctttacttaaagtaataccgcgctgtttctaatgcgctggtttccatcaatcgtttgccgtactccgacaaaaccgcagatgacaacggtgaccgatcaccaaattccagtgcgactgccatttcatcgtgcgcttcattagatgaaatttcgtttggatagaaagtcaaaacaaggtagtagttttgcttgtaacgataaagatcactcttaccgccttccaagcgaagcgtctgagcaaggctgatgaaatcttcaaaatcctttaattttaagactaattcggtttgtggtgctttggcagcatcaatataaccgccttcgtcaacagcttgctgatcatgttgatcgttggcatctaacccctgcagctgctggcgaatataatccggcacctgggtatccgcactatcaccatcagaaccggtgtcgctatcatcattcttttgtccgttcttactgatcaacaactcgagtccggactgacttggcatgacttgaaacgtcacggcctcatttgtcgcaaacgtatgatctttatcgacttcatcgaggatactgtagaagaagctttcaatctgcttgtgattaccaagcaaatccagcacggtaattccccgctgcgctagatcatcgttgcctaacatgacccggatcgtatttgcgttaatccgttccatttccatgattgctgcacctcactttagtcacggaaccctgacttttgtggttcatcacatgaccacttactacattatagcagatttcgtacttcacggcattctaccgcacgtacctgttatgatcaagtcgcaggctttgaaatcttaaaatcgcacacattttgtacgcaaaaagaactgcctcggcgatccattgtgccaaggcagttcttttaattgcgcctgttgcaattccaaagtccgaacagatcgtggcaagaagcggcggatttcgtcctcgttatagccaacctgaaggcgtttgtcatccatcatgatcggtcgccgtaacagacctggatatttcgccactaacttaatcagggtacccgttgacagttcatcaatattaacgccgagctcctggaagatctttgaacgtgttgaaataatttcttcagttccttcttcggtcatcatcaataaccgtttgatttcatcaacattcaatggatcagaaaaaatatttctttcttggaatggaatcttattttcctttaaccaggcgcgcgccttccgacaagatgtgcaacttggggatgtatataaaataaccatgagcgctcgctccttttctttgacgaggtatctttctcaactacaggtatagtatacgagattgcctcaaagcggcgcaatcacatttagaaaaataatttttcaaatgatgaaaatttcgcgttcaaagtcttgatattgcgtgatctatcaacgtctttataagtttaattgtaataaataccccaagttataataactaaatttttaacattttcctctcattttaaacgatcagttatcatcactatcagacattaattgtcaagtcatccctggcaacgtcaattggtatacctcccgctactgcttgtgcctgatccttcaaagtgacaagatctagctgttggggcaaatgcgttaagagtgaacgcttcacctgcgcttcttttgctaacgttccggcttctggagcggtcaaatgccatcgtggcgctggttgatcggcaaggaaattggtatctgccatcaacaggtcagcgtgcttagcaaagggaaccaatccagaaaaatagcgcgtatcactcgtattcacaagtactttgttggtgccttcttctttaatccgtaccgcaaacgccggaacaggatgctgtgtctccaggaaggttaacgtaagcggccctaaatgtaaggtgctgtctccggtataaccgatcccttgcgtaaacggaccaaacgttaagctcccaaagttcaaaggatcctttgtgtgcccgtaaattggcaatggcgacacttttttgtttcccttgcgtagttgatagaagtactgcaaaacgccgacatccgccgtatgatcatgatgatagtgcgtcaacaaaaccgcgtccaattgcaatgggtcaaagaccttttccaatgccagcaaaccgccactacctaaatccatcagtaagtgatagtcgccactttcaattaaataagtactcgttgcatgtccggcatccggatagccgccgagataacctaaaactgttaatttcatttagtttttcctccttttcaaagtgaaatgctgccaagaagtttataataaaagtggaggtggtcgttatgtccacaatacaaacggttttcggcagcaagtcttttctgactaaattgcttgatgaacgccatgatccgcaactaaaactcttgaaaccagcacaaagcggtctagactatatgattttcgatcccagcggtcaagccacattcagtgctcccctacgctatgaaattttagctagcctagggaaaaccgagcaaagcggctatgtgcatttcatgtactttaaccttgatacggatgacgtcaaagtcttcttatccaaaattaaacaactgatcgataatcatgatattttgttgggcgaaaatcatattttactagcgcaggaagccaaacatccggacaatttcctggtgatgtcagtctggcaaacgagcaatgactattacgaattcaagaatacgccggcactcgcatcagtcaaggaattcattcgccgcgctgcctctgccaatggttttcatgaggccggttatgccgtgatcgacccgcacaaaaagtgacagtgtcaaccgccaaatcattttcgtagcggttgctgcatttgattgggatgaaaaatttaaacctgcaccaagctactcgacaccagaagtttgccaccaagattcagcgtccggctttacaggctgggttttggcgattcaaacatgctggtgtttttccatgccggaaattcattcagttcgccaccgcccaatcggtgaatcgaccatgcgaaccatcacatgaacggttgcttcgtaaaagagccagtcaaatgctgcataaatgccaatcatgacgcctaaatagcgcgagggtggattatcaagataattggtcatcacactaatgacacataaggcgatcaaaataccgcagatgagcggaacagcaaaaataactgcagcctggcgataaagcgtgacccgaatctgatggggatccatccctaactgtttcagaatctgaaaatggcgaatttcctgccgcaccgcgatcacttgcttcaacaacaagatgcttccggttgccacgacgaatacaccgctaagcaataagatcaaaaatagtaagaacccatataaggtactgacgaaattctgctcggccgcctgaagaccaatggggttacgccaatataccatgttggtgctcgctcgatccgtcaccgttaaatcatcgccttcacgctgttgtatgccaatattaacaaactcttccagatttttactgttgcccaaatgctgcagcaaggtaagtgcgcgtttggcagcttttgtttttggcaacttagccatatacaagcgatccggcgtcccattcaacatatcaaaggttcgattggtcaccaacagaccacggtcaaaataattattgcttccggttggaaaacgattggtcgtctgcgtcagacgtaacgatgtatcactgccaggcaggataatggcgcggttcggattacgtctggcgccaactggccgaaagccgcttctggtcggaagcatcaacttagcctcttgtgaatgcaaccgaatcggtcctaattcccgttgaatcttagccgcgcgctggtaatcacgtaacgcaaccacattgtagacccccggctgtttacgcacttcaccaatctgattacggagacgaatttcagcataaaccagctttgagggaatcgtcatcgcctgcttcggtttgacttttgcctgtttcaaaatatcggtcacattatcaacaccgacacctgatgcgactatggttgtcggaatctcacgtaaaaccaaatcctgattatattgaaaaagcatgactgaactacctagcatggtaatggtgatcgcacacagcaacgtggttaaccacaacgaatgagcattcccctgcagacgcttaataatcagatgtcgggaaataccgctcgcattatgggtttgcatctcgtgccgtttttgataccacgctaccagtcccggcaggaaataagcaaaaaccaaaaacaacccaagcaataaggcgccgattaccaacaataaaaagagcggtaacacaatcggtcccgggagccaggagagtatgcgcatcaagcgaccgccaattggaagcaaacgcaacatcgtcaacaaactgccgaccaacaacaaaaagccaaaaataccgacccagaagcgccagcgggtttgcggttttggtggtgccgggacatcttgctggcgaataaactggcgtaacggactgcgaacataaatcgcattgatcgcaccgactaaaagataaacaactcccatcaacgtcaagacgtccattaatgcggacaaagaaaacataaagccgatgggtgtgtgcaatgccattaaccggatcaacaccatccctagcaatggcgataaaatcaagccaagcaaagccccgacaaacagacccactatgccgatcatcacactttcaagaaagacaatcagcccaagtttggcgcctgataatcctaaaagacggtataagccaatttcctgatcacgccggccaattaacagactattcaaataaagcaggaaactgattgaaaaaagtgccaacaccatcatgacaatcatcaacaggctcgggacaatatccaagttaccaagtcgcttactggcatcacttaaaattaaccgattattggcaactgcaccgatcgcgtacataatcgcactaatcaaggcagcaatcagtatctgtaggccgtcctcgtgccgatgccgaatcagattcgttttaatctgttcccacacgtgaatggcctcccccactaacggtcgcttccatatcaatgatgcgatcaaaaaattgttctcgcgacttaccacgcgttacttcggcaaaaaaggccccatctttaataaaaataatccgactcgcaaaactagccgtaaacggatcatgcgtgaccattaaaatagtcgttttctcttgctgattcaactggcgtaaataacgcaaaaattctgttgctgccagcgaatcaaggctgccagtcggctcatcggctagcaacagactgggttgtgtaatcacggcacgcgctgctgctacccgttgccgctgccccatactaagctcacccggaaaagcgttcaacaaagcatccagattaaggtgttttgacaccatttgtaaccgttcggcccggtcaggctgcacatgatgttgcaacgtcagtggtaacaagacattttgggcaaccgtcatatcatctagtaaattaaagtcttgaaaaacaaaaccaaggtgatcacggcgaaacttagcttgctgccgttcattaagcgcctctagatcatggccggcaatcctaaccttccccgtacttggcgtttcaatagttgccaaaatgttcaaaagggttgatttgcccgcaccactaggacccatgatgccaataaactcacctgccttaacctgaaagctaagatcgtttaaggcccgaacccgatcgtggcgctggccgaaaatcttacttaaattagatacttccaaaattgccatgggcttacctccgtcatcatcataccaaaaaccgccacattcaacatgccagtgcgactatcaagctttctaaacgggacaggttaaaggcatcagaaaaagttccgagaacttttcaccataatacgcttatgttctaagttacgcccatagcgcgctcaccggcgcagggatctgcgtgtaaggaccttggtcgcaatggccaaggccacttatgttctaacttacgcccataacgcgctcaccggcgcagaaacctgcgtgtaaggaccttaagcgcaatggccaaaacccggccatcacgcctgaggccacttatgttctgtcttacgcccataacgcgctccccggcgcagaagtctgcgtgtaaggaccttaaacgcaatggccaaaacccggccatcacgcttaaggccacttatgttctgtcttacgcccataacgcgctccccggcgcagaagtctgcgtgtaaggaccttaaacgcaatggccaaaacccggccatcacgcttaaggccacttatgttctgtcttacgcccataacgcgctccccggcgcagaagtctgcgtgtaaggaccttaagcgcaatggccaaagcccggccatcacgcttaaggccacttacactccgacttctaagcgcgccggctcgcgctcacttttgtttgtgtctcggccacaaaacttgtacgataagttcaggaatggagttggtcgcgtgtttaaaatcatgattgtagaagatgatcagacaattagcggtcttatcgctgacaacctcaagaagtggcagtttgagcctgtcgttgtgactgattttaacgctgtcttcgatgattttctgcaggaaaaaccacatttagtcttattagatatcaatttgccggtttttgacggctattattgggtccaaaagattcgtgaagtttcaaaggtgccggttattttcatctcaagtcgcaacaccaatatggatatggtgatggcaatgaacatgggtgcagacgactttttgaataaacctttcgcgatggaagtcctcatcgcaaagatcaatgcgctgttgcggcgaacttataattatgccgatcaaggaaccgatgtccttgaacacaatggactcatgctgaatctaaaaaacggtatggcccaaattggcgaaaaggaaatcaatctgtcgaagaacgaatataaattacttcaaattctgatgcggcaacatggccaaattgtcagccggtcaagacttttgcgcgacctctggcaagatgaacgctttgtggacgataacacgctcacggtcaacgttaaccgcttgcgtaagaaaatcgaagaagcaggattgaaagattacattcagactaaagtcggtcaaggctatattgttccctaggaggcagccatgcgttttcgcgactattttaaagaccatatttgggcgattggcggctatattttatgcgtcggtttagctgccatcatcgtttggctggatccgcaacaccgcgttaaattggcaacggtctggtatgcggtcttactcgtcacgttggttgcaattgccttctttatcgcccattttgtccgtattcgccagtttgctgctcgcttgcaggcgcgccagaatgctgaagatgctgctttggattggccgctaccagggggtcaatccggactggaacaggttgtctcggatacttacaacaaaattctgaccttgcatcggcaacaaattaccgcgcttttggctcaacatcaagaccaaaaagatttcattgactcgtgggtacacgaaattaaagtaccgttggccgcggtttcattgcttgctgaaagttttgagggccaagttcccgatgacaagctggataacctcaatttacaactggatcaaatcgagttttatgttgagcaggtcttatactattcccgacttgacagcttttcgaaagattacttgctgcataatacgcaattgaaaccgctgattaatgacgttgttgccaatcaacgtaatggcttcattaacaaacgtctgtcatttaaactgaacggcgatgaccaaaccgtcttaacggacaataaatggctgcggtttattttgacgcagctcatttccaatgcagtcaagtataccccagaaggtgggcgcatccaggcaaccattcgcgacaccggcaaggaaacccagctgatgatcatcgacaacggcatcggcattcctaaagacgagcaacaccgcgtttttgaaaaaggctttaccggcagcaatggacgcctgtcaaatcataaatcgactggtttgggattattcttagcagaaaagttggccgaaaagttagggcatcacttaacgttgacgtccgtgatcaatcaaggcacaacggttaccattcattttccatatgtcagctattacaatgatgctggtcaaaccgttgaacatcccaaaaaggcacttcatcaaacagcagatacatctgattcatccaaccaaaatgagtaggacattcttctttaacgaataaagcgagtagctaagcacacgaccgtcattgttgtcttgtggctagctactcgcttttttatctgtctatattttgtttgcagcaaagaacccaaccaccagcggctgcgactttaatcagggtcaaacttttatcgaatgaggtttttccaaagcttgatctcacccgccgcctgggttgccggcacatcaataatccgttggttggaactgccgcgaaattgcagcgttaagtctttttttgccaacaggaagcgcccatccaccaatatatcgatgaggctcagcagcgttaacttgtcttcggaatcctgcatgagttcttcgtaagtgtaaccactccaactccagatatccttatcatgcccaaactcttggcgaatccggcggcaaagacgaatgcagacctgagtattcaaaaaaggttctccgcctagcagggtcaagccttgaacatatgactgagccagatccgcaataatccgatcttccagttcctgagtgtatggctgaccataccgaaaattctgggcgacacgattgtaacaacccgggcaagcaaagcgacagcccgagacatataaactacaccgaaccccttccccatcaacaaaattaaacggcttgtaatcagcaattcgttgttgtgaaagttcactagcaagccattctttcggttgtggattctgcggtaaacgagctgtggtcatcataagatctgcctttcttaacaggttgcgttagtcaggttaaaacgcagccgtgcgtgttcttgattcaatcaacgcttcaaaaatgaacgccaacgaataagtctttttcatcgtatcatcttttgactacaagatgtagtatcgattgtgcacaaaataccggcctattatctatatcttgataacaggccggtatggatgctgtttttaaatacgattacgcgcgcttcaaatgcagtgtcatggcatttaacgccaccacgatggttgataacgacataatcgcggcaccaacagccgggctgagaatgaagccaactggtgctaaaatgcctgctgccagtggaatagccaggatgttgtagccggcaccccaccaaagattctgaaccattttacgattggttgctttagccaaagataagaagttaagaatatcggctggatcactatgaaccaacacaacatcggcagtatcaatggccacgtcggttccggcaccaatggcgactccgatatccgcttgcgctagactaggagcatcattaaccccatcgccgaccatcatcacaacgccacgtttttgataagcttcgacttgcgccactttgtcttcaggttttaattcggcttgaaaatcagtgatgccgagttgatcggccacttttttggcggtttcgtggttatcaccagtcagcatgaccggtgtaattccttgctgcttcaacgcggtgacaaacgacttgcttgacggcttcagctgatcgccttctgcaaccatccctagaacttgatcatcctggatcagaaaagccagtgagttaccggcccccgctaattgatcagcctgcgcttcatcataagccaagtgatgatcttttagataccgggcattgacgatcgtgtaacgttggccatcgatttcgccttccagaccgatgccttttaagacttgaacgttttgcgcatccggcagctttaacgcctgttgcttggcggcagctttaatcccggttgccagcgggtgttcggaatgattttccaaagcagccatgacagacagtacctgcgtttgatcgtgaccggcaaaggcaatggttttggcaacggtgaatttgccttctgtcaacgttccggttttgtccatcaagataaactgcgcccgcttgacagtctcaagtgcctggcgattacgaattaacagtccattggttgcgccaatactggtactgcgtgcaatgaccagcggaattgctaacccaagtgcatggggacaagcaatgataaagacagtgaccattcgttcaaacgccactgccgccccgcttggcaaccacaggaagaaagcaagtaacccaactgccaatgcggcgtagaaaagccagccggccactttatctgccataccctcggctttacttttattggcttgcgcactttgaactaacttcatgacttgcgacagatagccgctttcgcccgtaccggtgaccttgatttcaatgacgccatcaccattgacggaaccgccaatcacctggtcaccttcagccttgcgaatggctttagcttccccagtcactaatgattcgttgacactgctattgccactgaccacttgaccatcagccggcatttgttcacctgctaatacccgtaagcgcgcgccaacctggacttctgataatggcatgtccatcacgtgatcaccatgaaccacatgtgcctgattcggcaataacgccgccaacttctcaaccgcgttacctgcagccataacggcattcatttcgatccaatggccaagcagcatgatcacgatcagtgttgctaattcccaaaagaagtccatgaccatcccattaggcgcaataaagttattcatcaaaaacgcataaagcgaataaccatacgccaccgtgatgcccatcgcgatcaacgtcatcatcgccggttgtcgctgttgcaattctgcctttgcgccggtcaaaaacggccagccgccatagaaaaacagaaaagacgacaaaacaagaacgacccaatcagaccccggaaagacaatcggcaattcaatgaccccgagatgaatattcatgcccataaactgcgccaataacagcacggggatcatgacaatgaggctgacccaaaacttctgcttcaaattgcccatatgcatcatatgcccaccaccatgatccatattgccatgatccatgtgcatatccataccactgtgattcatcgccatatgacccatatcgtggtgactcatttgcatagatgccatatccgtttgctgatgcatatgttcgtggtccattgacatatccgtcattttcccggcatgcatctggtcgtgatgactcatttgcatctgtcctttgtcattagctgattctttcattttttgtgaagggttcatattatctttcttcatcaattgcctccttgcagccgtctggtaagcagttacaatgaaccgttgtcggtgcaccaggcaatttagccgccaaagtttgctgcactgcttgaatatctttcttggaaagcgtcacttgcgctaccaaatgattcacggtcgtaccgatcttcatctgacaaagatgactaaataactcctcaacggctgcatccattgaggcttgctcaccaactgttgcatgatataaaaattcgcgcccttgcttttcagtgaccagcgcaccctttttgacgagtcttcccaaaaaggtcttggtggtcgctatcttccacgccattttatccgcaagaatcgccgcaatggtgctgctttttaatggtccaagcgtccaaataattcgcataacctcccattccgactgggagatttcaactttcggtgtttccatcatcggcctccgtttacacttgtaatctttctacacttataatttacaactgtaaacgatgattgtcaactcatgattaaactatttatgaaaataggccgcttaagtgccaagtctggccctaactgttctctgcaaataaacaagcaccgaagacgatggcattggtcttcggtgcttgtttatttgctttttacataaaactagcggcagttatcccttcaaggcatgaaagccgatatcggtccgataatccagcaccccttgaatactttccaagtcatgcttggctttggcaactgcctcaggtaaggtaacagccccagcaacaaccgaaaaaattctcccggcgtcactgatccaaccattgtcggttcgctctacccctgctggcagccaagtaccgattggccaatttgttggcacaatgacgggaacggttttcagatttgcccgcggataatcgggatttaccgcgacaaaacaggcataggcttggccattcaatttcagcgttggctgctggccatccaacaagtcgctcacaagctgataaaagtcattttcgatctgtggcaataatacctgagtttcaggatcaccgaaacgcatgttatattcaagaatcttgggtccctctttagtgaagatcagcccaatatacataaccccgtgtccatttaaaccatcttggtgcatgcctgccaatgtggcatccaccaaggactgggccgcctggacttgatcgggcttaaattgtggcaacggactaatcgcacccattccacctgtgttaggtccacgatcagcagcgtggcgccgtttgtgatcctgggacaacggcaagatcacgcgcttttggtcattaaaaagtgccatgacggaagcttcttcgccagcgagatattcctcaagcaaaaccgtggcatccgggtggccggcgtaaaactgttcgatcgtatcatcaagtgtcgctgcatcattggcaatgacaacacctttaccagcggccaagccatcttttttcagaacaagcggtaaacccatcaaagttgcttcggcatgtgcttcaatcgcactgtgaaccgtcttgctggccgcggttggtaaatgatggcgatgcataaacgctttggcgaaagttttactcgattcaagttgggctaatttttgcgtgacgccaaagatcggcaacccgattgcttgaaaatcatcaacaatccctgctgccaaggggacttcaggaccgacaaacgtcaaatcaatctgatgcgtttgcgcgaacttgattaaagccgggacctctttttctttaataccaatcggctcaacaccaagcaactccatcgccggattgcccggcgccacatagacatgatccacttgtggcgactgactaaatttcaaagcaagggcactttcacgcgcacccccaccgataaccaggacttttttcataaaaacctcctaaaaaagtgagcgtgaaccggcgcgcttaggagtcggagtgtaagcggccttggacgtgatgacccgggcttggtcattgcgcccaaggttcttacacgcagactcctgcgccggagaacgcgttatggtgaacgtgaaccggctcccgcctaatgccggaaatgccgaacccctgttgtcaccatcgcaatgccatattcattggccttcgcaattgaatccttatcccgaatgctgccgcctggttgaataatcgccttaatatcatgtttagccgcgtaatccacgcaatcatccatcgggaaaaaggcatcgctagccatgaccgcaccggcaaagttgtcgttttgctgggcttgggttaacgccaattcaaccgagccaatccgattcatttgaccggcgccaatccctaacgtctgatcagcctgtgccacgacaatcgcattactcttaacatgtttgaccaccgtctgcgcaaatgccaatgccttaagttgagcttcagtcggcttgacctccgtcaccaccgtcatatcggctggtgtctcagctttgtcgtcacgtgtttgaatcaacaacccaccataaattgaagtcgtttctgttcccaattcttctggcgtatcagcagtattaatcgtcaataagcgcacatttttcttcttcgccagaatctcataggcatcatcatcaaatgccggtgccatgatgatttcaaggaaaagtttatgcattttctcggcagtggcaagatcaacccgccgattcaaagcaatgatgccgccaaaaatggacatcggatcggcggcatatgccttgtcccaagcggcttcaagcgtatcgcccaagccaatgccgcatgggttcatatgtttaacggccacggctgccggttgtttgaattcccgcaacattgccaatgctgcatccgcatccttgatattgttataagaaagctctttaccgtgtaattgcttagcagcggcaagactggttggatcaggattcggctcaacataaaaggcagcttgttggtggctgttttccccgtaacgcaagtcctgccgtttgtgataagttggcgtgaattgctctggaaatggctctggatctaagtaatgggcgatttgagcatcgtaagcggcagtgacggaaaagactttggctgccaaccgttgccgtaaatcagcatcattttgatcgagtccggctaaaacatccgcataatctgccggatcaaccacggcccagacactgtcactatttttagctgccgcacgtaacgcagacgggccaccaatatcaatttgttcaatcgcttcggcacgcgtcacacccgcacgctgaatggtcgcggcaaacggataaagattgacacaaaccacatcaattggctgaatatcatgatctgccaatgcctgcatatgggcaggatcatcccgccgcgccaagatgccggcatggatcttaggatgcagtgtcttaactcgaccatcgagcatttctggaaaaccggttactgcttctacgccggtcaccgcaaccccagcttcagccagtgcgcgatgggtaccaccggttgaaatcagttcaaaaccgcgttcaaccagaccttttgcaaaaggtaccaaaccagttttatcagagacacttaataatgcacgcttcacttaaatcgctccttcttcaatgagttgcttgacagttgcgggaaaagtttgatgttcctgatggtgaatggctgcttctaattgtgccagcgtcatccccgggcttacgcggaccggatcctgtgcgatgatttcgccggtgtcgattccggcatctacgtaatgaaccgtcacgccggtcactttgacgccataatcaaatgcatctttaatgccctgccgcccgggaaaactaggcagcagcgcgggatgcaaattgataattcgcttgggaaaagcatttagcaaggttggcccgatgatccgcatataacccgctaaaatcaatgcatctacaggcggcaactggcttaaaatataagtttcggccgccgctttattcgcatagtccttaaagttcacaactaaagtcggaatatgacgagcagccgctttttgaatcaccggtgcttgcacttgatcacagactaagaccgcaatttgatagtgactgtctgcagcctgcgcggcgtttgccaaggcttcaaaatttgtgccatttccggacgcaaagacagctagacttttcatttgcttgccacctgccattgtattttggcgcttggatcagcaaccacgcgaccgataactttactgcttggtaacgccgcctgaatcgttgtggctgcatgttcagggacgaccaaaatcatcccgatgcccaagttaaacgttgtccgcatcgtggtttcactcaaatgcccggcatattgcaggcgatcaaataactccggtcgatgccatgcctgggggttaatctgcgcacacaatcctgccggtatcacccgcggcaggttctcggtaataccgccgccggtaatatgcgctgcggcgtggatcaaaccttgttgcatgagcggcagcacctgcttaacgtaaattctagttggccgcatcaacgcttgcatcacttccgatccgtcttcaagtgtctgactgcccagatcggtttcagctaacaatttacgcaccagcgagtaaccattgctgtgtacgcctgaacttggcaagccaatcaagacatcaccagcagccacgtccttaggtaaacgattcggttcggaaaccaaaccaaccgcaaacccggccagatcataatgattttgtgggtacatatccggcatctcagcggtttccccaccgatcaacgccatttccgcctgctgacagccataagcaatcccacgaacaaccgcctcggcccgggtcacatcaagatgatcaacggccatataatcaaggaaaaacaatggctgggcaccggatgcgagcaaatcattggccaccattgcgaccaaatcaatccccaccgtttcatgcgcatcacattgcagtgccaacaacagtttggtaccaaccccgtctgttgcactaatcaaggttggctgcggcacggatggcaaccgataagcggcagcaaaaccgccaacactggccaaaacattgtcattggctgtttctttggctaacgtcgcaatacgttttacggctgcatcgccggcttcaatgtcgacgccggcatccttataatctgtcatgcgctaacctccgctacattaactttgagtgatgcgacttccttatttaacgccggtgcataatcatcaagagcagttggatatttgcctgtaaagtaggcgacacataaaccgccattaggagccgtcgttggcaatcccacgctgtcttccaatccttgcgtcgaaagaaaacctagcgattcgacatccagtaaatcacgcatttccggtacgctatgattagccgcaaataattcactggttgtctgaaaatcaatcccataaaagcaaggaaagcgcaacggcgggctggcaattcgcaaatgcacttcagcggcgccggcttcttttaacaatttaacaatttgtttagaagtcgtgccgcgaacaatcgagtcatcaactaacacaatgcgttttccggcaacaaccggtttgatcacactgagtttcattttgacgcttttttcgcgtaacgcctgcgtgggttggataaatgtccgagcaacgtactgactcttcaccaagcccatttcataaggaattccgctggctttggcataaccaattgctgctgacagggatgagttgggcaccccaacgacaatatccgcatctgccggctgttcccttgccaaccgctcacccatccgcacccgcgcctggtgaacattgatgccgtggatgtctgaatccggacgggcaaaatagatatactccatcgagcaaaccgctaacgatgtgttggtggtgaagtgatccaaatgcaagccatcgtcatcgatcgtaatcagctcaccgggttggacgtcacggacaaaatcagcccctactgcatccaacgccgcggtttcgctacaaacaatatagccgccatctggcatgatcccaaccaccattggccggaaaccatgcggatcaaccgctgcgtataagccatgctcggttaacaagacaaaggcgaacccgccgtgaacctcattcagtgcctttttaagttgaaccagccacggttggccaacctgacgccgaatcaaatgcattaaaacctcagtgtccgaggtggattggaaaatcgccccttgactttctaactcacgccgcagactgatggcgttggttaaattgccgttatgcgctaatgcaatggcttcatcggaaaaccgaaaaagcaatggctgaatattttccaagacccggccacctgctgtcgagtagcgcacgtgacccaaagctgcccgccccatcaacggtgtcaattgatcggtattggtgaacacttcactgagcaagcccagaccataatggcgccgcataccatctttagttaagccgacaattccggccccttcttgcccgcgatgttgcaacgtatgcaagcccagatgggtaatgctcgcagcattgggattgccccaaataccaaaaacaccgcattcttcatttaagccttttggttcagatagcatgggagtgcctcctcaaatgcagtttgcaattcttcaagcggaatcgaaaattgatgactaaccgtggtgacgtcaaattgcggggctgcttgtacccgcccgattaactcagccggtccattcagcgcctcaaacgctgcttgatcttcgggagcaacggtaactaagaagcgcccttgagtctcggaaaagccccaactcgtcggcaaatcgaccttaacttgcgcgcccagctggttcgtaaagcccatttcagccaacgccactaacaagccgccatcgcttaaatcgtgggctgctgtcacaaagtgttgccgaatcgccgttaatacaaattgctgattggccttttccgcatcgagatcaaagtcgaataaccgcccggcaacttcaccggtttgcaatttctgtaattcgctgccattgaaatcgccatgggtttcgccgacaagataaagcaaatcatctgcatgtttgaaattcgccgtggtaatggtgctgagatcttcaatcagccccaccatcccaatcatcggcgttggatagattgctttgccattagtctcgttataaagcgaaacatttccggaaatcaccggcgcgttaaaggctttagttgcagcaatgatgcctttagccgcttcggcaagttcataaaacgcttccggcttggttggatccccaaaattcaggcagtcggtaatccctaaaggttccgcaccgctggccgccagattgcgcgccgcttcggcaacactcatggccgcaccgacttttggatccaaatacagataacggcctttgctatcggtagtcatggcaagagcgcgatgggtcccgcgaatgcgaatcaccgcggcatcgctaccaggcaagacaaccgtattcgtttggacttgtgcatcataacgccgatacaatgaggacttatccgcaatcgtcggcgtgcccatcatggctttccaagtcgccaccggatcggtcacgatcgggtcaaaatcaggtgccggttcagctaagcgcgctggcattttaccgacttgctcataaatcggtgcatcatcagtcaatgaactgaccggaacatcgcaaaccaatttgccgtgatgataaagccgatattgatggccttcaatcacatgtcccacaactgcagcgtccaaatcatacgctgcaaaaacatcaaggacttcctgttcaaaaccggcccgcacacacagcaacatccgttcctgtgattctgataacatgatttcaaatggtgtcatattggcttcacgctgcggaattaagtcaagatccatttccataccgctattcgccttgccagccatttcaacgctggaagacactaaaccagccgcgcccatgtcctgaataccgactagcgcctgctgatgatcctgcgtaatttccagacacgcatccatcaacagcttctccatgaatgggtcgcctacctgaaccgccgaacgatcagccgcctcttcatcggaaaaatcaccggatgcaaaactggcaccattgataccatcacgcccggttttggcaccgacataaatcagcgcattaccgactcccgccgctttgcctttttggatctgatccttatccataatgccgacacacatcgcattgaccagcggattgcgggcataggtatgatcaaaattggtttctccgccgaccgtgggaatgccgattgcgttcccataaccaccgataccggccacgatgcgatcaactaaatgctgcgtgtgcgggaggttgagatcaccaaacgccaatgaatccagcatggcaaccggcttagccccaattgagaaaatgtcccggataatgccgcccacacccgtcgctgcgccttcataaggttcaaccgcggacggatggttatgactttcggctttgaataccactgccttgccttcgccgatatcaattacaccggcaccttcgccaggtcccatcaaaacgcggtcatttttggtccagaactggcgcaaaatcggtttactgtatttatacgcacagtgttcactccacatgccgcttgctaatccgatttcggtatcatttggctgatgaccaatcaactcagcaaaccggtgatactcatcttccgtcaatcccaaagccaaatacggtttcttttcagcgatggcttctggactcatctcaacgtgcgtcacggacatggacccctttcgtttgttgcatcaatgacttgaaaacgcctaggccatccgtaccgccaagtagtgcttcaacggcgcgttccggatgcggcatcatgcctaaaacattaccggcttcgttcgtcaccccggcaatatcatgaagactgccattgggattgtcagcataccggaaaacgacctgaccattggcttccaaagctgccagcgtcttgggatcagcgtaataatttccttcaccatgtgcaatcggcaatgtcagttgttcaccaacctgatattgattggaaaatgctgtatccgcgcgatcgacaagcaacgtcaccggttcgcaaatgaagttcaaatcccgattccattgcaaagcgcccggcaacaaacccgcttccgtcagaatctgaaagccattacaaatgcccagcacatagccacctgcttcggcaaaagctttcaacgccgtcatcactggcgaaaaccgggcaatcgcaccgctacgtaaatagtcgccgtaagaaaaaccacctggcaccatcaccacatcataacgacttaaatcggtttgactcggcttgatcagctcgcactcagcaccggcaatggtctgaacggcccactgtaaatccaagtcacaattagatccgggaaaagaaataacggccgctttcatgcctcatcctccgtaatgggttctaattcaaagcgataagtttccatgttgacattggcaagcaactgatcgcaaatcgtgtcgacctgcttttctaccgcttctttggtgccagttagctttaattcaaagtatttgccgtataacacgtcgcctacattgtgataatccatgcgggttaaagcagtcttgataacttctgcctttgggtctaatacagagggtttgtacgtcacataaactttagctttaaacatgagccgctcctttttcttgtaatctggaaagcacttcttcataaacaggggttaagggaccgcgcgcttggcggaaaacatctttatcaagcgaatcaccggtcttttgatcaaccagacggaaattatccggcgacaattcatcggctaagaccaaagtaccatccgttaacgtgccatattcaagcttaaaatcaaccaacgtgatcccgacctcatcaaaacgcttggtcagataagcattcacgcgatcagtcaaagcccgaacttgtttgagctgttccggggtcgcttcgtgtaaagcaaaaatctgagcttcgttcatgaacggatcgcctaattcatccgacttgtaataatattcatgaattggcggatcaagcttcatcatcggcttgacattgaacttagtcacaaaatgtccggacgcgtaattgcgcaccacgacttctaacggcagcatggtcgcctttttaacaatcatggtggtggcatcgggagaatcaatataatgcgtaggaattccggctgccgtcaattctttaaacaacaaggtcgagatagcgcgattcaattcacctttgtgagcaatctgcgcctttttctcgccgtttaatgctgtggcctgattcgtataggtcatccataaaacatccggatcatctgtcgcgaaaacctgcttggccttgccggtatatagtaatgtggtctttttcaccatgctgcctccatttgtttaagtatgtccataacatcgcgctcatcggtcaccgtgatgtggcccattttacggccaggacggatctcggcttttccataatcgtgcatgtgccattctggatgttgcggccattttgccttggcttgggtgagatcatcgccaagcaggtttcgcatcaccgctggctgttttaaggtaatcggcggaatcggtagtccgcagatacttaaaatatgagcgtcaaactgggaaaagttgcaagcttcaatcgaatagtggccagagttatgtgggcgtggtgccaattcatttgcaacgacattgtcaccttcgagaaagagttcgaccccaagaactccgcgtaaatcgagtccaagtgcgattttagtcgccagatcatcaatcttttcagccaaaaccggtgagatatgaggtgccggtgccagtgtgagatgcaagatgtggttcttgtggcgattttcaacaatcgggaatacccgtacttgatcgcggccatcgcgggtgatcatcactgaagcttcccggtcaaactgttggcgtttttccaaaatgcagggaccgtgggctagcaactgctcggctgcgggtacatcagccatggtgttgatgtcttgctgaccatgaccgtcataaccgccagtcgtagtttttaagatgctcggcaagccgattttctcaatggccgctgtcaacgcctcaggccgatcaactgccgcaaagggggtgaccggtacaccatgcgtctgcaggaatgttttttccttaatgcgatcgcgggttgttgcaagaatagctgttccttgagggattcgggttaaatcacgtactgcttccaaagctgctaaatcaacattttcaaactcataggttaaaacatccgattctttagccaactttgtcagtgctgcttgatcgttgtatggtgccgtgatttgaaagtctgctacctgaccggctggtgaattcggcgtcggttccaaaatgccaactcgatagcccattgtcttggcactttgggttaacatacgtccaagctgaccgccaccaataatcccaatcgtggcaggtgaggtaaccacatcaatcattaagtgtggcctcactttcttcagcccgttgtgtttgggcctgacggaaagccgccagccgctgagctaattcaggactttgcaaagcgaggattgatgccgcgtacaaagcagcgttcacagcgccggcatcacctattgccatcgttccaactggcacacctcctggcatttgcacaatcgacaacaagctgtcaacgccatttaatgttcgtgttttgattggaacaccaatgaccggtagcagcgtgttagccgctaacattcccggtaaatgggcagcaccacctgcacccgcaataatcacgccaaaaccttgattagcagcatgtttgccaaatgccgccagctggtccggcatccgatgagctgatatcacgtgcttttcataaggaatatcaagcgcctctaactgtgtggcaacttgtcgcatggtcggccaatctgaacttgatcccatgaccacggctactttttgcatctcgtcccctgctttctttaagatgttttgagaatagcacgttaagcagcaacattcaacactaaaatagaactataaagcatattattcgttttaatgttcgtattttgctcaaacccggtcgagaactccagctttttaaagcaaaaaaatagccttagagacaatctcatctctaaagctaacttattttgagagcacacttatccctcgacagcgccttaacaaactaattgttttaggctgctttagtggaaagtgatttaccatcctttgctataaacagttgtggcgccaccgtgagtaaaataccaacaaccacgattgccaaaacggtgctgaacaaagccgatccaccgttgacgatcagtgaataaatccacacattcatgccttttggcgcgtaactgccccaaaaaacaactccggcgatgaaatgaatgaagtacttagcaaaagttccgacaataatgccagcaaaagcatagccgctagcttttaccttctcaccgccgcggacagccttttgaaatgatgcaaaagtcaagcccatcaagccaaccagcgtaaaggcaattggatattccaaaaagccttgaaccggattcaaaacactgccaccactaaggccgcggaggatcaaatcaagaatcccccatacaaacccggcccacgctgcaggaattgccccacgccgcatcgccaaaaccgcgatcggaatcaacccatagttcaattcaatcgccgaaacaccggttgtatgcggaatataagtcaacgccattgcaaacgccgcaataatcgctgtttccaaaatcacaaccagacgcttatgttgttgcataaaaaaagcctcccagtgaatccccactcacaaagaaggtcgtttccgacattcacaaatccctacgctcgcactaacgaacaggttcgaagggtccgggtctccccgctctcagccaatggctcccctttgtgaaggttcatctaattaattgatacattgtcatcgtaccagactttataaaaagcgcaaacattttgtccagaacagagcgtgagccagcccggttagaaaccggagcataagtggccttgagcgtgatgaccgggttttggtcattgcgctcaaggtccttatgtgcaggtttctgggctggcgatcgcgtttatgagcgtgagccggcgcgttcagaagtcggagtgtaagtggccttagccgtgatggccgggttttggccattgcggctgaggtccttacacgcagacttctgcgccggcgaacgcgtttatgagcgtgaaccgacgcgcttagaaaccggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacgcgtttatgagcgtgaaccgacgcgcttagaaatcggagcataagtggccttgagcgtgatgaccgggttttggtcattgcgctcaaggtccttatgtgcaggtttctgggctggcgatcgcgtttcagagcgtgaaccggcgcgttcagaagtcggagtgtaagtggcctcagacgtgatggccgggctttggccattgcggctgaggtccttacacgcagacttctgcgccggcgaacgcgtttatgagcgtgaaccgacgcgcttagaaatcggagcataagtggccttgagcgtgatggccgggttttggtcattgcgctcaaggtccttatgtgcaggtttctgggctggcgatcgcgtttcagagcgtgagccggcgcgttcagaagtcggagcataagcggcctcagacgtgatggccgggctttggccattgcggctgaggtccttacacgcagacttctgcgccggcgaacgcgtttatgagcgtgaacaggagcgcttaaaaaccgaagcataagtggccttgagcgtgatagcctcctcttaactattgcaccgtgatccatacatccagctttctgcgccatgaagcacgttatggtaaacgcattttccacattcacaaagcaactggtctcaccgtcaaaacacaccgcacacctcaccaaaaattttcagctcaacttcaaagctagcgactcagacgaattttttcatcccgatgaagtgtctccaaagattttcctgctgtctccggtacaaacaaaatgacaaacagcaaagaaatgagattggtgccaatgaaacaaacaaaagtccaaaacataccaatgcctgccaaaccgatcgggaaaagaacgccgaccgcaaaattagcgagccacaggaaaaatgtcgccgttcccattcccaaaccgcgtaattgctcgggaaaaatttctgatagaagcaaccacgtcatcgggctaatagcgccttggaagaacgctagaaaaatcatcatcatggtgatggttgtaaatgcgcgccatgaagagcctgcaggtaagcggctcgcgaaggtcacgccagtaattgcaatactagtcccgattaagccgatgatcagcaatggacgccgcggaacatgctttagcaactgtaaggtgacaagggttgctgcaactgccgttaccccattagcaatattggtgattaaggcactattacgaccaaatccggtcatttgcaaaatcgatgtaccgtaatacatcatgacattgatcccggcaatctgctgaatcacgcccaatccgattccgattagcaccagccgccgaatccacttaaccttaagcgccgtgatccggactttcttgtgtttcgcgctggccgcaatggtttgctccaaatgatcaagttctcgcggaacctcttgcggcgcacgaagaaccgacaagctcgcctttgcagctgcctttcgtcctttcataactaaccaccgtggcgactccggaacaaaataaatgccgattcccaagataatagcaggaataaccgctaacacaagcatccagcgccaaatcccaggcatatcaccaaagtttgtccctaacacggcattaaggatgaacgcaagcaactgaccggtgacgaccatcaattcattttgggtcaccagccgcccgcgatggcttgttggcgcaatttcggctaagaaacttggcactaacacggaaacgccgccaaccgctaatcctagaatcaatcttgccccaatcagccaaatagcacttggcgccattgacgaagcaagcgttgccagaaaaaataatccggctaatccagcaattaaccgtttgcgtccataacgatcactaatacgtcccactaaaacagcaccaaatgctgccccaagtgtcaaactgctggtcacccagccttgctgacccggagccaagtgaagttcactggaaataaatggcaaggcaccattgatgacgccggtgtcatagccaaaaagaaggccacccattgttgaaatcagggcaactaaccttaaacgaacacgtgcgctcatcaacgaatggtgtcgttgacgcaagcctgtctttgtttgattctgcaaatacatgcaattccccctcatcaactaggtgaaccgccatacttactagcaaagatccgcatcgcagctcaaccatttagtttacataataaccatagcacttttctgaaaaatctgcagagcgtgagccggcgcgcttagaagtcggagtgtaagtggcctcagacgtgatggccgggccttggccattgcggctgaggtccttacacgcagacttctgcgccggcgaacgcgtttcagagcgtgagccggcgcgcttagaagtcggagtgtaagtggcctcagacgtgatggccgggccttggccattgcggctgaggtccttacacgcagacttctgcgccggcgaacgcgtttcagagcgtgagccggcgcgcttagaagtcggagtgtaagtggcctcagacgtgatggccgggccttggccattgcgactgaggtccttacacgcagacttctgcgccggcgaacgcgtttcaaagcgccacaatccagacttgtgccccatcttccgtcaagagatcacaaccaatttttcaattccaaacaaaaaagcgtcaaccctagaaaggattgacagcttctttaaatcaatacattttattgtccggtagtcttcttaaccagatcagcgttttcgtcgtttgaaatattttcattcaacgcaacgtcagccatcttggccatgtcctcggtggaaagccgcttcatcaagctgcgaaccttaagaacagaagttgcagacatggaatattcatcaagtcccataccaagcaataatggaaccatgattggatcgccagctgcttcaccacacataccagcccatttgccttccttatgcgctgagtcaataacatgcttaaccagacgcaaaatggatgggttatacggttgatacaagtatgaaacatgttcgttcccacgatcagctgccatcgaatattgaatcaaatcgttggtaccgattgagaagaagtctacatacttggcaaactgatcagccaaaacagctgcagcaggaatttcgatcatgatgccaagttggatgttgtcggaaaccttcacgccatccttgaccagcttttctttttcttcggtgaagatctgcttagcctgtttgaactcggcaatcgtcgcaatcatcgggaacataatccgtaagttaccaaaagcagacgcacgcaacaacgcacgcaactgagtccggaaaatatcctgacgatcaagactaatccggatcgcacgataacccaagaatgggttctgttcttgcggtaatggcagatatggcaagtgcttgtccccgccaatatccatggtgcgaacaacaaccggctttggattcatcgtttcaagaaccttcttgtaggcctcaaactgatcgtcttcagtcggtagctcagcagaatccatgtataagaactcagtccgatacaaaccaataccttcagcgccatttgccaagaccccatcaagatcttttggtgtcccgatattggcagcaacatcaaagtgcttaccatcagcggtaactgatttggctgtcttcaattgcgcccattcagctttttgcttggcaaatgcttcagcagcttgcttgaatttggcaacttcatcagtagtcggatcaatgacaacttcaccagtcaaaccatcaacggagatcgtttccccgttggtcgctttcttggtgacatcgtccgtaccgacaacggctggaatttccagcgaccgtgccataatcgcactgtgcgctgtccgtccgccgatgtcagtgacaaaggccttaacatatttcttgttcaattgggcagtatcagaaggcgtcaaatcgtgagccacgataatgacttcttcgtcaattaatgccggattcggcagtgtacgtcctaacaaatgtgccatgatccgtttggtaacatcgcgaacatcggcagcacgttcctgcatatatggattatccgtcatgccttcaaaagtctgaatgaagaattcagaaatttctttcaatgcctgttcagcattgactttttcatctttgatcttggactcgatctgacccgtaaagtcaggatcggccaaaatcatcatatgggcatcaaaaacttgtgcctcttcttcgccaagcgattcagcggcctttgctcgaataacctttaactcatcattactttgatcaagtgcctgctttagccggtcgatctcctttgaaggatcatcaaccgtctttttgtcaaatgataaatcaggttgaaccagtaaataggccttcgctgtggcgatcccatcactagcagcgattcccttcaaatgttcagccattattcagccaagccttcctttttcattgtgtccgtaattgcagcgattgcatcggcttcgtcagcgccttcagcagagattgtaacatcggcaccttgaccaacgcccaaactcataacacccatgatggacttcaagttaacgctcttacctttatattccaagttgatatctgagttgaacttgctagctgcttgtaccaacaaggttgccggacgtgcgtgaatcccggtttctgcaataatgttaaattcgcgtttttccatgactgatctgctccttcgtattaactagatttttctagtgtttttccgaatagtttgtgtgcgtactcgtacccaaaacaattcatgtaaaccttaccattttttccagcctatcacaagcgccacatgagatttgacacttacttagcgggaatcgaccgaccggtaatggtactcgatgacaccatcgcgtttggccatccccacaatctcttcacgatcgggatagtttgtccatgccgaccgaaacgccataaacgtttccggcgtcaccgtgatcttgtcacgctgaccagtctttaactcatccattaaagcgacataatcctgagtcatctatttgcctcacctcacttcataagggtagcataaaagtaggcattgaaaaagcgctaaggcctgatatcactgaaatttttgcatctttttagcactcttgcggttagagtgcttgcattctggtaatgagggtgtatactattgccataggtcaagaaaggtcaaacctttttgaccgttatgtggcacctaattagacaggaaggttgtgacaaaatgttatgtgaaaactgtcataagaatccagccactattcatctttcaaccgttgttaacgggactcggcaagaaatcaatctttgccagaactgttatcaattactcaagaaacaagcaggaggaaatatgaatccaaccaacgcatccgatccatttgggtttggaagcttagatgatattttccgtgcgatgaatcagggaatggatcaaccgcaacagccaaacgcacaggttccgcctacccaggcaggacgcggcggcaacaatggccgcaatggcaacggcggtaagggcttgttaggtcagtttggtgttgatctcactgaacaggcacgcaaaggtcaaattgatccagtcatcggtcgtgataaggaaatctcacgcgtgattgaaattctgaatcgccggaccaagaataatccagtcttaatcggtgaagccggggtcggcaaaaccgcggttgttgagggactggcactaaagattgctaatggcgacgttccagccaagttgcaggatcgccatgtgattcgccttgatgtcgtttcactcgttcaaggcacaggcattcgcggtcaattcgagcagcgcatgcaacaattgattgacgaactgaagcaaaataagaatattatcctatttattgatgaaatccacgaaattgtgggtgccggcaatgctgaaggcggaatggacgccggcaacgtcttgaaacccgctttggctcgtggcgaattacaactagtcggcgcgacgaccagcaacgaataccgtcaaattgaaaaggattctgccctagctcggcgccttcagccggtgatggttgaagagcctagcgttgatgaaaccattaaaattctgaagggtctgcaaccgcgctaccaagacttccaccatgtgaaatacacggaaggcgcaattgaagctgcggcaaccctcagcaatcgttacattcaggatcgcttcctccctgataaagccattgacttgttagacgaagccggttcacgcaagaacctgacaattgccaccgtggatcctgaaaccattaaagctaagattgctgatgccgaaaagcaaaagcaagccgcactcaagcaggaagactatgaaaaagccgccttctatcgtgatcaggtcaccaagttagaagacatggccaaaaagcaatccaatctgccagatgatgaaatcccaaccgttaccgaaaaagacatggaaaaaattgttgaagaaaagacaaacattccagtcggtgaactcaaagctcaggaacaggcgcaactgaagaatctcgccagtgaccttgagcaacacgtcattggtcaaaatgaagcagttgataaagttgctcgggcaattcggcgcaatcgcatcggcttcaataaaaccgggcgaccaattggctccttcctatttgtcggaccaaccggtgtcggcaaaacggaactggcaaaacagctcgctaaagaactattcggttctgaagatgccatgattcggtttgacatgtcggaatacatggagaagttcagcgtctctaagctcatcgggtcaccgccaggctatgtcggctatgaagaagccggccagctaactgaaaaagttcggcgcaatccatacagtttgattttgcttgatgaaattgaaaaagcccacccggatgtcatgaacatgttcctgcagattctggatgacggccgcctaaccgattcacaaggtcgaactgtttccttcaaagatactatcatcatcatgacttctaacgccggatcaactgatgcggaagctaacgtaggctttggtgcaacgttaagcggtaaaacccacagtgtgctggatcagctgggtaattacttcaaaccagaattcctgaatcgctttgatgacattgttgaattcaagccgctttctaaagacgacctattgaagattgtgtcactgatgattaatgacactaacaacaatctcaagagtcagggattaacgattcatgtcaccgatcccgtcaaggaaaagcttgtcactctgggttacaatccatccatgggggcacggccattgcgtcgggttatccaggaacagattgaagaccgtgtggctgacttttacctcgaccatcctaatgccaaggaacttgaagcaaggatcagcaacggagaaatcacagttggcgaaccagccaaggcagaagcctcttcaaaaacagccaagaaataatccgattgttgaagattgaaacgttctcagtgcgaccaattggttatcgtggtcgtaaatgaggctcgcactaaatcggttcaagcataaattgcttgaaccggtttttttattccgaagcttccaggatcaattatcaaaataaaaagttcacgctcttttcttgtcagtgcagcagcgatcagcgcttttgcttgctgaatatacgcctagaaagctaaagttagtggacctcaacgagcgtagttgtatccattccgtccagtcatcacgatgtcaataatattattttttcttaaactgttttataataaaaccagtagggagagaaatggagggcatgaccatgcgattaattaacgtaaccaacagcttcagaaatttggtaaaccagcagctgagcggtaccgatgcccgactcgtcaaagtcttttcactcggtcaaaccacagttgtttatacagaggccccttcgcatattgagctattattcaccaatgaacgccgcaacatccagcgtgaagaaattgccttcacgttagatcgcttgctaaagaaatcaatcggtgatgtaacgccaattatgggccaccacctagcagaggtcacggttcccaagcttgagcgccaggcagaataagccgctgtcattatcagataactttttaggtaaggtcggctgttgatcctcataccggtaagattttcacttactagtactccaagtcctgttggccggtcagtccggaaacacaggcatcaaaaaagcgaccgtaaatggccgctttttttgatgcctgcttttgattatagtttcgccgttaacttgacatccggatacttgtcagcaaaccagcgctctgcatattgattttcaaataagaatagcggatcgccgtgaacgtcctcaacgagcaggttacgggaactgctcatcttttcgtccatttgctcagggtcaatccagcgagcaatgcgggaaccaattggcgtcatgaccacttcagaatgatattcatgcagcatccgaaattggaaaacttcaaattgcaactggccgacagcccccaaaatgtattcattggtgtgataagtcttatacaattggacagcaccttcttgaaccagttgctgcatacctttgtggaacgacttttgtttcatcacattcttcggggttacacgcataaacagttccggcgtaaactgcggcagcttctcaaactgaatcgacgttttcccttgataaatggtgtcgccgatttgaaaattaccggtatcatacaaaccaacaatgtcccctgctaccgctgtagaaaccgtttcgcggctgtcggccataaactcagtcgaattatttagccgcatggtcttacctgtccgatgcaagatgacgtccatcccccggtcgaattcaccagagacaatccgcacgaatgcaatgcgatcgcgatgagccggattcatgttcgcctgaatcttaaaaacaaatgccgagaattccggatcagtcggtttgatttcgccatcttgagcggttttctttggccctggctcaggcgcgtacttaacaaagctatttaaaaaggtttcgacaccgaaattggttaacgcggaaccaaagaagacaggggtttggtcgccagccatgatcttcttgagattaaactgattgccggcatcgttgagcaactcaatatcatccagcgtctgcgtataaatcgaatcttgggtcaaaggctcgctggcatccagttcgcctttgtcgttaagcggcaaaaagcgatcggcaccttcctgtcggtacaattcaatccgattattgacgcgatcatataatccctttaaccctttacccataccgatcggccagttcatcgcatagccttcgattccgagcaagtcttccagctcagcgattaagtccaagggctcgcgaccatcacgatccagcttgttcatgaaggtaaaaattggaataccgcgctgtttgacaaccttaaacagttttttcgtttgtgcttcaatccctttagcagaatcaatcaccatcactgccgcgtcaactgccatcagcgttcgatacgtatcttcagagaaatcctcatgccccggcgtatccaaaatattgatgcgcttaccttgataattaaactgcatgacggaactggtgacggaaatcccacgtttcttttcaatttccatccagtcagatttggcaaaatgaccggatttccgtcctttaacggtaccggcttggcggatgacaccgccaaataacaacaattgttccgtaatggtggttttcccggcatccggatgtgaaataatcgcaaacgttcgccgttttgctacttcttgtgctcgttcttgtggtttcataatctgtttccttccaaaaataacattacgcctgccaacatacctttaactctcaatgctggcatcgctaactatccgcctccttggaaacaacttctaaaggtggcgtctcacttaaatgaatatgcacattgaccagccgagaaccttcgactttaccagtggcaagctgcacccccggagccagttcaagcttctcactatgatgggtcgaaggaatggccccaagttgagtgagcacataaccggcaatcgtgtcaacatccggcgcttctaagttagttttaaacagctcattaaattccgaaatcggcatccgtcccgaaacaatgaagtcgtggtcggtttgtttcgtgtatagcttttcagcctgatcggattcatcatcaatatcgccgacaatttcttccaacaagtcttcaatcgtgacaatgccaacgaccccgccatactcatccaaaagaatggccatctgttgctgcttggtttgcatttcagtcaacaacacgtcaacggggatcgtctccggaacaaacaccggctcaatcatcaccgattcgatcttaacctggtcaaagccaacacgccgggcttctttaagcaggtttttaatatgaacgatcccaataacgtgatctttgtcttcttcataaactggaattcgtgaataaatgttattcaaaattgcatcaatagcgctttgatccggttccttggcatcgatcataaacgcatccgtacgcggcaccatgacttcacgcgccatcgtatcagacaacgagatgataccttcaaacatttggtactcgtccggttcaattgcgccggcattgcgaccattttcaatcatggcaaccatttcttctcgggtaacggactcgccttcatgactaaactccatgggggtcagcttcatcagcaatttagtcgaggcggataatagccagacaaacgggcgcattaacgttgccagccaactaatcggtgtgacgctgatcttggcaacccgttccgtcatctgaagcgccacctgcttaggataaagttccccgaaaacaagcgagaaatatgacaaaatcaacgtcactaaaatcactgccgcttcgtgtgcaaacgaccatgatccaaaaatcggagcgactttatcggctaatgtcgtcgccgctgaagccgaggcaaagaaaccggcaaaggtgatcccgacttgaatggtagccagaaaatgacttgaatccttcatgatggcaactagcttggcggctttgcgatcacctttatcagcctgtgcctgcattcgagcacgtgaacttgagacaaccgcaatttctgcggctgcaaatcctgcattgattaatgttaacagcacaatgaggattaactgtccccatatctggccgtccgggtcactgcccatttcgaatccacaacctttcgtaaaaaaaacggggactcatccccgtagttcgatcactttagtatagcaagaccttatttctttttcaattccgaatcgggcttgtcagcgtgcgtcggggcttcaagtgacaattcatggtcctcatcaaaatcctcgtcattcttatgctcctggtgaaaacgatacagctcatataaataagtaatgaccgtcttaatgacagcgtaagtcggcacggcaagaatggtgcccagcaagccccacagattccccgctaccatcagtaaaatgatgatggtcaacggatgaatatcaagcgagcggccaatgacattaggataaataaaattgccatccgtcatctgaataatcacgacaaccaagaccacgagcaacattttagtccatccttcagtggcagcaataatcaaagccggcgcaatcccgatgtaggggcctaaataaggaatgatggtaacaacaccggcaataaaaccaagcagatacgcatacggcatgccgataatcaagtagccgataaaggtgaacgtaccaacgaacaaacattcaatcgcctgcccgccaatgtaatgcgataaggtcgcgttaagtcgggtaaagacagtagccacttcagcatgataacgccgcggcagcaagcgctgaatacttggaacgaaattttcgccatctttgagaaaataaaagagcatcaccggaatcgtaataatactgataacggtacttgccaacgagccaatcaccccaggcaggccacttgaaaagccgccaagtacctgactcagcagtttactcggggaaatctgcaagcttgcaacatatttaccgatgtttaaccgctgataccaagtataatgcgatgctttgctgataaacgtgcgtacaccttttaagaagtcggggatattcgtcacgaattgggttatctgatagatcaggttcggtaacaccgccatgacaatcaaaacaatcgcaccaatgacaactaagaaaatcagtaaaatcgaaacattgcggctgatatgcaatcgctgtaataacttcacaatcgggttaaacaggtaaaacaagaaccccgccgaaatgatcgggatcagtaacgttgaaaagaaagtcgcgaccggtgcaaataaaaaagaaacctgcgttaagccgatcacgataaaaattaagactaacaattcgactgaccagaacattaattttgaatggcgtaacttatcgaacataatcgacctccccaacgtcttctcactagtgttataatagcaaacaatttatcaaaacggaaagaaggctgacgcattggaagtaaaatcaacaacagacttagactctcaggttcatcacgacagcgtacagataagaacccatgtatttgtggaagaacaacacgttccggcaaatctggaagtggacgcggatgaaggcaaagccacttattttgtcgtctacgatgctggcttaccggtggcaacagcacggattttaccagaaggaaccggttatcacgtccagcgcgttgccgtcgaaaaggcctaccgcaaacacgggcttggaaaaatggttttaaatgcgattattgcctatgcccgcgagcaaaacgttgcgttcctgaagctcggggcacaactgcaggcaatcggcttttataaaacattgggctttcagctaaccgaccagcctgaatttctagacgccggaatccgtcatcgcgaaatgcaattacagcttacgtaaccttgtgtatgatttgattaaaccatccgaatgtgaaaaaaatgcgcttctaatttgattttcttagaagcacaccctgacaagccgcttagttcgtgcttgtttttttattcatattcatcaaccccggttagctgatgcggattgatgtacaggcgataagccacctcggcaaccttaccaccgctcaagcgataactttccagatagtaaggatgatccgtttgcccaagccgctccggaagcgggtatcctgcttgttcaataacgtgtaacccttgattaaagctggtcgctaacggcaattctttcatgagcacgcgatcggcagactgcttcacctgcccggcagttgcggctggtagtttaaaacactcataatttttgggcactttgacgtcaaccggtaacaaactgccaacccaataaataaaggtattgtacggcgaaaaaacaaccaaagctgttcgattaggtgttttagtcaactgatccagtgttttaaaaccaaactggtgttcaaaatccgcccacgctggtgcaaacgtccccagttggtcgctatcttcggttgtatatgcgtgtccggccaacaattgtgctggctgttgtggaatctctttcatgttgccctccaaaacctagtggactaaatccgatgtgcaagctgaatataccgccgataccataaatccacgtatgcctgcgaaaatggtcctttaccgtgattaatccaatcgacaagcactttgacgtttgcctttaagattcgatccgttgttgcaggataatgccacaatttccgatgcgcttcatactcatcaacatctaaaaggcgcttttcaccatcagcgaaaaccttcacatccagatcataatcaatatacttcaacgcttcctgatccattgtaaacggggtggccagattacaatagtaagaaacgccgccttcacgaatcatggcaatgacattgaaccaataatgtttatgaaagaaaataatcgccggttctcgcgttaaccaccggcggccatcggattcggtcaccaatgtatgatcgttacagccgattaaggcatcttcactggttttaagaaccatcgtatcacgccaggtacgatgcaaactgccatcatgtttataactctgaatggcgaacgagtcgccttctttagggattcgcatacttaacccgctttctaaaattccgtgtttcattataacaaacctcatgaaaatacgacagcgcgtaagcaaggcggacggcggtaagtgtcaacttttcctcggttctactctcattaagtgatttccgatactccgggctggcctcctccccaacagcagcctttcgcctcagccgttttacgattcatccaccagctcacttaatacatcatcaatcgcggccaaatcaaagcccttccggaacagtgccgtcttaaccttctgcttgcgggtgcgctcatcatagcgttgctttaagcgccactgtttctccgcctctgtctttagcatggtcaactcggcttccgggtctggctgcggatcgagttttgcgatagctgcctggatagtcgcctcatcaaatcctttttgcatcaggttcacgcgcagccgctgcaattgatctttgtacgcacggtttcgatgatgccgtaagttcttttgcccggcacgaaccgcaactgccgtccactcatctgattcgatgcctgccagctgatcggctaacagctccgtagcaatacctttttgacgaagcttgtattgaacgacccgcggaccggagtcacccattttgagatcggcctccagatagcgcttcacatagtcgacatcatccaaaaaccccagctccgtcaaacgggttaaaatttgtccgatcacatctttgggcagttcttctttctccaaccgttcccggacttcttgacgggttcgactttgatgcgtgatataattcagcccgatctccaagcccatcgcgacgacttcactgtctttaatctgcgcgatcatatctgccgtgagcgtcattcccttggctaggtggtaagtcaccagcgttgtttcactgactggaaacgcatattggccgtccaaaaaaatattgtaccgaccacgccgtttttgtgccgttatcttggtgatttgtgccatgttactttgaccgcctctctaatcatactgtcagttatgttatacttttcataaatatatggaggttagttatgtttgaagccagtttctttgaccgtcatagtcttaccaactaccagctatttcgggcaatgaagaccttgccacaaacaaccttatcgatcaatgcactaagccgcgccactgggttatcgtattctcagacctacacggcattccagaccgttttggttcagttaaatcaaatgatccccgccgagacaatcgacgaggctaattttgcgcaatttttaggcaatgtcacgattaatcaatatcggtttgcgttacttaaagaaagtctgccgtttgtcttctttgatgatgtgtttaaaaacccgcaccctgattttcacacatttaaagaggtacatcaaaccagcgtctccaccttaagaaggcgcatcacgccatttcgtgattatctggctgataatggcgttaacctcaacagtacgacttgggcgatcgaaggcgatgaacttcatattcgtctggcaatgtttactttttttatgctcgcttatcgtggagctggttggcctttttcagccgaagaagaaaagcaagccaaaactttgctaaccgtcatcaatcaaactgatccggactttttactaatgcccgttgaaccaatgtcaaaagaagcgctggttgtgctttccattcaacttatgcggattaaacaaggtcatcccttattacctaatcgccgaatgcaattgctattttccggacatgaggacctgcctgatctgatttttacatcagaacaattcccgaacttatctgattcgcagctgaaggccgaaaagcagttttactattttatgcggctttattttatgacggtcacccgccaaccacagaaaatcgaccgccaattgctgactcattttggagaaaccgacaatctcgtcaatcggtttgtgaccggattggttgaccatttaaatgatcagcttaaaaaaaccgaccgccagcccatcgctgaaagccaagtgatgattgcaaatctgtatcggctcagctttaatgaatatgtccttaatggccgctttagtcagcgtcttgattttgcgcaatcgttgtatgacgaagccgatagcagcaccttggcaactgctattcagcgttatctaaagcaaattcccaagtcaatgccagaatcagtatttgcagatttccccgatcagtttattagcgggctctatttactggttagcgacaactatcctgaactcaaccatgatatgcaaatgattgtcaatgttttgattgaacatgactcatttgccaagcgggacttgttagactttttgaacgatttaggttttattcgggttgttccgccagttgaagcggtcaaacccgacttgatcattaccagtattactaaaccaaaaagggtgatcccgcgtttgggccacccgtttgatcccacgacaccgttgatcacctggatgccggaaccgactgatttggattattttcacctttatcagcgactcaaacaattacaacgccagcatcgatcaaccgctcgctcctaaattgcctcaatgcaacggtttagccgtataccccacaaaataaaccagcgcttcataaccggctagtccaaggatgacagcggtaatcagtagcgtattgttcaaattactggtgcgcgtaaaccataaaaagacaaccatcagaaacatcaccacaaaataggcgttttgcaaactgcggttaacctggatttcaaacttggcatccgggctttgataatcaatcgtgtgtaccgtattcaaacgtcctactttatatgtgattttatcaccacgttgaacttttaaatccagtgtttcaccaacatgcatgatgtgcgcggtttcattttgccacacagtcgccgtcatttttttgctcatactattcgaataattaattttcacagtcaatcctcccgaatcttcattatactagaatcactcgggtatcgtcaccatttgtcagcgtaaaggagtatttcatggcaaccacggttaaaatcggtcaacgttttcctttaacgatcaagcgtctggatattaacggcgccggaatcggatactatcaacgcaagatcaccttcgttatcggtgcacttcccggcgaagtggtcgtcgccgaagtcacagccattcacgatcgttatcttgaagcaaagacacacaaaattcgatcagcctcaccggatcgggtcaccccaacggaaccgctttttgggcaaatcggcggcgttgagttgaaccaccttgcctaccctgcgcagttgcgattcaaacgcgatgttgtcgcccaagcgctggccaaattcaaaccacttggctggcaacattatgatttaaaaccaactagcggaatgacacacccaacgcactatcgcaacaaagcccagttcccggttcgcgaaattgatgggcatgttcgcgccggtttatacgcgcctggatcccaccgcctcatccctctaacgcactttttaactcaggcaccgctgaccatgaaggtggtgacgactttatgtcaactactcgaagaccttcaaatacccatttataacgagaaaaagcacgccggtattgttaaaacgttagtcgttcgcgagtccttttcaactgggcaagttcaagtcacctttattaccaacagtgccaagttaccaaagcaagctcaattgatcaccactattgccgcccaactgcccatggttgtcagcatcgcccaaaacatcaatcctggtaacacctcgctgatttggggaaaagacagtcgtttgctggctggtcagccatatattcaggaaaccttgtccgggcgtactttccaactctcaccgcaagcctttttacaactaaaccctaaacagaccgaacagctttatgccattgccaaagacgccttgcaacttgcgccagatgacacgctgattgatgcttattgtggtattggtacggtggggatgagcctagctaaccgtcaccagtcgatttacggtatggatacgattcctgaagcaattgccgatgctaaagctaatgccaaaaataacggctttaacaacactcattattttgtcggtaaagcagaaaccttattccctaagtggctcaaggaaggtattcgtcccaatgccgtcattgtcgatccaccacgctccggactcgaacggccatttattgatgcgctattgcaacttagcccgcaaaagtttgcttacatctcgtgtaatccgtccacgttggcgcgggatttggtaccgctagccaagcattaccaagtcgattggattcaaagcatcgacatgtttccgcaaacagcgcggtgtgaagctgttgtcaagttcaccagacgttaaactgagtcacttgttacctgattcgggattatgtgcccagttctggtttaacttgacgtttgtacgaatcatcgccattttccaatcatgctaagtgaggtcctctttcaatgaaaatttattttgccaatgcactgtttagccacgccgattttgactacaatgccaaactagcagcccagatccgcaccgccattccaaaagttgatctgtacgtccctcaagaaaatgcggccatcaacaacaaagaagcgtacgcagattccaagatgattgctgaagccgacacgcagcggttagaagcagctgatttaatgattgccattttggatggtcccgtcattgataacggtgtcgcaactgaaattggtgtggcgtatgcacgacatattccgattctggggctctatacagacagtcggcgtctgggcgctactaatgacaagaagctcgccgccttgcaagaagtggcagaaaaccaatttcattatctcaacttatacacgaccggcttgattaagctcaacggtgccattttcaccgatgaagcggccttgattgcagccatcaaagcccgcgcatcggcataatcaaaaaagcttccgtccccttcaatgaccaggggtgcggaagctttttgaattgattcaattaaacatttgcagttgtcttttcagcatcctcgagtaactgccggaaaggaatcaaggtttcggcatgatacttcttaacgaatgcgtcaacggcttctggatcctgcgtttgcttatccaaaaccagttgttcaaccggaattggccgtaaatcggaaatctttacgtcaataacaaccgggcctttacgatccttggccttggcgaatgccgccttgagttcgtccaaattatgaacttcaaacccttgtgcgcccatcgcttcagccgccttgccataatcagcatcaatgagatcaacccctgaatgcggctgacgggtatcgtcttgttccgcttcaataaagcctaaactttcattggtcaggacaatgttgataatcggcatatgatacttcacttgggtcataatatcctgcataaccatcgcaaacccgccgtcacctgaaattgaccacacttgccgatccgggaattcagcttgggcgccaattgcagcaggtacagcatagcccattgttgcgtaccagccggaagtcgtaaagatttgattatcgttggccttcaaataacgcatgccattaatcgttacgttaccgacgtccacctggaaaaccgcatctttgtcggccatctcgttgataagtttgaagatcggttcaacgcgcaatggggtttgcgaatcgtcttcaaatgacgtcatccactcagcccagtttgccttgttagcgactgcagcgcgataccaagcagtttccggtacggcatcagccttttcggtcaatgccttgatgaatttcttggcatcggctaaaaccgccagatcaactgtgtgccgccgcccaaacttgctagcatcaatatcgacttgaatatatttagcatttggtgcgatgaagtatggctggaatgggaagtcagagccaaggaacaaaaccgtatcggcgccgcgggctacttcaactcccggcttcgatgcaacccgaccggcagatcccatgttggccttataatcatctggcacaatgccttttgccagtgcggttgtgatgatcgggatatgcgttttttctgaaaatgcaatgatttcatcgcgagctccacgcgcaccattaccaacgtatagaatcggctttttggcatcctttaaaatgctccaagcggttgccacttgctcgggatccggttcaggcaataacggcttttgataaagattggccgatgaaacataattatcatcaatctcctgccaaccgagatccttaggaatggtcacaacagcaacgccttgatacttatacgcttgacggatggcttcatcgacaacgtgtggcaattgtgcagccgtcatggcagtccgattataaaccgacacatcggcgaacatcgggttttcattcatttcctgaaaatagttggtattcatggctgcagtcggcacctggcctaccaatgctaataccggtacatgatcgtattgcgcatcatataaaccgtttaacagatgaacggcaccaggacctgctgacccaaacgtggccccaatgcgtcccgttacctttgcttcgccagccgcagccaatgcgcccacttcttcatggcgaacctgcacgtaattaatggtgtggcggcgattgtaaagcgcgttcatggtgctatcaaacgatccgcccggcaatccataaatattatgaattccccagtcttctaacaccttgatcattgcgtctgcagcattgattttttctgtcatgacacttgcctccattattacttacattttgtaagttctttacgattatgagtataacaattaatcaataacaatgcaaaccctttcactcgattcgagatcaagtcacggctaaaagtaaggaaagcgctttaatcattgctattatacccacgtcaaggtggtaacagtcaatcaaactgactgatacagagcctgttcgtttcagatagtttgttagcagactgtattttgccttagatgttttcttgcccatttctatccatttcaaaataacggcaggtgctagttgtcacaagatgagcgggcaaattgtcatcactcgctttgacgcgttccccgccgtctcacacttcttcataacgcgctccccggctcgcgcccacacaaaaaagaatgaacgattccatctaagcggaaaagtccattcgttttctattactttttacatggggccgaccgaatataattatcaactaaaacattggtgcttgttgattctgaccagacaagactactttaacttctacacccggttcatcacgattgatgtttttcgtagtgccgctcctggccaatgacaccggtcaaaataaactgaccacgatagtaagccggatcagggcgatagtcatcggcatcatacgggactttatcgctaaagaccgcttcgtattccggtacaggcaattctttgcgtttagttagttgctgggcatgttcggcggcgtgtagttgttccttaaattgtggttgcaaaatgccgctgaagaactctgccacggcaccggaaccatacgaaaacagtccgatccgatccccggcttgtaacgtcgtatcatgatccagcaacgacaacaaccccagataaagcgacccggtgtagatattcccaatttgccgacaataacgtgtgctggcttcaaaacggtttttcaatcgttgggcactcgcgtcatcggtggttggcaacactagatccaatgcttttttacccattttggtatatggcagatggaatgtcattgccgcgaaatcatgtgcgcttaaatgatggtcggcctgataacgttcccagactgtcttgaagaaggcgagatattgttcggttgagtattttccctgagcaagcgccgtatcttggtaaaccggtcgccaaaagtcgttgattgatgccgatcgataaaccgaatccggttcaattgtcagcagacgcggatcagctttgacaatcatcgccactgcgccggccccttgcgtcacttcaccggccgttgctaatccataacgcgcaatatctgccgcaataacgagcacacttttatcaggatgactcgcaacataatcacgagccatcatcagcgcagcggtcccaccgtaacaagcttctttcagttcaaccgcccgcacccattcaggcagcgccaaaagatcatgaatgaataaggctgcggatttactggcatcaaccccgctttcggttccaaccagaatcatgcctaaactggcacgtgatgctggcgtcaatacttttgcggcggcattggctcccagcgtcacaatgtcttgactagatggcggaaccgcctgctcgtcttggccgatgccgatcgtatatttattcggatcatcaccgcgaaccttggcaagttttacgagatcgacgtaaaagtccggggtatccatttcaatggcatcaattccgattttcataatttcaatggcctgctttctgttttgatcgaatcgttgctaaatacattttggcatgtgccagatccatttcacctgcgcgtaaggcggcgactagagtaggtacttcctgatcctgagctccggcagcaatcgccagcgcattggcctgcagtttcatatggcctgactgaatgccggggccggctaatgcgcgcaaagccgctaaattctgcaccaatcctaatgcggcaattacctgctgcatggtggctaagtcgcgataacctccaagacggcgggcggcctgggctagtggtaatgcaccgatcgcgcctccgacaacgcccagcggcaatggcatttgcagatggccttcaagtttgccatcgcgcatcaaccaacgcgataacggttgatactgaccagtcgcagcggcaaacgccccaacactggccgcaaccgcgcgcgtgtcatttcctgtcgccaagaccgccccaatgacaccattaagaatgcctttgttatgcgtcaccgcgcgctccggatcgacaaatgccagatcgctcagctgcacaattttatgggcaatttcatcccctgacagtgtttttgtggcaagtgtggccggtgtcaatttcacagttgccgtgactaactcgccaggtgcattagtcaaaatgctggccaaaaccgttccatccacccaagctgtcactgcgtctgccacagcttcggcaaccgtattcgcataattggcacccattgcctctttaggattaagcgtcaggcgaagttttaaaaaccggttggccaagattgtcacagtcattttgctgaagcctccgccacgctgcaccattgagggatgggaggcattggccacagctgcgatcgttgcttgatgggccaaaaggatctgcctagccgcattcaaatctgctaagtcagttaagaccacttctgccaccacttcatgggtacccacatgcgctaaaacgccgccgttttccgctaccattcgcgcaccattgctggccgcagcaacaacagagggttcctcattaacaatcggtacctgatgttgctggccattgaccattaaatttcgcgcaatgcccatcggtaaggaaaattcaccaattgcattttcaatcagccgagttgcagtagcatcaggaagcgtgcgtaccgcagccaataaagcggcatcggcactggttaacgacccttcttgcacgagttgctgccgcctagcttcgggcgtttgctcataaaacttcattttgatctgctcctaatcatgcaaagtaacttgcatcgccataccgataccaccaccgacacataacgccgcgacaccggtttgttgcctgcgttccgccaaattatacagcaatgaaaccataatccgcgcgccggatgctcccaagggatggcctaaagcaagcgctccgccattgatattcacctgttcgtcagtcagtcctaggtcacgcatcacggcaacactttgcgaggcgaatgcttcatttaattccacttgatcaatggctgttaaagtttgtccggttttttgcattagctggtcaatcgctaatttaggcgcataccccatgatgtccgggtcaatcccgacttctgtatagtcggtgatggtagccaaatagtggaggcctaactgctcggcttttgacttcgccataagaatcaatgcagccgctccatcattaatcccgctagcattaccagccgtgacggtcccgccaacttcaaaaactggcggtaattttgctaactgggctaatgatgtatccggtcgaatcgccgaatccgtgtcaaccgtgacatcgccatgtcggccggaaatggtcaccggcgcaatttgtgatttaaaccggccttctgcagcagcagcggccgcacgcagatgagagcgcagtgcaaactcgtcttgcgtttgacgactgatctgaaagcggctggcaacattttccgccgtaatccccatcggttgctgactaaaagcatcgtttagcccatcgcgactaagaccatccaccaacgcagtatcgccaaacttatgcccggcccgcatcgcctcagcataatacggcacctgactcatactctcggtaccgccgacaagtaccgcgttagcttcacctagttgaatcgccgcctgacctaaccgaattgcctttagcccagagccgcaaacctcattgatcgtcatggccgtggagttcgtcgccatgccactatgcaacgcaatctgacgcgcaacattctggcccgatccagcctgcaaaacattcccgaaaattgcttgatccagttgttgcggatcaagccgtgctgctttaatcgccgccttagctgcggcaacacctaaatccactgcactagcacctgctaactcaccgcccaactttccaatcggcgtccgcttggcactaagaatcacaactttttccataataaccccttttcaaaatgtgagcgtgagccagaccggttagaaaccggagcataagtggccttggtcgtgatgaccgggctttggtcattgcgcccaaggtccttatgtgcaggtttctgggctggcgaacgcgttatggtgagcgcgagccagcgcgcttagagatcggagtgtaagtggcctcagacgtgatggccgggctttggccattgcggctgaggtccttacacgcagatctctgcgccggggagcgcgttatggtaagcgccgagccgcccggtcaagaatccaattcaaacatgcgttataatacatcgaagaagattccatcgctgacctgagcaaccgctacataccaccaatgcccgctcagaaaaaccgttatagtttatcacagtccgaaaaacaaaacatctaaatcgtggcttgcaccgttaatcgcccagattccggttccttgagccgtgattgcatttatgtctagctacataagttcatgttaaactgtttaaattgtatgcgattcttttcggaagtaacacccgtcttcaccaatccttaacttttaaccatagaaagtaggtgccgttgatgcgcgtcattgatttgctcgccttactcgctgaccaaagtaaaaacgcctcagtactgttaaatacaacaccagcaccaagtcgttttgatgattttattttgaaaacccaaaatgatcagccacaattaatctttaagcccaaacctgatcgaaaatcgccattacgcgtgtgggaattacaactgttgttaaatcaccctgacttacaatcacgttttctttatcttgtagatgcagacggcacccgtgcactttttggctttatccaccggccagttggtcttttacttaactaggccggatgttttgccgccgccaactttgctgcaaccttttccagataatggtgactggctatcatttcttggcaatcaaactgatttttcaaaccgatttcataaatccggctggcgttaggattgagctgcggtaaaacgcggtaccaatcaattcggccttgtcccaaaggcaaactgtcatgcgtctgccccattgagtcaaccaaatgataatgccgtactaatggttttaggttggccagactcgctatcagtcgctcattatccccgtgtaacgtgataaaagcatggctagtatcataagccaatggtagccgccagcgcagcaaacgcgcctcaaacgcaggatcgccatacctaaagattggcgacatcgagttttcaaataccacgtgtcccggcgcctcttgagcaaacgcaatcatgcgagccaatgccacatcttgtgcttttgcaacgtcacgccatccggcataatctccgggggtgtccacgcggtagcctccgtgaatcagtgccgtggcgttcacttttttagccagtgtcataagcttaacggaactggtcatcagaaagtcatacctggctggatatttagtcggattcatcgctaactcattgcgctgaccgcgaaaacgcatcgggtggtgaaacacaacagtcggcacctgactttgaacccaggcaaccattttcaaaaaatgttgccagccactcgcggtaaaatctgcttccgtcaagtgaaactcaaaaacgtcaggatgatactgcaatcgatcacgaatctggcgctcatccgtactggcttttaaacccaacaacatgaattgccaacctccttaaaagcaatggacattctagctcggtaatctgcgcatcaagcgtttaagcttcttgcggtcaattaacatcacacccaggtcgtcagctaaggcaatcgccgagtcggaaaactcactgttggtgatgaccgcagcttgatcaagttgataataatgatgccctgcccaaacttcctgaaccgccttattcccaacaaagccagtgtatcgcttacattgaaagccgaatgactggccttttttttgtgcaataatgtcaatgccttgatcacccgaagcctgagtaagttgaatacgcttgaagccattgcgttttaataaataggcacaaaattcctcaaacttctcaccttccatgatgtccacgctctccatcttcaaatctcgaaaccgaaaatgatgatggtacagcaacaacgcattgatcaccacaaataaactaataatagtaaaactggcaggatcgccataaggtcgcaactgccggggcaaaatagtgcggccccaaaaactgtaaataagggccaatacaaacaacccccacaacaaatggtaggcctttttaagtaaaattctcatgcttctaaacccttctagttaagtgagcgtgagccagcccggttagaaaccggagcataagtggccttgggcgtgatgaccgggctttggtcattgcgcccaaggtccttatgtgcaggtttctgggctggcgaacgcgttatgagcgtgaaccggcgcgcttagggatcggagtgtaagtggccttgggcgtgatggcctgggcttggccattgcgaccaaggtccttacactccgatccctgcgccggtgaacgcgttatggtgagcgtgaaccagcccggttagaaaccggagcataagtggccttgggcgtgatgaccgggctttggtcattgcgcccaaggtccttatgtgcaggtttctgggctggcgaacgcgttatggtgagcgtgatccgacttctgcgccggggagcgcgttatggtgaccgcaagccgccgcgacacacgcgatcttcacaccatcaaatacatgatccttatcaagcctagcagattcacgccatgtttgcattgaaactcaggtaatttttctgtaggcttaatttattgagaagggaagcgttttcgtcatgaaactaagcgccaaaatttttgccaaagttggcagtgagcgcattacgcaatacacattagtcaacgatcagcaaatgacgctgcgatttttaactttcggcgctcgcgttcagcaagtccggttgcccaatacgactgggttagatcctaacttattgcttgggttcgtcactttagaagattatctgcatcaacccggtctttttggcgccatgaccggtccgcttgcaccagacgaccctaaaacgattccgggagcttggcagaattggaattgggcggtgaaaaccagtcaaacggctgacttagccattaccttttctctaaatttacctgaaaacgctgatggacaaccgggcgagcgctcccttatggttacgcaccgactgaataacgacaatgtctggactatcgatatggccgttaaaaccactgccgaaatccgacttcatccacgattgatattgccatggttattgacagccgatcccgcccaaacaatgttacacgctcagttaaccattgaccaccagcaaagtaccatcaggcaacagccagaaatctcgcctgcacgtagattctccttagccaccggtgactggcaactgcgctatgccaccgatgcgccggccacccgcattgactcgtttgctaacattggacccgataacaactttaacggcattctgggacaacctcatgttgcaatcggattttctcctgaaaacaatttaaccggcaacgcgtggacacttgctgccggcgcaacttggcaacaccacgctgaatatcagttgagcaggattaaggccagtacgccagaccgttaatccaatcagctaaccaaactaatcgctacaaaaagccttggacgttgaatgagctgctcaccgtcacaaggctttttctactggtattagtcgacactaataatttttaaagacatctttgtaaaccttaatactgtcgaacacgtcttggaggtcaacatattcatcggtttcgtgcgaggtgtcattacctggcccgtaaatagccaagtccaaaccatcgtggaaaaataaggccgcatcggttatgccggttcgataggccacagccccgcgctgcaaaccgatccgctgccgtgcctgctggactttttgaattaacgcattatcgggtgcagccgctgcggcacttaaaaccgaatcaatcgaaagtgataggtgaaccccttttggtactgatgttttagcagcctgcttcaaagcggcaataaacgcatcattatcagcaatcatggttgttcggatgttgccgcgtaaataagcagactccggtaatgaattaatttgattcccgccatggataatatcgatgttgtgggtagcgtgacccagaatcggatcatctttagcttgaagcggcgcggtggcagttaatgcggcattggcaaaagcaaataagccgtgaatggcattagccccaagatctggacgtgaagaatgcgccgccttgccctgagccgttaacgtatagtcaataatgccacgttcagccgcatccacattgctgtttcccggttctgcgaccaaaagaccggtcaaccgatcaccataaccggcagccgcaagttggcgggcaccgtagttatcgatttcttcgcccacggttgccatcaactgaacgccatgatcaagctcttcatgcgcgatttgcttaaacgcaaccacagcagcggcaagtccggatttcatatccgtcgccccgcggccatacaatttaccatcttcaatctgggctgagaacggaggaaactgccacttgttgggatcgcctgcatccacgacatccatgtgcccgtcaacccctaaccagcgctgcgcattaggatcaccaatcgtcaaaactaaattgtcgcgtcccggcgcataactgatacgttcacgcttaatcaaccctgtgcttagttccggggccaaaaaggcttcgatcaagtccgccacttggccttcttttgctgccacactggggattctaaccatcgcctgcaatagatcagtaacttgttgttcctcgtctgtcaaactaccgcctccacttttaaaatacatcatcttaacgatccaaatcgccaccatgactgagttcatctagtcacatcagatgccatcaacaccattattccgaacacgcaacccagtcttttaacgcagccctattttcttctaaagcgcaacaatgcctgacctaagattggggtgacaatcccgccaagcaccgcctctgccaccgcattaatggccaaggcagtaatcaacagccaacctaaattcgttgcattggctcctggaacgatttgcgcggctttgctggcaaacaacaaccaggtaaagccgatcaccagcaatgtattggttaaagcgcctgtaaccccggcgatgaccattttaatagtttgagccagcgtactctggtgtcgtttaaataattgatgaaaaacaaaagctgcaaccaaaccaaccatgactcgcggcaccaacgcgataattggattgcgaaaaagcagtaaagttaccgggtcagccgctgatgtataagcgcgaatcagactcgttaagccccataataagccaaggctggcacctccgccatagcccaatacgatcccgccaatgatgacggtcaagtgaatagtcgaaatagccggccaagcgggaaaaatctgaacataaccaaccattggaatgtaggcttgcaaaataatcaaagctcccaaaataccaatgatcgcaatgttataagcttttccgcgacgtgtcatgctgacacctcctaatcgtttatagctaattttatcaaattatacacgcttacgtttgtttatattgtgttttctgctgttgctggttcaatcaaagtagaccattgcgttcaggtatggctcatgctgggtcaatagtccatgctttgacaatattgcttgcggtcgccagtgttagctaccgctgaggccgcttgggttctagcttatgcccttgacgcgctcaccggcgcagaaacctgcgtgtaaggaccttaagcgtaatggcccaagcccggccattacgcttaaggccacttacactccggtttctaagcgcgccggttcgcgcttagtaaatttctattgactttaatctcacgttttcctataatatttcttgtgcttaattagtcatgcgggcatggcggaattggtagacgcgcaagattaaggatcttgtgagcatttttgctcatggaagttcgagtcttcttgcccgcatcatagcaagatccgatcaacaaggtattactgttgatcggatcttttttattttatacctgatcatggaccggcttgaaaaatattaagcctctgaaaggagtcccattcgatgcttcgtgaagcccaatttgtcgatctgccggcgattgttcatctttatcagcagcttactcaagagatggctgcattggcgccggatacttaccggcccttaaccaccgacaatcggcagtattttgctgattacctgcagaatgatctggctcgcctattcgtcacggaaagtcaaggcacacttaccggctttgcattggtcgttttagctcgaaccggggacagccccgaattcgttccacaacactttgcgcagttgattgacttgtttgtcacgccggatcatcgtcatcacggcctagccaaaaccctcatgacagcggtcgaggcattcgctgccagtcatcaagcctcttttattcaactgaacgtcctcagcggtaatcaaaccgcacgagaagtctatgcccgcgccgggtttcagccagtcaatttaatcctgcaaaagccgcttaattagttatttcgcgttgcctgcagccgtaatttgccacggcagacaccgcacgcgtaccgagtgacattcatccgtcggcgccgaacgaattgccgaccacaccttgtgcattgataaacatagtgtcggccgctcatcggcagtggcggcgcaaaccgcgagccgccaactgctgccagtaactgtttgaagtcatgatcgcgatgttgatagccgcgatgctgggcgaacaaatggtagtgcaccaattcatgcttgatgatgccatccgtgacatcagatggataaagcgcaaaaattttggggttaaaatccagattcatcgtcgcaggataaaaccggccgccagtagttcgcaagcgcgcattaaacacggcttgatggttgaacggttggtgaaatgcgctcatagaaatggcttccacacgtgcttgtaattcttggtttgtcattgtctcatcgttacctccgagccaatagtgtacatcagcacgtcaccaattgcactatttgtatcaggctaccttgcgagactatccgatacctgttgagtatgttcatctcactattcatcagactacaaaaaggaacggttcagacgtccacctgaaccgttccttttttctaaccatgaaacttgcgcattgaccaagcaaatgagccatcacaatcagatttgcctacctttttcacactcgcttaattgaaaaaggctaagacatcggcacgcttcaatgctgcttttcgtttttgatcgaagtctgccacaatctggccggcatctagcacaatgagccggttgccatagcgtaacgcgtcttcaacttgatgggtgatcatcaaacaggttaactgttgctccgaaacgatcgcattcgttaacgtcataattgcctgactggtgtggggatctaaggctgctgtgtgttcatcaagcaacagtaaatccggtttgcgcatggtggccattaacaagctcaaggcctgccgttgtccacctgaaagctgctcggttggcttataaagcgcctcagccagaccattaccggtttttgcggccaaagcctttagctgggctttttgtgcattcagacctcgggaacgtaaccctaggcgctgaccacgatggctggctagtaataaattctcagcaaccgtcattcgcggggcggttcccattttcggatcctggaaaactctggcaatatgccgagcacgctgctcaggacggcgcccgttgagtgtttggccagccaaagtgaccgtgccgccgctaactggtagatcaccggtaatcgcattgaataaggtcgatttaccggcaccattatgacccaaaacggtgacgaattcacctgttttaaccgtcagcgtcacatcttgcaacaaggtcttgacttgagttgcaactggcacattaaccgtcacgtgatccaattttaattcagccatggatctgcacccctttctgcaacacacgtcgtaatcgtaattgatgatcaatttgcggcaccatgatggcaatggctaacacgaccgccgagatcagtttcaaatcatcggcattgaaccctagcgccaagacgaccagcaagacaaagcggtaaataatgctccctaggatgactgccaccaaccgctgcgacaaagtcaactcaccgaaaacaacttcaccgatgataatagcagctaacccgataacaatgatcccgatgcccatgttcacgtccgcatagccattattttgagcgagcaatccacctgcaagcccaaccagcccgttgccaaccattaagcctagaaccatctgatgatcaggattaattcccagactccgcgccatattcggattatcacccgccgcaatgaacccttgacctaattgggtgttcagaaataacatcaacaatcctacgacgaggacgacaacaattaaaccaataaccacgctattaaagtagggcggcaagtcttttaagaacgatccttggaaaagattagcctgatgtagcaaagataaattggcccgccccataatccgtaaattaatcgaaaataaaccggtcatgaccaggatcccggcaagtagcaccggaattcggcctttggtagttaacaaccccgtcaccagcccggcaagcatccctgctaccgttgcgagcaaggttgcgataatcggggaaataccgtgagtaatcgcactgacggccactgctgcgccaaagggaaatgttccttcaaccgtcatatctggaaagtccaacacccgaaatgttaaaaagagacctagtccgattaaaccgtataacaatccttgcccaattgcagaaacccctaaactcatttgatcaccgttcctttcgcctctgcctgtttcactaacgaactcggcaatgttatccccaactgctgcgcttgcttttcatttaaaatgagtcggccggttttttcaaagtggatcggcgtcgtggccggtttggctttgccttttaaaacatccgccagcatatgcccagtttcaacacctaaatcaaactgattaagtccgatcgttgccaccccgccttgtttaaccatggtatccacagttggaaaaatcggaacctttcgtgcgttagccgctgccactaaagtttgcatggcgctcgccaccgtattatcggtcggcacaaaaaccgcatccacctggcttaccattttcgttgccacttggttaagatcgttagttgagctaatcgcataccgtttgaccgtgaatccttctttggggcctagtttagccaccatcttggcttgggtttgtgcggaatcatcactggaagttgcaatgacgccaagtgttttcgcatcaggcatgatctgacggataagtttcaattgagctgcaatgggtgcctgatcggaaaccccggtaatattgccgcctggttttttaacatttttaaccaattttgctgcgactggatccgtaattgcccccaagatgatcggcgtcttttgattcacattggctagtgcttgagctgcaggcgtagcaataccgactgttgcagcggcatgttcctcagtaaagcgttctgacattgacttcagattactctgatcgttttcggcattttgaaaatcaatcttgatattcttgcccgccacgtagcctttatctttcaatccggcgataatgcccttatgaatcgcatcaagcgccgggtgggtcgtcagctgcaaaatgccgacagtcggctttgtctgcgtctgttgcgcagttgtgccactttgaaaataagcaatacccaaaaagccaaagatgatgatcataaatccaagcattcgtttcattcgcttgcctccattttaaatattccaatagctttggtggtgtcgatcctttaatgtgataccgacatattccgcgtggttaaagctactttgcggttaaccttcccttttttgtatcaataaaaataccgcgacaggttcaggccgtcgcggcaataaaaaaaccgcatagccccgtgattgggtatctatgcggacaataaatcggaagccaacatagacacaacctgcgcgtctggcaggctgcatccgcaacctacctaaagttggctttgccagttctttaaggtaagcaatgctgtcatgtgggtttcctccattcgtttatacttgatgagatgttagattaaaggtacatgagtaaacatttcatgtcaagaaaaatcattgcaagatgagcgagattttttgaatctgcttggtaaatttctgaatcgtctcatcctgcgccttttctgaagcattaaaggcgggaacatctacttctaagtcaggttttaagctggcagtcattgcttcacacgttgcggtaaaagccgcaaagtcatgaaccaacgtacgatgcggcccagccagtcgcgccggaactgccacttgttgcaaccgagttaataacttttggtactgagcggttccttcacgaaaaacgacctgagtatcctcataggtctcccgatcatattcagctaactgatccgcatcaattgcttttcgcaacggttcgaacaatggtgccattttatcttgattagcctgaatctgttccaccacatcattaatggtcgaaccataatgcgccaacttcatttgttgcttattcatgaaaagcacgaatcctctcttaagcacgtggttgtcattgctgacctgccaccttttttatttagccaaacgtcggcgccgggcgcgttcaaacaccttcacgatttcgacgatcacaatcatcgacacgcccgcgccaagaaccgttatccactgatgccaatcaagggtggtgacatggaaaagcccgttaaagcccggaaccagaatcgtcactgccagcaacaggaaggatgccaaaatagcccagttgaatgctttattccggaatgcacccactgtaaacaggctttgatggatactcttaacgttaaaagcatggaagagttggatcaagcctaaagttgcataagccatggtcaaagcatccgcatgcatcgccgcttcaccgctatggaccggataagtgatagcaatccagtaaacgcccaatgtcaacaagccttcaagaatcccttgccaaatcacggccggacccacgccgccagagaagaagttggattttcgcccgcgcggtttttgcttcataatccctggctcagtcggttccaccccaagtgcaatcgccgggaaggtatccgtcaccagattaatccaaagaatgtgaaccggcgctaaaatatcccagcctaacattgtcatcatgaacaaggtcaaaacttcaccaaggttagccgacaagagatattgaatcgccttttgaatgttggaaaagacttttcggccttcttcaactgcgaccacaatcgttgcaaaattgtcatcggccaacaccatgtccgaagcaccttttgaaacttctgtcccggtgatacccatgccaataccgatatcagctgcttttaacgcaggagcatcgttaaccccatcgccggtcatggcaaccactttgccttttttctgccaagcattcacaattcgaaccttatgctctggtgcaacccgtgcgtacacgctgtatttgccgacattcttagcaaattcttcatcgctttgttgatcaagttcggcaccggtaataacggcagcatcatcaccttgatcaataatgccaagacgaaccgcaatcgcttcggccgtgtcgcggtgatcaccggtaatcatcattggccgaataccagccgatttagcttccgcaaccgccgcttgtgcttctggccgctccggatcaatcatcccgacgagccccgcaaagatcagctgttgctcaacggtctctgagtcaacggtttcaggaaccgcatcaatcaccttataagccatccccaatactcgcaaagcctgggtcgccatgtccttatttgctttcaaaatggcatcgcgttcactgtcagacagaggcgcaacgttatcgccggtggctaaattcgtcacccgcttaagcaattcgtccggtgcgcctttcgtggcaaccagaatcttgccgtccgggcggcgatgaagcgtcgtcatcaatttacgttcggaatcaaacggtacttcagcaatccgcggttctgcagcaagttccttagtaagatcaaaggactgggttttaccataagcaactagcgctgtttcagtcggatcgcctaataattgaccatcatcttgaacctgcgtatcgttggcaaaattcatgatggtcatcaaaggattgccaccgtggatacctgcgctggcagcgttcaactggccatcataataaactttttcaaccgtcattttgttttgggtcagtgttccggttttatcactggcaatgatgtcggtactacccaaagtctcaactgctggcagtttacgcactaatgcatgccgctttgccattttttgagtgcccaatgccaaaatgatcgtgacaatagccggcaacccttccggaatagcggcaacagccagcgaaaccgcggtcaggaacatctccggtaaactggcggcattacgccaaatcccgactgcaaacacaatgacagcaataacaagaatcatcaccgtcagcgtcttcccaagactcttaagattttcttgcagcggggtggttgtttcctcggcagaattaatcataccggcaatccggccgacttcggtttgcatcccggttgcgaccacaacgccaaccccgcggccataggtgatgttactgttcatgaaggccatgttggtccggtcaccaataccaacatccgcacccgtcaatggttcggtggtcttatcgaccggcacactttcaccggtcagtgcgctttcttcgatctttaaattagcactttccactaaccgtaaatcagcaggtaccacatccccagcttccagcaacacaatgtcacctaaaaccagctggctgctagggatcgtgagtacttgatcaccccggcgaacatgcgcgttaggagtggacatttctttaagcgcatcaatggcctcttcagctttgctttcttggaaaacaccaaaaaccgcgttcaataagacgaccgcgagaataatacccgcatcggcccattcacttaataagaacccggcaatcaaagcagcagctaacaggacaataatcatgaagtccttaaactgatccaaaaagcgcgccaacatgctcttcttttcagcctgggcgagttcatttggcccattttcatttaaccgagtctgagcggtttccttagatagtccagtcaattgcgttttttcttcttgcaaaacttcttgactgcttaatgcatatggcggtttctttgccaaaatagtgcctccttctttctttgggccggtagccaaaaagagacttatggcctaccagcagtagatccataagtctcactatttaagacaacaccagacatagccttgttggtgacgttgtcgcagatatgctctgctagttactcccctatgttgagtaaagtatatcaggtctaggcaggcttacgcaagttcctgagtagtgagcgcgaaccggcgcggttagaagtcggagtgtaagtggccttaaacgtgatggcccgggtttggtcattgcgtttaaggtccttacactccgacttctgcgccggtgagcgcgttatgggcataaaacaggacaaagcggccttaaacgtgatggcccgggtttggccattgcgtttaaggtccttacacgcagacttctgcgccggtgagcgcgttatgggcgtaggctagaaaaaagcgacctcaggcatgattgccggactttatcactgtggctaagatcctttcaattttaatcaagctcactcaccccaacgtttgaaataaatgcactgccagatcatgcaaatttagcgcatgtgaattgtaattacttaacaggatgatcgcattttgaccatcgtgactgattgcagtcgatgccatttgaccagcgacaacgccatgagttgaataaaaatcttgatgattatagatgccggctgtataaacgccatcgtcacggttgcgcaacgtcttcaaagtggacaaagtgatcactttgccgctgtctatcccgcgcaatagccgataaagatcacccgtcgtcgtatacatgttgccggtaccgagctcgcggttataccataactccggttcgccgataaaagtctgataaggattggtgacgggacctgtatacgtcaaagaacggtttgaatctgtcagcatcgccggtaaaaagccggtgtgcttgagctttaggcgttcaataatatcgttttttacttgttgttcataggatcgcccagcgactttctcgatcacaccggctagtaaaagatagttcaccggttgataggcatagttttgttgtggcaaataggtcatgttggcaatggcccaacggataatatccatatcacccatcacggcaggttgatacttcttaagggcaaaaccgctgcgcatgtcaatcatcatccgcaatgttacttgatcgccagtttggatgcctgacaaatacttgctaaccggatcgtctaatcgtaacttgccagcttcaaccagctgcatcacggcaactgcggtaatcgctttttgaatcgagccaatttgaaacaaagtcgtcggtccattaagccgctgcgatgcttgatcggcgtaacccacaccaccgttgaagatgaccttaccatgttgaatcaccaaggcactgccgataaatttgtcattggtcaaggcctctgaaaaagattggccggctttggtttcaaccgaacgatccaatttttcgtcaaataacgctgcttgtgtcttggccgtatctttgcgcgttactttttcacgatactttgatggcttgacccgtgcctgacgttgtgaagctgaatgatcttgctgccagccaagaacagtcccacctaatagcaatgctgccaaccccaaaacaacgcctacccaaatcatttttcgacgatgcaacacgttttcatcctcccatttattgctcatcaaagataccttaaaagcagacaaaaaaacagccacgaccctcaataaaagcaaaaatttcattgaagttagctgttttttgggttatttccaaaatgtatcgaaaacagtgattggcaaatgtcgtttgtgagcagtcttctggtaccaacgctcgatggtttcagcagcttggtcgctaacttgtttgccttcaagatagtcatcaatatcgtgatacttaaccccaagcgccacttcatctggcaaggccgggcgattgtcttcaaggtcggctgttggcgccttttgatacaaatgagcaggtgctcctaacgccttcaacaatgccgcgccttgccgtttgtctaaccggtaaagtggggtcaggtccgcaccgccatcgccaaacttggtataaaaaccagtgacggcctcagctgcatgatctgttccgatcacggcccctgccatgttgccggcaatcgcatactgagcaatcatgcgcatccgggctttaatattgcccttgttgaaatcagaaatagccgcaccattggcttcaacagcacttaccatcgcatcaacacttggtttgatattaacccgtttaaccacatcggcttgcataaactcgatggccgccatcgcatccgcttcatcagcttgttcaccataaggcaggcgcactgctacaaactgataagtatcgtcaccggtttctgcccgcatctcctgcatcgccttttcggttaacgttccggcaagcgtcgaatcctgcccaccggaaatgccaaggacataagtttttaaaaaggtattcttcttgagataggcttttaaaaaatcgatactccggcgaatctctttttccggatcaatcgttggcttgacacctaatgctttaataatttctgcttgtaatggacgcattatttcactcctttaatcatatcaagaaatagactttgcgcgagatcccgcgttatctgaccggcattagccatgagaaccactgcattctgcccgctactatccatcaccgttgccgccgagtgtgctgccacaacgccatgcgtcaatgtgtagctgccaaaattataaaccccggctgtatattgaccttgacttaaatcgcgtaattgcatgacggcggatcgactaataattttaccttggttaattccggccataatctgatataagtcaccggcactagcataaatattaccggtgcccaactcgcggttataactcaacgctggctcgatataacgcttcgaatacggatcagccttgggaccattatagccaaaagcctgattttgttcacgatataattcaggcatgaatcctgaatgagtcaaggctagccgcttgaaaatttcctgttgaatcaaatcagcatataagcggccggtaactttttcaatgacacccgctaataacacaaaattaaccggttgataatcataccgaggtgtttcgtaattcaagttggcaattgaccagcgaacaatgccggcatcggaaagttttgccggttgcgcacgaggtagcgttagcccgctgcgcatatccagcatcattcgcaatgtcaccttcttgccagtacgaatcccggtaaaatagtgaccgatcggatcggatagtcgcaccttgccttgttcaaccagtttcatcaaaagcactgccgtcagccctttttgaattgagccaatttgatacagtgtttcgggaccgtttaaacgccccgaggttgcatccgcataacccagaccggtattaagtatgaccttacccttgcgcatcatcaaaaccgtcccgctaaaatgcgccgcctgcaattttgccaatagcggcttggcatccggcgcgtcaaccggctgcatcaatttattagtggtaccggtatcggcttttgcctggttttgcagccgctgctcaattgcgcgatggcgattcagttcggtttcatattgacgccgcgcacgctcttccttggcggctatctgcggacgaacatacaaataatcataactgccataaatcgcaatgccggcgatgaccccaataacaaggcctaacaacagccaccggccccaacgccgcttttttgtctgtctcacgctatttcctcgattattcttcgcgatcggccactgcagacttcacttttttaatcaaatccatcttgttatcccaaacccgctgcgatagatcaaccggataatcttgtggattcaaaattcgccgatactcatcccacagcgcgttggtactgcgtgttgcataagcttgaacttcggctagcggcggggtttgataaacctgcttcccctgatcataaataagttgaagtaacggcttggcctcgaaattcttaaccgtcttattgatatatggaaaattcggatgaaacatatacaaactacgctctggatcaatcacttcgtctgccagtgctacataatcaccttcagacttgccatcatcacgccgcgtaattcgccagacttgttttttgccaggcgtcgaaactttttctgcattattagacagtttgatcgtatcgtgcatctgcccagtgctgtcttcaatcgataccagcttaaacacagcacccaacgctggttgatcataagccgtaatgaggcgagttccgactccccaaatgtcgattttggcgccttgcatcttcagattttggatggtgttttcatcaaggtcgtttgaagcgtatattttggcagaagtataaccggcatcatctaactgctgccgaacacgcttggaaataaacgccatatccccactgtcgatgcgcacgccgagaaaattgattcgatctttaaactcattagcgactttgatcgcagcaggcacgcctgatcgtaacgtatcataagtgtcaactaaaaagaccacgtcgcgattactttcggcataagccttaaaagcctcatagtcgttgccatatgcctgaactaaagaatgggcatgagtgccaatgatcggaatgccaaattccttacccgccaagacattgctcgtggcattaaacccaccaatatacgccgcccgtgtaccccacaaagctgccgctgtctcctgtgcccgccgcgtcccgaattccatgagcggatcagcgccagccacactacgaatccgcgctgctttcgttgccacaagcgtttgataattaatcatattcaaaaccgcggtctcgaccaactgcgcctgtgccagcggaccttcaatctgccaaatcggctcattattaaaaaccaaatcgccttccagcgccgaacgaacggtacaggtaaattcaaaatgacgtaaataatcaataaacgcatccgaataattggtctgagactgaagataagccaagtcggattcggagaacttgagatgattcaagtaatcaatcacatgctctaacccggcaaaaaccgcaaatcccgaaccaaaaggcaactcacgaaagaaaacttcaaaaacagcatgacgttcactgattccacgttcaaaaaaagtgttcatcatattcaattcataaaaatcggtgtggagtgtcaatccttcacccaattgtgtggtcatcatctttccccttccagagacatcctaataggagctatcgttaagcattgagcatttaatttaataatatagctattgattatatactaagtaggcattaattgcagagcgtgaacccggccctgagcgcgaaccggcgcggttagaaaccggagtgtaagtggccttaagcgtgatggccgggctttggccattgcgcttaaggcccttacacgcaggtttctgcgccggtgagcgcgttatgggcgtaagctagaacacaagtggcttcaggcgtgagggcccgcttttggccattgcgtctgaggtcattacacgcagatctctgcgccggcgaacgcgctttggagtaggccaacccaccaacctataggatccttacacacgagctcagagttttgcaaagtcatttcagcaaataacttttccttccaccccaaccccaaaaagccagaaaacaaaatcacttctgctttctgaccttagaccaattcattactttaacgctctaaataaaattcaaaccgttcgccaacatactgagtacgtacatattcaaacggtgttccatccttgagaaatgaaacttgacgcagccgtaaaatggcatcgccgcgtttgatggctaagtattcagaaattcgttcgctagccaacatcgcactgaccgtttgttgtgcgccgccaagaacataaccgccttttttctccagtgtgtggtaaaagctggctgtcatttcttttttggtaaaacctttcacaagatcgtaaggcaccgctgcggtttcgaaactgatcggtaccttatcggcataacgaattcgttccatccgcagtacctgttcagcaggcgcaagttttagcttctccacttcggaacttgtcggttgggcgacatgatacgagaccgttttactggaaggcaccttgccttgagcctgcatcagatccgtaaagctagtcacaccggacattttttcctggaccttttgattggccacatacgtccctgaaccaacccgccgttccagaatgccttcatccaccagcgtttgaatggcttgccgcagtgtcatccgcgacaccttaaacgtgacggctaaatcgcgttcagacggaattcgatcgcctacccgccatttaccggcttcgatatcagcacgaatggcgttatgaatttgaatataaactggcacatccatcctcatcacctcctctttttatggtttaagcttccgtatcgtgtttctcaccataactgtaggtcgcgatcaaatcatgattgcgatccaacatattaatatctgcatctttaccaacttcaagtgttccctttgaagtgagattaaattcacgggcttgattgacagaggacatttcaactgcatcgaataaggaagcgtccatgaagctcatagcatttttaaacgcatccttatacatcaaaacggaaccggcaagtgtcccatcggctaagcgagcctgcttatccttaacataaacagtttggccgcctaattcactcttaccttctggcatacccttactacgcatggagtccgttaccagttcgatgcgttccggtcctttttgatcaaaagcgagccgtaacatgtccggaacaatgtggaagccgtcgcaaatgagttcacaatacatgttatcttccaacatcgcatggccggtaacgccgggttcacgatgccgcaaaccacgctgggcattgtacaaatgagtgacgtgggtcgccttacttgccagcatttgttcccgcgtcgcattgctgtgccctactgatggcacaatgttatgcgccaaaaggtagtcttcgaattcacgcgagccttcatcttcaggtgcatacgtaatcagcttaaccaatccgccagacagttcctgccattgtttgacaagatcaatattaggattcttaatatattcttctggttgtgcccctttgaagaccttactgatgaacggaccttccaaatgaacgccttgaataatgcgattgcgttccgctgcctgtttgaccccacgcatcgccttatcaatgttttcagtcgattgcgtcatggtggtggcaaaaagggtggtgaccccttcatgagtcatcattttagttgccatttgatcgatctgatcagcatcgccatccatggcatcaaacccatagccgccgtgtgcgtgaacatcaatgaatcctggtatcaaagttttgccttgaacgtcaacgacctgttcgccagcctgtgcttgataatcaaacatatcgccgactgccaaaatcttgtcatcaaagcggatgtacccgtcttcaatccgttctaatcctgtataaatcgttgcatgtttcaataccgtaaccgtcacaataccactcctaattatttaaagtcccgaatatcaccaattagtataaccggtatagaccagacttgcaagttggctaaccggtcgtccaccttgatcaaccgtgacgatctttggcaatcgttgcatcaacgcctttgacaaccgcagtcatgagtccagcctcttccatcgccaacaacccggcaactgtggtaccacccggactagacacttgatcgatcaaatcaaagggcgattgatcgctggcgagaacatttttggcactgcccatcaccgcctgagcaacgatagccgttgcctgatccttctccagaccatatttgacccccgcgcgcgccaggctatcaataaacaaatagataaacgccggagatgaaccagctaaagcgacaaacgttgaaaactgttcctcaggcaaggacatggtctttcctaagacattcaacaaatccaaaaggccatctaattgaccagccaccgcatcgttagccgcataagcaatcatcccggcattaatcgcaacattaacattcggcataatccgcaaaaccggttgatcgtgactgcctaatgcctcctcgagtgtcgccacggaaacaccggttagcatcgagacaaccggaacatgccgtttttttaacgttgatccaatcgcttgtaaaatcggttcgcctaattttggcgatactgccagaaaaacgatatctgcagtctccgcaactgcctgattactggccaatgcttttgcaccgattttggcggcatatggttcataatgaagcggctggccgccatgtaagacaatatctgttggtgcaactgcctttttagccaataaaccacttatcattgcccgcgccatattaccggcaccgataaatccaattgtcattcttattctcctttagccatctgcggttgtgcttgatgggcgtcaaaccaatccacaattgcctgcaatcgtgccactcgcaaattcggcaacccgctgcgggacaaatcatgatttgactttgggaaacgcatgaacttggtttcaacaccatgcagtttcaggccaatgtagaactcttcgccttggccgatggggcagcgttcatcattttcactgtgcatcacaagcgtcggtgttctggcatgatcaatgtgagctaatggtgaaaaatcccaaagcccttgcacatctgacaaatcgccagtccactttccttctagttcccacggtgtaaagtaataaccgatgtcactggtaccatacatactcagccaattggaaatcgaacgctgggttaccgctgctttaaaacgatgcgtatgggtcacaatccagttagtcataaacccgccataagaaccgccagtgacaaatagacgttgcggatcaattgttgtatcgagctttagcgcttcatcaaccgcagccaagcaatcttcataatcgccttgcccgtaatgtttaatgacagcggccgtaaatgcctcgccgtaacctaaccctccacgcggattcggacaaatcacgccatagccttttgctgccaaatattgcatttcatggaaaaaggtatagccatatccgactgccgggccgccatggacatacaaaattgccggatgcgaggatgacgcctgttgcggtggaaaataccagccctcaatctcaaaaccgtctcgttgaaaattaaacgtttgaggcgtaaccaagcccaagtgacgtgttacctgacgattcgggtcatacagaacctgctcttcttccgatgccaaatcaaaataaaccagccgactcggaatggtcatcgtactctcagtgaaaaccaccccacgatgatctggtgtcaatgcaaagtccgtcacatgacgccgaccatcaatcaaaggcgtcaaccgctcgtcaggcccgccagcatacagactcattttgccatgatcgaaaccacgagccagataataatctgccgtcacaaaatcggccactttaccggacagatcctgctgaaaatcactattaacataaccgggaatgtcaaaatctacatcatcggcaacgtcttgcaattcatgattggttaaatcatagtgccacagatgatcctgcgagacatttggcaaatgattatccgatcccaccaacagcagctgctgcccatcagccgaaaacgcctccggagacagtgccgcttgtggtaaatgttcattgaccattgtgattttttgactcgtcaaatcgaacaaataagtcgcctgactaaaatcattaggatcatccggtaaccgctcggctgcaaaagcaattttttgtccatcaggcgaaatcgctcccaagtcaaaatcatgttgccgtttcataaccaggtggctggttttttgccgccgttgctgtattcgcagttcataagtaacattttcctttagcaaaccaacaccattcagcttatacggggcgcgagtgaccgttaccggttgcggctttttcgcgtccgactctgatgattgcggtttagcgcctaccgttgtctgcagcaagagtgccttgctgtcaggttgccagccaaaattggtcacgccttccttttcattggaaaactgctgcgcgccacccccgtcaatccgctgaaggaagacttgcgttgttttgtcagctgcctgactaagaaaagccagccattgctgatccggactgacttgcggatgacgatcgtgcttctgatcaaacccgtaagtcgttttttggccgcggcgattgaccaaataaatgcgttgataataagtattatcttcttctgaaattcgattctcctgaacaaaaaaaccgcgatttgttgcaattggatacgacagcgataccaatttaaaaagatccgttgctgcaattgccatacactcacacccttctttgtcatgctttaagcgtagcggttgggctataccatgtcaatcaactggaccgctgaatttaaaaatgaatcaaatatttaaaaatcatcgacaggtatagccagcaaaacagccgacaaatgagacaaaacgtctcacttgccggctgtcagtttccgaaaatcaactttctatgatgaggtttccctatcattcataactgcgacttcttgagcttaagaaccttgatctcaacgcctaatgtgatgctttctttttggcgaaccacaatcctgagaacagactcagcaacgcacctagaatcaccatccacagagattgttgctcctctgttttcggaaggttgccttctgttgaggtgataacttttgttttaggtgctgcaggcttctcaggtgccttagtcgttggcaaaggtgttgctttggtgaccttttgtcccttgccggcacgatgttggtcgttaattgccttaatgccagctactttggcttggttcaccgcatcagcgttaccagctgcgtcaatcgctttctttgctttatcagcttctgcggcaactgcttgcttttgcgctgccttttctgcatcagtcaatgttggatcttgatcaattgccttgatgactttagcagcttcgtcgtcaattgcctttttggccgcatctttttgcgccgcgatggtttgaccggagcggtgctgggcatcaattgccttgataccagctgctttggctttgtctactgcatcggcaccttttgccgcatcaatggcttttttcgctttgtcagcttctgttgcaactgcttgcttttgcgccgttttttctgcgtcagtcaatgttggatcttgatcaattgccttgatgactttagcagcttcttcatcaatggctttcttagcgtcatctttacgggttgcaactgcttgtcctgactggtgttgcgcatcaattgccttgataccggcgtctttggctttatcgactgcatcggcactgccagctgcatcaatcgctttcttcgctttgtcagcttctgttacaacgccttgtttctgagccttcttttcagcatcagtcaatgacgaatcatgatcaattgcttcggtcactttagcagcttcgtcgtcaatcgctttctttgcatcgtctttacgtgttgcaactgcttgtcctgactgatgttgcgcgtcgatggccttgatgcctgcatctttggcctgatcgactgcatcggcactgccagctgcatcaatcgctttcttcgctttgtcagcttctgttacaacgccttgtttctgagccttcttttcagcatcagtcaatgacgaatcatgatcaattgcttcggtcactttagcagcttcgtcgtcgattgctttctttgcatcgtctttacgtgttgcaactgcttgtcctgactgatgttgcgcatcaatcgctttgatgccttcgtctttggcggtcgtaacctcctcgatatttttagcctgatcaattgcctgttttgctttaccggcttctgtcgtcactgcttctttttgctgtttcttggcagtagcggtcagagtcgggtcctgatcaatttcaccttgaactttggtagcttcagcatcaatcgctttcttggcttcgtctttgcttaagtcaaaagctttaccagagacgtgttgagcatcaatggccttaataccggcattttttgcttggtcaaccgctgaagcattagcagcagtatcaatcgccgctttggcctttgttgcttcgtctgcaacggcttgtttttgacgcttcttttctgttgccgtcagtgttggatcctgctcaatagcttggcctacctttgcagcttcggcatcaatggcttttttcgcagcagccttacgatcggtgagcgcttggccggactggtgctgcgcgtcaatgatctgaatgcctttggtcactgcttgatcaacgccatcagcattgtcggcagtatcaatcgcctgcttagctttcttggcctcgtcagcaacagcttgcttctgagtgcccttttcgctgtccgtcaacgttacatcatgatcaatggcttcgcttactttagcagcttcttcatcaatggctttcttagcagcatctttccggattgctagtgcttgcccggatttgtgttgctggtcgatcgccttgatgccagccttttgtgcctggtcaacggcatcagcatcaccggctgcatcaattgccttcttggccttgtcagcttcagcgatgacggcctgcttttgtgttgccttttcagcatcggtcagtgttgggtcatgatcgatcgcatcagttatcttagcaacttctccatcaatagctttcttagcgtcatctttacgagtatcgatgctttgtcctgacttgtgttgttcgtcaattgccttgataccagcagattttgcctgatcaatagcatccgcatttccagctgcatcaatcgcttttttagctttatcagcctcatcagcaactgcctgcttctgcgcttctttttgagcagccgtcaaagtggcgtcgtgatcaattgcatcagtaactttaccggcttcagcatcaatggcctttttggcatcttcttttcgtgcatcaactgtttgtcctgacttgtgttgctcatcgatagccttgatgccggctgtttttgcctgatctacagcatccgcatcgcctgcagcgtcaattgcttttttagctttatcggcttcagttgctaccgcttgcttttgtgcttctttttgggcagcggtcagagttggatcctggtcaatcgctttaatcaccttagccgcttcttcatcaatcgcttgcttagcgtcatcatgacggctatcaatggttttaccggctttgtgctgagcatcgatggcttgaatcccggctgtctttgcttgatctacagcatcggcatccccggcagcatcaatggcttgcttagctttgtcggcttctgtcgcaaccccttgtttctgggcagctttttgggctttggtcaacgtgttatcctgatcaatcgctgccgtcaccttggctgcttcagcatcaatgacctgcttggcatcggctttacgatcgtcaagagcttgcccggagtgatgttgggcgtcaatcgctttgatcccgtcagtcttggcctggtcgactgcatcagcctgcttagccgcatcaatcgcttttttggctttagttgcttcatccgtaaccgcctgtttctggcttgccttttcattcgcggttaaggtggcatcgtgatcaatagcagctgtttcttttgccgcttcggcatcaatggcagttttagcatcacgcttccgatctgcgagtgcctgactggattgatgctgagcgtcgattgctttgatcccatcactttcagcttgcttgataccatcagcattgccagctgcatcgatagtctttttggctttgtctgcttcagcgatcacagcctgcttctggtcagctttttgcgttgccgttaacgtcacatcttgatcgatcgccttacttactttggccgcttcagcatcaatggcctgttttgcttgctgcttttgcttgtcaagtgccgttgcggactggtgttgcgcgtcaatagcttcaataccatcaattgttgcttgaatcaccgcatcggcgtcagaggcttggtcaatggccgcttttgctttcgttgcttcatctgccactgcctgcttttgtgtagccttttggtcggctgtcaaagtgacatcctgatcaattgcttcactaaccttggctgcttcggcatcaattgtttgtttggccgccgccttttgcttatccaatgctataccagtttggtattgggcatcgatggttttaatcccgtcagccagagcttggtcaatcgcatcggccactaacgtagcatcaatagcagctttagctttagttgccgcatctgtgactgcttgcttctgtgcctttttttcagcggcggttaaagttggatcttggtcaatcgctttggttacttttgcggcttcagcatcaatagcctgcttggcgtcattttggcgcgctttaattgcctgcccagactggtgctgagcgtcaatcgctttgatgccgtctgttttagctttgtcgacggcgtcagcattttgccctttgtcgatcgcttgcttcgcgttatcggcttcggttgcaactgcctgtttttgcgccgctttttctgtcgctgtgagggtttcatcttgatcaatgttgcccgttactttagccgcttcggcatcaatggcttgcttagcagcggctttacgatcggcaactgcttggccagcgtgatgttgggcgtcaatcgctctgatcccgtcattcttggcctggtcgactgcatcagcctgcttagccgcatcaatcgcttctttggctttagtcgcttcatcggcaaccgcctgtttttggcttgccttttcattcgcggttaaagttgcatcctgatcaatggcagctgtttcttttgccgcctcggcatcaatcgcctgtttggcatcacgcttccgatctgcgagtgcctgaccggattgatgctggtcataaattgctttaactcccgcatttttagcttgatcgaccgcgtcagcattgccagccgcatcaatggcttgattggctttagtgacttccacggtaatcgcctgtctttgcactgctttctgggtcgcagtcagcgtcacatcctgaccaatcgcagcctgcaccttatcagcggtttccgcaattagctttttggctgcttctttgcgttcgttcaacgccaacccggcttggtgttgggcatcaatcgccttgataccatccgctttggcttggtccaccgcatcggcattcttggcagcatcaatagcagccttagcttgcgttgctgcatcagcgactgcttgctgttgcgttagtttttccgcttgcgtcaaggtcacatcttggccaatagctgcaatgactttaactgcttccgcatcaatcgcctttttggcatcttgtttgcgagtgtctaaaagcgtgccgctttgatggacggcatcaatggcttggatgcctgatgctttagcctgatcaacggtgtccgcatttttagctgcgtcaatcgctgtcttggctttgactgcttcatccgtaactttttgcttctgagtggctttctcagcgctggttaacgtgacatcttggtcaatggcgtcattaattttagcagcttcggcatcaatggcttttttagcatcaactttgcgcgtatctaaaagtgcacctgattgatgcccatcgtcaatggcttgaatgcctgctttttcagcctgaataacaccatcggcatcctgcgctttggcgatggtatctttagccttggttgcttcagcagcaaaggtctgcttttgggccgccttttcttggctcgttaaagtaggatcttgatcaatcgcttcgccaactttggcagcttcagcgtcaatggccgcttgtgcatcagttttacgcttagctaaatccattcccagccgatgttgcgcatcgatggctttaatcccatctgcttgcgctttggcgatttcatcagcattccgcgccgaatcaattgcggtcttggctttagcagtttcatcggcaacgccttgcttttgcgcctttttttcagcactggtcaaagtcggatcttgctcaattgccgttaaaactttggcggcttccttgtcaattgcctgcttagccttggttttctgggtatctaaatctgcaccaatttgatgtttcgcatcaatggctttaatcccatcagcttgggcctgaagaatggcatctgcgttttgagcctggtcaatcgctgctttggctttagccgcttcgtcagctactgcctgcttctgggcgtccttttcggtactggttagcgtgtcatcttggttgatggcatcggttattttggccgcttcggcatcgatcgcttgtttagcactatctttgcgggtcgccaaatcggtacctgcctgatgttgggcatcaattgccttgatgccatcatctttcgcttggatcaccccatcaatggtcttcgcttgatcaatggcagtcttagctttggtcgcttcatcaccaacgccttgcttctgggccgtcttgtctttggccgtcagagtcgggtcttgatcaatagcatccttgactttggccgcttcggcatcaattgcgtctttagcttgagctttacgcgtatcgaagtcagcgccttgcttgtgttgggcatcaattgctttaatcccatcatctttagctttatcgatggcttcaatcgtttgggcctgatcaatcgccgtcttggctttcgcggcttcatcagcaactccttgcttttgggccgctttttcgctagtagctaaggttgaatcctgctcaatctcagcagtcactttagccgcttcggcatcaatcgcctgcttagcttcttctcggcgcacgttgagtccggttccaggctgatgttgggcatcgattgctgcaatgccggcatctcgcgcctgctgaacccctgtttcggtttgcgcttggtcgattgccgccttggccttggttgcttcggctgcaacgccatctttttgctttgccttttccgttgccgttaaagtcggatcctgctcaatttcagcgctgactttggcggcttcggcatcaatatctcgtttagcctgttccttatgcgcgtttaaaacgatttcctgaatgagcttgtcaaagtcctcgtcaaccgtgattgggtcgactttttctttaacttcttcttgaaccggtttaggatccttggccgtgtcatcaatcgcctttttcttcatggcttctaaaagtttggcgttgagtgcaggaccaaaatcgttgtactcaagaatgcgagtggatcgaaatgctggatgaatagggtgtttcccttcaatccgattggtttccatccgaacagcaatccaatcctcgggcataatcttatgcgcctgcatgtagatgacggcatctgctcgtccacctagttgatgactaacgcttttaccatcactaccatcccagcgccgtgcaaattctctgttcttgttaagacttgtaataaccgctgggaccagcccatcaggtgaaatcacaacccgcttgatttttccttctaaggcatcgttaaacgaatacccaaactccaaataccgatccaagccatctgattcaagcgagccgaaccgaattggaattttgaaggtatccgtaccttcgtcatataccacggcgtcgttgctatattggaatgtgatgctatttataagcttcctatagctcgaaccatcggcaccacccaaatggatatcaccagcctggggcttattcgctgccaatacgacaccgcttgaatcccaaagaccaattgaaatcagtcccgtggctaatagtaatatcagtctcccctttttcacttcaacatgcctcccttttattgaacccaaaacagcaaacaattaagttaaccctacccattctcaaaatatttgatataaattattacattttgaaaggcgagttcttaataattgaaacaacaagcattatcactttataatttatggtgaaccaagcaatgcttatgcaatatgtcattagtataaataaatcaatgattggttctagttcaaagcttgcctaacgttaggcaagttttgatagtaacaacctacttggggaggtaagtttatggaagaactattggaaagtagcctgctcaagcactacgaaatcattagttttctgcttgacaaggaatgggtgaccattaagcaggtggctgaagaaacccggatcccggcacgcaccatccgccaaaatattggtaccatcaatcaatatattgccccggcaaaaatcgaaagtagccaacgctatggaattcgattggcttatgactcagcccataatcccttatatatctatgcagctatttatcgtcagtcaacgcgttttttgatactagagcaaatttttctgcaccattatttatcaattgctcaattttccgaagcacttttcattagtgaatcaacattaaaacgacatatgcaagttttaaaccagattctaccgcactatggatttcatattgacacgcaaaccctagatattattggcgatgaaaagaaaatccactttttttattacacttatttactagagagatattggtttatcgatgattttctgccacaggatgaattaaaactaattgctgctatcatctcagagtttttcgcacattatccgacactgacaacccccagataccagtctttttcttttatcaacaagttacgcgcgacgatcttcgtttgcctcaaacgcaacagtcgcgggcacacgtttgaaaatgcgaccccggcaatcgaaaatgcaaccttctcgccagaactgcgccaatcaattgcacgctgctataagattgactgctcctcattagttttctcgcatctgttctatctcttttttaatcctcgaaatgcttggtcttacgccgatctgctcactaaaacacatcaggatgctgaaattcgcgcgatccatcgcgcacttacgcattttcttgacatggtcgttgcaactgaacatctatcgttaccaaatcgcgaacaagttctactgcgcttgtataacgccatcgaatatacgtggggtccgacaaaaatcctgtacagtccgagcgaagctttctttgcgagcatgaaccaatttagcaagacttttattcgtcaggccagacagacactggttactgcactgagaaatgaaaaagtcaacgttcgaattgatgatgctttcatcaccaaactgttatttactttggtgacatcatgggagacgctgccgctgcaattagagcaaaaagccccgaaagtccgaaccgggctcttcttcaatacgagttttgagcatagtcactttttgctgaatgaactcaattaccatttacgttcgaacctcaaactcgagcttgtcccggccagtaccttagcagagttaaaaaccgttgcccgccaatttgacctgatcattaccaatctccccttactcaatttgccaaattgccaggtggtcgccattcagcctcatcccacgccggaagacttcgataatattttggctgcttataatcggattattaatgccaaaagtctggaaagttccgtatcgtaagctcccaacgacttttcacggaaccgaacgcatacaaaaatccgtttgacaaaatcgctatgtcaaacgactttttgcttctgatcggtctgatgtcaatccgatatttatgaaatggaggagataggattcgaacctatgaacccgaaggagcggatttacagtccgccgcgtttagcctcttcgctactcctccatgcgattgatataaatcaactttaatagtgtacaaaaagaggttataaaaatcaaccattttcaggtagtttttataacctccgatacttaattttttgcttaatctgtcaaagctgcgggcacttccaatgtgactaatgtgtcgcgccattccgtcaaccagtctgtactttgccattcaaaaaggcgtttaagcccatagcccagcggttgatgataataagttgtcttgcctagcagcttaggggcatcgcgaaaatgctcatgaccaaacaccacggcactagcccgatttgtcaacagatcgcctagttttgccgatcccattaacgcggtagccatctgccatgaccggcgatcaactgcgtacaccatcgcaccgagaatcggaacaaaatgcgtgacataaatgatccgtttgccgcgattggccaccaaagccgctttggtggtatcaagcacccgctgcatccgctctaagtcacttatcggtgagtcaatggcgctgtcgatccaaaacgctcgcttccactgcgcatattcagccgacgttttcgactttccaagttgcgcaagtgaataatcataccaaccgttgtttccaacgataaccgcattcgttcccgggactgacaaaaacttttcgtgtaaataaagcgggtcaacatctgactgaatttcagcataggtcgcacccttaaccatgtcgtgattaccagctaaaaagcggataatcacttgatcgccgacttcccgttgcaatgcctgatagtacgccagcgtttttgtgaaatcgttatacgtatcaccggcattgacgtagacttgatagccatgttcaacgagataggctgcttggtgtttcaacatttcgaaaccatcaacatgattaacgtcaaaatgattatccacgctgatcgcaacttttaccatcaccacacctccgttaatttaccggtgcgcgccagcctatcacccgcttaattaaccccttgcatcagcttttcaatgcgcggcgtgaaaaaggccagtacaatcgcaaagataactgaaaccaggccaacgacagcaaaataggcaacttcatggcttggtgtatagaaacgcacaatttgcgcattgacggcctgcgccgatgcatcagctaagaaccacatgctcatcatttgcgatgaataagctttaggcgccaatttagtcgtaactgaaagtccaaccggtgaaatcagcatttcgccaatttccacaattgcccagctcatcaccagccacaaaggtgaaaccttagcactgctgccaaataacaggaccggaatgaccatccataagtacgacgcgccggcaaaaatcaagcccagataaaatttcttgggcgaggtcggttggcgtttaccgagtttcatccataaccaggcaaataatggaccatataacagaatgaataacggattcaacgtctgaaaatttccaggcaggattttaaagaatccaaagtccaatttagtctgctgggccgcaaacaaagccaaaacaactgagccttgctcctcaatcgcccaaaagatcatcgcggctaagaacagcgggatatacgcaatgacacgtgaacgctcagtcttggtcacctttttgctgcggatcatcaaaataaagtaccaaaccggcaagccgatcgcaacgatggtgatcaaactaataacgtttgcaatcgtcaaagcacctaggcttgccatcacggctaaaataaccgcgacaaccaccaacgcacccacgacgcgcatcaccagcggccgaatatcttccggctttaacgggtcaggcgccgtattgtcagccggattaatatatttacgcccatcgatgacataaaagatcaggccaataaacataccgatcgctgccaacgaaaaaccagcgtggaagttaaacttgtcggccatccacggcacaaagatcggtgcaatcaacgacccgaagttaatccccatgacgaagatactgaaaccggagtcccggcgcaaatcttcttcaggatacagactgccaaccatttccgatacatttggtttaagtagtcccgtccctaaaacaatcagcacaatggagccaaataaccccaccgcgccaattggcaaagacaacacaatatgtccgagcatgatgaggacaccgccccaaaagacagttcgccgcgacccgagcaagcgatcgctgataaacccgccaattgtggcacttaaataaaccagtgatccataaatcgacataatcgataaggctgtgggctggtcgaatcccagaccgcctttttctaccgcatagtacatgtagtagattaagatcgcccgcataccgtaatagctgaaccgctcccagaattcggtcatcgacagcgttaatagcccgcggggatgacccataaacgtgcggttctttgaattatccaattgaaatacatcctctcgctaggaaatgatcctcctagctgctctcatgacacttccctcaaaatgtcaattgataagtaatcattatagaggtattttggcatgaagacaaatgaaaccgcaaacatgactgagacttctatgccttcatagcattttcaaacctaggttccctagctttttacgctcaagaaagatcttcttcctcggtaaagcaaaaagcagaggtgcccactgcagacaccactgctttctagataaaccatcaattgttaatcgttatagacatcagtcagctcgtaaagcaatcgctgcatctttgtttgatgccatacgcgctggaatgtggccgccgaggacggtcaggatcgtgctgattagaatcagaatcaccgcatgcacgggattcaactgcgcaacattcggcagttcggtcatgccgtacaaaatcgcattgatcgggaacgtcagcaaccaggcaatgataatgcccagtatccctgaactgacccctagaatgatggtttcagcatcaaaaacccgggtgacatcttttcgacgcgcacctaatgccttcaagacgccgatttctttggttcgctcaagtactgacgcataggttagaatcgcaatcatgatcatcgaagttaccagtgaaatccctgcaaaagcaaccaggacaatggtaatggctgacatgatcccgcctgtcatgctcgaaatggtgccggccaagtcagtgtaaaccacctgatcggcctttttcttaccatggttgaacttgtcgagataactcaagatcttgtccttatccttgaaactagttggataaatcgtgatctgcgtaggcgtttccgatccgcccaatccggtaatcagttgatccttggtggcatcatcaatactttgattggtgaaaatattaacgtcactatttcgttgtgctttgacaactgccgaattcttattcattgccactaaatctttggtcaaccgatcagaataagcaaaaccttggctcaaaagaccatcgctcgtcttggaacgggttcgcaaaacaccggttacggtcagctcccgattaccattttgattataggcatcagcgtaatttttagttggtacatagacgctaccacccacattttgataataatggtcattggcaatcgcctttagcttcgtcccgacaatgtcgccaaatttgattttttgaccatttttaactgagaagccaaggtttttcagcgcattgatattagtcgaattgtcccgatcaacaattaaaatgacgtcattgtcggatttcggatagctaccggcgacaacctcatagttcttcttgagatagcttgtcttgccttcacgatctacgggataaacagatgaactggcgctggaaaaactccgctgtgtttgattgctcgtcggtttggcggttgaaaattgaaccggcttcaccgttccgttgacattacgcaacaaattcattccggtgccatacgtataaccgatattattcgtcaatcgcttgctaatgccattcacatagtcgatatacttttgattaagtttgttggtgtgctgtgctttatcactggcactttgcttggcttccaccgttttagttgtcttaaaggtggaagttttcgtattatcttccgccccggctgtcaagttcacggcagtagacgaaatggtaatgggaaattgcgccaacgtttctgactgcgtgttatcgatttgcttttgaaaacccgaagaaagggccagaaccactgctatcccgataatcccgatacttgatgcgaatgccgtcagaaaagtgcgacccttcttcgtcatgatattggtaaaagataacttcagagccgtcagatagctcattttagtgcggcgtaaatcaaagtgtccggtttgctcctcaacatcatatggttttgaatcagatagaattttaccgtctttaaattcaataatgcgttgggcataatcatgcgccagttgaggattgtgggtgaccataacgactaaacgttcccgcgacaagtcggcaatcaattgcatgatttcctgactggtttcggtatccaacgcgccagtcggttcatcggccaacaaaattgacggttccgaaacaatcgcccgcgcaatcgcaacccgctgcatttgccccccagacagttggttaggttgttttcccatgtgttccttcaaaccaaccttaactagcgctgcctcagcctttttgcgccgctcactggcagaaaccccgctcaacgtgagtcccaactcaacattttccaaaatgctaaggtgcatgattaagttatagctttgaaaaatgaagccaaccgagttgttacgataagcatcccagtcagattctttgaagtctttggttgaccggccatgtaacaataagtcgcctgaatcataacgatcaaggccaccgatcacgttcagtagcgttgttttaccggagccgctgggaccaaggatggccacaaactcctgctcccgaaactgcaccgaaacatcatcaagtgctttcgtggtgtaatcaccggtttggtaatatttttttatatgctttagctctagcaaagaccattctcctctacaacaagtgacaacgcgccgaaatgaaataacttgccatatcttagcatacttacccagcacttgataatcggtctaaagcccaaaatgaaaatcagtcccgacttggcacccattttggcgaaaaaaagaccgaatcatcacacaataccttgccgattcggtcaattcagtcacgccatccgtctggttcaggattggactttcatcagcggctgccaataaattaagtccaagctatgatccggatagatgtaataactgatatttaattttgaaaaaggatttgccattgccattaagtaaatgggttgcggtgcatgcgccaatccagcaactgaaacaagaatgtacttggccatctgttcaaacaggggttgggtcaacccggttgttagctcaaaatccaagtcaacgtaaatcagctcttttgtttgtcgcgtgaggctgatccgatgaatgggtaatccgccaaaattaccgtcttgattgagttcatcgaccattcgtttaatttcctgatgcttaaactgcggccgtgcaaacatcatgcgccaaattgccaagtcgtcacccccttgcctcaattatgccacattgacgcaagaacgcggactaaaagatcggatcaagaatcttggaaaaagccgaatcaatttgagcccgagctgcttgctgttcggctaatccggccgcaaatcgttcatgatctacctgatccgtgtcgatcgcctgcaacatattcaaaacgccgctgcgaataccacaaagaccacttaccaataccttatgaaaggcagcatagttgcatggtgctgactcggcattgacactatctacaaaattacagaacttaatgacatttttggtgaaataaagtcgcaagcggtcgagactttcgcttgcatagcagtttcttttctcgatgttcttgcatgtgtggacgtactctttaaaaacagtctcaaacacgagaaggcgttccagattttgattaattacttcaacataactaggctcattgcttactgcatacatttaaaagtccctcctaatcttgtgagttcatcaacttacagacttaattatacctgttaatggcttataatcaatataattacatgctaatatttaaatacctaacgttatataaccgctacaaaggccattattattgggatttgcagacatgacaccagtctgtgaaaaccgttttccctgacattgcacgcaatgtatctatttgtgaaaacttgttttatctatgccttatcaccctgtcttgacagggtgatttcttgaaggcagccatttagtatctacttgcattaaaaataagataacgaaaatattttttggatattttgcatttatattttaatattttccaacaatcgtgcaaatcccagccataaagattctaattgcagggtcggttataaaacgaagatgtttccaattcgaggcagttaatagcatgttttaaaaacatcacctataatcgagtcaagaagcctgcaagttaaaaatcttatggtcaaaactcaaaaatcgagttgcgaaaacctttttaatttgtcaccgcacttatttgattcttgggaggattttacattgaagggttatccaaagaattaccccttagattcacggactttcttcggcgttaatgccatggggttgatcagcacaaccgcgtattatctttatactgctgttttgatgatgtttattaccgattattccgggatttacaccaacgtccctggcaaagcagcggcagtcgccaccacgctattattcgttggacggctctgggatgccatcaatgacctttggactggttatttgattgacatttcacccagaactcgttggggaaaatttaaaccgtatgttttggttggaaccttttttaccggtattttgggcatgatgttgtttcacattccccaaaacttaagtgatttcggcaaagaagtctacctctacatcacctatttcttatttatgttttcagcaaccattatcgtcacggttccgctgaccagcaccatgtccgctgatcaggaaattcgggctaaattaatttcctggccacgaattaccagcaatgttgtcggtgtggtcttcgcgttttttatggcgattgccagcttcttgggaactaagaaaagttcaaatattccattgaccgtagatttgatcatcattccatttttaatcatctcgttaattggcggcttcatggtcaaagaagggcctgttgcggaaggaaccaagccgccaaagttacgtgatgtcggacggatggtaaaaatcaataagccatttcgcgtcaatctctatttcacttttgttggcggctttgtctgggcgttactgacggcaacatcgctttactacattaagtacgcattcggcgttgccaacttaggtattcagtccatgtacttcgggctcctgaccttagtcaccctaatcggcggtacgttaatttcccaaaaagccatgaaatatatgtcagcacttcgaggcgttcaaatctgctatttgggaatggttccgtttctgctaatcatgtttgcgatcaatgaatttcaggtcattcataatccttggcttttctatcttcttatcggaattgtcatgaccctagccggcgcccaatttgtgccagctaacctcatcatcatggaaaccatggattataatcgacttaaactcaattcgggaatggaagcaacgatcaatgcggttaacatgtttctccaaaagctgcagtcgggtttggcaacaattggcgttggattagccttattgttagttggctataatgcgcaaatactggaaaaagccacccgcatccccgacagtttgcttaaaagcctgggggtagttttattcggtttacctgcagtcttttcgcttgtagcttatcttttaacgaagcaatacccattgcaaggtgaggcgcggacccagatgtatgcggaattggccgcgaaaactgcagctgcaagtcaaaaaaaaaataagcaggtctaattgttagttacttgaattgagcatgctgttacacgctcacatcataacgcgctccccggcgcagaagtcggagtgtaaggacctcaggcgcaatggccaaagaccggccatcacgcctgaggccacttacactccgacttctaaccgcgccggctcgcgctcactggaggtatagtttatggttaaaccatcacctgtcaatattcaccgcgacgatccccctgcttggtttaaacaagcagatttcggcattatgattcactgggggctttatagtgtcccggcttttgcgccgaccaatgtgccggattatgatactttcatcaaaagtaagccgctgaagttcttttttgctaatcaaccgtatgcggaatggtatgccaacagtatcttgtttcctgacagccccgctgcccgttaccatcgtgaacattatggcaatgcgccttactcggactttgccaaaacgtttaagcaaagtgcccagcaagtcgatgttgatgcctgggcggatgcctttgccaatgccggcgcgaagtatgtggtcattgtgacaaagcatcatgacggatttgtgctgtatgacaccgacgtagcgaatccgtatcaacctgattatcaccttgactttgatttcgttggccaattagcacaggcagttcgcgcccgcggtatgcatttcggtacttattattcttcattgttagactggaccttcccgcacgtgcccatcgctgattacggttcactgatgttaggaaatgaccgatcaaaaatttataaccagtacgcacgggcgcactggcatgaactgattgaccgctatcacccggatattttgtggagtgacatcggctatcctgacgatccgggtttgcctgacttattcaggtattactacgatcaggttcctgacggcttagtcaatgaccgctggcgccaatttcccaactggctgcgcaataagccagggcgggcggtttttaatatcgccgcaaagtacgtcatgaaccaagaacacaaacatcccggtgatgtcggcgagctcaaatattacgattatcggacactggaatataacagtgactggaaggaaaataagcgctacttcgaaatgactcgcggtatggataaaagttttggctacaaccaattcagccaatctaaagactacatcacaaccgccgcagtcaaaaagctgatcgcaacactccatcctaaacgtggccgtttactacttaacgtcggccccgatcgctatggcaccattccaccgtaccagatgaaaatactgcagcaacttagtgatcgttaacgctccaatccaaaacgtattaaaccgagctatgttcagtcatcaccacaacaaaaaacgctaggaacatcggccactgtcagacggtgcgattcctagcgttttttaattcagattattgaaccagcccttcagcagggtgcgcttaatcatggcgttaaaaccatttagctcagctgattaatcgccgcccagcttgccaatgcttctggatgaaagccgctccaagtagccagcacatccccggtctcatcgtcacgaacacggacaaccggaaaccgatcataaccatccgctcgaaatttaacgactttctgggcactccaagcacgtttcaacggatcttccgcactcgtatccaccaagttcgattcaccgcgctgattcgtggtgcgaaaatgctgatgatgagccagcaaccagcgtttcgtcaagcggcacgattcgcactggggcttttcatataccacaaagtgaatagccatacgcatttcctcccttactcatgcttatcctcgatctgggtctaaagcgcatgtctcattttgtttctactatcccttattccggctatttttgcaatgacaactcatcaaattcagtgtgcacatggctgtttggaaaccagccgtaccagcattttcaagaatagcaagcaggttccccttgataggccgcttgttgctcctgggcgagccgcttttacaggcatctgattatgatcattcaactaaggcagccgcgactttttccaaagcctgagttgctgcaagcggtaagcgatcatacccgtcagccactgttgctttatcggctaaaaatgtcaagcgatcatccaatcgttgccgtaataaggcccgataagccgaattgctaaagtccaccgcaaaatttggcaggctcaaatagcgcatggcaggcaatggaccaaatggtttaaacgccgccgtcccatccacaatcgcggcaatcgcatccaatgtatcgcttggtttgactttttgtccctggaaaaaaccggtattaagaatgtaacaagccatgccgcgttgctggaacaaatcatagaaatcctgataatcctctcccagcggataactacgaaaaggattggcaaacggttcaatgaccaactgttcccgatcgacatcggcacgcacattttcggctgtggagcgtttagtggccaaagttgccccaaaagctgcggctaagcttggatcctccactttgacaaccggcggcaaagcgtcatctttcatgatccagaaaatggcgtcaacgctctccaccaaatgatccacccgattaggcgtcacataacgcgatttaacggtccgaccattcccgttacgaatatcttgggtcaccaacgtcttcttaccgtgatcatccagcgtaacgccaacattttgaaccgttagaaaataacgcgtattcgggtcgctcattggataatcctgggttttatcaaaatatgccggttcaagcgcggtggtcgcaccggtctgccgatcaatgacaaacgcatcatcgtgtaacaccttaaccggataccggtcaccatgactggtcagggtgatggtggacttgccggagcctgacaagccaaacgctgccatcgtgaaggtaccatcttgccgctgatactgcttcatcccgccatgacaggcaacaaacccgtttcgatgcgctgttgcccaagccagtgtcagcgttcccttcttcaattcgccaaaataccgcaagcctaaaataatggcggcattatgcaacggatcaaaaattgccaagccgtccggataatccggatgatgccagtcaggatcagcataaagataaagatcatcttctggaagcggccgcgactgctcatattgctgcgttgcttcaggcgttttaatctgaaagttcagcaaataagtgtaaaggttgttggcgtaggtttccggcaccatcaaatgcgcctcaactgcgaaatcagccgacaagccaacaaccacatgtccactcaaaaatgatttgcgtgtacctgcaaagaccgcctcgcgtgcaattttcgtcagctcagcagtatcaaccccgggctggccgatgatacgacgtgcggctgccgtgcgccccaccacctgtccgtcatttgcaaccagaactcgggcatcttcaggcaatccaagctcactggcatgttgaaccggcaaatcggttacgatgacaccaggtgcttttttagccaacgcataggctgctgcaatcgtcgtcaccgcctgaacattgttaccataaaaagccgtttcgaccgttgccttgagcgcggaaaaatagccgcttgttgctgtcacatcactgactggaaacttctgcttactcgtcatggttgcatccccctaaccgctcggattctcctcaaaattcaccaaaagaaaaacccgaacttcatccatttgaaaaggctttcacaacctgattatacagacttgtcgcaaacaacgcgaattttaaaatagccgctgcagctaaaaattaagccgtaagcatcacccaacaaccgttacgggtagggttggataaatcccgtcgcctaagctttacgctgcttgttggcctgcatcactttagcatgatcaattaaaggacagccaatatcttcacactgactgcagccgcctgctttatttttacggaaaaaggtccggtacaaaaccactgcaatcgtcaacacaactaagctaccaattatccatgttgccatgttcaagactcctcgtatatttaaattacaaccaagttttctatcatgactggttcaatagctcgcagccattgccgatactgggcgcttgagccacaaaccgtaaatgatgagtcctgctgcaagccctactaatacgatgctcaacccacctgcttggccagtgaaaatcaggctgctttgataaaccaacatggtcaataagtacgccaccccggtttgatagccaacagcccaccatgtccaccgcgcatcgccaaattctttatacatcgttccaatagccgcaaaacatggcgcgcacaacaggttaaacatcaaaaatgcataccctgccatcgctggataagtcgcgcataacgtctgggaaaagctcccggaaccactagcaccaaaactaatgtgcagggttccgacgcaattttcttttgcaatcaagccggctaatgtagcgaccgttgcatgccaatcaccaaaacccaatggcgcaaacagcggtgccaatatgccgccgattgctcgtagcatactgtgattttccgaaaccatctgcaaagtgaaattaaagttcgacaaaaaccacaacaagacacatgacagaaaaataatcgttccagccttatgcacaaatgcccgtgcgcgcgacatcacactgcgataaaggttggtcagccgaggcaaatgatacgccggcaactccatcacaaacggtgcaggcgggccggcaaataaagccgttttctttaagaagatgccggaacaaacaaccgcgacaatccccatgaagtacgctgacggcgccacccagctattgttggggaaaaatgtgccgctcaccaatgcgatcacggttaattttgccgaacatggcataaacgtggtcaacatgatactcatgcgtcgatccttttcactttcaatggttctggtcgccataattcccggaacgccgcagccagtcgcaatcaggatcggaataaaactttttccgcttaaattgaaacgtcggaacaaccgatccatcacaaaagcaatgcgcgccatatagccacagtcttcaaggatgcccagacacaaaaacaacatgataatctgaggcaagaaccccaagaccgacccaatgccaccgattaaaccatccacgattaaaccggataaccacggtgcaactgcccagcttttcaacgtcccgccgaccacactcggaagccagctgccaaacaccgtatcattcagataatcgctgccaatggttccaatcgtctgaattgaaagataataaaccgcccacataacgacaacaaagatcggtaaagccagatagcgattcgtcacaatccgatcaatccgatcactcatcgacatcacaaaatcatcttgatcaaccacacacatggcaatcacccgcgcaatgaagtcatatcgtgcgttgacaatgatgctgtcactggcgtcttcaaaaatatgctccgccgtatgtaaaatctccgtgacctgtttttgctctgcaggtgaaaaagccaatttttccatgacttgcggatcgttttcaaaaatcttgattgcataccaccgcacccgttcttggggaacacgatcgccaataacttctgccaacatcgttaaggctgattcgagtcgcggatcgtactcgggaaacgtatacggcttcggtagcggtgcttggatggtctgaaccaattcctgcaatgcagcggttttagttgcattcgtgccaataacgggtacttggagtgcataacttaattttttcaaattaatgctgcgatggccgtttttttccagcacatccatcatgttcagcgccacaatcaacggccgaccagtctccatcacttgcaacgttaaatacaggttacgttcaagattggtggcatcaacgacatttatcaccagatccggttgattgtcgagtaaaaaatcgcgggtcacaatttcttcgctgctgtatggcgacaaggaatacgttcctggtaagtcctctagcaccaaggcatgattggctttaagccggcctgatttgcgttcgacggttacgccgggccaattaccaatatgctgtttagaaccggtcagcgcattaaacaaagttgttttaccactgttaggatttcctacgagtgctaaagtttcatgcatgtccatcggcacccacctccgttacgagcacatgagctgcatcttgcttgcgaatactcagcttataaccgcgaaccgcaagctcaatcggatcacctaaaggcgcaatttggtgaatcttaaccagtgttccctttgtcaatcccatatccatcaagcgatgacgcaacgggggatcacccttaatcgtgcgaatcaggcccacttgattcaaagctaactcccccaacgcaacagcaggctgatggtcatccatggcaaacggctgcaccacgagtaaaccggcaatctcatcactaatcgccaatcgctgtccttggaaaaaaataaccaacccggtagctttatttgcaggctgcaccaccgtcagcttcttaacaatcgcaagtcccatttcagcaagatggcgccgcaaagcagcactccccccgacactcatcaatagataagccccggactgattaacatcaagcaatgcctgcatataaaccacctccaaaaatgagtgagcgcgacccagcgcggttagggatcggagtgtaagcggccgcctttgaccattgcgtacgaggccttccacgcaaactcctgcgtccggaaacctgttccacctgttccagaatcaaacgaccatcaacaaagctcatcgtcatacaaagccaacattttcgccaatcgaactcgtttatttctttactttgatttcgctaaaaccgctttagcaactgtcgcaacgtaatgcagttgcccctcagttgtcggatgggttttatccgctgtaagccaattatcgtgtcccgccgaagcagcataccaatcgacaatatgtaaattcgaataacgttttgccattttcacaagatcacgattaacttcatttgtccacttggcatctgaacgaacattgatccaatacacctgtcgcttactgccaatactggtcataattgactgaaaagcttcatctgtaaacgtaccattcgtacccaacccaataataaccgtatcggctaatctaccagacgccgcgagtgacttaaaaagctctggcgcctgataaatttgccggctaaccgttgcgtccagatcaaccttggggaagatttctttatacagataagcgctacccagcatcactgaatccccgactgctgtgatcggcatctgtttagcgacttgaacctgatgataactaagtccttcatcagcaaaatctttataaaccgggtcttctgcctttcgggatgacgcctcggcttgactggctttggcaaccgagcgtgaacgcgcaaccgaacgcgctttaacccgcgatgatgaggctgcctgctgcgcccttgcttgcgcctgctggttaagtccaaaccagatacctccagcgatcaagaccacagctagtaagacaaccggccaaagccacccttttgttaaacgtgttctttgtctatgcatctcgcaccccttcgatcattttgttaccgtttgatcatagcatatataagcgcctaacagggtcgaaaattgtatcgaaaaaaggacttttagactctggcacttttagaattcggctacatttaacgtctcaaatagaagcagctatctacggtttttttggcacgttttaccttaagaactgatatactaaaaagcaactagctggttaacagttagcactcgtttttaaaaatggagatgaccagcgtgacaaaaacactatatttgattggcggacctatgggggccggtaagacagccgttagcgaacaactggttaagcggttgcctcaagcggtgatgctagacggtgactggtgttgggcaatggatccatttgtggtgaatgatgcgaccaaagcgatggtaatggataatatccaccatttactgaacgcgtttattcaagcaccggacttgattaatattgtgttttgctgggtaatggacgaacaagaaatcattgatgatgttttgggtggtttgatgctgaaaaatgttcaagtggtaaatgtatcgctgatgcccagtgcagagaaattaaagcgaaatattactgctgatattcacgctggcattcgaacggcggatgctattccgaaggccattgcgcgattgccaaagtatacaaccgtcaatagcactaagttggatacaacggctcttgtccccgcccaaactgcggcaatgatcagcaaactatcccattaagctgattcctgctgtagtgatcgccgaatgtaaggtcaaactgatttatagccttgtacaaaacttttgtggcattttagaatcttttctaaattcgcaaacgtctctgtagaatctgaaaaatctaaaataattttgtcgcacaaaaagtctttacagcgcaatactgctcctgtataatcttacttgttgttcagcgatggcccgttggtcaagtggttaagacaccgccctttcacggcggtaacatgggttcaaatcccgtacgggtcattatgccggcttagctcagttggtagagcatcggtatcgtaaaccgagggtcaggtgttcgagtcacctagccggcatcatacaacttaaatcgcagatgcactggtaaaaccagtacgtctgcgatttttttaatcaagttctgatccggaaaaccatcatttttgcgccaatggccgtttaattttcaaaaagaccactattaagggcttacaaggtggtatgagtcatcaccaatttcacaaaaacaaatcagtctgaatgcggattagttctatatattgatgtcaattgtctttaccgttgtattgttaactttctagtatttaaacaaatttgcggaaaaagatgactaactttagacttgtttaattgtctatctacttttagtaagtgtatcataaacaatgaaacgactcgccacgaaaggatgttgtgatacatgaaaattgcgattattggtgctaccggcaatgcggggtcggctatttttaaagaagccttgaaacgcggccatcaggtgactggctatgttcgccacccagacaagggagttggcatcttaccaccagacgcggaattaatacagcaagacgcgtttacacttacgcacaacgaattacaaaattatgatgttgtcgtcgatgcttttggcaccaccgtggaccaagcctatctgcacatcgacttggccgaccacctgattcatgaactgcgcgagactacttccccacgcatcgtttttattctcggtgctggcagcctagaaactgacggaggacgtctctatgacttgttaaagaaagacccccacgctccttccttcatcaacacgcctaagaatcagctcagagaatatcagttgttgcaatggactgacaacgttaactggctgggtatttcaccaagtatgatttttcaacatggcccggcaaccgaatacgtgcgcggcgacaatacccttttaaaagacagtcagggaaagtcggtattaaatagcggcacattagcagtagcactgctggatgaattagagcagccaacgattaagcaagcacgctttactgcccgcaatgcttgataagtgattttcaagttcaaaaaggatgaggatcaattgatacaagtcagactaactgttcattatattgatgaaaacggtaaagcactaggtccggataatcacttaatgaactcgagagaccatcattttcgcctaaccgcaccgccattgattggctatgattttcaaaaagcaatccttcctaatggccaacatgttaaggatccgactgtggctggcaccatgagcggcgaaaccccggagcttacctttgtctatacaaccgccgactcgctcatccaccaacctaagccagccacacttgtgattaaataccttgatagtcaccaaaaaccgcttcgtgatgtgcaagttctacacaccaaaaccggtcatcaattcaagcttaccgcaccgaacttttcagggtttcattatcaccacgcattgcttcccggaggtatggtgatgtccgataaaactgtcacaggacgattaatccgatcacataacgagctgatttttacgtaccagccaacctaaggcaacaattccaataaaatagcttcgatctgactgttaatctgtcatgatcgaagctattttatgttattgctggcccgttaagatactctgcaatgaactcgtatcaccttgttgttgcaatgacttggcatcttgataggcctgataataatcaccagaagcaattgcctggcgaatcggtgtcaccgactgttctttaaagaggacagttgcagctaactttgcttgatcctgattaacacccgtcgccttttgaagcaatgtagccgcctggtcctgatcctgcgcagctttcataatcgtactcattttcgtttcttttatcgtatcagctgctcgctgtaaaacagcatctgttgccgggttgccggttttttgagcagtaatacctgacacaatccgtgctttaactgcactgtcagctggtgtgtcgttaccagtgacattgcgaatcgtgttattaatctgcggaaagaaaaagatcccgcacacagccattagtacaataagacccgcgacaatcgaaaaaattttcaagccacgatgacgatgctttttctgctgacgtatttgcaatcgtttatccaaaaatgacactcccttcacttacaaggactcatattaacatgatgccaattcacgcagaggcggtcaagctagtgaactttagtagccactcgttgttaaatttcccgactcggaatcataggttaatgcaagccaaagtcacgagaccatttacccttctgaaaataatatagaaaaaaggcatccactcattgatggatgcctttatgagctccggttgtcaggctcgaactgacgacaacctgattaacagtcaggtgctctaccaactgagctaaaccggaataaacagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgttgttgtttttgccggaacttaacgtatttcatcgaaacgcgcgcgctggcttagcaccagtttgcgctttacttggttaagtcctcgaccgattagtactggtccgctccatgcatcgctgcacttccacttccagcctatctacctgatcatctttcaggggtcttacttccatataggaatgggaaatctcatctcgaggggggcttcacacttagatgctttcagcgtttatcccttccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttctacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaatgcctccatcgaaactagcgttccgatctctacggctcctacctatcctgtacaagcggtaccaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactttaatttcgctccccatcacagcttgtccttaaggcggcaagcatttcactcgctaccggacttactgcttggacgcacttttccagccgtgcgctttccttagcctcctgcgtccctccatcgcttaaacaaaataaactagtgcaggaatctcaacctgcttgtcatcgactacgccttgcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcaatggtattcggagtttatctgaattcagtaacccttgacgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctacctactgaagcgccctgttcagactcgctttcgctccggctccgacttttcatcttaacctcgcaggcaaacgtaactcgccggttcattctacaaaaggcacgccattacccgttaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctgaacggagagtccgccgtttcgtttacagggctttcaccttctatggcgcagctttccagctgacttcgactacgtcgaactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccaacaagctatgtattcacttgcaggcaatacactgatgtgtactgggttccccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctattattagaaactcatacaaatacgctgtgttctcggcaatttaaaacatttacaacaatgatatccagttttcaaagaacaaagaatcgccaactaacgtcaacgatcggcctgacggccaatggaggataacgggatcgaaccgatgacctcctgcttgcaaagcaggcgctctcccagctgagctaatcccccataagggttgttcaattaacaagcgaacgcttgatgggcctagatggacttgaaccatcgacctcacgcttatcaagcgtgcgctctaaccaactgagctataggcccgataggcgtgtagaaagggtaatcccctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcacttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcattgccttggtgagccgttacctcaccaactagctaatacgccgcgggtccatccaaaagcgatagcttacgccatctttcagccaagaaccatgcggttcttggatttatgcggtattagcatctgtttccaaatgttatcccccacttaagggcaggttacccacgtgttactcacccgtccgccactcgttcaaaattaaatcaagatgcaagcacctttcaataatcagaactcgttcgacttgcatgtattaggcacgccgccagcgttcatcctgagccaggatcaaactctcatataaatatgagttgttcgaatagctcgatttgttgttctagcgaattgacttcgcaaatgttactttttgcctcgataccgaagtatcaaggaccctgcacatttaaacgaaactttgttcagttttcaaaggactaccttgtcaaaaaacaacttttatagattatcatgatcaccaatgcatgtcaacatcttttttgaataaacatgcagttgatgaatgcgataagcaattaacaatttgacaacgaagaatatgatagcaactttgccaagccgcgtcaacactttttaaatgaggttttaataagaatttctaagccgaacgttcaaagaaaaatgcagcgaattattaataatccgctgcataaagatgcactttttgctattaatcttcctgcttgattgcagtttggccgtgcatgtagggaaccagaacgtcaggaatcttaaccgttccatcagcttgctgataattttcaagaatggcagcgacagtccgtcccactgcaaggcctgaaccgttgagtgtatgaacaaattgcagcttgccatcatcatcgcgataacggatttgtgctcgacgtgcctggaaatccgtgcaattactgcaactcgaaatttcacgatagcgattctgcgccgggaaccacacttcaagatcgttcgttttagcactcgtaaagctggcatcgttgctggccaaggtgatgacgtgatatggaaggcccaacttgcgtaacaagtcctctgcatcgtgaatcaaattctttaattcttgccaggaatcttcgggtttgcaaaacttgaccatttcgaccttgttaaattgatgcatccggattaatccacgagtatcccgaccagcgcttcctgcttcggaacgaaaggcaggtgttagtgcggtgaagttaactggcaatttagcagcatcgataatatccccgcgataataattgaccagcggcacttctgcggttggaatcatggttaatggctcaccatcgtttgtgatggtgtacgttgcatcagtaaacttaggaaattgacctgtgccaaacattgaatcattgttaaccaaatatggcggaataatttcttcataaccttctttttggtgttcatccaagaagaagttataaacggctcgctctagtcgcgcacctgcacctttatagtagacaaagcggctgcctgatactttggccgcccgttcaaagtccaaaatacctagtttctcgccgatatcccaatgatgtttcggttgaaaatcaaaatgaggaatgttgccccatttatattcttcacgcgagtcgtcttcatttagtgacatcgggacatcatcggccggaaagttaggtaaccgaaccagaatataggtgactttctcattcagttctgctaattctttatctaactggctgattttttgaccaacttcacgcatagccgtgatttgctcgtcagcgttttctttgttccgtttcatcaccgcgatctggccggaaacttcattacgctttgcctttaactcctcggtttgaactgttaccttacgtcgtttctcatcaagggcgattaattcatcgatttcttcacccttgatcgtgcgagcagctaacttcttttttgcccactccggcttttgccgaatcaacttgagatctaacatattatcctccttcaaaagtatcaagcagttcacaaaaggccgactttcctggtgcttgccatcgctagggtgcgcctctttggccaactttggactgctgtacttatttctaatcgaaaacccgtctgagtgctcagtgcacacaaaaagcccttcatctctaatgggacgaaaggctttttccgcggtaccacccaagtttggcgcataacgccaccctcttgaggctgataacggttgtcaccgtgcagttcatcactgcccactaaggcgctggaatgaggatgatatgtcagcttgcaccacccgctaactctctaaaacatccattaggcgcttcagacgtgtttactatacgttgttagattaccgcatctttcgtgtttagacaagcatcgagagcagttttcactaaaagaattagcaaaacgatgcgtcattttcaatagataaatcgcgcatctttgagggttttcccgtcccatagttcccgcaaaaggctataaagatgcccataatgatcgttcgtgacattgatgtgccatgggaagatctgggtttgtcctgctgcatccttaatggcaccaaccgaagtcgtaataatcaggtcaacatctttaaggtcggcatccggtgaagccaactcaacaaatggcaccgcatgtaaaaaggccaataaatcaatgtatcccgtcaccgtttgttcaatgaccggcgcaaccaatactttttgttggggctgaaattgaaccagtagttgatgcagattgcgataaaacgcttctgccaaaacatcgcggcagccgacaaatgatgtcagttgctgactatcaatcacctcatcaagggttactttaacctgctgataaaagtccgggtcatctttggtttgctgcatattggcactaaactccgccaacaagctggtcgtgaagtctttgttgaacgctaacacgctgacggtcacgcttagcatattggcaaataacaaattataagtatcatccggcaaatggatatcaagcttaaagttatacggaaaacgcgtaaagaaaccgttaataagttgatagatttccggattatagtcattgtaacgggcaatgattcgttgttctacctggccatccgtaataatatacagcggggcaaaattaaaaaggaaatacaaggcatcactttcactttgctgctgctgcgttgtcaggtgctgcaaccgcttcgacttatccagtaggctcaaagcagcatcactaaagagattcgggacaggatattgcaaaactcttgagccggcttcatgtgacaaaacatggccgcttaaaatacgctggtgagccaccgcaatataatacatcaacaattctcgcgtaatcttgttgaccttgccactgtcaaacacaaccaacaagtcatctaaaattttgcctgcacgatcatgggataagttttcaaatggccaagcgacaccattcgttgccaaccagtaagcaatggtgatgaacaatctgacattcaattccgctcccacgaaggaaagtgtctcgtaagaaaattggacgccactttgccgggcgtaaccgcgaatgactttcaaatgtcttaacacggtcgctttagaactgtcacaggctcttaaaaagtcatcaaagtcttcatatcgctgatacaaaaccgcatccaaaaaatgatacggatttgactgtttaaccaaaaaatagcgaaactcatcaaccggtattcccagcaatgttttgaccgacgcatgttcgcggccaatcattgcttccagcgaatgcatcaggccattatacgtgttatagacgctgccataattacgattggtaattgccgcaacttgtttaaggttgacttcactaaccaatggccggtgatcccgatacgctttcacccgctttttaaccggtgtctgggcttccctgacgtcaataatggtccgaaacaaactcagcttttcagcatcggacattgataagaaaatgtcatgattgtctttcataaaatctccttcctgtagacttctgtgttgggtaatccattcatttggaaacgcgtggcataaagacttgaagtagcagcccacgagtcaaggtcattctctcgtcttcttagaccagcacgcttgatactacgcctgtatgtctgaatcaggcgtcaatttaataggaatttctagatatcttgattatacttcactgaagacgcataatcagcttcttacccctgtctggcctattgctataccaacttgtgaatctgcccgttatttgattcacttacttaaggttacaaaagctcaatcattcacgagagtcgcatcgcttttgtcattctttggtataattagaggtgaaggggttttaattgctacagattggagggtacgcgatgctttatgagcaaacttttcttgaccgcgctgacttgcagaagtttcaaatgttttcggctatcaaggacagcaccgtccagacctataccatcaataccctcagtcgccacctagacctttcatatcagcaaggctataacattttacaggaactgtttcgggatatggctggtttgacggtccatccggaaaagttaaagcgccgtcaaattaatcttttaatggaaattgatgtcactgtcgacgattatcatctttacctgctgaaacatgccattgcttttcagtttgtggactatatcgtgcaagccaatcacccatcaaccgaaaagttttgccaagcccattttatcagccgctcgactttggtccgtaaaaccgccaccttacgcaaattactcaaacgatttcaactaaaactttcttttagcgatttaggctttattggccaggagagccgcatccggcttttcctgtttgacttttattggcttggctatcatggcgtcgattggccgtttaaggttctggatgaacatcagattgtgcaggaatacatggccttgccgaacgccaaaacgaatccggttgatattcttgaagaaatccttttttgggcgatctgccgcgtccgtatcagcggcaatcattttgtcaccggtaatgaagcatttgatcggatctttaacgactatccgccttttcaacacgatgtttatacacgtgagatgttccctggtttcaaccaacgctacatgaagggtgaaaatgactttttttattttcagcaacatcggaccatcaccttcttgccaagtattccggacgatcaaaacttcatccaatatttattgcagcgaccaactgtcacggcagattttgtgaaacgcttattggctttcttaaatcagcatgtccggcatcaaaccgcttttgatctcaacaatgaacatgggctcatcctcaacctcgcacgtatcgctttaaataatgagatgctcggtggggacttcatgcatttggttgacttctatcagccgcgcggattgaattacacgaagacgaatctattccgggtcttggagaaattcgtggcatccttgccgaaaactcctgaatatcagtattttttgggaaccgaccatcaattcctgcacacactttatttcctattaacgccttatttacgctactttgttgaaacgccaactgtacaggttaaattggcttacctggatcacgacttgttaaaccggcgcatggtcaatctgttgactgatttaccggttgttgatttacttccagaagatgcagcatttgaaaaagctgatcttgtcatcaccagtgtggacaatgaaccggctatcaaggcagctgttccggccgattttcgcggtgaaatcattagttggatgactgaagatagtgacaatgctattttccagctctacttgcagattcggcatttatatcttaagaaaaccgatgcttccttatcggctgacaacgatgagcggttataaatcgtcaccgcatgataaccagtgacaatttcaaattggtagccttttgcgaccaataagagtgcgtaataaaaaacgacctgaaagatgacattcatccttcaagtcgtttttcatttgtaagcttgttatttaggattaggttcatgttcgcgatgcggagctaggtcgactttttcaagcgggatcagtttggttttatacttcactttataccagacaaacagcacaataaaaagcggaattgacatgtacgacaccattaaccgtccccaagcaaagtgctggactgcttgcaaatcctggcccacgatgacgatcagactcatgataatcgccatgatcgggccaaccgggaaccacttggcatggtatttgagttcgtgaacatcatgtccctgtttcacgaaagcccgccgaaaccgaaaatgcgaaaccgcgatcccgagccaggccaggaacccggttaaccctgacgccgctacaagcagctggtaaacgtgtggtcccataatactggtcaagaaagttaatgcgccaaccagagttgttagcaacaacgcagcaagcgggatgccgcggctgttcgttttttgaaaaatccgcggtgcaaagccggagccgcccatcgcccacaacattcgcgtcgatgcatacatccctgagttagccgatgacaaaaccgaggtcaaaatcacggcattcatgacacttgctgctcctgcaagtccaatgcggtcaaataccaatgtgaagggcgaaatcgccacctgatccacgctggctcccaacagattcgggctagtgtacggaataatggcggcaatcacggcaatcgacaggatataaaacagcaaaatacgccagaaaacctgcttaatcgccttaggaatacttgtttcaggcgtttcgctttcgccggccgtaatcccgatcaactcggttccctgaaaagaaaaacccgcgacaacaaaaacagccaacgttgcggggataccacccacaaacggcgccgcaccggttgtgtaatttttgaaaccaatgggaccatgcccacccatgatccccataattgtcagtaacccgacaattaaaaagacaaacaccgttacaaccttaatcaacgacaaccaatattcagtttcaccaaatgacttgaccgaaataatgttaatcaagaagatcagcgccaaaaaccccaacgaaaacagccagccgggtacatttggcagccaaaaatgcataacaatggcagtcgtcgaaacatcaaccgcaacggtaatggcccagttaaaccaatagttccaccctaaagcaaatccgaacgccggatcgacaaaccgactcgcatactcggaaaaagagccggaaaccggtacatacgtggccatttcacctaaactagtcataagaaagaaaaccatgagtccgattccgatataggctgcaatggctccacccggtccggcagtggcaatggcgctgccacttgcaacaaaaaggccggttccgatactaccgccaagagcaatcatggatagatgccgtgtcttgagctctcgttttacttgattggatgctgattgtgccacagatgaactcctttgttaacgtgaattgatttttgctaaacaatgccagattttactgacgatatctggaatgagattttcgtgattggctggttgttgacagccggtggcaggttaggtgcaacgatgcgttagccaaagaccggtgtttatggatggaagactgcagcaagggcagaagcattcttctttgggcaatccgttaattttattctgctttctataacgcgttcgccagcgcagggatctgcgtgtaaggacctcgaacgcgatggcccaagaccggtgtttatggacgaaaaactgcaacaaaggcagaagcattcttcttcgggcaatccgataattttattctgctttctataacgcgttcgcagtcgcagcaatctccgtgtaaggacggacctcaagcttaaatggccaaagcccagccatttaagcttgaggccacttacactccgattgctaagcgctcctgctcacgctcacacaaaaaaagccaatgagtcggtctgttgtgactaacccatcggcttattctgctttttaccatgaataaacgtgatccgatttgttagcgccccgcgataatcgcgacagtccagtggatattatccaactggcccaatatcgattggctgaactcaaccggtatttcggcacctttccctttaacaactgcgcgcttggtgttcagaccattgcagctgcgactcatgattgatgcgacctctaatctcaattacgactcaccatatcatgttcaactaacaacagcaactcactctcacacggctttaactcaactctcagctttaagaatatcagcaaccaaacttgttgtatcaaattgttgcttcaagaaaggctgatcatctgttggcaaatgcaactggaagtcgctaaacttttgtaaaaacagttcgccactatccaattcgaagccaagaatatgcccacccatactatgatcagcagccagaaaatggacatggaaaccaggtgaaaccgcacccgcatagagatccggtgaaaagtacccaattaaagtgcccttgatattctcggcatgaaattctttttgacccgaggccgtttcggtcaaggtcggataagatggctgttgcggcagcaccgctcgtgtatgcatttgcgtaaacgtaccttctacacgaaccgccgcaaataaattactggtctgcagccgctcgagagtcgctttgtgaaacccggccaaatcaagcccctgaagcttaccagctgcaacgtcgtgttgatagtgaacgttagcaaaaggaaccttctcgtcttcttgcacttctcgaactttaccttgggcattcacttgataaaccttacccgcctgaataattaactcaccatcaagcccagtcaaagttccaatgccagtatcaccgtgctgcaacaattccccaactgtctgcgtccccgcaaaaagccccggaaccagcatggctattgttccatgttgatacaaccgatccgtattcaaaacgacatctcctttttgaagtgagcgtgaaccggcgcggttaggggtcggagtgtaaacagacaatctcacactgagccccacgctccccacgtcagtccagttaacgattaatagatctgatcaggcaacatcgcagcgccaagttcggcgttatcggaatagtcaaccggaatgtcaacgatcactggaccttgagtcgcaaacgcctcatcaagcacggttccaagttcgcttggcttatcaacacgcaaacctttggcgccaaaagcttctgcatacttcacaaaatcaaccggtccaaagtcaacacctgctgcacgcccgtatttcatctcttcttggaattttaccatatcataatggccatcattccaaataatatgaactaaatccgccttgagccgcacggcagtttccaactcttgacccgagaaaagaaaaccgccatcaccggatattgaaaccgccttttttcctggacgaaccaacgttgccgcgatcgcccacggtagtgccacacccaatgtttgcataccattcgagaaaagtaagtgtcgtggctcataactacggaaatgccgtgccatccagatgtaatgactaccaacatcaactgccacagtcatatcatctgcgacccgctcctgtaatgcggcaacaatgcttagcggatgaatcagcttttgatccgtcaaggctggcggtacgtcgctgtcttgtaatttagattgtaattcactcagataatgtttactctccggggccacctgataaccgcgcagcaacggaaccaaaatatccagtgtttgtgaaatgtcaccaatcaattcggtttccggttggaagttgtgatcaatttcagcaggaacatcatcaatcacaatgatgcgggccttgccatcagcattccagttacgaggttcgtattccacaggatcatatccaattgcaataaccagatcgctatgttgcaacaacatgtcacccggctgattacggaacaaaccgacccggccaaagaaattatcgatttggcgatgcgaaataatgccggcaccctggaatgtttcgacaaccggtaactcggtgaccgacaacaactcgcgaatttcagcagtcacatcgctggacgatgcacgcatacccaacagcaacactggtaatgaggcttccttaatcgcacgtgccaagtaagtcatgtcactagggctggccggtcccaactttggtgccactaacggtttgatcggttcggaattgaccggtgaatcggtcacatcttggggaatcgacacaaaacttgcgccctgcttgcctgattctgccgcctgataagcgttggcaataatttcactaacattgtccggatcctgaacttcagccgcatattttgtgatcggcgcaaaaagatccgcattccgcatactttgatgggagctacgtaacaaatctgctcgcttaacctgtccggacaatgccaaaaccggatcgccttcagcagttgctgtaacaaggccagttgccaagttcgaagcgccaggtcctgaagtcgtcaagacaacgccgggcttaccagtcaaacggccaatgccggctgccataaaggctgcattttgctcgtgtcgggcgacaattaattgcggactttttttagttttgggatgttctagggtttcaaaaacccgatcgattttggcgccgggaattccaaaaacataatcaatcccgtgatttgctagactctcgacaattaaatctgcgccataacgcttctcttcagccatttcgccacttcctcattattgatgtgtttcataatacgctttttgtgttccgtttcaacccctaatttaactgaaaaacaccgattaaacagagcggttctgttacagtattttcataaatctgttacattcttggcaaacttgtttaaaagcctagtttaatctttccaatataagtttaactgatttagtaggaacatcgttaaaggaagctcacgccaaactaaaatcgaccgcaagacaacttgtctttgcggtcgattttacttagttcctatactgtttcaagatactgcggcatcattttaccggctaccggtctattgtaaggaacgactgattttaccgataccggttttcggatcagtcagtttcaggttaaatccaaattttgtgaaaatatgccgtaacttggctaaattaactttatcaaacgagctaatcgtgccatccacgagcgcaacgtcggccttcatcgccaaattcagaaaagctttcagcgccaactgtgcgaggccaagattctcaaaatcgtaaaaagccaagcgactttcggaacccagcgtctctaaaaccgtaatatgcatcacgttgtcccagcgattcgtttcaaataagagctgtgcctgataatctgctttcgaatggccatatttgtcaacattttcaaacggtgtgtagacgtaaatcgagttggttttttgtttctgttcatcggctttaaaatcggtgaagacaatatattggcgcacgtcattttgatccgattcttgcggttgattcatgcttgatagcactgtcaattgcggatcagcttcgattgctgcaagccgcttatgataggcctgttcatactctgtttgcacagtcattttgaaacctccagactaatactcgttttcattatagcatttttcaattcgttgcctatataaaagagaaaagccggattgaattcacccggttttcaaaaaaatattaaagtaaatcctcattttcaaactgattcggtaacaatctaaaatattgttcatcgcggggatggtcgccactcaatccccgtggcagcggcacttcgaattgaaatgtaaagcctaaacgtttcaacaagtgaattgaagcatgattactaggaaaaacacctgcccaaatagccttaatatcatgggcgaattgatttgcaatgaccatttgcagtccctcacgcatcaaacctcgatgccaataagccggatgaaggatgtagccaatttcacgcgtcatatcatcccctgtcagtggcgataactcacgcggataaaccccaatgttgccaatcacatgcaactgataaacaagagccagatcctgacgctcacgagcaaaccgcttaacgtgattcgctgcttcttgacgagtcttcaaaggcgccatccctgccgcccgcgtgacttgttctagtttggcataagcaaaataatcatcaatatctgatgtcgtaaaaggacgaactgtcactcgcggacctttcaaaatgacgcctcctaaaaaaagtgagcgcgaaccggcgcggttagaagtcggagtgtaagcggccttaagcgtgatggccgggtcttggccattgcgcttaaggtccttacacgcagatccctgcgccagtgagcgcgttatgggcataagctagaacacaggcagcctcagacgcgatgcccctgtcgtgaccattgcgtctgaaatcctcacacgcagatcccagcgctagcgaacgcgttacgaaccaacactcttataatcaaacggccaagacatccaacattcactcataacccctaaatccacacatataaattgcggcctgtgaaaatacgttaaccttgtctcatcaactgacaaaatttttccattttttgagacaaaaatatttccagtagcaaattttctcgcgattgcggcgcgcgaaactatttatcttttcatattatcaagtatcttccacggtatgacaagcctcagctaattggacatcgaacttagcctaagcatttgacgactgattatttgttcttatcggtaaaataaagtcgttcaaacaactccttgagaaaggtgcgtgacaccatgccggcaagcactactgttagtcgaaagttcgccaacttgcaggaacacattgatctcgcggcgaggtcacctgccatcacctcacaaacatatatggtgatttttccaacatactgaggacttttaagtaacaaccgatctactagccaaagttaaccacgtctgataatcagtaatggcagctgattccgttctcaacgaacagctgccctacataccgacaggcgaaaggtgacgacaattgtgaaaaagataataagtcccattttggttcttttatttagcgtgctctttatttggccattgaccgtgacaaccgctgccatttcaccaacattcacggttacgccggtcctgcctaataatcagcgtcagtcggttaccggttactttgacttacaagttagcccgggccaacaagaagatttacagctccggatcgctaatcaaagtgaccagactcaaacctaccgtattgcagtcaatccggcatatacgaccaatagcggggtcattgcctttgatcaaagccaaccaccgcttgatcaaaacgccattcgtctgagcaccttaattcaaggaccaagaacggttactgttgcagccaattccgagcaaaccgtaacgtatcagttgcaagctccagctgagcattttatcgggattatcgcaggcggcttttatgtcctgcaagaaggcgccacatcaagtcgtgcttccagcaacggggttcaattcacaaaccgctttgcaatcggcattacgaccattttgcggcaagatcttaccacgccgaatccgccattgcttgatataaccaaagccagcatcggcaccaacaaccacacaccggtcgtcaaggcgcggctgcataacccttcaagtaatcaattcggtgaaattgcaacagattatattttggttaaacccggtagccaaaagccgctactgacaggtcattttacggggttagcggttgcaccgcattccttttttacccaaagtatgcctttgaatgagaccaagttggctgcaggtacctacacgctcaaatggacggcaaaatcgggatcttacacttggtccaaacaagtcaactttcgctacaacggccagttaccgatcagtgtaactgcttcccgaccacgatcaccaagcgatgcggatgatcatggcctgcttccttggataattgccggcatcatgtccgctttgctaatcattgttctcggtctatggcgctggaacgtggtacaccatcggcaaaatcagtagaaaagcgtgccagcattgacagtttgacttatgataaaggtagcgcgaaaccaaatgattatgaaacgccttggaaatgtaaatccttctcacggtgtcatctgtttggtgcgcattttgatcgtacggtcatggctggaaataggcgttgcgtatgctaaagtgctgccgagtttaaagctttgcaaggctagatcgtttgtgggcatcggtcagcatgaaggatcacttgcctgcattcatcacaacacgtttgccagccgcgaaacctgcgtgtaaggaggagttttgatgtcgaataaacgtgtacttggcaatgagtttcaaactgcctatgaaaatgccggtggaactgatattttgaaatttttagcagatgttaagcaggcttatcgttgcattagcgacttaaccgctcgaatgacagcgatgcctgactctgttaaaagtgagtcggttccgcaactattagtccaacaattagatcagaccacctttgctgaaagttcggttcgtaaatgggaagatgatttacggcgttttgctgcttatctgacaccgctagaacctccgattgcaattcttgacagttgggataccctgaatgatttcttggaagctaaccaagcattactgagttcactgcaaaacgtgccattgctacatgaagacacacaagatgttaaaacttcaacgcaacttctcgtttatccggctgagcccctctttcaagtcgttcaggccgatactggcgaaagtgatgccattgacctgcctggcttaaccacggccgatcctgatggcgttgcggaaattgcacgaacccacggcgtcacgccctttgctgcctttaacgcccagccttgattttagtctgtcaatcctgtatgcttgacaggttaaattagaaaaaagcgaggtgctaaaagatgcggaacaacatcatcttaggtaacaatgaaaccggcgaacgtatctatttaacttccaaaaacaagcgtaacacgcctgatcgtttgcaactcaagaagtattcaccaaagttgcgtaaacgcgtggtcttcaccgaagttaaataatctgatcgcagttcatcagccaatatcgcattctgtcagttttttactgatagaacgcgatatttttttgcttttgtgcctgattggtgagaatgcccatactgaaagctattgcccaacgccaaataagccctaacctaaaagcagcggttgtagggcttggcttaaataaatggccaacagtttcggatcggcaacgatttcaaccaattaactaatagcaagctacttcaaaggtaatatttggtctaatatggccttgctaaggacatgttgaagcggatttttgctgacacttgtgatgagaccgtcagcttccaactgattaatcatgcgttttgtccgcgacctaggagtttgttttgaaccctttttaagcacttggacaatatcacgatcctgaatgccataagtgatgctctccgtaaacaaataagattggagaagcaagtataagatatccttcatctcgtcgttcaggtttgcaaattttgaatataatttttccccggttacatgtagttgttctttagctgactctaattcttgaataacttcaagttgaccgtgttcaataatttttaacattccttctaagaaaaaagttaactccgcgcgattttcaatattgtctgcttcctgaaaaagccggtaataagcagaaagattgttatgaatcgctgttgatacagacaagccagtgaagggatctaacttgcttgacaaatatgacgagagcaaatacctgccagttcgaccgtttccatctaagaacggatgggcattttcgaacataaaatgggtgatgatcgctttttccaatgtcactaggtcatcattattcataaagatgatgagctgttctaaagccgtctcaatctctgcttcatcaatcggaggaatatggaccgcatgtgaaccagtcccaataaatgcaaatgagtttctgaatcgtttaccatccggcaacttttctggtggaatctccccttttaacaactcatcataaatatcacgataatccttcaaagtgtcaatctgacgcattcttgcggtaatcgagtcatgatacttgcgaatggttgattccaaacgtttttcaactctacccggccggttttttaaattaccaataatcgtcccgatctctttcgggtttgtttcaacaccttcaatctcattggtaaaaataatctcattgctaagaagcttctttaaataactgttaatcgcaacttgaggcaattcattgtgatttgccaatttggtaatctgcattgagttcctaagaatattagcaaccagaagattaatcttgtgagtttcgacaaaataaatcggatacttggcgattgaaatagagcgcttttcgatggctgcttcatccagaagactcgtgttttcgagtgccggaaagagcgcagtccggactgttgagggacctgaaagccttaaatgatattcgtcatcaatttcctgtggtgattttctgccagtgccattgttattgtatttaaatctgcttaaaggtaaatagctcacgtttgcgcctccattctttaaaatggcgattattgaaatctgcttttcaaattatgcatatcgattttaaaaaatcaagcatttttaaaaattgactcccgcatttttaaacactatatcatacaattgtcgaaaatagactattaaaaaaccttctacccgcatcagcaaataaaaggcgtgttgcgtttatgacaatcaggatctggcgctactgatttaaaaggttcacaaagtcatcaggaatcggtaaatcagcctgaattcttttttcagaaaatgggtccacaaaacttaaatgggtcgcttgtaatgcctgatgatcaatgagcggactcgcttggccataaagtgaatcaccgattaagggatggccaaggctggcaaagtgtactcgaatctggtgggtacggccggttaataattgcacatcgaccaaggtgttgaccgcttctttcagcacttgatacttcgtgatggccgattgtccgttttccgtaaccatccgatgaatgccgtccggacccagaccgatgggtgcttcaattgtcccggttgcatgactgaggtgcccggcaaccacggccagatattcttttttcaaggttgcatgatgagcctggtcaaaccgcccttgtgcatacgggtgtttcgcggctaaaaccaatccaactgtatcgcgatccaggcgcgtgataatcgcgggttgcggttcggttatcttttgctgctgcaggtaccagacgatgcgattcaacaaactgtgatgaggatcatgaggaccgggaacgctggttaaatgagccggtttattgataatcagccagttttgatcttcatacagaacatcgagcgaggctttttccggtgtcaccgtcatcgtcgttggaatggcgaagcgcaccgtctgcccagcctgaatcgctgtattgccagtgcgatgaccatccagccacaataaatggttcgctaacattttcttgaataatctgtggctaacaccttgtttggctaaccagcgcttaattgtggttgccgttgtcacctttgaatcaaacgtatatcgcatgcttttcctttcgccatcccaataatctgatgtttcaaaaccgaacaaaaatatgtaaagatttgcatttaaacggcttttgggactatggttagaatatgattaatgtataagaataaggaggaataggcaaatatgcaagtggaaaaagacgtgatctatgatgaggcccatgatttacccgttgatatttacgtaccggacgcggctaatggcggtgccgtcatatacgcacacggtggcggctggttccgtggcgataaagaaaacgaaagcgatttgggccaatatcttgcggacgccggctatctggtggctattcccaattttcggctagctcccaagtttctatatccgaccgcccaaaacgactttgatcatttcataaactggctacttgcctctccttatgaatttgatcgcgaacgagtaggtttgttaggcgccagctcgggaggcacaatggtgttgcaaaatagtctgaccactggctacccagttgtggcatggtcgcccgtagttgattttgccaactgggtgcagaagaatcaaatggtaaaagcctcggttgacgcgaagaatgaactgggcctgaccgaaattcatgaaatccatgacgctttttataaatactttattcagacatatctgggcgggttggatccgcgcttactaaccgccgttaacccaaccaatcatttaactgatcaactcgggccaaccttattgttcaactcggcagatgaattaatgccattaccaagtgccctgcattttgtccagcaagctgccatgtttggccgggacatttccatccacgtggtacccggcgttggccatgcacgtgattataccagttttgccttacctgaaacaaaacgcttcttcgatcaccatctttttgcaagtgttgaagacaaggcgctgaataaagcaaccgattagtcttgacgtcatttcaaaagcaccgcgaatgccagtaaaagttggctttcgcggcgccttttttgatcgctccaaaagataagtctatgtggtatgcgcattacttacggccgaagaattaatggtgtggtggtgccgggtgcaacccattcaatgccgcctgttactggtactaagtaaatcgcgtctgcttcgatatcggttggtgtaagaacataaccattaccgtttgatgtcgccgtgtagcgagacgtctttgaaatgccattttgggaaatggtcatctgagtagccgtaatggtcaatgatacatgttcgttatgccacgtaccaacataaaacggcgcttgaaccgtgggctgacttgccgtttgggtcgttgctgttgctgcagcatcactggttgtggcagcagcatcagtcgctgtgcttgctgaacttgccgtcgtcttttcggttgtcgttgcaggggtcttaacggttacggtagcgccggactcatgcgtgctggtcgtttgagctgtacttgatgatgagcttgacgatgcctgtgacttgctcgttgctttcggctgacttgttgttttttccgtgactgtttttaccgttgtggttttcacatcgcttttagcactgacatgttgttgatataaagcggcaccggaaacgccgctaagtgctaagaatgccgttgcaatcatcatccattttttcatgtcaatcactcccactcagaagttgtcgcttgtcggatcgtttcaacaatttcagactaacatgcggcaagcggaaatgttacaaaatgatttcaaatcaagaaaatcttaagacttatcaagatttttgctgtcatcgttttgtaacattcaaataaacataacctttttcttgaaatagcaaacatatgttcgtaaactaatctttggggtgagattgatgacttacgaagaaaaaatcggtaagcaaaagtttgctgccttggtggctgatttttttactaatcgttacattgatcgcgggatacgcaagtggcaaggctattacctctccgaccacaccgccgcgttaaaaaaacaggcgcagaccgagcatctgacttatccgccgctttcgttacaagatcaggcttacattcggatgatcttgcttcgagcatacgctgaaggccaatccgtaaccattcagctcgatctgcaaacaccagatggccagatgctgccgccgatcaccggtaaagtcggcggtgtaaccgatagtgatgtcgttcatgtcggcgaccagaacatcagtatccgcatgattcgccacatcgatctgattccgtttcctgtttaatcaaccagagcgtgtgcagtaaaaaaagaccgtgcttatctttcaacacagtcttttttcatctaaaggaagcttcaactagtctggttgggaatcagttgttgccaagtctgccagtgcatcaaaaaagtaagctagactcagataatcggccgtaccacccggactaagattaaacgtgatcatctcagcatttaactgacgcaaggcatgaggcaagtgtgaatccgggacatgcaacaatgttttagccgcatcttgcacgaatcgtaatccctttggcccgccgcgatggaggacattggcatcttcaacttgggccatcaagtgcaccattaatcgtaaatagcgcatatccccgcgtctggctgtcttgcgtaaatatggcaagatcacatgccggatagtcggataaccagccaaagcctcacctcgaaccccagtaacgccgtgtttgacatataacgcttcgccatggctccagcgggcttttttctccaagtcccgaaaatcaccagccacaccttgcgtcacttgagccaccgtcgggaatagcggcgcaaagtcagcggtgactatttgttgcagggattgctgctgcatgagccagcccaatgcacccaataaaaaaccaaaggagaagttagccccacgatgcgtattaacaccagcagtagcggcgagcatggcattttctgctgcaatcccaatggtgcgtaattggcgatagagatcaggaaccgttttagcaacgacgccggcatgaaaatattgctgaaaaaaaggcgtcaaagcttcaatgctagctgcaaaggtcgtcacatccatatcccggtgtgcaccatttgattcagggtcgaccaagccgggtttaggcgccaactgaacttctgcttgtaaactggtaactgccgcttgtgcaattgcttgttcattcaatatgttttgccttcataactttcagaatatagtgcagggaatgctctaagtgctcgcgcgtaatgagcttaatttgatcgtcatcttgattcaacatcccccgataaagcagccaatgttcctgaatggcaagattgcgccgatcatcgccattaatactgatgtcacgaaaataaatcaaataattctgcagctggttgacgatcattttcagccgcaacatatgactggcatcataaataaaattattaaattcagtaaacttagccatcacctcggcaacacgaccggctgcgttcaaacgatccgtttcttccaaaagagtccgcatctgattgaattgctcaggggtcatcagacgcatggccttacgcgtggccaacacatccaattccttgcgaatgtcaaaaatttcataggcatcgttaattgaaatacctttgacaagtacaccaacacccgttttgcgttcaaccagatcttcttcatccaaacgctcaagtgcatagcgaattggcgttctgctgatatttagattttcggaaagattcttctcgttaatccgctcaccgctgggtatttcgcccaaaaggatcgtcttacgcagcgcttcgtaaatcgcttctttaattggccggttctgtgacaaatccaaatttttcttaaccgctgacaccacttgattcatcgattgtcccccctcacctaacccaatattataccttaacgtgtctcaccacttaaaacatgctggctcacgctcacttaaaaagctgccgacaaatttgtcaacagctcaaattgtgctagcctaccaactcacggccgcgcgttaattgattagggggcgaaaggatcatgtaccttaattatgagtaggatcaaacgtcagcgaaaccttttgaaccggcacatcataaaacggatcttcacgccggcctaaaaagtcttttgcctgatcagggaagagcgcataactcaagacatcttcttctgaatgagcatactcggcaatagctttgcgaaatgccggtagttgcggctcaatcaggtctgccggtcgcgtggtgatgactggtgcgtcaccaataattttctttttcatctcaggagaaatcgggacaggcggctgcccataaagtccgcgaacatagtctttgatttctttagggatcagtttataccgttctccgctcatcacattcatcaaactttgcgtaccaaccatttgcgacaatggggtaaccaacggcggataacccaagtcagcccgaacgcggggcacttcttttaaaacatccccatataaagcctcttgtccctgatctttcaattgcgccaacaggttagaaagcatcccgcctggcacttggtaaatcagtgactttggctcaacatctttaacgcgggggtttagctgcccggcatcccggaatcgatcgcgaatcggcgcaaaatagctggcaatgtcactgacttcagctagtttgacatcagtcgggtagcctaagtcctgcaatgccacgagcattgattcggttgccggctgactggtaccgccagcaaatggggaaaccgccgtatcaataatatcagctcctgcgcgcaccgcctcaagatacgtcatttcagccattcccgcagtcgcatgcgtatggacctctagtggaaccgtaatttcctgcttaatgccgcttacaagatcgaaggctttctgcggggttaaaatgccggccatgtctttaatggcaatggagtcagcgcccatgtctgccatttcttttgccagcctgatgaaatagtcaatcgtatggaaatcactggtggtataactaatcgccagttgtgcgtgcccacccgcctgcttggtagcttccagtgcggttttcaaattacgtgtatcatttaacgcatcaaaaatacgaatgatatcaataccgttttcaactgatttcgtgacaaaatcggctacgacatcatcagcataattcttataaccaagcaagttctggccacgcagcaacatctgcaacttggtgtgcttgactgcttggcgaattttccgcagtcgctcccacgggtcttcgtttaaatagcgtagacaagcatcaaacgtagcgccaccccacatctccaatgcgtggtagccggccgcgtccattttatccaaaataggcaaaatatcacttgatggcatccgggtagcgatcaggctttgctgaccatcacgcaaaactgtttccatgaattggactttttgtttagccatgtgtggtccaaccctcctttatgattgcttcaactgccgcttgaacttcaggcaatccgtgtcgacgtgagcgcgcgcaggctttggcgtctccgccacaaaccaagcaggctcgcggaggtaacttaaaatcggtgcgcgaaacctgatgcagttcttcaccttgcaacgtgaccacatccaagtccagtaagtcacaaaagcgttgttgctgctcaaatccgatcattcggcgctttaaactaaccgggtccatgtgcaccgccaagtaagcttcagggccagttggtaacgattcgatttgcatgccttgcacgtttggttgtaattgatcctgcaaggcttgcatcgcagctgtaaacactgtaacgacgcgttttccggttttgaccggtcccggaatccgcaacgtcacgtgtaatagcgtcgtgtccggatttgcctttaaccagtcatactccttggtcatacgcgcatctttggcggccaacatttgccctaagtcaacttgggggccatccaaaactgacaatttaaacattgtgcaccacatcgattaaggtaccatcacgatattcaatcaaagcaaccaccttgtcgccatactgaatagctgcaggcgtgcccgtgatctgataggccatgttcttgagtgcttcaatcgaaaattgtggcaccttcaaatccttaaacatttcaatcagatctggccgggccgggttaatggccacgcccacttccgtcacaacaacatcaacactggctcctggggtcacaacggtattcacattttcgacaatcgttgggatgcgtccacgaaccagcggcgcaatgaccatgctcattttgcaggcggcacttgtgtcactgtggccaccggatgcgccacggatcacgccatcggaaccggtaatcacattgacgttaaagtccgtgtcgatttccaacgctgacaaaatagcgatatcaagctgattaatgaccgcgcctttgctcaacggtgacgcgtacatgttagcatcaatttcatagtgatcggcattttcaccaagcgagactgcagatgggtgatcgaagtcctgcacgtcgatcactttttcaacgagcccctctttcaacaattcaaccatggagttggtaatcccgcccaaggcaaaacttgctttgatattttgctgcagcatcgcctcacgcaagaagcgggctacggccaacgaagagccgcctgtaccggtttggaaggaaaagccatccttgaaataagcagatttcgtgatcacttcagctgcatattcggcaatctttaattccttagggttcttcgtaaagcgggtggcacctttagcaataccggtcgggtcgccaatcgcatctacttgaaccacatagtcgacatctgtttggggaatactgatcggcgtgttgggatatggcattaggctgtcggtaatggcaaccacttgatcggcatacttggcatcaatcatggcatagcctaaggaaccgcaagtcgctttgcctttggtaccgttaatattaccgtattcatcactacttggtgcgcccaagaacgccacatcgatatgaatatcgccacgagcaatagcgcgagcccgtccgccgtgagaacgaatgacaaccgggttttgcatgattccgcttgaaatagccgcgccaactttatcccgcaaaccggagctggtgatgttggtaaccacaccatttttaatgtgttcaatcagcggttcatgaacattggcaattgaactaggggcgatcgacaggtttttgattcccattttggcaatttcagccagtaccatattcatcacatagtcaccttcgcggaaatgatggtgaaatgaaatggtcattccgtcttttaggccggttgcgacaatggcatcatgaattgacgccactagtttactgtgatcaggcttgacgggtttaatgtggcgcgcatgttcatcataaggttgaatattggcaaactcgccaccgaaaacgccatattgatcggcaaacggctccgggatttcacgattaagcttattcttgaccatcagtctacctccattcctgacgccttagcgagcgcaatcgtgtattgagcacgctctaccactggcttgtcaaccatctgaccattgaccgaaaccacgccggcgcctttagcttctgcttcttttagtccggcaacaatttcccgagccttttgaacctcagccaaagcaggcgcaaacacgctgttgatgaccggaatctgccgcggattaatcacggatttgccatcaaagccgagttgcttaatcagctcggtttcatgacgcagaccttcttcgttgtccacctgcgtgtaaaccgtgtcgattgcagaaatgccggcttcacgggcagcatgcaaaataaagttgcgggcaaatgacaattcggcaccatcagcggaacgatgggtatgctgactggttagatagtcttcggcgccaagtgcaatcccgatcattcgtggggatgcctgggcaatttcccgggcattcaataccccttctgccgattcgatggcggccatcatatgggtcgtgccgtttttgataccgtactttgcttcaactgccgtaatgaccgcatccacgtccatgatgtcctgtgccgtttcggtttttggcagccgaattacattgataccgccaagcaccattgcctcaacatcctgatcgccgcctgcatccaaggcattcacccggacaacggtttcaacactgctgtaatcaaaagttttcaatgcagaatagaccagcattcgcgcggtatctttttcttttaacgaaaccgcatcttcaaggtcaaacatgatggcatctgccccataaatcggcgcatcacgaagcatgcccggattagcgcccggaacaaacatcatggttcttcttaatttatccatgcgttaatctcctcccagtcaaatgtcttgttgtcagcagcgcggtaagccgccgcaatggtgcgtgctttgatcgtacaatccagtgcacctttgtcattggcttcaaccgcaacgttttcgatcgccagttttgcaagtgttgctttgatgaccgcacgaatttgttcgccaaattgcttttcaacactgctttgcaactgaatcgtgataccgtcagcggctggtgcaagcgtgatttgaatatcacttgactccagtgtcccagccgtaccgggatgattaattttcatgggttgatcgctcctttatttctgtataaacctctggataaacgagttgttgcaccgttttccaatcctgttgtgcaatcgccgcccgaacccgcgtggcactgacaacttcgccagcaatctgcaagcgcggaacaacaatcaattcgatggtgtcaccaaaagtggcggctaattggcgattgtaaatagcggtcacgggtgacaatggctcttcaccgacataacgccgggtaatgtctaaaatgggggcaattcgctgtttaaaaagcgccgcatccaattcggcttgagcagtcgcaattgccgcatccgcctgatccttgagaaaataactcggaaacgtggtattcgacaccatgtaatcagcggttggcaacaccacgacattcgcccagcgtgaggcgattttttttacgaggcccaagcgttcggcagcggtgaaaagcgagcgttcggctgacagcacaaagacgtaaaccacggcattgtccctagctgcctgctcaatcagatacgcatgaccgcgggtaaccggattggcgttcatcacaattgccgcaaccggctgtcctgagtgctgatgctgctccaacaatgccgtgtagtcagcaaaattaggataaccacgttcgagcaaaaccaccgtgtctgttgccactaactgcttaaagcctaacgattcaaaaaactttttcgtgcttggcttggtatagacaaaactatgcgtaatcgtctcatcatccagccgatccaacagtgcctgaataatctgtgccaacagattttcgtgctgagcatctggtgacaccgcaacctctttaatgatgttgccagctaatgaaccggttgctaataacgcaccatcttcgaaaataccaactgtaaaatcaacgtgttcatccggcgttaaatcagccgcacgtaaaagcgtttgccaagccgttttttcttgcggattcaggtcaaaccaaatacgttttaacgttgccatcttacttcgccgctttatcggctggcgcaaacttaagcagtaatttggccacaatatagataatgaacaaaacgataaacacgccgcccataccgaccaacatcaattcaccagcctgttcaactgctgtgggatcaaacttcatgatagagacctcctagtaaagtgagtgtgagctggcgcggttagggatcggagtgtaagcggccttggacgtgatggccggggctttggtcattgcgaccaaggtccttacacgcagatccctgcgccagcgaacgcgttatagtgagcgtgaaccagcgcgggtagacttccgcacttacaaaccacatcaagcgccaaagaatgacaacaatagcccaccagcaatcactgagccaatttgaccagaaacattggcaccgactgcatacattaagacaaagttctgcggatcttcgtcagtggccattttctgaatcacgcgactcgacatcggaaaggctgaaataccggccgcaccgatcattggattgattttttcttttcggaaaagattcaacagcttagcaaaaagaacgccgccaaccgaatccatgatgaaagcaaacaaaccaaacgcaataatcatcaatgtttgaatatttaagaactgatctgcctgcaatttaacggaaatggttaagcccaagagaatggagacgatgttgaccaattcattctgcgcggtgttggaaagccgatccaacacgccgcattcccgcaacagattaccaaacatcaagaagccaaccaatggcagtgaaatcggtgcaatgaagccagcgatgacggtgatgataatcggaaacagaattttggttgtcttggatacgccttctgccttatacgtcatccggatgcgacgttcatgcttggttgtgactgctttgatggccatgggttgaataatcggcaccagtgccatgtacgaataagccgccactgtgatagcccccaacagattcggcgccaactggtttgaaacaaaaatggatgtcggaccatcggcagccccgatgatcccaattgaagcagcctctttaatgttgaagccgaagaatactgcaacaaaaacggtagcgaaaataccaaactgtgccgccgctccgaaaagcagcataaacggattttgtaataacgggccaaagtcaatcatggcgccaatcccaatgaaaatcagcaatgggaaaagttcggtgttaatgccggccttgaataaaacatccagcaccccttctgccttggtgcccccaacaacttgagttaaaacgccggttccgggaaaattcaccaaaatggcgcccagtcccatcggaaccaataaggtcggttcatattctttcttgattcccagatacatcaggagtgcaccgatcaacatcatcgcgatttgacctaatgtgatagtggtgattccgtgaatgagcgcttccataagcttcctcctccctaaataatgctaataagaccgtcaccggaattgacactttgatttagcgttgcgataatatcgcccaccgtcccggctttaggcgcgacgatttcgttttccattttcatcgcttctaatatcatcaagggttggttttcggtgactgcatcaccacttttaaccaaaatcttggtaaccgtgcctggcatcggtgccgtgaccacttcaccttctccgcttgccgctgccggcgttgctggggcgggtgttggtgctgccggtgccggcgctggtgtttcagctgcaggtgttggtgccgcagccggtgctggcgtcggagccgcggcagccggtgtcccgccgatttcttccatttcgaccaaataggttttcccatcgatcgttatcttgaactttctcaacatcttcttcagtccacctttttcttaattgacttgaccgcgtactgagcatcgccatcaccagcagcaatcgcactggcaattaaacccacacgcttagcttcgggattttcaacgtacagatgtttcaacaccagctttgcatcaggtgccgaatccgcagtaactgccgcggcaattaggctggcagttaactcggctttaggatcaacctccaaaaagttcggcaccgtttcccattgtgttgtttcgaccggagccgctactttcttcgttgtcggttcaaccggtgtctgcggcggctgctttttacgatgcaaccatccaaacataacatcacctcttctcttaaagtgagcgtgagtcagcgcgcgagacttctgcgctgatgaacgcgttatggtgagcgtgagtcagcccgcttgcgaacgcgcgttattaaatagcgcaacccgcataactttgatagatctatcatacggggaaaagccaatcacaattggcttttcggtgtcttttttcggttaaatgctatttttgcggcaggtagaacggcacgtgaccaaagagcataaccgtcaccacgaaaattgcaaacacgcctaatgcatattttccggcttcgcgttgccacttacccatatccaagccggttagccgcagtaagaggtagatgaaagcaaccaatggcgacagtaagtggaatgcctgacccattaatgaagccaatgccatttgcatgttagtaaacccataggcacggccggcagttgccaaaaccggcataacgccgaagtaaaaaccatcattacttaagaagaatgtccctggcgccgaaatcaatgcgatcacgagcccccagaagccagccatagaatttggaataattgcggtaaagctcttagccaacgcttctgccatcccggttccttggaacagacccatgaagaccccggctgcaaacaccagaataaccacttgaacggcatcgccaccattagcgccgatccgtttgctttggtcgcctaacttaggatagtttgccatcaatgcgatacaggttccgaccaagaacagcaacaatggcggcattgcaatggctttaataaaggaacttgccaccaaccaggcaatcagaacaatcgtcaaaataccgttaaacaggaacatattcgggcggcgaatttcagaaacttccggatccactaccgatgtcatttcgtcaatttcttcatcggttaactcccgaactcccaagcgtttccgttctgcgcgacccatgtgcggtgccacatagaagatcacataagccagtgccaaaatcatccctggcaacaggtaggtcaaaatatccgcatcaacttttaaaactgccattgcccgtgcagttggcccaccccaaggcaataggttcatgatggtattttgcagaataatcaaaacacccaggttcatcatattcatgttgagcttcttataaatcggaataaatgccgagcaacaaatcaaagttgtggtcgtgccgtccccgttgagtgaaacggccatcgcaacaattgcggttgccatcagcactttcattgggtcgccttttgcaatcttgatcatgcgtgccgtaatcggatcaaacaaaccagcgtcaagcataatggagaaataaagaatggcgaataagagcatgatcccggtgttagcagtcgtcgtcagaccttttaacacgaaatcgcctatcgttcctttctttgccacgccagccaccattgcaataatcgcaaataatagcgggatcataaccaaggaagtaaacggtgaaagtttcttagtcatgatgacgtacatgaagacaatgatcatggcataagcaatgacggtgagtaacatagtcccaacctcttttcataagtttttatcgctgccctcatattacgtgatattcgtcactaaatggcggtttttccccgtttagaacacgaaaagaacaatcgtcgtttgaccgcaaaaataaattttttcaaaaagaaagcgcccccattggcttaaaattcgcttttaagtcaatgaggacactttagcaaaggtgtgcagattagtttgaaaagaggctatagctattgttacatagttcacattcaactaatacagaaacaaaattctgtatcagtctaccagtcctggaagcgttcttcttccaactttttcaataactggttgaaattttcgcgcgatggactatgactcagtgtttcttcctgaagctcgttaaaccgctctgctaagtagtaagcggtcagataaagtgttagcttccgtttaacaattgtttccggatctttgtcatcgggtacctggtgtgaaccaacaacaagattagcgaactgtttcggatttaaccgtaaatcatccggcgaatcagccttcatgatataacccccttttcttaagtatgcctaatactaacataaaaaaagaacgcttcttgagaaaaaacgttcattctcggtcaacctgatgtgggcattcgggttaggaactttcgtaaaatttttccagtgagccaaacccgactaccagtggggtaaaaaagtgcgcccgccgtgaatgctgctaatgcgtcaattcgaaaaataaccgggtgcgcatcatggcgcgacccgacttgtttagccatgtcaagatcactagacaaatggacaaaatcacgattcatcggccgcaacccctcactttcaatcatgatggccgcctgatgggaagtcccatgatacaaccaagtaggtggtttgctggcaggcattagcggtaaaaccggaacactatgaccatatactgcccgaatcttattaccttcaagcgcgaatcgccgcttatcgctttgacgcatcatggcagccagtacctgtcgatctaaatgcatctgataatgtgtgttaaaccgttggatcaaggtgttcagatccacgcggccatatgcatcaagttttaagccgagtctttccggatgatggcgtaaaataaaactgagaagcttactgatcttcacaagttgtttgtccattgctacataccccattttcgccaaatccaatgagactaaggaaggatcaccttgaaacttaatttatccactgcacgcatgtccgatcttgatgcaatcatgcaaattgaacatgccggattcaccccgcaagaagcggccagccgtatcagtatggcggcgcgcatcacgaactatcccgatacctttattgtcgcccgggttgcaaataccattgtgggttatgttgtgggtccagccactttcaagcctacaatcacagatgatctttttacggatagtcaacctaatcagcccgctgccccttaccttgcaattctcagcttagccgtggccccaaacatgcaacaccatgggatcggccgccaactactaactaagctgactcaagttgcgcaattgcaaaaacgcactgcgctcactttaacctgcctatcacgtcttatccctttttatgagcatgtcgggtttcataatgacggccttgcagcttccacccatgccggtgaagtctggttcaatatgtcaaaaccagtcaagccccttgcaaaaatctaggttgctaactttggcgtagatgctgtcgcaaaatcggtgctgtttctttgactaaaaaaagcgacccgtcagcctgtgccggcaaactagcacccaaatcgcctaaatcaaacggctcaaaaccaattgcccagattaacgccgccacttgcttcttagcctgaggatcgtcaccggcataaggcagtgcaatgcgatccactgattgattgggacgtgtgagctgtgcaaataccgccatttcaattgaattaaaggctttgacgacgcggtgtgaatgaaaatgctccgcgaccatttgtgacgttgctttttgatgacattcaatctcgggaatccgttcatcccgatctggaaagtaattggttgcatccacaataatcggatcattcccgtttggtaacggtaacgctttgatagcaaaaaacggcaccgccaacacgactaaatcctgcgcctctgcctgctcaactgtacctgttgctgcccccaacacgcgtgccaaatcatctaatgcatccaccgaaccgcgatgagccagcacaacggtattccccgcccgcacaaaaagctgcgtcaaaacctgaccaacatcacctgcaccaatcatcccgattttcattcatcatcacacaccttcattattcattaattatatcgcgccatcgctttttgaggcaaataagcttttatatccttgttatgcgtgcagatattacatcttttataattatttaatttagcagacagactgggccagttgtctcttttccactattatggtttacaaactagtcaagtcggtttaaactactagtatgcaaaacatgctagttgaagggaagcgatgcacgtggcagccgacgcgaacagtcagatgctgaaaggaattttacaagggtgcttgcttattttactggcgcgaaaagaacaatacggttatgccatcagtgaatcgcttgatcttttcggatttggcgatgtccccaaaggcaccatctatccgttattaatgacgatggagaaaaaaggcctgctagtcagccacatgcgcccgtcaccggatggcccgcagcgcaaatactatgccgtgacgcctttgggagaaactgcccgccagacttttatggtgcaatggtcggaacttaaagatcatgtcgaacagcttattgccgatcgaccggagaaataaagcaggttataacgcgacaataccgccagacctagggggacttgacgatgaaaaaacaagatcaggcagttaagaagatggttgctgagaacaatgaattacgtgagcagttaaccaaggaaaaccgtgagtattacgagaatctgctggcttacttacgaggaaaatctctattgcgcgatgattatcaagtcgagcaaaatttgttaactattttgcaggacttaattgatgcccaagcggatggggttgatgccgctgcttattttggaaagaatccagaagcaattgctgatgatttgctgaagacgattccgctcaatctcactgactttttctggtttaatttaaaaatggtgttcatgatgctgtttattttctggatcccacagttggttagaccggttatgatcgttgatatcggtatggcacttctttgtggcatcattgctgttatcggcagctggggggttctttggcttctggcacatcacgcttttacgaaacacccccgtcttgaaacaatcgaattaatagtttatagcgtcattatagttatcgttttgtttttcatatctgttttttttaaaccggctggcgaatcaccctttcctcgcaaatatcgcttgcagttatcgtcttaggtttagctattgctattattttcccgttcgtccagcatctaaatgagctcaacattttcttctacctgtacgtttcgttctacttggtattgggtttgcttctgcgcctcccacaaacccggccgtttctaacagctaaagccaacttaggtccgtggaaatgggtcgtcaccattggtctagtactcttttcactcgcgattgtgggcttcatttactggttttatcaacgccgccatcaagactaaccgctgcgtgtggagagtattggtctgagaattcgcgccaacgggttttctaggccgcaaattcagctacaatagatggcatacgttccaactgaaggagtgactattttgatccctaatgaaaccatccggcaccagcttcaccaccgctcgattcggcaatttaaaccggaacagcttagccaacaaacgatccgcacattgctggatgtcgctcagcatacagcaagttccatgtatctgcagctgttttcggttattcatattctcgatccgcaaatccgggctaaaattgccgagattagtacgcaggcctatttaaacggtcctggggaattatttattttcattgctgacctgaatcgcgttgcctccttgaccgccgctgccaatcacccgcttgatcgcgtcgggcggatggacaagtttctccaggcaagcgccgatgctaccttggcactgcaaaatatggtggtggccgctgaaagcctgggtcttggaaccgtcacactaggcagtattcaaaatgatgcccaagccatgatcgatttattgcatctgccgaagtacacatttccattgttaggcttagcagtgggtttgccggctgaccagccagacgaaaaaccgcgcatacctcagtcgctggttgctttcaccaatcattatggtgaaccggcgccaaaagcagatgtactgagcgactatgatcaaacagtgcataattattacgccacccgtcatggctcccatcgtgaagagacttacaccgatctcgccgtgggtgccggaagctataccccggccaaacgcgctgatttatttgatgtgatgcgtcatcaaggcttcttccctgaaagctaaccgtttgtttttctttttggttcacacctatattgtccaaaatactaaccgtttgatgaggtgatcaagcggttattgttgtgtcttctgttgagcatttaaaatggataaagaattattgacccaccagtcaatttttgttgactggtgggtcaatggcgactatacttcggttgaaatgagcgatgattgactactgtaacgaaaacatcggttctcggttcggtcaacgacttggtatccgcacgcaccataccgtagaaacacgcgctgactcacgctcactttacttaggaggttagtcatgacaataaatgttatcgaacttgaccatattcaaaaaagatttggtaagtttgaggctttaaaagatgtcagttttacgttgtcgtcaggtcagattttaggctttttagggccgaatggtgctggcaagtcgacaacgattcggattattttggggttactaaagaaaaccagtggctcggtcaccgtgtttggcaaagacgcttggcatgatgatgctgcgattcatccgcggattgcttacatcccgggcgatgtttatctgtggccgaatttgtccggcggcgaaatcattgacttgttactccgcttaaacggacgcactcataatcaaaaaaccgatgaactgatgcaacgattcgaatttgatccgaagaaaaaagctcgtacctactcaaaaggtaaccgccagaaagttgccctcattgccgccttgtcacaagacgcggatctttatattttcgatgagccaacgtcaggactggatccgttgaacgagcaaacttttcaacaagaagtgcttaaactcaagcaggcgggcaaaagtgttttgctctccagtcacattctgtcagaagtggaacgaatgtgtgactcgattgtgattattcgtgacggcagcgtgattgaaagtgggaatctcgctcaaatgcagcacttatcgcgtttacgtgttgaagtcacgtcgacaacggctttggatagtttgacccaatcaaccggtattcatgagctgacctttccagagagacagcacacgaaggccattttcactgctgatcgcgatgacctaagtgcgatcatgcaaaccttggccagccacgcgatcctggatttgcaagtcacgccgccaactttggaagatctctttatgcgatattacgaaaaagaaggtgctgatcatgcggcacaataatcgtcatgctggctacctattccgggctaacctgaagcaaaacttcaaattttccggcatttggctcgtgattctcatcatgatgatcatcagtggggccgccaaattggaagcagcctttgcaaacggcacggctggggcgaaggatatcgtcaaaatgttgcaagcaccaggtatggcggcgatgtttggcgccacgccaaaagttgctacctaccactcggcgattatttttgctggcgttatggttgtgttcatgatcatcctgcaagcattgtgggtcatgccgctaatgattcgcgacacgcgggggcaagaagaaagcgggttactggaaatggtgcgtgcacgcaatgttggccgcaccgctgctgttactgcggctatttttgaattagtttttagcagtctcgttatgggactcacctacttgatcagcctgctcgccattaaaatggatggtgcgacccttgcaggcgacttgctatttgctttaggaatggtcgttgctaatctggttttcggcacaattgcactactatttgcccaacttgccaataacagtcggaccgccagcatgctgagttatatggtactcatgattgcttatctcatgcggctagtcaccgatatcaaccatcaacagctgacctggctttcaccaatcggctggtttgaaaaagctaacttttataccgacaacaaccctgtacccctgcttttagggcttatcgtcagcgcattgcttgcaggcgtggccgtcatgatcgcccagaaacgggatcttggcacggggatcattgctgaaaacggtggccgtccgcgagcggcaaactggctgcgctccatgcctgctttagtctggcgcaccgaacgcggcttgttggctggttggttagtcggggccgtcgtttttggcggcgtgatgggcagcgtgctcggcggtgtaggtgatattctgaaaaccaatccaatttatcgaaaacttttagatgtcagccaaattaacgctgccaatcaaaccatggtgctttcgtttttggcgatgtacatgggcatttttgtggctttggcggtgacagcgggcgttcagattgcctttcgactcaaacatgacgatcagcacggctatctcagcatcattcacgccgaaaagccgacccgcattttaatcagtgccagttacaatggtatggccttgttagctggcgttttggtgctgacagttggcttactcgccttgtttttcaccggcaatcaggtgctgagtcatccgctgccggcgaagtaccttggtcgactctttattggtggcattccagctgtcttggctttcattgcgttaggcatcgccttgtctggtttatggccgcgcctaagcagtcttttctggttgtatatgggcgccgggctgattgtgcaagtcttccgcggcttattcgatttgcccaaacacgccgccgactttacgccatttggctggattgcggatgtcccactcaaaacgctggctcaaccatggctgtccgtgatgctcattagcgccattatcctagtcatattaggaatggccggttaccgcagacaggacttgagcgtatgaaaaatgtcgtcaatgatccgcaaaaagtcacccgaattctcgcaacggctaccaccgcttttggccaacaaggctttgctaaaaccaaaaccgatgatattgccgcaacggctggtgtctctaaaggccttatctttcactacttcggtaacaaacaagacctttacctagatacttttaaaaccgcgtatcatcgcatttatgatcatatggacccccataaatggcaggacgcaccgggactagcgacgatgatgacacaggccgttaaatacgagatgcaactgcagctgaaatttccggacgaatatcgcctcatgatgcaggcttatgccgacttaccgcattttcctaaacccttacagcaacaaatccagcaagaaacccaggcaatttcggctgaagccaaccgcattttccgccaaaaaatcgagcaacttccgcgccgggatggtgtttcggttgctgacatttttagtgtggtttccgccgtcattgcccagcaaacggctaccactacccggatgattgcaaccggccattaccgcaactttgatgatttacaggttgtcgtggaccagatggatcgtcagttaaagattatcgagcatggttttttacctgattgataggaaagtcggtttagcttctgattgttatcatttcgcatcgaatggccgcattcaaaccttgcaaaccaagtcacccacaaaaaagctctggcacgccgctaccgcacaaaagctagcgagttgcctgagtttttttacctgtttaactaatcctgacttttagtagctttaaagagtcgcagatacaacccaaaattaaccaacccaatcagaagcaacaagccaaatgccagctgactgccgatcccgacgttttgagcatgggttaaacccggaacggtcacggctgtcatcatgccggccaaaaccgtggtgccaattgagccggtaacttgttggccggtactatacagcgcattggcgtcgctttgatactgatgtgccatcaccttcagtccataagccgtactgttaccaaatgccatcgagcggccaatggcaaaaatcaggtacagcaccgtgacccatagcacgctaatatgccgcccccaaatcgtaaagcccatcatgcccagtgtaaacaaactattgcctaacaagagtggcagccgtccgccaaaatgatccagcatccacccatatacaggctgaccaagtccattaaacacactgccaggcaacaagattaacccaccgacaaacgcgctggccccatccacggtttgcacgtaattaggcagcaagaagttaatgccgacattagaaaactgcaacaaaatgtaaggcaaaaagctgtacaggaagcccgcgtcatgaaaaacatcaagcttaaacaaagctttggcatgatgctttgacagccacaggaaaaccagcatggcaaccaccaccacaaggccagcaacaccggccagcgcccacgttcgatcactcaccccatttaaaccgaccgtcagactgatcagcgccacccccaacgcagcaaaccgcaaccagtcaaacgcgaatgcggaagtaggcgtgtactgcttaatccgcccttgtcctaaaattaataacattaaggcaaacggcagcgtactccagaaaatcatgcgccaatcaaaaaagttagcaactgcaccgccaaaagttggccccaaagccggtccgatgagaatgattaaattagcaacgcccatatacgtccctaacttgctggtcggcaccgtgtccaaaataatattcaccatcagcggtccgcacaagccaacacaacccgcctgcaccaatcgtccgatcagcaacacccagaacaccggcgccaatgcacacatcaaatcaccaataataaagagcaacgccgcggtgataaacaattggcgattggtaaagcggcgtttcatatacgctgaactaagcatgaccaaagcggccgctaataaataaccggatgtcacccactgcacggttgtcaacgacacatgaaagtcatgcatcaacgttggaaatgtgacattcatcgaagtttccgtcaaaacgccaaaaaacgacattaaggcgacaatagtgatgacgaataaggcgtggcgagtattctgttcttttgcttcaatgattgtttttgtcatgatcgacccttctgtatgcaactgccggctcgtcagcaaaccatgctggcaattgcgttatagtttcatgataggccggattattttcagtaacaacattgaatttcggcttgattggtgaaaattccgcttttggattgcgggttgcgatgaaaactacttgtgaaatgaggtaagataaggatacttgatacaaatatttttatggttttcggttatattaatcgtgagtgaacgtaactgcgcaggttcggtatagaggatggttcgcatgtcaacatagtgcgttcttcagtgcaaaaaccgggctggctcacgctcactttctataacgcgttctccagcccaaaaacctgcacataaggaccttggacgcaatgaccaagcccgggtcatcacgcccaaggccgcttatgctccggtttctaaccgggctggctcacgctcactttagtttaggagaattttataatgacaattatcttagtgcttctcggcttcttggtcggggcatttattatgaccatgggtggtggcggcggtgctttttatcttggtattatgaccggcgttgcacatctttcgccgagtactgcggcggcgacatcgctgtttacggcgattccggcgctggcggtgggctgttatagtcactatcgcactggcaatatgcgttttcacgctggcaaccggattctgctgacggcggtaccagcaaccgttgtcggtagtctggccgcaccttacatcccggaactggtttattcatgggcgattgcgatcattttcatggttcttggcgttcaaatgttgcgccaatcctttgggcgtaaagcaaagaagaccacccagccggcatggttcgcctatgtgcttggtatgattagcggcttaatggttggcgttgccggactaagtggtggcggcccgattatggctggtctgatgttgatgggtttggatatgccccatgccgctgcaacctcatcttatgctttagtagctttgtccatcatcggttgttttctgcacgccactcaaggaaaaattgcgtggacagtcggcggcctcctgatgctcggctcgctggtcggtgccgcaatcacaccccgcatcctcaatcgctttgacccgcgtaagttgaccgccatcttacgtccgctcctcggtttacttttggtcgtcatggcgatcgaacaagtatggtaatgattttcaacttaaccatcagttaaaaaatttgccagcaacttgaaaacgccgccattgtcttcactaagaagcaccatcataatgaaggtgatcaaaaggggtgatcatcatgcatttaaatcagattattcgcaataaacgcctggcagcaggcttaactcaggaagcgctggcgcaaaaagtcggtgtcacggcgccggctgttagtaaatgggaaaaaggtatttcctatcctgatatcacgttgctgccgattctcgcacgcaatctcaacacggatgtgaatacgttgttggacttttcggctgacttagatccagctgcactgcgtcgtttctatacgaaactaaccgcaacggcccaaaaggatggctggaaggcggcagttgctttggttgatgaagaactacgcgaatatccgtctgtaccgcagctgcaaatgatggtaccagcgtttcttcaaggtttaaaatctgacatcccgacaaatgagtggccagcagttcgggagcgaattattcaactttaccaagcaagtgaacgaccacattcaagtttgccagaagcccagatcgcagcggaagggttattccaattctatttaagcgagcacgaattcgatgcggcggaaaagcagcttcaaaatctaccatccgaaaccgttgcttatcaggcgctgaagcttaaactccagttgagccaaggacagtttgacaaagcttatgttgatggcgaacagctgcttacaagcgatttctccgcccttaccattgtcctcaatttgttaactcaagttgccattgccgatcaccaactggccacggctcagctttatgtcgatacactcctcaagtttgatgctgttttcaatatgtacagtccctgggcaattgattcacaactacgactcgcaaaagctgccaacaaacctaaagaagccatcgccgtacttcaaaagtccatcgacaagcttgatcggaaagttccggcagttctaaagcatttacctaagcttaagccaatcgcatcacttacagaagcccaaaaacaattagcccaaagctttgctgctgatccggaactggactatttaaaagacgaccctgaatttcaaaaactcatccaccagtttgatgcgtaaaataccttttggccaattaggcttttaggaactaccaaactgcaaataaaaacctcaccgcgaattttcttgtgatgaggttttttgtttgtgctggcgatccttaatggttaatcttccccgtacttaagaactcatacaagtaccgattcaccagtggattatgctcgtgtaatttactgtgttgcgccttgctgttggtaatctcccgttcggtgtaacttttggcacgatctgttacaaggtatcgtaatgaccgggctgagttaaccggcacgcggccatccgagcctttcccaagatttccatacaggttcaaaaccgcggctgttttgggaaaatactggcgatgctcgtacatcggtttgtaccgatccgacattgtacttggtcggccatcgctagccagcttaatatcaagaccactattcatgccgcccatccccggaaagccattgaaaggtccggcaatcgtaatgagtttctccaatgccggcgtcccttttttatccggcatgagcgaccattcggcccaagccgtcgaacccgcagaatgaccgactgcattaaaggccttaacgccatatcgcttcttgacttgttttagaatcttatccagcgttgatgcatctggccggccgctactaaacaccaccgcgattaacggatgccgaatacttggcgaccacgatccactaacgctaagctgtccggtgttggtcaccgtatatcgtaggacttggcggaatccgggatgtttgctgagatcgttaatcatgtccttttcagaaccatagccgccaccaaagccgtgaacaaaaacggtaggcgtctggtaggttccggcaacccgtttggtcgaaggggttgccccgcgattcagccacagccacgcgccgccgctgacaaccaaaaagatgccaatgataagaaagactttagcccattttttcgtcatcattcgcctcacttttccccagtagttcttgctttgcattgtaccacgcttaccctgattttgaggtttaagcctcttaatttcaaaatagttgtcaaacttccttggcaacgtcatcgcttaatgctatagtgtaatagatagctaatacactagtgaggagggacaccgtggaattcgatgataaggtgccgatttattttcaaatcaaacaatatctttatcaagccattattaccgatcggctcaaatcaggcgcgcaactgccggcggttcgccaacttgccgccgagttaaccgtcaacgtcaacacggtgcagcgtgcgttaagcgagttaattcaagaaggcgtgctcgtgacgcgtcgggggcgaggcaatttcgttactgatgacattaaagtgctgatcgacatgaaaaaacgcgtcatcggctccgaacttgaccatttataccgtcaattagccgacttgaatctaacggccgacgaaatgaaggacgctttttctcagtatgttgacgaacaggaggaacaccatgacaactagcatgatttcagcagaacatcttacttataaacgcaatcgtcacctgattttggatgatcttaatctcaacgtccaccaaggccacttcatcggtttgcttggtgcgaatggagccgggaagaccaccttgatgcggctgttaaacggcttggcaaccaattttaccggcaccattcaaatcggcgcctcagaaagcattgtcgatcgcaaacaactcagcagtttcagcgaatcactcaaaggtgtcaacgccagccgcacccttcagcaaattgccatcgattatgccatgatgtacatcgacttttctgaaaaagcgtttgcggaattcaccactgagtatgaattggatttgcaccaaaaactcaacgccctttcaaccgggaatcgtaaaaagtttatcgccgcgttgaccttggcccgcgagacccagctgtacttgcttgatgagccctttgaaggcattgacagtatgacccgcaaacgactcatcagcaatatgatcgcttggaagcccgatgccgccaccgtgatcatttcggatcatcacgttaacgacatcgtgaatattcttgatgaaatcgttgtgttaaaagataaacatattgtcgcccataagaacacggaacagctccgtgcggaaaccggcatgagcgtggaagcttactatgaaagtctgtatcaaggaggcaaaaccaatgactaatacctggaccatggcaaaagtgctgactcggcaacgatttaagactgcgctgaacacctttatcgtgaccattgttgctgctattatcaccgcaattttggtctattttggcggtgattcgcaactgtcagcacaattctttttcagtatgctttccccttatgtcctgtttggtagcatctacttatttatccggcttgccatcaaacaagaacatacttgggtcaacaattattaccgcgcagtgccgaccacaaatctaaagctttacgtcgcgaatttattcagcactgttgctaatttcgccttttactgcatcattgaagggcttgtattaggtggcctggaactttccggtcgtggcatgcacttgccaactgctagtgcctggccagacattatcgaaggcgtcattatcatcgcactaacttgcctcttcatctgggcatttgtcagcctcgtgcacatgttatccgtcaccatcatggcgttcttaccagaaactcggattcgtattgttcaatggggcatttatttagtcgtcattgttatcgcttcatatctattcaatcaactacagcgcctcttgttcatgccgttacacacttacaatttcggtgccgtgatcgctgttttcctcatcatctttaccctcatctctgctatcaacgtctacttactggaaaaatgggttgaaactaagtaacctcaccccatccaaaataattgattccaaatgaaaagcctgtgcgaccagttattggtcatcacaggcttttcgtttgacttcattcgcttgctgctggctaagtgaataaggcatttcttcatctattgcaatttaatccaattacgcttcagtttgcgccgccagtacccagtgctccggtgccgcctcgactaagtttgccgttcgtgcaatcggttcatggtcaaactgaacatgggtcttttgctgttcaaaaatcggatcggcttgtgggacagacgccagtaatgtttgcgtatagggatgcagcgggtggcgatacaccgcctcggttgcacctgcttctacgatccgaccacgatacatgacgacaattttgtcactaatgtaatgcaccatggatagatcatgagcaataaacaagtaggtcaactgctgctctttttgaattcgccgcaataagttaacaatttgggcctgaatggacacatctaatgccgagatcggttcgtccagcaccagaaacttgggttgaacggctaaagcgcgcgcgatcccaatccgttgccgctgaccgcctgaaaattcatgcggaaatcgattaatggcgtctggcggtaatccgacctgcgccaacagctgcaatacctgatccattcgttcctgatgcgagccagccaaatggaagttatcaattccttctgcaataatatccgccactttttgccgcggattcagcgatgcaaacggatcctgaaacaccatttgaacttgacgccgaaactgcttgcgttcagtacgggaaaaatgctgaatcgactgatccaaaaagcgcacatcgccgcctgaaatcggcccgataccagcaatggcgcgacccgtggtggttttgccagagcccgattcgccaaccaatcccaccgttgtccccggctcaattgtgaagctaatatgatccactgctttaatgggctggcggcctttatgaaacgtaacactcaggtcgtcaatggtaaacaatggtgctgtcaaatatcgtcatctccttttacctaagcccggctcgcgacaacggtttgtggttttgccgtcatgtccgcaaagcgatcccaccgtttttgaatcgtcactggcggctgatagcttggtgtgcgtggatcaagcagccacgagcgaacaaaatgggtaggcgatacctgaaacaacggcggtgcttctttaaagtcaatcgccatcgcataaggattacgcggtgcaaacggatcacctgtgattggtttacgcatatccggtggcgttcccggtagcgtaaataactgctcccgctggtcatccgaactcggaacggcatccaacaagccccacgtatagggatgctgcggattgtaaaagatttcattggcagtgccgacttccacgattttcccggcatacataatcgccacccgatcggcaatattagccaccacgccgagatcatgggtgatgaaaatgacacttagatcatgtttcgccttctgggtcttaatcaaatccaacacctgtgcctgcaaggtaacgtccaaagccgtggtcggttcatctgcgactaatactttcggatgcataatcaaagccatcgcaatcattgcccgttgccgttgcccgccggaaagttcatgcggatacttgcgggcaatcaaagcaggatcatcaagaccgaaatcttgaatagcagcatacaccgcttcttttaacgccgcgccatgtagatgttgatgtgctttgacaccttcaccaatttgacggccaatccgcatggtcgggttaaggccactgagcgagtcttgaaaaatcaagcccaattcctgaccgcgtaaatgggtataagtttttttgcttgcatgtaaaaggtcagtgtcaccatattgcatgacgtctgctttgacctcggcatccttacccagtaagcctaataacgcatgcgtagttaccgatttgcccgatcctgattcgccgaccaatgccagcgtctcgccttgatgcaaagtcaggttgacgccattgaccgcataaacattttcatttgcttcatgaaatgtcacgtttaaattcttaatggaaacaatatcagtcatgccgcgcccctttcatgaattagtttagccattttactgctttgtataaacgattctagatcgcgttgcttgtcagtacaaatacaaatcaattaacgcaccacccagcaggttaatcgctgccacaagtgccaattgaccatttccggggaggctgccaagaaagcgactggttaaagcagcatgcggtcgccgcgtgtgtagcagtaatttaatgccgactgcaagtaacgctaagccaactagcagccaaaaagtttgatgcaacccccacagcaaggccactaacgcgggctcatgcgtcagggaaaagccggttgttgtgacaaacaaaccgacaaataaagcggtgatgacttgccagggatgtttttgaatcatgatggtcctccttcatacttctcatcgcaactgcctgagcaacggcttttgggtgaagtcttcctgacgaaatacttctcgttgccggcagtcggttcaattagtcctgaaactttggatccaacgcatcacgcaagccatcccccagaatgttaaacgcaaagacaatggcgattaaaatcaaaatcgggatgtacagttgcagcggatgttggagcatctggtcttgaccattagcaatcaaaattcccaagctcgtattcggtgcttgaatccccagccctaggaaactaagactggcttcaccaaaaatgttatccggaatgctttggccaatatccagaatcaaaatactcatcatgttgggaaccagatgccgcgccataatccgccacaacggtgtatccaacatcactgccgctgtaacataatccaagccccgcaactgcatcaccaatccgcgagcctgacgcgctgatcctgaccaactggtaaccgccaaagcaaaaagcatcgtccacataccattgcctagaaccaccataatcagcatcgtaatgagcaagcctggtaacgaattaaacacttcaataatccgcatcaagatttcgtcaacccagccgccaaagaaagccatgatcatcccataaatggttccaaaaccaatggccaaaaaagtgctcaaaatagcgaccatcaatgacacctgaacgccaatgcaggttcgggtaaacaaatcccgacctaagcgatcagttccgaaccagtgagcggcacttgggccaacattacgactgttaacacgaatgaggttaggatcataatgttgaatctgtggaccaattaacgccgccaatacgattaagatcaaaatgatcccccaggcaacagcaagtcgatcctttaacaacttttggcgagccgatgcccagaaactgatacttttgggagcatttgcttcgatggtcgcgacttggtctggctcggtcagcacagttggcgtactaaaattgccacttgcctgaacaaaatgaaaatccgtatcacttgcagccattcgtccatctcccttcagttgtcatagagtttgattcgcggatcagccagtgtatacagtaaatccgtgatgaacatcgtgacaatatacaagatcgccagcagcaccgtttcgcccatgataatcggaacatcccgattattcagtgccgtgacaaaatattgtccgacaccgggaatgacgaaaatactttcgataaacaccgatccggtaataccgaatgccaaggtaaccggcaatgacgtaataattggaatagaggcatttcgcacgatatggtgtaagacaatttgcggctctgacaatcctttcgcgcgtgccgtcatgacatactcacttgagccaacatcgaccattgaatttttcaataaacgcgcataacccgcaatgtagccaatgccaccagcaatggttggcaggaccgtataaatccagccaccccaccaagtctgatcaccgcttggccagccaataatcggaaaccagccaagtttgccgccaaaataactttgcaagagcaggcccaacaccagactgggaattgacattaagaacagtgccaaaatcgtaatgacacgatcaatccaggtgtttttataaaccgccgccaaaatgccaagcaacaagcccagcggaatgcctagcagcatctgctgaatacctaaccgggccgatgctggcagccgatcacgaatcaaactgctcatggtcacagacgggtcactaatcgactcgccaaattgcccatgcaccatgttattcatcgtaatggcataacgttccagaaccggcttatctagaccagtgtttttatagacttgctcccgcgtggcttctggtaacttatcagtctgcgcactcaacgcatcgcctggaactgcagatatcaagaagaacgtcgcagttgcaattaaaaaggtcgatatcagcaattcaatgaaacgccgaatgatcaatttgatcataagtgtaaccacctgtttttcaaatcatggtttgtcattttctgccatctcccatcaatccgtacctacatcaaccaaacgcatgactcacgttctcggttgattactttttcgaagcataagtgtagttaaaggttccgccaaataccgttgtttgcagatttttaaccgacttattgatgtaaacctttgattgtgggttggttaacggtacgaccccgaagtctttggcaactaactgggtttccagctgtttgtacaaagccaatcgttctttggtgggcaagttgccattcagtttattatccagatcatcaaacgtcttgctgctataaccaccaaagaacttctggaagccattgtttgaattccacagactcaggtaagagttaggatctgctgaagccgaccagccattattcattaaatcgtattgattgttgttacgtatttggatgaagctggcatcatctggggccgttttaatcgttactttgacaccaagttgctgcttaatcgcctgcttcaaccaagtaccagtatcatcactgccaaccgttaaataaacaaagttcaacttgctaaggtcggtcgacttgcctaactcttttagaccttccttcaacaatgcctgccgcttagcttttgtgttgtattgagcctgggcttctttcaatggattgccgacatatttgccgtaattggtcgacccgacattcagcgttggcggtgccattgtgtaggtcaatttgtcctggccatcactgaccgctttattgtaatcatcgcggttaatggacaatgaaaatgcttcccgaaccttcgtattcttgaacaatccctgcgtcccgccattatgctgattcataatcaaaactgtggtaccgggaccattttgcgtgcgtgaaaccaatttattactctttgcaagtttattaaaatcggcaatttgtttccctgaggctgacaaagcatctaactgtccgctttgcattaatgacagcacggtcgatggcttgtccgtcgttgtgtaagtaactttctggagcttaaccttcttggcattccagtacgatggattctttttcagcgtgatcttgtcattctttttccacgctgttagtttaaatggcccgttaaagacttgatccttcacgtcagttttccacttcttattaccgacttgattaatcttgtcgaggcgaaccggataatacacaaccgaggagagatctgacaagagtgacgggtaagcataagcaagttgaatttggagggtgttcttattaattgctttgacaccaacgtcttcagcactgccttttcccgtgttataagcttccgcacccttgatgaaataggcattagtggcctgtgaaaaggcgttttctttcttcagcaaccgccggaaggaatccacatactgctgagcggtcacggctttaccatctgaccactttgcatcccgcaacttaaaagtataagtaaggccatcagccgacttggtataagatttggctccggtcaaaacgactttatccttaccatttgtcgattgaatcgccgtcaaaccttcctgtacttcggataaaatatcgttctcattagaattgcgcatatcgttgacatctaatgttgtcggatcatccgattcagttaagttaagcgtctgcgcatttccagacgccgaactactttgaccgccacaaccgaccaacaacgtcgcaagcgcagcgcctgtgataagtgctgttaacaaatgatgcttcttcataaaagccatctcctaaaataaagtgagcgtgaaccggcgcgggtagaagtcggagtgtaagcggcctcagacgtgatggccgcactttggccattgcggctgaggtccttacacgcagacttctgcgccggtgaacgcgttatggagcgtgagtcagcgcgggtagaagtcggagtgtaagcgaccttgggcgtgatggccgcactttggccattgcgaccaaggtccttacacgcagacttctgcgccggtgaacgcgttatggagcgtaaatcagcgcgcgagcagagctcgaagtgtcaccaaccttaaccatgatggctgggccctaaattggccattgtggttaaattgcttaccttctcattcctccgccattaaccgcgttataaaataaaaactggcggtgcatctaggattctagatacaccgccagtttcgttcttcgttcaagtcacgtgatttccgtcacccaagctaatctccagccatgtaaatagaaccactatgtcgttcatagcagctgcacatgcacatggaaatggcttgaataaattgggtcatcatgttaactcccttcgaagaaattaaagttagcatacgtttaaaaaaatagttcgtcaacggttaatttttaaaaagatcctcaccagcccgcctaaataacggcgacataaactgctatatcagtcctacctagcgctcagtggcttttaatcttctttaaaaaaacggccttttaattgcaaaattaataaatcaaccacagattgtactgaaaaaagactttgaagctctaaaactggccaccttgtactacaaatgaacgataggcccgtttttgaacaaaatgagtttgcgtttatttgaaactgttttaaattaaatataggtatttatttttctcatgaatttaaacaagtggaccactttcttcgtgctacggcaatttttccattaaaaaaatcgactcagtaaaacactcagtcgactttttcatcttcatgtgctcgcggttttatgcctcggtacgacggtggattaacgtccacaataacgcgatgcccgcgccgataaataaaagcgcagggatgacattagctgccgtgaacatcacaaacgccatggtcgcaaacaggccgccgatcgaaaggccaatcccccattgctgcatcgctgtcaggctggcaaaggaggtacggaaaccaagcgccaacagcaacgaaccaacaaatgcaatgaggccaaatacgatatgtcccaaaatcaaccagttaaacattctttatctcctttcttggtatcttcactatacggaaaatgagagcgcttgccaattacttttattcaaaacttggcttcattcaaccgtccatgttctaaccgcagcgcgcgatcccaaaattgttcaacatcttgacggtgtgaaataacaatcaatgcgactggtagttgacgcaatcgctgactgaggctttttgcagctgcggcatctaaatttgcgaagggctcgtctaataccaaaatattccgttgtgccaaaagtgcccgtgccaaaccaatcttttgtaattcaccggccgaaacattggctcttgtctggccatgaagcggcgtggcgagtccttctggcaatcgctggacaaatgtctgtaaatcagtctggactaacacttccgatagtgccgtctggcttacattgcggccaagcgcgatgttttgccgcaacgtatcatcaaacaaagccaccacttggggtacaaagccgatgatgcgcgcaagttggtgtgatgtttcaagagtgtccggctctacttgaacgctgcccgcttgcggtgataaaagccccaagataattcgaatcaaagttgatttaccgccaccgcttggccctgtgatcagaatcttttcatgtgccgccacatttagctttaggttcaattgcgccaaaaccggccgagatgcatctggatacgtgtaagtgatgtgtttgagaagcaactgttgtaccgagttttttggctggtgagctgagggcgcttcttggctttcagcagcaatatttctcgacgctgcttgtaccggcacaattaacccgaagattcttttagctgcaactagattccgtgataactgcgcgtactggcctggcatactgtaaaacaaccaggtaaaactgggcgtcagcattgcaaaagcagcaaattgcccgatggagataaatttgaaaccgacaaacagtaattcaacgcccaaaatcacaatatcaacgaataagcccagtgcaaaccccatgacaatcgtaccggtttgttgcaaacccatgcgatattgggaatcggcaaagctttggtatgttcggctaaatagttgcaaaccaaactgttctttttgataatcttttagaagcatacgtccggcgagaatttccaacagtgctgcttgcatccgcgcattttcagattgttgcgtgtcttgtgcctgggttaaccgaccggccatcactttaggaatcagcaaagccgtcaagcacaacccaataatgataagcatcaacggccaggagcttaaccagccaaatagactggcagcgagaaatgaaaataatccgactaaaatagccgttaccgatttgataaacaaaggtgctgctagtggcgcttcggttgtcaaactattgacccgttcatttcgagctgcaagatcaactgcaactggtccgttcattagtgctgccattaagcgtgattgcagcgtttgggtgagttgataatgtgcctgcgtttgccagcgtgcgatgagccagcgaccaccgccaatcacccctgctgctacaacagccatcatcatcaacggcatggtaagtgcacctcgctgggtcaaccgttgaatcaaccgcgctaacccaaactcaattgcggcacaaatcatggcaataatccatagcactggcacaatccgcgtactaaaaagatgccaaaactgttttaattcagtcatcttattcacccaccttaatgatttgatcagcagaagtgacaaaatcaaacgtatgcgtgatcatcaaaatgccgtgagtgtgggcagcctgtcgcaacacttgcatcactgccatctggttggcagcatcaatatctgaaaacggctcatccaagactagccacggacgatttgaaagcaaggcgcgggcaatgccgaatcgccgctgttcacccggcgataactgtgcaggttgaagaatctgattgaggtcctcagcatattttcccaacccgagtttttccagtaacggtcttatctgaggtgaagaagcctccatgtccaaaagcaaattggctgtcaccgaagcggtaaacatcacgctgcgttgcggcacaaaagccattaattcagccggggtgactttatctacggatccctgaagcctaatctgaccagatgttggcgtcaaatcgccgaggatcaatttcatcagcgttgttttgccagcaccgtttgccccaacgataaaagtgatcccgcgattatggatctcaaaattcaatccgcgtaataattggcgctcactatgcggataatgaaaagcaacctgatcgcctacgatagtcaacagttgtgccgaattgacctcggaaggcgcgatttgaacttttgacgatccctgcaagcgcggcaaaatccggttcagtgaggtccgttgttgcgcgagatagccaatggttggtgccaatcctaaaaacggccacagaatggaccccaccccggcattccaggctcccaaaacaccggcaacagattgatgcgtcagtggaagcaagccaaaccccagcgctagtgtcagcacctccgccaaataaatgccgccattaaaaatacctgccagcgccccggttgcgcctgccagttgctgaatagccggttgtgcttcctgaaaaatggcctggtgccgctgccgaatataaccaaagacattcagattacgaaccggttcaaagtttgccaaaaagttattgaaaaatcccttatgccgatcatccaccgcaattaaactggtttgtgcctgattttgacggcgaaataaatggcgtgacaccaaggcaaacaaaagcccaaatacaataaaagccacagccaactgccaagattgcgtcgcgacatacaccagtcctaaactaactgtcatgccaaaatcaaccaacggcagcacaccactgtccaaaaattgcatcacattctgcgtatccgagatcaataaattcgttgccacacctgcatccggtgcatcctgcgcatcccccgacaagaaacttgccatcaacgcccgggcgactgccacactcaagcgtcgttttaaccgttccatgacaacgcctgacagccagtagagtccggtgtagaccactgttgccccgagcatgccagcaaaaacacctaccagcatccctgtgcgacctgttaatgcagcggtcaatcccagctgaatcaacatcgaaatcgccacattgaacccatcaatggcaacccgtaaaatgaataatcccaataaccaccgtttcttcaaggcgccgatttgcatgattgtctgcatagcatatcccctcgtttcctccgactggccgaaccaatcgtaacgactacttagggctgcacaatggcaaacaaaaagacgacctctcagccgcctaacgttaatccaattttatgaccgaccgaaagtctacctgcgaagcgcatcaaagaaccctgcaccaagcgcagccccgacattaagttttgatggggtaaatcggtctttgatccgcattggaaaaagcctccgttcgacttgttattttatgatgcaatagtaccaattatttggtcaaaaggcaacgaagaaggtttgtcatttcaaaaaaatctacggtgagtttacaaacattcacatgctgtgcgtgccttttaacgttattgactagctcactgcggttagacaaaaacgacactgacaacgaaattaccatcgccagtgtcgtctaatttacttattttctaatactgccgcgaataactagcaagtagcgccactcatcataatgcccttcttaaacgctgccagcacatctgaacccttagcaattcgaacgcttccgtccaaataagcatgagcgtcatctttgatactgatcgcaccttgcttaaagtccatcgccaagccgtttgcaaagaaaatcatgtcatagtcggacgtgtaaagctgcaacccggcatcattttccaacttcacttgataatccggatccggttcatcaaggacaattaacgaaaactttgtgccgatactgcaggccccgccttgtaaggaataccgcccgccgccatcatcagcaatcaacaacagaatcttctggtcaaaatgcttcttcttcatcaaatcaacaaacgactgcgataacttgatcgttgccatcataccgtcacctttcctgttacttacttttagtttgccactttttgtaggggaaatcaattgtgcgcgaggaaatttgccattaaatttgaaacaacgacaactgctcgtacatcacttaccggtttacttgcatttaaagatccagtccccgagtgctttgagtcatcattgtttgaaattgtttaacaaaggcaggctgattgaattgaatcgtcatgccgctattacgttgaaaaccgttgtcagaagaaaaccaaagttgttcttctcctaaaactaagcagttaggtaagttgccattgtaaaacgtataagacacgtcatttaatcgtttcagctcgacttctttatattgatcctgattcaaaatgacctgaatctgtccatgattggcttggacaatcgtcatcatattttccataaatctggagagttggtttgctataatggttatcttattaaccgcgattaaatttcggcgcaggtctttttgataatcaccattataaacgcgcaatcctgactgcttggaaaactgatcttcggttatcttgtaatcaaggcgtttgtattctttaagacgcttatgatacatgcgagcaagcatcgggattgacggatcaatataatcgtaaactcgtaattccggtttggtgctcaacgaccgctgcattcggccaagaaattgaaccgcaatgcctttccacgaatatggcatggctaaaatgatggtatcgataccacttatgtctaacccttcaccggcatactttcctgtcgcaatcaatgcataagccgcctgtgtttgcgaaacttttgctacgatctgatcattttcctttgatttttggccaccataaagtttgtagacgccttgctccggtaacgcctctgccaactgttcaacatgcgcacgcaaatcggtcaataaaagaacatgccgaccttctgctaaattggcttggacatctcgaactaatgctcggttacgctgctcatcatttaacattgcttcacgattttgcgtcaggctgttatttgccatttccaaagacagcatacccaagctcgtgtagcggggaatgacatttcgctttactttaagcgcgaactggctatcaatggcatccgtttggtaacgaattggtccatagcgcatgattaagatgggatcttgtccatcgcgtcggtacggggtggcagataatccgtataagtattgcgacctgatccgcttaatcacttgatcgtaagtgtaagccgcgtcatgatgaacttcatctgaaatcaccatgccatagtccttcaagatattttgaacttgaatatctcccgtcaaagactgaatggttgcaacatcaatcacaccactgcgatttttcttattgccaaaaaacgtgccgatactgcgcttatgccgttttcgaccagttcgggttaactcagtcaaaattggcgctgtttcaacctcgagaaactgattcagtcgagtaacccattgttctgcaagcgccttgtttttaactaatatcaaagtgctaacctgatgcttggcaattaaggctgccgctatcaccgtcttgccaaaacctggacgcgcttgcaaaatgccggtggaaacttttcccaatgcggtaaatgcgggtagttgatcagggcgaagttgccccttaaatgtagcctttatgggtaatcctttaatcgtctcgtcttgccactggatatttggaatcaaaccacgcaacctatccgctaacccacgcggaagcagaagatattgatgattttcttcaaacaggctgataattcttggaacgccaaaagtcgactgacgctgggcttcacgttcatagaatttgggattgtgaaaagacgcaagatatttgagactcataatctgctggtcagtcaagcttgttttgtcaatatataaagcgttggcgtgaataatggtcagcttttggtcaataacaagaggttgttttagtagatctagctcactgtcctgatcatcgttatacagtcgaaatacagaccgattcgctaactcgttaagcaattgatcaatcgttgctgcatcaattaaaccgactcgttccaacgcctgccactgatccgctaacggtttaaacgcgtcatcgacaaagctagcaaaaccgtgcaagcggcgttccccttgcaatggcccagcaatcaggttgccgatttgaccatttcccaacacactttgactaggaaacattcgatcaaatgcggaaaacgaaatgttggtgttaaccgcacttgccgcttttaaaatcgcgtctccaagccttctcgccaatcctgctgcaacgggttgagcgaaaaagaaccaaatatgagctccttttccagactgcgataattccaccaaacaaggaatattatatttcctacacaattttttgaccgtcatcgtcaccgcttgccagtgctggccttcatgatgaccatcaaagtccaagataagttgcttagtcgtatcgtctttcagcattgggtaaaaccccaaaaattcttgtccctcaagatgatcaataagatcttgatcggtcaacggtgcataagtacctttaactggtcgtctatctttaaaaaccggaaaaggcgaataaatatctttctgtgcttttttattaaaatagcgatgtgcgtaaacatcggtgcggccaacaattcgcgcacgataaagcgctacatgagcagccaaattattccccgagcgtatttcaagttcactttgaggaattgaacaatagttgttactagcaatatcttgcagaatcacaattttacctaacttttgggcgctcaagtcctgcgcgatatttatataaagatattgctttccatctatcgtgtaggttttactcatcgtcgtcaatgtccttttccttaggcctttaataaaagcgtacccaatcaattaatattaacaactactttacaatatcattgatggttttgcacatgaaaagtaaagtaaagtcacatcaagacgactaacaaccttcaccagtttcctcaatcccagtgattaaccgaattttactccacaactcctggacagcagtcggttctttttcaactcctaccaataatccttttaccaaccacaagcgaactgttgctaaaaagagtggccgatcagcttcactaataccagctaaatggcaaaaacgctcagtatagacagatagtgcgactccctgcctcggcataaaaccatgataaagggccgctaagtccaaaaaacgcggaccgcgacgagcttgtccaaagtcgatgataccaacttgcttattcgtcattgtgagcaagttccaccgtcctaagtcgccatgcacccatgcttcctgagcttggtcgagcaagagcatcgattctatctgagaaaccaaatgtgcataaattgccggctgagtttgctgcaacttggcatgctgcttttgccacagttgctgcaatggctgcggatcttgtggttgccaatcatattcaaactgatctaaacctttccgaatttttagataacaacttagtgctgccgctaatgtaggtgcagagggatggtgttcccagaatcgctgaacttgataaattttcttgttcacactgataaatggttgctgagcttgtgttaacaaaattgctggcgtcaagtggctatcaacgtcttgaatagcttgtgttagcgcaaattcaagcaaatcctgttccgtactgggaactgttttgaccaaaaccggtcccgatattgtctcaactcgccatgccatgctgcttttaccatttgtcattggaatcgtttttgtgacgcgaccaaggttataagcaaggagcacgcttgataaagaatccatttgatcccctccactttttcaactgatggctcgctaacaggtttctccggtgagatcgttcacttgtgacactaccggatgacgattccctacaaaaccgttaaaatatcagtctaaagctgcacgacaaccacgtctaagttagcatagaataatcgtacgcagtcagcaaattcttttttggaaatgaggccaatgggcatgaaacaccgcaaccgtttattttggctgatcttgcttgtggcaggcgtttttctggtttatagcaccgaaagtccactcccgttcacaactcgcgaaacagtgaaggccggcatcgcccaggcatgggctacaacaacgcacactgttggtaactggctgcacggcaattcatctgcggactcggccagtcaaacctcctccaccagtcttgcctcaagcaccactagccaggcaacttcacgctcggcaagtacgccagcaggagccaccccggccttgaatattgtccaaggccgacaccttaagcgtacttactattaccattttgacgccaatttaccgcaagcagaacacactgttttcaccaatgccgtgcgcgcttacaacgcaaccggtattgttaagctcatccccggtcaaggcaaaagaagcgacaatcagatcactttttccagttatcaaaaagacatgagccaagcaagtcttggtaccaccgaacttggagaaggcgggccgaccattatcgtggaaacgctaggcgcacaggttaccgttatcaaccatgcccgcgccagtctcaacctagcttacccatcacaatccattaatgcggccgtggccatgcatgaacttggccacgcgctcggactggatcatagccagtcgactgattcggtgatgtatccagtcacgcgcggggttacgcaactatctgatggcgatattgcagggctcaaggcgatttatgcccaataagcagcctgcttgcttacatggaacccaattcttgctttggctttactcacgcatatctcaaaaaagctgtcagagccttcatatcagcattgagggttctgacagtttttgccttattagtatttgccagttttcaaagtgcatgttgactttgttctgtctataaaaccaccgcgggaatcggacccgcgtgtaaaatgttaaacttcacagcaccagcgtggttagcgatcggtttcgatcagtggttcatcttaattgaaggttccatcattcccggttgcaacagcagttgaagcggcatagaaatcaccttcatcaacgacgtaaacgccgatgacgatgttcttgtagccagagttaatgatgttttggtagtgaccgcctgtttcaccgtggttgttttctggacgttcatccacaatgtattgtttgaacatcgcttccgcaatcaaagtgctcagcttatcggcactgccatcgacatccttcttccaaagcgaggaaattgaaatgttctcagtatttcggctcatgtaaggctcgcctttttgataggtgacggcttcagtaccacttgctggtgcattaactggccgcgtgtgactgaacttgaacataacctcaacggcgcgcggtgcttccatctcataagctttcggatctgaagttaaggaagtttgaacatgaccggtacgcttctgttcaccattgatcagcacattgaacttcttgatgaccgccatggttagatctttgtccgtgtactgtgcagcttgttcaatcgaaactttccgatcattcttttcgatctgcgtttgaatcagctgcgtggtagcatcgttgacactcttaattgcgccgataatggttcctgcagcttccacattgcgccaaacatttttcgtcgtgatcgtcgtcgttgtatcccaagtattcggatccttcgatactgttgtaattggcgttgacgaaatcttgacgtaaccggtcttgtcggtcaaggtattgccgccttcgtctacgtcaacttcttttgtgacggttttggcttgtggcttgtgatacgtgcttgtgtaggtcactgttgttgtcttgtgaccatcactagtcgttaaccaacttgtagctgatcctccaccaatgtaaacatacccatcagtagaagttagctcgtggccttgatcatcaacgttaacaaacttattgatgattgtttcgtttggatcggtattctttttccaaacgttggtcgtggtgaaggttgttgtcgatgagcttgggtcttctttagacgtttttgaactgttaacaagcgagtaattgtcaacactagttaaaacgttacctgcttcgtccacattgacggtcttgttcacaatggctggcgttgtgacctcgttcttcttccaaacaatcgtggtcgtaactgttgtggtgatgttaccagcattatccttggtatcttccgacttactggagcgagaaacttctgtatagccagccgtgcttgtcaaaaccttgcccgactgatccacgttcacagtcttgttgacggtggtgtgggttggcgtctcgttcttcttccagacaattgtagtcgtaaccgtcgtggtgatgttgccagcgttatccttggtgtcttctgacttgctggaacgtgaaacttctgtatagccatctgtgcttgtcagaaccttacctgactggtccacattgacggtcttgttgacggtggtgtgcgttggcgtctcattctttttccagataatggtggttgtaaccgttgtggtaatgttgccagcgttatccttggtgtcttccgacttgctagaacgtgaaacttctgtatagccatctgtacttgtcaaaaccttgcccgactgatccacgttcacagtcttgttgaccgtggtatgcgttggcgtttccgtcttcttccaaacagtggttaatgtaaccgtcgtcgtgacatcgccagtcttaggatcggttgattcagcaacttgtctcgatacagaaactttagtatagccatctgtgttcgttaacgcatttccggactgatccacattgaccgttttgttaactgtctgataggcaatcttatgataaacattggtcgttgtataagtcgtgattgtgtcaccgttgctagaagtctgaaccgacttaacaggcgttccggcagtgatgagtttgtacccgtccaagttgttgagcgtctggccattttcgtctttgttgatggtgactttcttgtcagtgttctttggcacatagattgttggcaaagtcttcttagcgtcagcaactgatgtttgagcagcttctacagtctgttgatggtcggttgtgtcgactttttcagacttggttttagcagcggccaagtctgtttgagctgttgcagcatcatcttgtgccgttgccaaacgatcttgccacgttgcaatttgagcgttaagcgtatcaatcgttgtatctaattggtttactttgaccttcaaatcagccaactgagctttaacggtttctgcttcttggctgttttgactcgtcacggatgcgggtaaagctttcaaagttgtttcagcttggtcaaattcatttcgggctgtcgtagcctcatttttaaccgcattaaccgcttgggtggctgcggttaatttttgtcccgcttgactagctgtttgctttgcttgagtcagagctgtagttgcatcggctaactggccttcataacttgtcagcttttgttgtgcaactgccaactgggcttttgtttcattaacctttgattgtgaatctgggttggtcttcacttggtctgccagcgtatttagttgattctgcaaatcgctcagttgtgtggtgacgctgttgacttgggctgtgctctgatcaacggcggcttgttttgcagccactgccgcatttgtctggtcagcagctgtttgtgcttgctgtgctgctgtttgagcggcttgaagcttttcttgcgtggccgtcactttagctttggctgcatcaactgccctttgcgccgcggttcgtttggcttgcaactgcgccaatgtctccgtattttcgttgttcaacaaggcggtcaacttagcttctgcttcacgttgggctttttcggctgctgctttttcagcttctgctttatccttcgccgcttggatcgcttccagttgtttttggagggcatccttatcggtacttccaggattaggtgtgacagcaggagcagatgacgcgccaccagttgaagtgccgccagttgatccgccaactacagtatatttagcctcagcttgttgcgccggtgtaagggtagccggttttgctggatttaaattaaatgtttgattatttcccgagacgtcttgcgtcgttactgtcgcattgtcaccactaccttgcagggataacttggcgccggcataaatcaagtccacgttggcaatccgattaatggctgccagtcgcgctactgatgttgtgaagccggtgtgattcagcgcttcactgatcgttgaaagcgtgtcaccccattgaatgttgtaattcgtcgagcccgtcccggaagctttaatctgtgcttcgatttggcttactggacgaactttccaaactcggccctgattggtcgctgtttgctgtgttgcaggctgttggtcacttgcatgcaccacttggccctgacttgacaaggcgattcctgcagtccccattgcaaaaaacgttaatccaattgccaaccagccatgatgcttactatgaaccaatgtcaccttatgttcgttgtttgtaagcgctgtccaaaattttcgccgcttcgttgttcccatttgtactcctccaaatcctttaatattaaatacaaatgttattatacttctattttcgatttctttatacaaactattcaacaatttttgtaaaagttaccaaatcttttttacagaatcaatttacaaattcacaatgatcaaaaccagcgtaaactaaaagaatatcccgccatagacaggatattcaaggcacaacttactaggaaaagacagatcctgcaagccattaaaataaactaatgatatacgaacggcagcgataatcttcgccccacacgaaaattgtcgccacacagactgttatgttttgtaagcatcttgtcgaaaaaagaacatccccatatgcttttcatgatgcgttcaaaaaagccggcttgatctgcctacgacttgcagctggcaacatgattgaaagtatatacactaccaccccaacagtggcgcaaaccttatccgtccgacgattccagcgaataacaaggtttaccatggcaattgctcctcacatcatctgtcaaccacaaataatattataaagctttatggtctaataagtccactttttttaaaaatatgtgttatttagccctaatccttcaatccggagtcaggtagcgttgatgttatgaccaaggcagatagggggttaagggatgcggttacaggaaaaggtcgccaaaagaatccacgaattaagactcagcaaatccatgacccaggaacaactagccgaaaaagccaacatggacgtttccatgctagccagaatcgaacgcggaagccgcggcgacatcagaatgagcacactagaacgcatcgtttccggattagacgtcagttatcaagaattcttcacttttccagaagacggagatgaaacaaccgaactggcttcttcaatcgctttgattaaagatccggaagttatccgggcactccacaagatcgtgaacacgttgattcatagggacaataagtgataaccatgcgtaaacgactgatcatgaatttatttaatccaacatcttttcttatatttttgatttcaaaatggcaattttaaattcttcctcttgtttttaacgtattcaatcaagtctcatcaaaaaagccgccagttttgtgcaaatgcacgcgactggaggtttttatgtgcgataactaaagagtgaaagttgaatgtccggagaaagtcccgagaagacgggacttttggtgttaggcacaatgccgtctggtgttaggttaggcacaactttattcaggatgcaaaatatggtagactaaaattaccgatcccgatatgatactattcgacgttggtcgcgggtgagactttcgcaatgccagccgctggtaatgtcaagcatatttgctcgataatgctgttagcaagtgcagacacgatgtatttattcatttggctgttctccttatggctgactaacgacacaactataatgttaaccactataattgtaatgttaattgtattcatctgtcagacaatgatagatgttattttcgaagcagtgtatccctgcggagataagatagacaggcgagactttcgacaaatacagtcgtttaggtttcgcctgatttcatttttagctttaaagtcattgatattgcaaaattggcggaggaaatttcttggatttagtgacacaggttggtttacgtgcgcttgaaagaatcaatggtaaagattacttgcattttgactttccagttacagagagtgaaaggaaacagttagtttcggatattgtaagtggtgatattgtccatcaccgttacttaccgtttatttcttttgaaattcgatttcggatctatcacgctcgacaaaagtcagttcaggctaaagcgcgaagaattatgctaccttcccatcatgatgctttgatgtatcgcttttatggccaagcattgaatcggctatactctgactatgctttaagtcatcacattaacgatgttgctgtcgcgtatcgcgaacgacatcctggagtccatctttcaaacattaccactgcaaaagaagtctttgaccgcataactgcattgtcgaaatcatgggttattaagggtgatttccatcattttttcgacactctatctcatcgatacctcggaaccaatttacaaaaagtttttagtggaaatctgcccaaggactggaaaaagatgtttcgagcaatcacacaatgccaatcgatcagtcgaaagactttagaaaaacagctgcaaacggcgcatatcaaagttgcctaccggacgcatcattcggatcagtccaatgcccgcgcatatgtaaaaaatttacaagaactcggcaaactaattcaggacaagaaaattcgtctttctgggaaaaaccgtgtgggcattccacaaggtactgctgttagtgcagtattagccaatgtatacatgattgactttgacgagtggttagcaaaattgtgtgagaaagagggaggactctatcgccgatattctgatgactttattatcgttttacctcaaaaacagtttagtgaggagtccgtcaaaacttttgcgatgggagttattcagcgaagcaaaactgaactgggattaaaaattgagtcgacaaaaacaaaactgtattcatatgatcaagacaaccattccgtgatgttataccctattcaggaaacaggtaaacaacgctcagggagaattgactatcttggattcgtttttgatggtatttctgtttcgatgcggtcaaagagcatttacaaatttatctatcgaggaagacgaaaggtcggcaagtatgtcactcttggtcgattgtatgatcaggtaaagaatggatttagcgattcagatatcattcaaaatcaaatggcctttaaatataatacacgttccgaaaaaagtaaaaaaagacctgtggttccaaacatatatcagacggtacagactcttcaccgacttcagcagattagagaaatgaaatatgagacactgcgcgctattcacaaaggggtgacgatccgatatttaagtgctgaggtaaaaaatccaagagcctcaatgttagcgtatgcttcgcgagctcagcagatatttgaagttggacaacctaagtatcgaattgtcattcttcgtcaggtattgcgtcagattaagcataaccaaaaaaagcttcatcaagggcgggataattataagcattggcgatactctaaatatcaattctaaagagtgtaagccctttaagtcggtccgtctttcgacgttactcactgcatcgagctgaagctgatcccaacttttcaaaacggacaaggcgtaattgcttgaatgatgctcgaatcaattggcagcggatggttctactggtagcggttcgtctgattcaatacctccatcaatttgtcgtgagcggccgtgatcaagccttcgtcattgacgattcactatttagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactatttaagcgcgagttctccaagaagaccgaattactctccaaagtattcgatcatgaccatgaacggtactataccggctttcgggctttgactttgggttggagtgatggcaataccctcctgccgctcaactttgccttcatggcctcaagtaagaaaaagaaccaagttagcccgcaaaagccgtgtgatggtcgctcacttgcggccaaacgtcgccagcaagcccatcgcaaaatgaacctagtggccacttgaactcgttgatcaggcgattaaagcaggtgccaaggcacattatgctttatttgatagctggtttgcttatcccaagatgttccatgaactgcttaagcgcgggatcaatggcatcggcatgatcaagcagacggagaaagtgtattttcgttatcgtggacgagaaatggatgttaagcggctctatgccacgttaaagcagagtaaatggccaacgcatcaacattatctgtacagtcccattgtgcaatacgacatgggcggtacgacgatggccatgaagctagtcttcgtgactaaaaaaggtgccaagggccgcttcttggttttagcaaccacaaagactaatttgcgccccgaacgcatcattcagatgtacggcagacgctggcaaatcgaaggctacttcaaggttgctaaacaatatctgcgctttgatgcgacacaagtacgtggctatgacagtctttgcgcacttaaggcaatggtcatgatgagttatgatcttctcgccttgtgtcagcgtgaggaaactgacgaacgcacgctgggagacttgttcttctactttggaaaagctttacccgatatcggcattgcgcgagctttaagttggctcatggcacaattgattggtatagcgtcaacttatcatgaagctcaagcggtcattaatcagatcatgagtgaattcatgcaaaaactgccgaagagtcttgcggatctcttcggcagcgcggcatagataggatttgaatatgattttgtggatacaccctgacgcagcggcagtcagagccatttttttactttcactctttagttattgaatttttcagcagtctcgcttctttctgggctactattatcagtctgattttttatcttttctttttcaaaagagcacaagcgctattaaatgaccaagttattagtactagctgcccaattatactcgtgaaaaatgtttgtatagtcataggatcgttacagttttgtatagcaatatacgcattaacatctacagcaagcataattgttaaccaagttacagataagcagtaaataaaaaataataaatattcatgtatgtttatgctgcgcttatttttcctatctgtataccagacaaaaagagctagaagaaaggccaccacaataccgagaataaaaatccaaaaaaataatttcaaccgctcatctcctgaaaattaatttgttaaaaggtatcctaatacaaagagcgacattttggaagtgccatggtgatttatttgctaagtaatgaattaaggttaaaagttcttaagaaaacctcaaaaaccacctgcgcccttgaaattctctaaaagtttataacttggattgaactataagtgcactaactttggaccaatgctaactgagggcgttggtcttttttatgctcggtgtaactttgtcgtaagcgtctaatagtacagtacctacaaacattgagatcctccttctatacttgttctatcaagcagattggaggattttttatttctcaaactaacgacatggttcccgttaggatgattaaccgcgatagtgcttctgctgtcgtcaaacctaaactaggagctaaagtaaaactggatgacgccgaggtacttttctacaatggtgccgacaaagtaatggcgcgcattattttacaggagctgatgaagcatgattccagatctgtccaaggctaacatttacatcatttgtggccgcaccgacttgcgcaaaggcattgatggtttggcggccttagtgacagaggaataccagatggatgttttcgataatgccctgttcatcttctgtggcacccgtaaagataggttcaaggcgctgtactggaccaaaagtggctttcacttctgtataaacgctttgaaaactgctatatgcaatggccgcgcgatcgcagtgaaattcgccgcctaaattatcgccaaatgtcacgcttggtcagtggtttagccattgaagaacgacgcaccattcaagccataacgcccgggcatgtgtactgatactgcgaaaaggaagccttttctagaaatcaaagaaaaggcttccttttcgtatggccgcttgatatactcatttcaacaattttaacggaggatccaaaatgcctgctgaagcagcagttacgcaagcctaattcaactacctcaaacaagaaaatgaactgcttcgtgaacaagtggcatttctgatgcgtcgcctttacggtgcgaagcgtgaaagtctgaccgatggtcagctggatctttttgagaagaataaagctttctccgcaccagagccgacggaaccagaagcagctggcaagaagccagctgagcggaaaaaaagaaaaggcaggaaggcagcacaactggcgaattttcctgaagtgtctgtgcatcatgaattaactgacgccgagcgtcagtgtccaaattgtaccgccgaaatgcgtgagataggtgtcactgttaccagtcgtgaaccagttcgtattccggcacatgttgaagtccacgtgcattatcaacacgcctatgaatgtcgccaatgttcagaccaactagatcatagcgtcatcaaaaaaacccccttaccacagccgttcattaccaatagttttgcctcacccagcgtccttactcagacgatgatcgaaaagtttcgtaaaaaggtccccgtctatcgccaagagaaggattgggaagaggttggtcttcccctaacgcgtcaacaaataaccaactggcatatcttggcatgcgattatggtttggccgatctttatgaactaatgcatcaagaactgctcaaacagacaatcgttcacgctgatgaaaccagctatcgcgtcttagaaagtgaaaaggtgaagacctactactgggtattcgcatctgggcactgtgaggataagccaatggtcctttatgaacacgccgattctcgtgcgactgaggttccgaaacactttttaactggttataggcattatcttcaaaccgatggttatcaagtgtacgagaaactcgatcaagtcacgcgggttggctgtctggcccacattcgccgcaagttctttgaggccatgggcaaacagagcaccacgaaaagtgctgctaaaacgggggttgattattgcgggcgcatgttcacgatggaacgcaaatggcggctgctcacaccagaacaacgttatgaaaagcggcaaggccaactcaagaccgaaatgactaagttctttacttggtgtgagaacatccataccttaccgcaatccaaattaggccgcgcgattgagtatgcactcagtcaacgcgaagccctagaaaacgtcttgttggatggccgtctggagatctcaaataaccgtgttgaacacgccgtcaaagaactggttatcggccgtaaaaaccggctgttttccacgagtttcaaaggtgctcactcaaacgggattattttgagtatcatgcgttcagtcgaggccaacggacttgattgccgcaagtatcttgaatacttatcacaaccttcccgttccttgtgatgccggggcattacaagattatttaccatggtcgcccaaggttaaagccaactgttcgcgttaaagctgatttaaaaaaacggcttcggtattccttacagcataaaggatatcgaagccgttttaaatgtaccttacaatcgtacgcttacggtcattaatcagatcatgagtgaattcatgcaaaaactgccgaagagtcttgcggacctcttcggcagcgtggcatagataggatttgaatatgattttgtggatacactctgatgcagcggcaatcagagccatttttgcactttcactctatagtttagatattaattttaagtctttacacgaattccagtgtttttgtgctttttaagcataattttgctgatgacatcaacaacgtaataaatatcccacattgaaaccaagaatattgaggcccaagcaactaagataagagcgtttattaatttcatttctaatgaaggaatgaaatcaaaggatactgttataactataaaaataatatcttctataaatatcgtcctgattttttttatcaacgaatcaaaaaagtcttgagcttttgaaactttatcggcttctttaaaaaattctgaagaatgtcgttctccaatcagtagtccaataaagattcccgctgttgccaatattattgatgaaatagcaatcatatcactagatccagcccgaatactttttaattttccataatagtaaaaagtgctgaagaaggctgaaacaaccactgctatcaaccaccgtaaaatattaaccttgtctgtgagatcaccaaatttaaaaacctcttgcacttttgaaataaacttttttaagttcaaagttttcaacatttaggatcacctcttcagagattatctggtttgggaatagctcgagcagctctttgtctgaatcctttatttttgctgtttttatctagattatcttgaggcaaatcaaaattttgttcaacgaaattgttataaatgaactcggctcctggcgtttctcgattaggaaactcaatggtcatgcttgactttaagcgcggagaaagcagatctattgtctctatggcgtggtgttcatcttctttagaagcaatttgcatcgacacatcttttccttgttttgcaagatatttaatatcttcaatgacctgagtcacctgatctttttctaaagatctagctctaggtgttctactcattgaaactgttaaatcaaaagaaattccgccaatttctccagctgcatccacagctttatgcataacttctgctgacatatgttcatcattaagcaacgaaacatcacttgctttaatattaatacgtcgaataatttggttttgcaatgcgcgatgatatgcagattcatcaggaatcggcttcaatgaaacaactccgacttcattttccccctcgccaatactttctttgtatctttgtctaagttctgttaaagcgagttcgctttgcttcgtcgttaaaccataaaaattcgactgaaccaccagcaccccgctttcaggatcaaaaacgaaaatagaaaactcaccgacaaattcatccttgtctaattcaataggctttccgggcttattaagatgtttaagcgaagggatgttgttatatctgtttttggagattcgaaaccagtacaagtttctttgttgatcaagctgttgatcctcccattcaaagtctgccacttcatctcctaaaatgactgaactttcaatcttgcccttgtgatttagaagaaattcaaggaaatccttcatgttccatctaaagttattaccgttttcataattcaattccggaacaaagtagttgaacctcacatgttgtttcgtcataagcacatctcctaaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaatattgtttgtggccttagtatagcaaaaatggggatggttgagttcttcactgacaaacaatatcttgcgtagcaacattatatgcgaacatacgtttgaaagtcaaccgatacaatgtgctttatcaacatcaagatctgctttgcgttcaatcgattgcaaacgctctttcatgtataccataattatgcttgaattttagggctttttaggtttttgctgcattagccacaattttgtgtggctaataaccagcaactcctgcagtctctgtggcattgcctccgttggtaagataggcctcagtgaaggctttctgccacttgcttagtttcattacatatcaccacacctcccaaggcaaaataaaagacgccacggcgtcaatgttcaaaatttagtcttcggaattttgaaaaaatttctttacaataggcatgccccttactattatcagctctacaagcataacaacgaaaacagtaaccataaccttagcagcaacagataaggtttccaataaattaacaaataaattagttgaactcgttacatcccaaagagtttgaactatttctattgaaagtaccgtgttcagccaaagaatacggactattctccgatgatccttacttatagttggttttgctaaatcatttccaaaatattcaaaaacatcttcggaaatgagcaaaactgttaatgacgaaacaagcgccaatctgccgtctgaattaatccgatacaataatccaaccaatgcaatggtaatcagttcaagacaaaaccctatgataatctgtccccacgtcatttttggaaggagcagtttttggaatttcttaaacgaccttttggacatacttaaccacctcaccaaaatgatacgcaatatcatcgtaaaatactagtgaggtgatgcatggatttgccgttcgtatccactcaaggataagcgacaatgtgcctggcgggacttgcacccgctgaatctctgctgtcagccaccagctgctcacccattgtcagctagggttcatcgcaaagctgtttcgttacaagttcaaacaaggaaggaggactcacctctctttcttttatttttgtccggtcggattgggcaatgactactatgcctatgggaatatagcagccttcctagatcatgctaacccacgaaatctgctacttaacagtcacgctagaatttcctctaaaagatgcgctcattgcttatcaattcttgcacgaaaccatgatgaggtacaaatcacgatgattttgggctcgcttgggttcaaattgacggtatttcaggcatatcagtgatggtaggtgatttgccatctgttagcggcctaccagctattcttgcctgccagagatattttttcagcaagttacgcgcatcatcacggcacgcatgctcgtctatttccggaatcaatgtcatcaactgcgccactcctaatgatatacctgatttttgagatcaagtagggcgttccacatgtcggtgcgctatttttttgacttcttgaatgtgtacacctccgatgcacctccaatacaatgaattcatatgagtgcggaataatttcgggtaaagaaaaaagctgaagcatcaacgattttcatcattgaacttcagctgaattcatttgaattttataccggtcattcatattctattgttgccggtggtttactcgtcacgtcgtaaagcacccgattaacatgcttcacttcattaacaatccgactcgagatttcctgtagaacagcccagtcaatacgagcaaagtcagcggtcatcccatcaatactggtgacagcgcgaatagctattgcgtagtcgtatgtgcgaccatcgcccataacaccaacagatcgaatccctggcaacaccgtaaagtattgccaaatatccttatccaacccgtgcttagcgatttcttcccgcaagatatagtcggagtcacgtacaatctccagtttatcttcggtcacttcgccgataacgcggatgccgaggcccgggcctgggaatggttggcgccagacgagtgaatgtggcatacccagtttttcgccgagttcgcggacttcatctttgaagagtttgttcaggggttcgattagtttgaacttgagatcttcaggtaggccgccgacgttatggtgggacttgattgtttgggcggtgtcggttccggattcaaccacatcggtgtatagcgtaccttgggcgaggaattcgatgccgttgagtttggcagcttcttcgttgaatacctcgatgaagtcccggccgatgattttccgtttcttttctgggtcagtgacgccttttaggtcattgaggaagcggtctttggcattaactttgataatgttgaggccgaatttacctttgaggctgtccatgacttgttctgcctcgccttttcgcaacaggccatgatcaacaaagatgctggttagctgggtgccgattgctttgtgtagcaaaacgccgacaacggaagagtcaaccccgccggagaggccaagaaggacgcgcttgtcaccgacttcggcccggattttggcaatttgtttggtgatgaagtcgtccatgctccagttggcttcggcgtggcagacgtcgaaggcaaaatggtgcagaatttcgtggccgtattgagtgttttgcacttcggcgtggaactgaatgccgtagaatttacggtcatcgtcgtccatcgcactgattgggcagttgacgctggtggccgtggtgcggaagccatccggaacgcgggtgactaaatcgccgtggctcatccagacagtctggtcttttggcagatcgtggaagagtttggcgctggcatcggtgacttcgatgtcggccttgccgtattcgcggttgtccgccggttcgacatcaccgccgagtcgttgggccatcagctgcatcccataacacacgcctagaatcggaatgccaagtttgaaaatgtcctcatcaaccccgagcgcaccttcgtcatagacactgttcggaccaccagagaaaataattcccttaggcacgattttcttgacttcagccgctgtgatggtatgaggctttaattcagagtagataccaaattcccggatacgccgggtgattaactgattatactgactaccataatcgaggacgatgatcttgtcgtaatccttgttctggtcatttgccacagtccgccacactcccttgtttgaatgcactaattttacagagttttcataagctggtcaatcatgggtgagaagcctctcatctgagtaaaactgccaagtgacagtctcaccagactaactgatttcaggctttcacacatgtacccctcagtttctgaaaaccaaccaaggctctattttaccattttctcaacgaaacctggtcaattttatgtccttttgttttatgcaaaatgacgtcggcccgattctttgtgggcaagatgtattccttgaggttcttgaggttgacatcatgccagacctgccgcgccatggcaaatgcgtcagcccgattgccaatggcgtattgatagtagtaattgcttggatccgtgaaggccgtgtccagcagaatcccgaaccgttccaggtaccactgctcaattaacaccggatccgcgtcaacataaatggaaaagtcgaaatagtcactgacataaatcggttgcttgcttggcagctgcaagacgttaatcccttccacaatcaggatatccggccggtcaatgacttcatattcatttggaacaatatcataaatctgatggctatattttggtgcccgaaccaccccgctcgcatttttgacgttgttcataaaatgaatgagcagttccatgtcatagctttccggaaaacccttgcgatccagaatcccgcggcgttcaagttctgcgttgggatataaaaagccatccgtggtaatttgttgaacccgtttatccggataagcccggctcaacagcaattgcagcagtcgcgcggtggtgcttttcccgactgccaccgaaccggcaatgccgatgataaacggtgtgtgcggattgcgctgcatgcccagaaaacggctcagggtaaacatatcgccttggtagtcttcataacgaatgtgaatcaagtggcgtaatggtgaatagatggttttgacatcatcgaggctgatttcatcattcagcgaccgtaattgcgccaactcggcatcggtcacgctggtaaaattttgcgaatgaaactgtgaccattctgcccgatcaaacttgtagaaattcatttcggattgcataacttaccgtgtccttgcgtttaatgttcttattttagcatagaaacgcgtccatgtttggctaaccgcgaaaacgcgttcatccgatgaaaaggcatgtgcaaaggcccttgatcgcaatggcaaacgctgccgatcacgcccaaaaatattgacacaccgtttcctagtgggcttcgtttgtgatcgccgcaactgcgctttccttacgtttttcttaactgccgtttatcttgacagtttcaaaataattgttcacaatcaaaccaacgaagcgctgtcacgaacttagcaagccggttggaggtgctgcccatgattgagttcttgctggaacttttctccgatgttattttggagtttttactggcccccatctttatgccagaatttgatttgaccgcatcgccgaaatttaacggttttcgcatgatgctcacttcgcttattgatggtgggattaccgcagctggggcttggttattgattgaaagcctcaccgcggacccgatttcaatcatgatcgtctttgttgcggctgtgctcttgctggccgggctcttcatgtggtaccgggttagcatcagatttttcaactatcgccgcgcgttagttaaagaacgggcggaaaagatagcggccgaaaaaccgtatcaagaactttaaggttgtcccccgctacaaggtccattttcaaaaggaggtgaacggcttcatgcgtcagatcctgagctttctcggttcgattttgatcgccatttttcttgttcccacctttcgccgcaatccccgtccattttggtattggacgtggtacatactgcttgtcattttctgtgttagtgtcacagcctttgcattgtggttgctgattcttacccagctacgggccacaaaggggactattatgttggtcagtctgttactggttgtccttatgcctgtgtttttgatccgggcaacattacggtttcgtgattatcgtaagcgggccaagcaataattggcacacaaaaagcgctctggcatgagcgctttttagatactttcattaatcctgtaacttaaaggccagtttcatattcggagctgcggcggcaaccatttgccccagcagtgcattgctgttggtcatggctaagtcggccattttctcgttggcagcggttaagtgtgcctgaatgtctttggcatcctgcactgctttatccgtttcaagttgcagatgacggcaagcagccacagtcttttgctcaaacgcatcttcttgatctttgaacaatgaaaagtcgtagtcgccaaacgttgccagcagattactgagccaatacattttggtgacatcgaacttatcgccggtgtcgcggtatgctgccggtgtatcggtaacgttagcataaaacggaaccactgtgttgaaggtgttcgggccaaatgccaaccagtgaacacccgcaattgcagcaggcacatcgttacgaatttgcaaaatgtggagttcctgattacggttgatcccgatcggccggtacagctttttctgcgccggcgtgcccagcgaaccgtaaacatcgtacggcgtgttttcgtagtgggaactttcgacaaacttcacgtcttcgatactgatctttttgttagtgcggcagataaatggaagatcctgatcgattggcgtggtgtcgaattccggattgaaatacttttggccgtaccatgctcgcgggttgttgtaacgggtgtctttgatggtagccgagccgaagatatggcgcaagttgtagccttctgggtctgggttgaggtgataggtctcaatcagatcacgcaggtcggcgctgctcattgtatcatcgctggcaaaatcaaaattggtgatgttgaagcgattcggcgcaaccacataagcatcatcaggaatgcggatcgctgcccagtgatggccgccgatgctttcgaagtaccagacttcatctttgtcggcaaaggcaattccgttactttcataggtgccgtactgttggagcagactgcctagacgttgcaccccttcacgcgcactgtgaatatatggcagcacgatggtcggcatgtcttcttctccgatgccttcagccacaagcggatcaacgccgagcacccggctattggtcgtaattgtctcggttgaggtcatcgcaacgttttcgctattaatccctgcagccgcccaaataccgtggccatcttcagcttcaggcgtggacgtataccctaatggatcggccggcagatcaatggaaaatttgctcaaaacagactggtaatgacgcggctgatcctcaggtttaacgtacacaaacttttgcggatgtaacggtgattcgccatcctcgttccgggcaatgatcgtggaaccatcgatggaagccttcttaccgaccaacactgtggtacaggagccgacataacgttttgccaaaataatcgtccttctttcaaaatgaatccgcatatgtgcagaaccgtgcgggagtggatttatgattaactttaccgcgtgaaaacaggtttgccaaggggatgcgaaaacaagcgcaaaaaatagccatccctatcgtttgacagacttaggatggctatttgccacttctgagccgctgttgcttcaaaaattttaacatgcggtttaaccatgcgtctagccaaactaactcagaatccagctcattcagagtttataataaccagcaatttgctttgcggttattaaccgttaaaaagaaagcataacagttgaaatgtatggaaccgcgaacacttgtttgctacaatcaaattggcaacgtcaagagatggcggctactctcagaagaagggggtgatgcagatggttttcttccctgaagctcacaacccactgaagaaaggagcctaggtttgtcggtcttcgaagccctgagtctggtcaatcaagtcgtggataatttcctgacgctgattgtgctagtcacagtgttaacagccgaaaacaagcgcaaaaaatagccatccctaaagtttgacagcctcgggatggctatttgtaatctcagagccgctgttaatggcgttgtcgtttcagagaggctagcggttggaaaccgctagcctctttgcatgattattttagcatgcagtctaatgatgcgtctagtcaaattactctaggcttgctaattacccgaaatcgaagaatacaaaagccacacttttttcgcacaaaggcgaaaacagcgcgcctttaggtttgtggctagagcttctagttatatgcttatacgctaacactgtagcaaacacatttctccatgtctgctcaatcttttgatcaacatacctgcgcttagcaactttcaatccagtggcacttcaccaaagctggcgttaatcttccgataatccgctcgccgttcagcgtaacccgcgagcagccgcttttcaaagtccgattcggcttcgactggtggcagtggaccgtcttccttgtggcgggtcacaaaagttgcaaaggccgttcccacttgaaaacgctcgccgctagctaagtgctcgccgataagttgggcgaagacttcaagtgagcgatgaccaacgccgctgaccatacacttgataattaaggcatcccccattttaaccggtgcggccaagcgaaccatatccagcgatccggtggctaatccgcgccgacctaatcgttgcgcggcaatggagctgacgtcatcgatccaggtgaagatctgaccgccaaacagcgtctgatgggcgtttagcatccctggaaagatgcgataactggaaactgctaatgtatcccgcattttaaccattcactcacccccgctcgtacaattcttctggcaccttgtccaacaacggtgtcacgtctggactagctagcatcgtcaaccgatgcatggcccgcgatgcaacggtataaagcaattcgcgttcgtcttcttcatggtagttttttgcgttaacctgccacagcaccacggcgtcgaattccaatcctttggctaaaaagcttggtacgacaatgacgcccgccgccaagcgttgattttcggacttgatgagggtgactttaatgccggcagccttcatctttgcgtaaatcgcttctgcagcttccagcgttttggcaatcaccgcggtggtttgtttggcctcgtcattcaccttcagctgagcttgcagtgcggtcatcaaacctgcttcatcaggccggacaatcagctttggcaatggaccttggcgattaaaggcaacgattttctgtccggatgtcaaaatggccttggtgaaatccgtcacctgtttcgttgaccgataactttgcgtcaactgcaccacacgggttttctccggatcgaataacttgctggtctcattaatcagcgtccgcgagtcatcctttgtgaaaattgcctgattcaagtcgccaagtaacgtaaatttcgcacgggggaaactggctttaagataagccaactgatatggcgtgtaatcttgaatctcatcaacaaagacatagcgcatttcgcgttctccgtgccggccggtaatcaaatcatataggtgcaaatatggcgttgcgtcagccatgggcagtttgcgttccttgaacatggcaataaagtgatccacttctgcttgccagtcagcttcggaaatcccttccgctgctaagtcgtaaatggcaggcacttcgcgtaagaagctgacatattgcccccggatgttgatgaaccggttgcggacaatatcttgctgaatcgcgtcaaaacctttcatgaccaactgccgggcaaagaagcgatattcatcgtcactattcttaaattcttttggcccatcttgttgcatggagcgaatttcttcatcgcttagattctgaactgcttcttgaacccactgtgctttggtctcggattcaattttgcgattcaacattttaatcagccgctctttagtcgcattcaggcggttgcccatatgataattttcgttatagctgtagaagatctcccgaatccgcttgcgtgaaaagaaaacttcgccgcggaaccggatatccctaaaccgcaatccggagcgttccagactcgttgcataggtctgggcagttttaaagaagtccaaacttcccttgacccgggcaattttcttttgcaccggcgtcaattgctgttcaaactgggaaaagaggttctgaacctcaatatgtggcaggcgccgggtgacatattgataatacgtaaattggaccatgttttgttcgcctaattccggcaacacattactgatatagtcggagaaaagttggttggggctaaacatgatcacttggctgctcgtcagattaccgcgataacgataaagtaagtacgcaacccgctgcaacacggcactggttttcccggagccggctgccccttggacgaacaacaaatccgctttggtatcgcgaatgatctggttctgctcacgttgaatcgtcgtgacgatggtcttcatctgggtgtcagatttttcgcccagaacttccagcaacatttgatcgccaatggtttcggtggtgtcaaacatggtctgaatctgaccgtttttaatcacaaattgccgttttaaggagaccgtgacttgttgcgggccatcaggggtttgataagtcaccttacctaagccgccatcataataaatcgaactaatcggtgcccgccagtcatagatgagaaacttgccagcctcattcgtaaacgaaccgaggccaatataaatcgtctccggcttttcgcgaccttcctgaaaatcaatccgggcaaaataagggttccccaacagccgctgcaccgttgccagctgctgtgcgctttgcttccaagcattcgtccgctcatcaagcacccgctgctgttgctggatcgaagcagctgtttcaatggtttcagcataattcgtgaagtttaaagaaaaatcgttgaaaaagttatcactgatattcttctcttcggtcttggtcttggccatctctttagaaagccgctccttggcacccgaaagctccttcatgatcgcatccaaatgctgctgctctttagcttgttcattcccagccacgacgtcatctcctttaacggttattaaataatcgttataacatcttatcacttatgaggaaacgccgcaaaaaagagtgtgagcgcgaaccggcgcggttagaagtcggagtgtaagtggcctcaggcgtgatggccgggctttggcccttgcgactgaggtccttacacgcagacttctgcgccggtgagcgcgttatgggcgtaagctagaacaaaagcggcctcagacgtgatggccggactttgcccactgccaccaaggtccttacacgcagattcctgcgccggtgagcgcgttatgggcgtaaaccagaactcaagcgaccttaaacgtgatggccggactttgcccattgccaccaagatccttacacgcagatccctgcgccggtgagcgcgctatgagcataagccatgccccctacttcaacctcccgcgcaacaacggcgtccaagcctccaacacatacccaaccgccaatccaaccgccacccctaacagaatctttttaaacggcaaactaaccaacaacccgattaacacacaagtaccaacgataactgcacgccgattgaaaaacgatttaccttgacgtgaaggtttttgattttgtatcatacgcttccctttcatttataaatacttttcgttacgattgactcatccattatctctgatcggaggccattatggaatctatttcacttttaatcgtcttgacagccgcgttgttgacgccgctgttaatggcacactttcatattaatagtatcccgactgctgttgccgagattctagtgggcatcatcttaggcaaaagtctcttaggttgggtccatactggcggcgaaatgcaggcgttaagtgaactcggtgtcaccatcctgatcttcctgtccggcatggaaatcgacttttcgcttttcaaaccacagcccaagtcggacaaaggacctcagccggccaatccagttgtgctagccacagttggatttgcaacggtcatcatcatcagtttgggattcagttacctgctcaaattcattcacttctataacttcccgatttttgcaaccattctgttcaccacgattgcgcttggcgttgtcattgcggctttaaaagaacaggagttgttacatcaaccacttgggcaaacgatcctgctgattgcggctttgggtgaagtgattccccttatcagtttaacgatttactcagccttgaacggttcaagcgataacaatctatggttactgctgttactcctgctggcggcgttggttttactagcgcgattcaaacgcatttacagcttttttgcggcgattgataaaagcaccacgcaactagacattcggttggctttcttcttagtcttcaccttagtgaccatcgcttcacgagtaggtgccgagtccattttaggtgcctttcttgccggcatggtgatgaagctccttggtccgcgtcaagagactcaggataaattgacttccttaggttatggcttctttattccaattttcttcatcgtcactggggcaaacctcgatttgaaagctttagtcgctgatcctaagagcctctccttgattccgttggtgctcatcggctttttcatcaccaaaatcggcctcattcctgttttgcggcagcggtttaagccgcaaaacgcattggcgggcacgtttttagccaccaccaccatcaccttggtcattccgacgttaaccgttgggtgcaaccttggtatcgtgaccgagcagcaatccggcgcgttcacactggcagcggtcattgcctgtgtggcggggccaatccttttcaatagtttcttcaagcctgaaccagaaaccttcaaaaagacccgcgtcacctttattggcggcaatcttttgacggtacccatcgcgcaacatttaagtcctgagcgctatgaggtgcaactatttaccgatcgggtagaaaattttcggacgtataactccgaagtggcgatcacattaaccgattatcaggaggacgcgttaaaagctgccggcgcatatgattgtgatgtcatggtgctgggtgatttcgatgcggacaccaattacggcttggcaaaaatggcattagcacagaaagttccacgaatcatcgcccggtttgccgcaaaagacgctacctctgatcgctatgaccgattgcgcgatgatggcgttgaagttttcaatgcactcgatgccaacgttgcgttgctgcgtagcttgatcgaaaccccatccacgttgagaatccttgatgatacaattgcaggcatctatgaagttaccattcgcaattcgcgttttgccggccttgagctcaagaatttaccgttcattgatgacatcaccgtgagccagatttatcggcaaaagaaattcattgctcctcacggcgacacccaactgcatcttggtgaccacctcattttctccggggacaagcacctcatccgcaatatccgctcacaggttgaaaagttaaattaatgctgctcaatcaggatgtgaaattctgctttgatactcgccaatgaccgatctcagtgcaaaatagttataaatggcagcacttccttttttacgccgttgtcaggctattttccgtggtacaatgagattattctaagaaaaaaggtgatcaaatgaaacaaggaacaacgatcctgaccttagacaatggctaccacttgtggaccaatacgcaaggcgaaggtgacattcacctgctttgcctacacggtggccccggtggcacgcacgaatactgggagaactttggcgaagaactcgctgatctcggcgttcaagtccatatgtacgatcaactcgggtcgttttactcggatcagcccgattattctgatccggaaattgctaaaaaatatctgacaaccgattactttctcggtgaagttgaagaagtccgcaagaagctaggattggatcacttttatttgatcggccaaagctggggcggtgccttgacccaactatatgcgttgaaatacggccagcatctcaaaggcgcgatcatttcatcaatggtggacaacatcaatgagtatgttgagcatatcaacctggtccgcgaagaagcattgcctccttcagccgtaaaatatatgaagaaaatcgaaaaagctggcgattgggacgatccgcaatatcaaaaatatgtggatgtcttaaatcgcggctatgtcgatcgcaaacagccaccggcaatttcacatctaattagcacgatggcaacgccggtttacaatgcgttccaaggcgataatgaatttgtcgtcaccggtaagctgaaggactgggacattagcgatcaaattcacaacatcaaagtgccgacactgttgacattcggcgaacacgaaaccatgccgctaaaagctgcccagcgcatggctgaagtaattccgcatgctcggttggtaacgactccaaatggcggccatcatcacatgattgacaacgcaccggtttacttcaagcatttgaagcaattcatttccgatgttgaaaacggcacctttaacgactaatggtaaaaaccgcgcccttactgttaatatggtcgcggtttttgtctatgcatctttttaacatgaaaggatctcaccatggcttacaccgttgattttaaaaccgttagcaccaacggcttagaaagttctcctgttgcaccggctttggctgggctaagagccaatgaagcccggtatatttggaacaaatataaagttccttatgtcacctatcctgtcagtgaaaaaccggacagcctcgcttgggtgcaggcaatgcttgcagaacgccagctccatatcgctgccaagccgcttgaaatctgtgaccttgcgctaccggatctgcgctgggttgaagtctattatcaagatggactagctatcaatgtgatgtatcaccttactgatccccaaaaacgggcagtcggctttaaactcagcgacggcatgaccgttcccgccgaactcgcggataaatttaaatttgcccgccaaaaatcaaaactcgccggcaccattcgcggatccttcttcgtaattaaaggaagttactgatcgcaacatctatcacgtaccagatcaggttcaccaacaaaacggtcgatgcataactgcgcatcgaccgttttatagtattcaaggtaaaataactgacaaaataagttgcacattcaacaacgtaatgatgccggttaaaacatatcccatccaacgcacgactggagaattaacgtgctggcccattaagtcacgccgatcggttaatgccactagcggaaatagcgtaaatggcagcgcaatgctcagtgctacttgcgcgtaaacaataacctgctcaaagtgttgctcgctaaaacccatcacaaagccaatgatcatgatcggaatcagcgtaaccaaccgcgtcaataaacgtctggcccacaacggaatctgaatgttcaaatagccttccatcacaatctgaccagctaaggtactagcaatcgaactgattaaacccgtgatcaataacgcaaaggcaaacaaggtgctcattaagggactggccagaccacccacgattgccggatttttcaagccgttataaacaccttcaaatgcggtggcgtggctgctcatgccataaaataaagttgcccccagaatcagcaacagcgcattaattataaatgccgcgactaaatggacattagaatcccatttgccaaagcgcagcgcctcggtgacctgcgcgggaatatgttcatcatatcggcggctttgggccagcgatgagtgcaagtagatattatgtggcataatggtcgcacccataatgcccaggcttaataacaacatgccacgattagtcagaatctcggtatgcggaaccaaccctgcaacaatgcctcccattgacggccgcgcccgcaccacttcaatgccgaaaataatgccaactgttagaatagatgccaacacaatcaactcgatccggcgaatgccaaaccgcaaaaacatcaacaccaccaacacatccgcgatcgttagcagcatcccccacatcaatggcaggccgaataatagcttcaacgcaatcgccgtaccgacaactccggtcatatccgttgccatcatggctgcttcgttcaccagccacaatccgattcgactccacttcggaacaaacgccgcaatcgcttgagccaaatccaaccgcgcgaccaccccgagtttaatggccaaggtttgcatgaacatcgccgccaaaattgacaatagcaacaccgctaataatgtctcatgatagcgactcccgccctccaacgccgtcagccaattgccgggatccatatacccaaccgcaaccaacgcaccgggaccactgtaggccaggaacttttgaacaaatgatggttcatacactcccggtacctgcacactgcgattaatctcatccaaactaggctttgcttgctggacgctgagctgctcatttcgcttggtcatgacgcatcacctctgcagcaaccttttctttcgccagcgttgctaaaaaggcacaaaacgcaggactgccattcatggggcggacagttttaaagactttaccgccattagcgcgaaaagtttgatagttttgaacatcattttcttctaacgtctccaaacaatccgtcacgaaactaggcgtcgtcaccaacacccgccttttgcccaacgctgctaaggccactaaacgattgcgtaaatacggctttaaccacggtaccggtccgaacttcgactgataacacgtctctacaatggccggtggtactttggtcagataacgcttaacccctgctgtagtcgcttcacaggcttgctgataaggatcgccatgccgcaccatcgcggttggaatgccatgataactcataatcacggcatcatagtcaccttgtatgtacgcatcgtccagttgttgcgctaataacttctgataagcggactgctcgtaaaagtgctcaacgttcaatgttttaacacccgatgctgcgactttttccaggattgtcttggtggtgctttgggtatacgccggaaaaaggggaatgacaacaatcggccgatccccgcgtgctgccattgcttgcaaggaggcggcaatgggatactgaccgccataagtcatcgccatttgaacatcccaatccggaagtgcctggcgcaagcgatcacgtgtgacttgcgtataagcaatcaacggtgagccagcctgcgtccactcgtgctgataaaatgtcgctgaccgccaactgcgaaatggtagcacaaatccacgtaaaatcggttgccataaaattttaggcatggtaatcacattctgatcgcttaaaaactcccgcaaataacgccggacatctttggtttgcggtgaaaccggcgatcccaaatttacaattaataacccctttgccatttaactgcccccattgtctccaaaaattataatttaagaataacacaggtccatcgctttaaatttgctttcttggagcgagtcgtttaaatcattccggttatcaactgccaaatcctacgctgacggcaaatctttttcgcgctttcgagacacaaaaacctcgccgcaccacaatattgggcacgcttcccgccaaccaactcctgcttctatgctaaactaacattagaaggataaaacgtttgccgaggtgaaatcggcgagcgtcagactgtcgaggaggcaaatttaatggctacgaaaggcattaccgtctacctagtgcgccatgggcagacatggtttaatcactttaataaaatgcagggttggagcgactcgccgttgactgaaaacgggatcaaggacggcaccaataccggagtcatcttgcgtaatgttgcctttacccacgcgtattgcagtgacactacccgggcaacccggacagcagacttgattttaagcaaaaatgtcacgggtaagattccgctgacagtgacgccgtttttccgggaacaattttacggctattttgaaggtgaagattcgggacaaacctggtacatggttgggttcccccacggtgcccgtacttatccggagattctcgaaaaatacggtgtcgatgcgtctaaagacttcatgcatgacgctgatccgtttcatgaagcagaagacgctcgaacttactggacgcggctaatgaaggggtttcggcagttgcgctcggagaatcatgaaggcgacaaagtactgatggtcagtcatggtacaacgattcgcagtattgttgacaagtttggcaaaaatgatggcttcgtagtaaccgactcaccgcgcaatggttcaatcagtaaaatattactgacggacacaggcattaaggtcttaagttataatgaattcgaagcctgattcaatttaaaccttcaagcggtgatttttcagccgctttttttgatgaaaccaaaagggtcacacaaccagctttgcatggttgtgtgaccctttttcagacattttattccctatctaggccactgcgactagtgaaccaattctttttcctcaatgagtgaaccgccgtggatgaactccggattcggggtcaaatcgaagcgttcggccagctgttccagattctcgtctgtgatttcgttgacaaactgaccaccttgcgcctgaattgcggtgtagatagtagcggctttttcaacggtttcaattaagccgtatgtttcgtcaatcgaatcgccagcaccgaagataccatgcagcggccacaaaacgatccggtattggcccattttttcggcagttgcctggccgatttcgttggttcctggcgtcatgtatggtaaaacgccaacgccttcagggaaaacaacgattgattctgcctgcatcttccagagaatgcggctgaacaatttttctttccacggtaacgtaaaggtcatagcaatggtgttcgttggatgacagtgcatcacaacccgctgattaggatcctgcttaagccgttggatatgggtcatcaaatgtgccgggaattcactggtcggctgaccgccatcggaaaagccccagagtaaatcgacactttgaccgtcttgattaatccgaaccagtcctgtatcacgttccgggaagtctttgacgttcttgaaatagcgaccggtcccggttaccaagaaatattgacctgccaaggcactggcatcaaacttaatcgggatcgtgcgcttgacttcatgaacatcaccgtactgatcgacttcctgctttgtaagtcgatagctgacattgccgccatttcgttcatcccaaccatgttgataaagattccacgtcaccttacgcatctgttgcacaaatggtgaatcaataaacgcctgtgtatattccggattcaagaaatctttttttgaatctgccatgaaaacgttccttctttcttctggtcatcatgccaaagctatccctttacagtgtcaaataaacagatcaacttttttgttgtcttaaaaagcgtcaaacctactgcacccgaatagccattagcatgtttgttatcaatctttcttacagcttctattttacgaagccatgtaagcgctcgaccagaccaaatgtacgcatcaaaacagcaaaatcggaacagatgcacatatcacccggtatcctggaaatgaaagctcaatccggttataacatgacgaatagcacttcacggttggcccgtcagtattttggcttttcataacgcactacacaaaaatcggctttagcgtgatggacaaaaccatcgctaaagccgattacgattcattttaacggttcaaattttttcagaccacactgccgggttgcttaagactttgaggccaggttcttattaatcacaatactctggtaaatccagacggttgccagatagtacaaaccgtacagcacgatgaataacgcgaacggtactaacaaatgaccatatggctcgcttaacagggtcttgaacaactgtaatccgaataacacgtgcacgatgccgaccactcctggcaagaggaacaaggcgccgatttcctggcgaatcgaccgacgtaaaacgcgcggccgggcaccaattttttgcaacatgagataacggttcttatcgtaattggcacccgatagaattttgaacatcaacgttgaagccaacatcgccaagaaagcaattcctaggaagaagcccatgaaagccaagccggaatacaggccattgaccaccgcatagaagacaaatttctgatcgccattgctgctccaaagccgtggatattggtgctgctgcagcgtcacaatcctttgaatcgtatcgtaattctgattgaagtctttaactttaatggttgtcaaggtctccggattccccaacttggcaaaagtggcagcatccgcaaccttcatctgcttgccgcgattgttcccgatgaagatgccaaaagcaccggggtacaattcgatcagcttttcaaagttctgactggtgactttgatgttgggtgcattgatgcctttatccaccgctttaatttccaacggatgggcgtcaagttccgtttgactgatgtagacggttttagcatctgatttaagttcgtattgctgtttggcggtcacatcctgcaacttattgatttctgcgcgggtggcggcatttggtgaagcaaccgtcacgtcgtaaactgtcgactgacttgccagcttgggaatgtcatgcgtaaagcccatccccacggtaatggcgcctaaagccagtgcaaacagcatggcaactacggataagatgcgggtatagtcccgaatccgaaaactgagctgggacaacgtgaacgtatgcaactgcttggctgcaaatgtccgattccgcttcattaaactgattaaagccacaaagacggaattaaataagaaatatgttcccaaaacaatggttaccaaagctagcggaatcgccattaactgaaacttaggaacattggccatgctgtaataaccgatagccagcaagatcacaccgaggacaatctgcaaggcaaagctgcttttgtgttgcttaatccgattcggtgtctgggcctgatgtaataactgcaacatcggcgttttcagcaattttgccgcgttatacatagcagacaaaagaaataggacgaagaagaaacctagtgtccataaaatggctggcacccagatcggtgaaaaacccgtggctggtgcatgtaaagcggcgataatccattttccaataaaaagtgtgccaaccatgccaataagaatcccgccaatcgtcgccataatcccgactgtgacggtttcaaggaaaatcagctggccgattttacgcccttttgcgcccagcatcatgaacatcgcataatcgcgttgacgcatactgagcaaaaagctgttggcgtacacaatataaactaacgtgataatcgccagcaaaactgccccgaacccgaaaataaacggggtgaagccgatgggtgaatttttctttaaaaagctcgtgttcgttgctaaagccataaacatgtagaaaacagcgctggcaatgaccagtccggagaataagaccgcatagtcgcggaaacggttttttaagccgccaagtgcgagtttacttaacattcttgctgcctcctacttctgaaatgtgccgagggtctcaagaatctcttgatagaaagcttcttgactcttgtcaccgtggacgagctcagaaccgatctgaccgtctttgatgaacaagatccgactggcatagctggcggaaaacggatcgtgggtcaccagcagaatcgacacaccttcgtcacgattcaaatgcgccatggtatccaacaattcgcgcgcagccttggaatcaagtgcgccggttggttcatcaccaaaaagaatatccggctgctgaaccaatgcccgagccgcggctacccgttgtttttgaccaccggaaagttcggttgggtaatgatccaacacgtgttcaatgccaagcgtttgcgcgatcttatcaacggcttcggtttgctttttagcgctgacattttgcaaggcaagtggcaatgcaatgttttcccggccggttaagttttctagtaagttgaaatcctggaaaataaagccgatctttttggcgcgaaaatcggataaggcgtctcctttgagtttggtcacatcggcgcctttgatgcgaacggaaccggatgtcggggtgtctagcgtgcttagaatattcaataaagtggttttaccggagcctgaagcacccataatcccaacgaattcaccgggttcaacctgaaaactcacaccttttagtgccggcgtttgtttttccccttgtttgccatatgttttcgtaacattttcaaccgttacaacaggttgcttgtccatgataaacctccatttgcaatgtgcttgctttttatttacaagattaatgataatggctgccagcaattttttcctgataatgcactaacggatgacggatcgaaactaacgggtttgtaagctactttagcttttctttatttttggcccccatctcgccgtaatccttgctataatcacacatgagctatgaaaatccttatgaaagttggttaatcgtgggaacctttcgcaacaaaacgcccgggctaagttcaaaatcagcggctgattgaacttagtaaaggagcacattttaatatgaatgatttagaaaaaccgcaaaagcagtacattccctggatgattgtcggcttgatggactttgtcaccgtcatcgggtttgacgacatcatctataacttccagaatcaaggcttggtggcattcaccagctggattatcatgaccttcttttatgtcattccgtataatctgattgtcgcacatatgggttcgaccttttccgaacacggtggcgggatcaccagctggatgcgcgaaaccaatggcgatacggttggttactatgcggcctggttttattggatcaccgggctgccttatgtcgtggatgtggccaattcggttgttatttcttttggctggatcaccaacggcaacggtaacattcaagccaaccttggtaatgcatggtttggtattctcacggccgttatctttgtgatctttatctggttacagcacttcttcaaaaataaaagtcttgagatcatgtcaacgatcggcggcggggccatgtttatcatgacggttttattcgtgatcatgaccttcatcgggttatccaaaggcgcaccgattgccacccgcccgtttgatttcaaggccttcatccccaaagatttcttttcactgagcttcctatcgacttttggcttgttcgtctttgccatgaacggctccgaacttgccgctccctacaccaaggacatgcgccatcctgcccgtgattttcccaaagcattgaaaatgattgcgatcatgaccatgttcctgacactttttggcaccttttcattaggggtttactttaacgcccaccatctgccaaacgatttgaaaatgaatggttcctactatgcgtttcaagccattggtcgtcaattcgggatgggcaacagtctgatgtatctgttcgccgtggtgcaaggtatttatatgttagcccagctggctgtgattctggacgcctcaacccgggtcttcctgtccgatgtggccaagcgcttcatgccgcgtcagttgacaaagatgaacgaagacggcttgccgattaatggttactggatgacaacgattctgtgtgcgttgatcatggcactcggcgcacttttgccgaaaatcaatgacatcttcaactggctgctcaatctcaacggcattgtcagcccgctgtccacttgcttcttgttctggtcctacacgatggtccggttacatcaggatcggttcccgacgcctgattatacgtttcttaaaaatcgaaaaatcggcttagttgtcggtatctggatgttagggattacctttttacttggcacccttggcttcttcccgactgacgccaccgcggacacttttgcactcatgctcggtttgaatatcgtggtgccaattggcatggtcacgcttggcgttttgatgccgtggatcgccaaacgtcagcggcaagcagataacggccttgcgtttagccgcaacacctggttggtactcactaccctcagcttagtcgggctagttgttgcagctacttatgggatgcacgtcaacttactcgatcacttaacgcctgtcattcaatggccactgattgtcatcgttgaccttgccattgccggggtggtgctcaaagtcaccgcaaacggccggcatcaacgggtggctggttcgcctgatgagggatgagttctggcttactatcttaagagataattttataaataaagattagctatatgatgtcccggcaacgaaacctgttgctagggcattttttggctgtaaccggattgtccagcagaaaaaatcaaccgccgccagcaactaccagtcagcgacaccgttaccacaccgcgtccatcgtagcaaaaagttggcacttactatgctggcagtaagttaagtagccaccgtgacaacgtgataaaattaattgtagaaattggttttttgcatagctgcttcgacttatttttaaacaatcgttgaagactcagaatattaggaggtgccgtatgctcagctacacgattatttataatcctgcttccggccacgctaaaggcccgactgccgccgaacagctcaaggccaaacttgaagatcgccagcggcaagtcaccatggcaccgactaaaagtgctgatgacgcccgaaattttgcttatcaagcccaatcggatattgtcgttgcagttggcggagatggcacgattaaccaagtcgttgccgggctcgcaccgcgcaaacaaccgccaacgctcgctattttaccggaaggcacggtcaataacctggctaaagtcctgcatattccgttactgctgccactggcgatcaagaacatcttagaagccaagccgcagccattagacattgcacaggtcaatgatcgttacatggtaagtaccttgacactcggtgttttagccaatgcggcgttgtccgtcactcaaaaagaaaaacgtcattttggtcccatcatctacttattaaagggttttaaagttttggcccaacaccaacactggatcctacacttgaacagtgctcacaaccactgggaaaaagacacccaatttctgctagtcagcatgaccaattccgttggcggttttacgaacgcggtgccagatgccgccgtggatgatggccatctacatgtttttatcgccccaaaactaacctggtggcgctcactactagccatcccctacttcatcaccggcaactttcagaaactacccggcatgacttatttcgccaccgagcaacttaccatcgaggctccaaaaacgctccaaagcagggttgacggcgacccgagcaccaagacgccgctaaaattgactgtcatcgctgaccatattcaagtattagccccaccggtgggaaaataatctgacagtgccgcatatgaatgacttattgcatttataacgtctacttttaagttgcgcagtttcaacggcttttgactgtcgtgctgctttttttactagcctgaacagtcctcgaatagtccgttagtgtaaaatttcgctcgataagacgatagggccggatgataaaaccatgaaaaatagaaagtaagagctggcggagcggtggcgggctcagtggtgaaattggtcttaagcggagtgggcttctccgctttagaccaaggccgagcttcgaaaccgcggtctttgcgggttcgaagtcgtgcccaccacgttccagcccagccaccgcggagccagctcggagtatcggaaatcacttaattagagtagaaccaagtaaagttgacacttacgaatagtccgttctaatagtctttccaaaattcccgtgttacactagacttattcaaatgagaggggtgaatcgccatgcggttacgcaaggttgcaccatgactgtcgattcgttagtaccgatctgtggcgataacgcccggatctatgaaaggaatttatgactgaacaaatatctaatgaagtaacttctgaaaatgttttaattgccggcatttcgcggcaacaacctgactttgactacaccatgaccgaactcggtgaattagccaaagcggataactacaccgttgtcggcgaagtgcggcagaatctcgatcgcgcagtggcggccacttattttggttccggcaaagtagacgacattcgccaactggctaatgtccgcgaggcttcaaccgtgattatcaacgatgaattatcgccttcacaattgcgcaatcttgaaaagcagaccaaactgcatgtgattgatcgcacgcagctgattctcgacattttcgccgaccgcgcgcgcagtaaagccgccaaaactcaggttgaaatcgcccaattgcaatatgccttgccgcggcttcatcccagcgccaaccgcctcgaccagcaagtcggtggcggcgccggatttgccacgcgtggtgccggtgaaacccaacttgaactcgatcgtcgggtgctcaacaagcgcatcagtcacttgcgacaggaactcaaagacgccagcgtcggcgatcaagtacgtcgcgcccgtcgcgaagacaaagccattccagttgttgcattagtcggctacacaaatgccggcaaaagcacgaccatgaacgggctgctgcagctgtttgcggatcgcccggaagacaaacaggttttcgaaaaagacatgttatttgccacgctcgataccagcgttcgccaaatcaccttgcctgacaatcgcaaattcctgctgagcgacacggtcggtttcgtctccaaactgccccacaacctcatcgacagcttcaaagccacccttgccgaagctgccaacgccgacttgctcattcaggtagttgattattccgatgagaattacccggaaatgatggccatcaccgaaaaaacgctccgtgaagtcggcatcaccaatatcccgatgatcgaagcttacaacaaagccgatttacgcgaaggcacccgttatccggaaataaacggccaacgcctcgtctactcggctcgtgacaaacgctcgctccaagccctcaccgatctcatcaaagccaatctcttcggccaagatgaagaacacacctacctgatcccatttgatcaaggtcagctcgtcaactacctcaatcaggaaactgtggtcaaaaccactgactacacggaacacggcacgcgcattacagccgttgttaacccggttcaaaaaggtaagttggcacggtttgcggtaaaagagaaagtttgacttaaaaccataattgacaccaatagggaccttgcttttcgctgcttaatcattgtaagcaggattggcacggtccctttttatagcgttaaaccgaatttggcgttgatcggctattatggtcactcaagaacaccaaatttatagccattatcacggtaataggcaataattttaggtaaggtttgaactgtcaagtctttacccagtgcgtcatgcatcagcaccacccgcacttgactcgtgggataaacggccaatgaccgtaaatgatattgcaacatggccgcttcggtttttggttcctgcgcctgactcaaagcatctccaaccgcagcattccaatcaatccaatccaaccccaaccgtgccaagcctttgtcggcatcagccagacccttccagctaaaatgaccgcctggatatcgccataaatgggtgacaaaatccggtcccagcgcctgcttaaccatcgtctgctccaacttagcctcatgctcgatcgcagccgtcgctccaactcgtcccggataaagcacattataattatgcgttatactatgtaagccaatgctattgcccccatcatatatcgccttcaaaaccggtacagtcgcaggcgaaagctgtcgcccaacgacaaagaaagtgccatgaaccccttcttgattgagaatgttcaaaacgcgtggcgaattgaccgtattcggcccatcatcaaaagtcagaaacacgactttttctttgatattgctcgtgttgggttcggtcatttcctgtttgacttgagcaacggggtaagcgtaagcactggctgtggcgaggtgactctgtccgcttggcattgacggtttctctgattctgcagttttttgttttgaccgtgctattgacgcccgctgcctttcaacaagacgtgaccttgaggcagcggccttaactcgtgccttcttcaggctagccaggtcgtcttggcgctgctgggtcgcaaccaactggcgaactactaacaagccgccaacaatgataagcgttgtcaggaacattatcaggaccatgaagtttttgctactgctatgttgccgcttctttcttcgcatcgtccaactccagtttattagtttaatccgagtgcaagtttatcatgatttgcgctgttacagttgttagacgacttgcgttttaagatcaactaaaaatccatctttagttcgcaccgaaacggcaagtaaagatggattagtaaaatctattcttcaacgctactcaacgcagcgcctaaaaattgcaaagactcgttcaacattgagtgcgaaacgattgcgggcgctctttcactcgtccaaactcatataaaattgcattcagaatccgctcagaagcgcgaccatcgccatatggattcttagcatctgccatgcgctgatattccgcatggtcatccaatagttgaagcatagccgttttcaccgtctgcggttcagtacctaccaacttcaacgtcccggcttgaaccccctccggccgttccgtcctgtcgcgcaagaccaaaaccggcttacccaatgaaggcgcctcttcctgaacaccaccagagtcagtcataataaaatagctccgcgcggctaaattatggaaatcgacaacatctaacgggtcaatcaagtgaattctggaatgatgatctaaaattgaatcagctgtctcttgaacaactggattcaaatgcacaggatagatcaactcaatatccgcatgggtctcaaccacttcgcgcatcacgcggaagactcgccgcattggctccccttgattttcccggcgatgcatggtgacaagaatcattttttgtttggatcaatcagatcaagcacttgatgatgataatctgtctgaacagtttgatcaagtgcgtcaatcgctgtattgccagtcacgaaaatctgctcttcaggatgatgctcggccagaagattggcctgactctgttcagttggggcaaagtacaagtcactcagaacatcggtgagttgtcggttcatctcttccggatagggactgtatttgtcccaagtgcgcaacccagcctcgacatgcccaatttttgtctgctgataaaacgcagaaacgctagcggcaaaggtagtcgttgtatcgccatgaaccaagacaatatctggctgttctgtggcaataatctggcccaattgcaatatcacgttactggtgatatcaggcaatgtctgccgtgctttcatgatgttcaagtcgtaatcaggtttgatgtgaaaggttgtcaatacctgatcaagcatttcgcgatgctgcccggtgacaactgttacttcattgaattgatcatgacattgtttaagtctttgtacgattggagccattttgattgcttccgggcgcgttccgaacacggttattactttaagtttgggcattaaggaatctcctcgtatattttgtgactggtacattagcggttcaaattgttggcatacttgatcacaaggtagtctgggtatcccatgaaacattggaagaacggtgtttcacaaatgatatcctgtagtttgcaaaatgatttgagcgtccgaccaactttggaagagaagctaattgacaagttgctaccagcttggccaataaattgggctgatgaattgaaccctttcgatatgaggactacgcaaagcccctaaacatgcgttaaaggatcaaaattgacaagccagatcggtgtctagtaacgatagactaccgtgtgtcgtcgatagattgtcaacaatgcacgataaaaacccaaaccaaagaaaagcatatacatctactatacaacgataatggtgggctagctgtcatgacgtcatttaacggccaactttgcggcggttattcagcttggtccggacaatcccggacatgagaacaaattcaggcctcaattgtattggcttcaaccctgtgtcaacccgattgaaatcaaattgctaatgacaaagaatactgcagtaacagccgttccccacctcaaaaagacgtttaaaagttttttgggcgaaatatacttatattgctctgtatatattctgacaatgatatatataaaggaaaaatttaagaaaagcagtgttcgtggtccagatgcgtaaacggttggtgaaaagccaacagccacagccgttaataaacccgaaattaaaacaacgtcaagaaaaagaccagttgaaagtttttcaaaagcatttaacaaaacaattaaaactgcagcgaaaatcaaggaatacagtacaaaaggaacataacttgtaaagttgaagtagttagttgccccaactctagcttgatcagcaacgtcattaaataattgatcaaactttggagagtatatgatgacaattggtttcaaaattgtacgcgtcaagacaaaggctaagggaacgatccccgtggcaacgagtactttggaacgtcgctgagatgtcacggcaacaagaaaaatcatgaatgcaaagcacagaaacaagaaactgttatcagtcatctctgaaaaagcgtgattaacacctatgacaaatttgtccacaactgtcagtccggaaaaatcaagcatgttatccttagtctctgtgacaagtctcaatttattcccgggagaatataaagcaaatacgatgttggcaattgagatggcgtattgtagcacagtaaaaatgaaccctaaaatggtgaaacgacgaaaatagcacatggccagtgaaaagtatgtcagcaagcagagatacataattccaaatgtttcaaaatttgtggcaaatgctaaagcaaaaagcgccagtaaagcaggaacgacccctactttcttttgattataaattctatcaagtaaaaccattgcgtaactgcccattgcaagtggccataaatagttaattgttgtcgccatccacccagccgattgcatctgtatgatcggataaatgaatacaagtgaaatcactaaataattatgcttataatgtgtcaatgccatgagagaccatatcaacagcatccacattaaagtatcaataaccgcccacgttgttgtgtgcataccgctagacaatcttattaacggagcctctataagaacacgtgaggtccatgaactataacgccaataaagtacagataaaagcgacgaatgatcaatgaggtgggaaaaaacggcgatagcatcaccaacatattcacgcataaagatatgttctaccagcaagactagaaaagctatgcccaacgcagaataccgagaatctcttgaaacctttgaccaaattttcttaatcattttataccaccaatttgtaatctatacctgtcactagtagtttaaactctctgctgaacagtccacgaacatcaaattgttcgcccaacttcagcgaagaccttaaagcatgccagcgcctacagtttgttaccgctcactggtcgttaaaatttatactagcagcgagcaacgttagaggataactgtttctctttctttatttttagcctctataacctgccctagtctgcaggtaagttcaactgtatgaaataccaatagcaataaagttattgatgactgaaaagactgtaaaagctataagcccccattttgcaataaagttcagatacatgttttgactaataaatggtttagatttttcatacataattgtgatgatataaatcaaaatgatatccaagaaaaggaaagtccgcggtccagacacatacatcgatggtgaaaatccaaccgcaacagttgttaataggccagatacaaacacaactgttaaaaatatgccaaagttaaagtttttaaaagcattgcataaaacaagtaatatcgaaataagtaacacaacatacaaaagaaatggtatgtagtacatcacattgaaataattaagcgcgtcgattctttgttgttctgctgcgtccttaaacaaggcactaaattctggtaaataaactttagcaattggtgcaatgatggtccgagcaagaacaaacgaaaaaggtataaacgcagccacaagtattcttcgcgatttgctttttaaaaatagcgcaataacaaccaacattatcgtaaacaaaaagaagaagaagttcttgtctgttaattctgagaatgtatgggtatatcccattactaacttgtcaaacgggcctaaattggcaaaatctagcatacgaaatttagtttcgacaagcactcgtgctttgtttccaggagctatcaaagcaagtccaacgtttgctatacaaattagatattgagaagcggtgaataaaacaccaagtgtggacacgcgtcgctttaaaatcattgcaaccgcaaaaaaagagagtatgcacagatacatcacaccatatgtttcaaagttagtagcaaaagctagccccaaaagtgttacaagacctgttactatattggctttctcgtggtaataaattttataaagtgaaacaagggcgaatgtccctaaagcagctggccaaaaataattgatagacgtggccatccagccagccccattcatgagtgatagcggtatcattaacaccagtgacataattaagtagttgtgacggccgcgagttaacttcattaacgaccagagtaacagcatccacatcagtatatcgataattatccagactttaatatgcatgttttgtgacaatttcaacaaaacggattcgataaagattcttgaagtccaagttgtatatcgccaatgtaatgtcgcaagtaatgtagttcgatctaagtagtgagaaaaggcagttgctgcatctccggtatattcccgtataaacaggtgctgtaatgtaaccacgaaaaacgcaatacttagacattggagttgtgaattatcacgaatttttgcccctattctccttatcattttacaccacccaccttatagtctatcccagtcttaaccaaatctgtctgctgtttgttggcaacaagaaatccgattttatactttttttctttctcatttgtcatatactttattggaatgtaaccgtgaaaaccactgttcatataattgtaaacaccggcttttccacgcatcttagcaacatcatttcgatcctccatttttaaaggaaagatctgaacttctttgctgtcttttgtatacaaaacgaggctggtgacaaacttctgaggctcttgccccttaacgaaaatccagccagaaatttccgtataatcgcggttttttaaaccaagtgtttctatactatatttaacccgtttctttggcatgatcgaaaattttgttactggttcaacttttggcactgcatgactccgatattggacaaccacgcaaaccaaagcaacaagaagaccagtcccgataattagccaggaaataacctttctcttaaaactgtctgtcatttaatttttcctccttgaacaacgcccttttaagattaccatatgttgattgaatggtcagtcctttcttgaatcgttcagaaattaatcatgctgacttagaaattgttcaatagcaagagcactgacatactaaaacaccaccagatatgttattctggtggcgtttttaagatgatcactcttatcgttcagtaagtctacttcgtgggacaatgtaagtgacattaaaataattgacctattttcaaacctgaatgtagtttacttatcgacaatcttcaaaaagtctttcaaagcatcctgccacgtcggaatctcaaacccagtggccttcgtcttgctcaaatccaaaatcgaatgccgcggccgccatgctttttgcggatactccgctgacgataccggtttcaccgtgacatctttatcggccaagatggcactggcaaactcataccagttacaactgttgtcattggacaagtgatagataccataatctaaatgctgatcaacggcaaaggtcataaactcggctagcgtcttggtccatgatggacggccatattgatcgtccaccacggtcagttccttatgcgttttggcgaggttcaacatcgtgtagacaaagttgtgaccatattcaccaaagacccaagaagtccgaatgatgtagtacttcttaaggtacttttgcacctgctgttcgccttcgtatttagcccgcccatattcattgcgtggcgccggctgatcgtcaacggtgtaaatctccttactatcgccatcaaacacgtaatcggtgctgatgtaaaccaaggttgcatcaactttggccgctgctttagccaagttacgcgtaccgtcaacgttcaccaattgattgagcgcttttgcttcgtcttcggctttatcaacggctgtataggcagcacagtgatacaccacgtctggctgatagtccgcaaagtactgattaacggcggcttcatcggtaatatctaagtctttggcatcagttgcccgataagtaatgccgcgtgcatccaataagtggcgtagttcggtgcctagttggccttgtgcgccggtaatcaaaatcttcatctatcttctcctcgacattttaaaacttggcaagtccgatccattgcgttggtcgcaactcattgaccattctgcttgtacttcgcttcaaccgcagacttttcatcttgccaccagctacgatgatcggtgtaccacttaatggtgtccgccaagccttcttcaaagtcggtatattgcggtttccagcctaactcttcgcgggtcttggaagcgtcaatggcataacgcatatcatggcccgggcgatctttgacctgatcataatagtcagtcggtttgcccatgagcttcaagatcaattcgagcacggtcttgttatcctgttcgccattagccccgattaagtaagtttcgccaatcttgcctttagtcaaaatgtcccagatggcgctggaatgatcattggtgtgaatccaatcacggacattcttaccggtgccataaagttttggcttaataccattcaaaatattggtgatttgtcgcggaatgaacttttcaatatgttgataggggccatagttattggagcaattagagatggtcgcccgaacgccaaaggaacgtgcccacgcatgaacaagcatgtcactcgccgctttggttgaagaataagggcttgaagggttgtaacgactgttgatcgtgaacttttcacctgggccttcgccatggccgggtagatcttcacgtaacggtaaatcaccataaacttcatcggttgagatgtggtggaagcgaacatcatacttacgggccgcttctaacaaagtataggtgccaatcacgttactgtgtaagaatggatccggattaatcagtgaattgtcattatgactttcagccgcaaagttaaccacggtgtccacttgacccatcagtttgtcaaccagttctttatcggcaatatcgccaacaactaatttaacccgatcgcccaaaacatcttcgatattggctttattgccggcataagtcagcttatccaacaccatgatctgaacatctggatggttcttgtaaacaaaatggacaaagtttgagccgataaagccggccccgcctgtaatcataagtttcatgtttaaatctccccgtaaacaaagttattctcggcatcttttaattgcggatgatgctgatctttctccgacataatcagatgtgccgttgacattggccagtcaatcccgatatccggatcatcaaacgcgatgccgcgatcagcttcaggggcataataaccctcaactttataaacaaagttaacattgggcgtcaaagtaatgaagccatgcgcgaaccccttaggaaccaagagttggcggtgattatattgacttaagatataaccttcccactgaccatatgtcggtgagcccttgcgaatatccactaagacatcctcaacgactccggtcaccacccgcaccagctttgtttgcgcataaggtgccatttggtaatgcatgccgcgtaaaaccccagcttcggccgacagcgactgattgtcttggttgaaatcatttttaatcccggcctcgacaaacttttcccgggtatacgtctccgtgaaaaagccgcgattgtcaccgaagacatcggtttcaactaacttaacatcctttaatttggttggaataacttttaaactcaagtgtctttgcctcctaggcttcttcgtctgctaagcgcaaaatgtactgaccgtaatcattcttcttaagcggctgcgccagtttgcgtaattgatcgcgatcaatgtaacccatccggtaggctacttcttcaagacaggcaattttaagattctgccgcttctgaacggtctcaataaaactagccgcctcatgtaaggattcatgggtgccagtatctaaccaagcaaatcctcgacccaacagctcaacatcaagttggccacgttcgagatacgctttgttcacatccgtaatctctagttcgcctcgtggtgacggtttaaggttcttagcaatgtccaccacttggttgtcatagaaatacatgccggtaaccgcaaagttactctccggatgctctggcttttcgacaatcgattgcacatgatgctgctcgtcaaaggctactacgccaaaacgctcagggtcattgacttgatagccgaacaccgttgccccggttgttttagccgccgagcgctgcaccagcttggacaagccgctgccataaaagatattgtcgccgagaatcaagcacacagaatcatcgccaatgaagtcagccccgacaatgaaagcttccgccaggccatttggcttttcctgtattttgtaactaatattgagtcccagttgtttaccgtcttttaacagatcctgaaaacgatcaatatctctcggcgttgaaatgaccaagatatcgcgaatcccagccaacatcatggttgacaggggatagtagatcatcggcttatcatataccggtaccagttgcttagagattgcctccgtaatcggatacagtcgggtgccagaaccaccggctagaatgatacctttcatgaagatagatcctccctcatttaaaatttcaataagctgctattttgctttcggtttctacttcaaccgctcacatgttacatgataccagtttacgcttacaagctgaactaaaagcaggaaaactttaaacatacccaacaaatcaatcatgacaaagccatccaaaaataaggcttatttgttacttattagcatgttgccttagttaagaaaaaacggcctaaaagaaaataaggccgtttccagaattgtcttaaatcgattacttacaccttgtgatagtgccagtaacagacatgcatgggcgtcatctgtgcgtaatcgtcataatgatctactgactcgttaagaagttcaaccaacctaagcaatgtctagtgctcgcttatcaatccagtaaaggctgccattagctaacttaatttggacaaaggttcccttcgccgttctcttttcttcgagtgcagtaaagtgctgtccattaagtgctttagcattcgtattacctactgcagttgccacactggtgaagaatggtccagagacgtatagaccatcggcacttgaactttggttgatgaccccagaataatcaaccttcttatctgacaggatcttatcatacttatcaatggctaaggctcgcttgtccgtccaataaacgctgccatcatttaatttaaccttgacaaatgttcccttagcagttttatcctcttcaaatgctgtaaaatgttgcccattaagtgctttggcattcgtattacccaccgcagttgcaacactagtaaagaatggaccagaagcatacaaaccatctgcgcgcgaactctaatcaaagctgcctgtataagaaaccgctgttgttgaaatgaccttatcatatcgatcaatggctaatgcacgtttatcaacccaataaatttttccatcattcagcttgatttcaacaaatgtgcccttggctgttgtgtcctcttcaagcgccgtgaagtgttgaccattaagtgccttggcattcgtattccctatggcagttgcgacactggtaaagaatggaccagctgtatacaaaccatctgcgcgtgagttttgatcaagactgcctgtataagaaaccggcgtctttgatgtaacggtgtcatattgttcaatcgccaacgcgcgtttatcaatccaatagacgctgccattattaaatcggatttgcacaaaagttcctttggctgttgtttcttcttgaagtgcagtgaaatgagctccgttgtatgctttggcagcagtattacctaccgacgtagcagcactggtataaaatggcgctgatgcatagagaccgtccgctcgtacgctctggtccaaagatccggaataagataccgttttttgcgaaacaattggatcgtagcttactgaactcggagcggtacttgtacttgcagcaccattttcacgcgtaaacaacccctgatagtctatcgaaacatcaagattctgactgtgcccaggaagatgtccggtagaagaaaattgccatgcgccaaagtcttgatcccatagcgagtttgcgcttggtgtatacggatactgcgcaatccaagtgcgatccttgccagttgttgaagtcaaagcgtccaaatgtttgtaataacgcattgtataggcaacatgattctggtaaccgcgctgggtcattgtctgccaaaaggctttcaagttcccagcaatgtctccactaacagcgtcagattcaatatcagcaacaaccgttacatttttaccgacattaagtgaatcaagtcgattagcaaaatagttagcttctgcaacggcagcactggccgaatcaaaggttgcataatgatatgcagaaacgaccatgccagcatttcgcgcaaacttaatttgatttgccgcaataccatttgtgtaataggttccttcagtgactttaacaacgacccctttaatccccaaattatgtaattgggtatagtcattttgtgtcatccagctttgccaatcagaaacatcaacaacgtcattacgcggaaccgatgaatcgcctatcgtaaagtttttcaaagtgtaatcgttagccgcaaacgtcgagatactgttttatccagtggttgtcgtgttatttccagcgtccaagacacttttttgcatcccaccagacatttgtgattcattcaaacttgattgagcagaaattgttgccccactattttctgctgcaaaagtcggtgttccaagaatcagtgttgaacacaaaaatgatgatgcgattgctgctgatgtccacaatgccccttttttcatgattaaattcctcctaagttaaaaactctgtaaaacaagcttaattagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaaggaaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaattatacattgattcgacaaactttaaaaaaacattctgattacaattcacaatcagcttagttgcattcattagtccccaaggtcttgccagttttcaaaaaaattccagaaaaagtagtgccgttgctttttctggaagtattattcgaatcaacttaaatgcgtaatatcctgctgaacaaccagatcatgcaacttctgccgttccggttcaatatcttcttccaacccctgtgaagatactttgtcaaacaggatcttgatcgtttgcaacaaaatccgcgcgtccaggaaaatactgtaggtcttaatgtatagcagatcaaacttgagcttgctatggtaatcggatgcatatttaccataaacctgtgcataccccgtaatacctgcccggacattgtgacgcaggtagtaatgcggctcctgctggttgaactggttgacaaaataaggacgctctggacgtggccccacgattgacatgtcaccttttaaaacgttaaaaatttgcggcaattcgtctaatcggaacttgcgtaggtacttgccaactggtgtaattcgcgaatcgtgcgctttagcaagaaccgggccagactttgcctctgccgttgccgacatggttcggaacttaagaatcttaaactctttttgattcaacgtaatccgcgtctgcttatagataacgggacccggagacgttagcttaaccaaaattgcagttaccagcatcagtggcgatgcgacaattaacatcaagataccaacaacaatgtcaaaagcacgctttagaatggcgctttctggtttgattcgaaactgagtaatacccatgacactttcatcttcaaagttcattaaattaggacgcagcatcatcagattttcgaaagtcgaaggtaaaagaatggttcgctcatttttgatgataagatcaataatttcacggcgttgctcatcggggagactcttagttaaataaaatatgtcgaccttatccatgatctttttggcattttcgacaaagtgatcggaaacaacataggtaactttatgtttattgtttttggctgaattaaaattttctagcacggccggaagttcatgttcataggaaagtacggccactttatagttactcgtaaaccgaatgtacatgtaatagatgaaaacgcgccagatgcctaagataagaatacttaacagaaacgaatagcccagcactaatcgtggaaacgcaaacagccggcccataaaggtaatcatcgtcaaaccggagatggtaataagttgtgccaaaaccgtgttgaagatgatgtcactaatgcgccgattatagtagacataaacacctaaaaagaagttaacgaacaagaacagcaaggaaatatagactgcagatcgttcgtacatatagaagttccactccggaatattccggccaaatcgccaataaaaggcaagtaggatacttagattaaaaagaccgacatcgccgatcattgttaacagccttttaacgccattccattcggcactctgtttcatacagcaaccctctcaatattgatatcttgacacgaaactaactgacccattatagcatatgggcagcattcgtcacttttgcaggatatcgttttaactgaatctagacaaccttcgtcaaaaccgccacctgacagtgtatgacaacccgtacttccatattggtcgcggcaaaaaaatgagcaccgttccctacagcccggctggcatgcactgctcctgacaagaaagatgatcggtcagcttctcaccgcctggccgatcattgtttactgaaccgacgccacatacttggcaagtccctgtgcaagtggcgtgtgggtcatgaagtcaaactgatccaacttgtccgtttgtgcatatgaatcgcgaatgtcaccaagacgcggggctttatgggtggcatgtaacgttttgccagtgagtttttcaagctctttggcaacctgatttaaggtggtctgtttgccgttagcaacgttgaaaacatcatcccgagcgcttggggtctctaacaagccgcgaatcgcatgcaccacatcaccaacatagatgaaatcgcgagtctgttcgccatcgccaaagaaggtgaatggtttgtcttcttgcaacgccgccatcatgatcgacaataccccactataaggcgacttagggttttgcttcggcccgtatacgttgaaaaagcgcgtgcaaaccattggcatgtcataaagccggccataattcaaaaccgcgcgttccgtggcaaatttgtcaactgcatattgggttagcggtttaacggccatgtcttctttcttaggtagctcaggagaatcaccataaactgcagcggaacttgcaaagaataactttttataaggtattttctgggtgcgcaaggtttcaatgatgttcaggttcgcttcctgattaacctgatgtgtcgcgtacggccgttcaaccgaatcagcaacactggcaatagcagccaacaagacaatgtaatcaaatcggccttccatcaaaagctgggacatgaaggcatgatccgtgatgctatgttcataaaaggtaatccggctagaatccggaatattggtccgcaagcccattgataaatcatcgacaatggttatcgtattgtcaggatccgtcaacaaaagctccgtcaaattggaaccgataaacccggcgccaccggtcactaagtagctgctcaagataatttcctccgtcttgcttgttttatttctctctcatggtatcacagcagcgaccagaccaccgcagctaatcgcaaatgttaggaaaatgataagaaccggtcaacgccttaactgttacccctttgcagcagcctgaccgatcatttgcttgaacggggacttaccagccgtcataggcaatttgtggtcaaaaagtaacagcaacccaaatcggttcaaaactttgccaagtgtggtgaggcaacgtacccacttacgaaaggaccgattgttgcctatatttaaaattgaggtgacaccgtgtcaccatctgtacgcttttgccagatgattttgcaaaataactaaagcaaatcggtcctgaccagacaaagttcgtctgccgaggaccgattttaatggctattaaagcactgatatcgagaatcattcaattcgactgtaccaaccgccgatccaaccaccgacttgccaaagataacgcatagttcaccacaaaatacatcacggccaatgccacaaacattggaatcatgtagttaatattttgaccataaatgatttgcgcgtgatacgtcgcttctggcagtaaaatgatcgtcgccagtgatgtgtctttgaccagcgaaataaactggctgacaatcggtgggatcattttcttcaatgcttggggcatgataatgtaccgcatcgcctgatagaaggtcaaaccgttactgcgcgccgcttccatctgcccgcgcggtacggcgttgatgcctgagcgaacgatttctgccaacattgccgattcaaagatgctcatcgcaacaatagcggcaacaatgacgttaagccggatgccaatgtctggcaaagcgaagtaagtgaagaatagaatcagcagtagcggcaaattacgaatgacgtcaatgacaaagccaaccgccgccgaaaaatattttatcttgacatagcgtgccaagcccaaaataaccccaaggacaaagctgaagaaaatcgaggcaatcgagacttccaaagtcacccctaagccttggagcaggtaccgtaaattaatccacgaatacgcatcaacaaaattttgcataaaacctgctcctttctaggcggtcacccattttttctcgagataacgcatcaggtaactcaacggcatcgtcaaaatcaaatagaaaatgccgacgattaagtacgtatcaaaagtcgaaaaagttgtcgccgcaattaatttaccttggtacatcagatcaaatccggcaacgaaggccagaacggaactattttttaccaaattgataaattgattgcccagtggtggaatgacaattttaaatgcctggggaaaaataatctgcgtcatcgcctgcgtataagtcatcccgatactccgcgcaccttccatctggccgctgggaactgcttcaatccccgcgcgcacggtttctgcgatgaaggcactcgtgtaaatcaacaggccaatggtgcccgcggtaaagccatcgattttgacaataaactggggcacgatcacgtagaatgccaaagtaataactagcagcggaatgttgcgcacaacttcgacataaattcgcccgatgactcgtaacggtttaaacggcgagatttccatgagtgcaaataatgtcccgacaatcaagctgccaatcaaagctaagatgctcgctgctaacgtgaaaccaagtccggaaagaaaggtgttccaattattggtaagaattgaccacatgttattccacctccttaagactgaatcctggcacatcgccgaaccacttcttgattagctttgcataagtcccgttttgtttgagttgtttgatcgccttattaaccgcgttgacaaacggcttctggcctttgttaatcgcaatcccgtatggctctttagtgaaggtgcccccggtgacaatatagttcttatcctgttctgacatcccgtataaaatcccattgtcagtggtcaaggcatcaccttggcctgatttcaaagcggtaaacgcctgcgcataatcggctaactgcagaacagtggtgtcgggagcagcttttttaacattatcaactgaattggacccttgcacgccgataactttggtgcctttcttcaaatccttcactgacttaatcggactgccttttttaactaaaagactttgcccggcattaaagtaaacatcggaaaagtccagaatcttttggcgctccggggtaatcgtcatggtagcgatcaccgcgtccaggttcccacctttaatcatcggcacgcgggtatcactggtcacctgaaccagctgggcgttcccttttttgcctaaaatctgcttggtaatcgccttggccatatcaacatcaaagccttcaattttaccggttttaatgttcatcaagccaaacagacgggtatcggccttgacgccccaaataatcgtattggttgccttggcgttcgctaaaatatcacgatccgccacacttttgccacagctgcttaacggtatcatcaatagtaacaacaccagtggcaggagcatgcgtttccacatttttgccattttaatgtccctcctcgtgagcgccagccagcgtgggtagaagccggattgtgtggtcattgcgaccaaggttcttacacacaagtttctggtcgggagccaacgcattatcgtagcacgagtcctcccggcggaaatgtcccgccagcaaacgcctcataactggaatcaatcctcaactggtcttgtcacactaatgattgatgatcttactgataaactctttggcgcgaggttcttgcggatcgtcgaagaactggttgacatcggttgaatcgactagaatcttgccatcgtccataaagacaatccgattgccgacatggcgggcaaaccccatttcgtgggttaccaccaccatcgtcatgccttgttcggcgatcttctgcataacgtccagcacatccccgatcatttccggatccaaggcactggttggctcgtcaaacaagatggctttaggcttcatcgccagactgcgggcaatggccacgcgctgttgttggcccccggataactcacccggaaaactgtctgccttactctccagtccaaccatcttaagcagatcgcgggcttcctgttcaacttccgccttgtctcgcttcaagactaaatcagggcctaaagtgatgttttgcaagacattcttattcgcatacaaattaaaatgctgaaagaccatgccgacatttttacgaatccggttcatatcggtttttttgtctgccaagtcaaagtcattgacaatcaattgtccggaagtaattcgttcaagaccattgatgcaccgcaaaaccgtacttttaccagaacctgaaggcccgataatggtcaccacctcaccgcgatcgatggttagattaatattttttaaggcttggaatttgccaaaatacttgttaacatcgtgaaattcgatcatagacatgttcgaggacctccttgggttcgcttgctcttatcatggattttacagataaaattaatgatacgcaaatatttcttttcaaaaagtcaagttttatgaccaccgaatccgtaaaactcccgaaactcaggattccgcaccatccacgattttcatcgtgacttacccgtgaacactgatcaccatacgacactttaatatcagccaactatcagcattaaaaaagagccgcgagttttaatggcactttcaaaactcgcgactcatatgcatttttattcttaaccatctgacagtagcgactacctaccgctgatgacgccgactttcacgcgtaggcaacggcggttcttccgcggaagacgttgctttgttttctgtcacagaagtccgcgcctcttctcgtgttggcaaagttgcaggagcggccggctgttcaccttcgcttgcagccggcgtcttatcctgataagccagctgcaccgttaaactgtatggctgcttctccttgcgcaaaccactgcgaccgagtaacttttgctctccgccaattaaaaagacattggcggcgactagatgataatcacgttgcgcctccgctgccggtaacaaaccaactcgttcaatggttgctagcggcttagccatcagcgcattcaagccgccagtgatgattagctcgtgatccgtgtgctgcaaatcgaaaaacggaattggaaacggcgcgccaatagctagaactggctgctgggtttcttgagccacgcgactaatcgctttgtcatcaagcccttgataattcagactcaagacgccttgtttaaccagactggcaactaagtcatccaaattggcttgctgctcagccgtcatggtcacatccgccgtcagcaattgatcctgggtaaacacgccactggccggcgctgcccccagttgcgttttcaattcgttttcggcagcagttttcttagccgaattactgcccaaccacttctcaactgtcggcgaaatatcaaaccgggttgtcttatttgtaaaatagtataagaagtttaaggcaataaaatacaaaaagacaacaaacgccagcatgaacaatgcaccacgaattcgaaaatccggataccgtaagttttgaatggcgatgtaaagtaggtaaaaattggcgacaaacgctatccacgtgaaggcttttccttttggcttgtcagcaatattaaagtagccaagtacgcggttgataatatcaattacagttaacatcatctcatcctttccgcggcttattgaccgccactactggtggtatccgtctcttggccattatcagtactcgtttgatcggatgcttggtcgttactggtcgtggtgctgcttggcgttgaggcggatgccgttgaagcggtcgaagcactcggcgttgaagcagaagcctcggtactcgttgtttctttttcaccagatggatgactcgcctgtacctgcgactgacttgctgcagatggctgcgaagttgatgtttgacttggctcagcttttgaagacgctgattgtgcagcccgtgaagccgattcggattttatttttgaaaccaattcactttgttcggttgccgattttggttgattgaccggattaatcgtattcacaatattataggcactaatcaggacaatgagcgaaacaatggcagtcggcggtaataatggcggtgttcgataagccatgaagccagctcctttcattcatcgattcattttaccctaaaaacagcccgaagcatcttaagttaccgctaaaattatacgacattctaagcagcagccaaaacggcgtagcgaaaccgctgctttgaactatctttaccaacattctatcgcctgcatggaaaaggcagttggtaaataaacgaaacgacatcagataattgatctgatgccgcctcatttagtctaccgttaaatttttttcacagcgcttcagctaccgattagcgtttttcaagcgatcagcatgttcttgacacgctgcgcacaagccgtagagttcaaaattatggctctgaatcttagcgccgggtacctgttcttcaaaataattcaagggacacatttttaattcgatcactttgccgcagttggtacaaataaaatgatggtggtgcggatgttgaaagtcgcactgaagcttaacgacaatttgatcgtcttccatacggctttcaacgatgcccatttcaatgaacgacttcacattgcggtatatcgtatcatgcgacaccccgggaaattgcgtgcgcatataccgatcgagaatcgtcaccgccgtgtaccgatgctgatttctacctaaataatcaaccatcgattcacgctgcttggtgacgcggtagccatgctgttttaactgcttcaaagcaatcgctgtgttatccataagaggctcctttggcttgacacttgaattctagacgtgtattctatcaaatcgtactggttacgattagcaacttacagtgtatcacgcctgataggaggaagcaacatggctgaaaaagccgattacgcatctgctgcacgccgtctcaaaagtaaaaaccccaaaacccgttcacgagcaaaacgggtgatcaaggcagttaagaaaacgacaaaataacaatcagaacggcaccttattgtcgctgccatgtcgaaaattgtaaagtaaaaacgttaaaggcctctaacgacaagatttttgtcattagaggccttttagtgctgccatcaagcattttatcgacacattaccagtctactagacattttacaaaattaatcgcgataattctcgaccaaggcctttttgccaccatgtcacttctgttcagtgtcgaccgacaaaaagccacaacttttaagcgccaagtccttcatgaaccggtcaatctgctgtcgcgcttcatcccaacgatcatttttaatgactgtcgcaaacggtttaagttcatcaggcaaggttaagtcgcgtttgtattcagggcttttcaatcgcgctgccaccatgttcggctcatctcctcgaccaagcaggcgatctttcaaaaccgtgggatcgtcaatggtcagaaacaaaacgacgacttcttttggcagctcacgaacatacgtaatcgcgcctttggtatccaaaacgatgcttaggaagggatgcttagcccagttcttctccagcgactcatgtgatgacccatattcatagccggcataagtgactttttcaataaaatgcttagtcgcaaaacttgccggtgtctcaaaataataatcaaccccgttttgttctccagtccgcggtggccgcgttgtgtgagtcatcacccgatgaattcggtagttgtcgcgcagatacgcgctcaccgttgttttaccagtccctgttgcccctgtgatcacaatcaacttatgcgcagccttcatgagcagcctccttaaatgattgcctcgattgtaccaaacctacgccgattcgtcagctcaaaatcaacgacccttgcgctttgatgccaaacttgctgaccgggttcacttacgtcaaatcctggtaaaaagcaatcacaccaactttactactttgaacaaaaccaatattttcgtaaaaggcgcgagtttggggctgatcatcggttaaaaggacccgttgacgaacctgtggaaactgatctactaatgcgtttaccaattgccgcccgatcccctgccgttgataactgggcaaaacgagtaaatcctgaataaataaaaacgtctcgccatcgccaaccgcccgaatcaaaccgactaaccgatcgccatcatgagcccccagcacgcttaacgattgcgctatcgcccgctcaagtttcttcggatctcgcgtgtacatgttccaaccaaccgcttgataaagggcaagcacatctgcctgatttaactgacgctgatcaattttaatcataataagcctcctcctgaacgtccaccgacatcaacgttgatgaacgctttaatgagttctattgtcgcatacattcatactcaatggatatgttcaggctcgcgtaatcgtaacgcgctcaccggcgcagggatctgcgtgtaaggaccttggtcgcaatggccaaagcccagccatcacgcccaaggctatttgacttcagaaagtggctagtaggcagtaaagtttcttatttaggcaattaagagaacagacattgcgttctataacgcgctcacagtcgcagcaatctacgtgtaaggacctctagcctaaatggccaaagaccagccatttaggctagaggccacttacactccgattgctaagcgctcctgttcgcgcttactaaaaaagaccggtcgccatgaccgatcttttagttactatttgcaggatgtgaacgataaattagagacgacggccgaagcttggtgcaaagtaagcaacactttgaaccgtaacgttttgtcctggctccggtgcgtggatgtactggccgttaccgatataaacgccaacgtgataagcattaccaacgctaccccagaagaccaagtcgccagcctggagatcggaaaccgaaacatatgagccaagtgtgctttgcgcctgagaggtacgtggcaggctaattccggcttctttagctgcgtaatagattaagcctgagcagtcaaacccagcaggtgatgtgccggcgtaaacatacggtacgccgaggtatttagcggcgttaccggcgatgctgccaccggaaacggaaactgtgctgcttccagctgaagcgggagcctgagaagatgcagctttactagagccgagactatttgaagaagcggttgtgctagaggaagcagaagtgcttgatgcgctagcggtggaactagcaacggctgtcactgctttttgagccgcctcagctttggcagcttcatcagcggccatggctgccagcttttctttgttagcatcaatcgtttgttgagcatcggcagctgccttatcagcatccgcctttaagccatcaatcttggctttatcactttcaagctggctcttggttgcaaccaggttcttttggttagcttcctgagcagctttcaggtttttaaccttggcttcggagtctttaacggcttgcaaagcttcggcgctggcttgactcaacttgctaactgtcaatgaccggccgacaagatctgtcagactgtcggagttcaaaatgaagtcaaaatagacattgccagtaaccgagtcgccggcacgcttttgcaaagaaatcagctgatccttcaaattgctcttacgcttgctgacttcctgattggcttttgtcagttgtgctgcgaaatcagcaatcttggcctgactgtccttgatcttggcttcggcatcctgaatcgccagaaccttattggaaacctcgttgttcaatttggcgcttttttcgttggcagtctgaacctgtttcaacaaatcgtcattttgcgcttgcaggctcgctttgtcgtctgccgcatgaacggttgttgccgcgaaacccgaaaccccaacaccggctaatgttgcaaccgtgatggcacccgtaaccaattgctttaatctcattttatcgccactcctgctctcattttgttcacaaggttcacactaacactgaactgttacaaactcgttacagggtggttaccatcagaatacttttgcgattacttcagcagcactttatgatcattttaataaccattttatttctaagttatatttgcgtttttaaatttaaaaaaagtcaggaataaaagcggctctttactcctgacttcctgcttattttgtcatttaatgctaaccggattgaaagtagccgcgactcgctacctagcttcattcatcgtctcaccgtaaccgaattacttgatttcaactaggaagtaccgcttctttccgcgccggacgatgacatattgaccatcaaaatgcgtgcttggatcaacttcaaagtctaagtcgcgttgacgggagccattgatggtgatcgcaccgttttgaatatcttcccgggcctgccgccgacttggttcgatcttggtggtatctaccaaccaggtcacaatgttttctgccgtttgcggcgcttcaaccgttggaaattgcttaaaacctttcttaatatcatcagcacttaaatccgcaacatcgcctgagaaaagtgccgcactgatactttcggcttgatcaactgctttttgtccatgaacaaacttggtaacggcacgggctaattcacgctgagctgcacgtttttccggatgcgtcttagtggcctcaaccaactcggcaatttcatcacgagataggaacgtgaagaacttgaggaatttttcgacatccgcatcgtcttgattaaaccagaactggtagaactcgtatggtgacgtcttttccggatccagccaaaccgctccgccagctgatttaccgaacttagtaccatccgctttcaacatcagcggattggtcaagccgtaagcacgggcgtcaggtccctcaaatcggtgaatcaaatcaatgccggccgtgatgttcccccactgatccgccccaccgatttgcagctgcacatcttcatgcttaaacaaatggaggaaatcaaccgactgtaaaatctggtaggtgaattcagtgtaagaaatgccagtctcaagccgacttgccacgacttccttattcagcatattattcaccgagaacaacttaccgtaatcccgtaaaaagtcgagcatcgaaattttggaaagccaatcgtaattgtccacaattcgaaaatcgtcggttccaaacagattctccatctgcgccgtcagtttcttcttgttcgtcgcaatggtctccattgtctgcaagaccctttccgagttgcggccagatggatccccaatcgaaccggttccgccaccgattaaaatgaccggtcgatgtcccattaactggaagcgcttgagaatcatgaaaggaatcagatgaccgacatgcagagaatcgccggttgggtcggtaccacagtatacgctaaccgccttttcttcggttaacttgcgcagcccggcttcatcggtcagctgattcagcgcaccccgccactttaattcatctaaaatctgtccttgctgtgtttctgtcattagaaaaatcctcctcgttacgatatggctagcatgatcagcacgttagcctcgagccaaaatgtacctgattacgaaaaaagtcgtccctgatcaactaagatcagggacgactttcaccgcggtaccacccaaattatgctttgcatcactctcatggatatcggcatgacccgcggccagaattcattgagctgtaattcgtgctatcaggtggaacggtttgcagcaaccaccgtttttctgaaagcctacctagataacactactgcgactcagctggtaaattttatagctcaaattttaacacatgcacgctatttgtacagaggcagtcgttaaactcatccacgaaaaccgcgcgctaactcccaaaagcctcgtttcggaaaatccaccgcaagcttacggatcttgcggcgcatcttccggtggtaaatcggccggataagtttttacatcggcatccaaaatatcgtacgcatccatcaatttgcgttcgactcgttcgcctaattcataagaatccgccacggtcatcttcggatccacccgaatgccgatcgtcagcagcaccgcatcgccggcataacgcgcttcaatgctttgaaccccgagaactccggaacctgcgtaattgtttgccgataagccgcaattttcttggtgtcaaacccatctgtcaattcaaaaatggcgtcacgaagaattgtccaagcggcatataaaatcaaaaggccgaccgcaatcgctgcgccgccatccagccacagccacccagctttcgcacctagaatggccaataaagtcccaccgctagtcgcagcatcggaaaaactatctttagacgctgtccgtaaaacgctgctgtccagttgcttggcgcgaatatgattcatcaacgaaacactcgccatggccacccccgcagctaggctcacgtaaaccgccaaaacaccgggcacttgcactttaccttggtaccatgcctgcaagccatggtagccatcaagcaccacgtccagaccaacgactaacataatcagacctgaaaataaggttgcaatcgtttgaaatcgccagtgcccaaatcgatgctcactgtcaggtcgttgctgggaaacttgcagcccccataataagataagcgccgaagccacacctgtcagattattcaagccatctgccgccaatgcccgggaatgtgctaattgcgcgatccacaattcggccactgttaaaccaccataaacgaccagattcaacgccgctgcatgctgggcacttttcagacgggcaaatcggcgttgttcatcttttaaaatattgcgaccagcatccatactaattccccctcgtcagaaaagtcattagaggctattataaagcaaaattgattttaatcatcgtttaaacacgttttttaacggcatcaagcgctttcttacaaaacttttacataggaataacctgttatttgcattagccatggttcacgctgaacaatacgacttttgtcacacttgggcgatctggcgcttcaaggcgttggttaaccgctcaagccgggcaattgtatcgtttaaggtcaaataataataaaccatattgccttcacggcgggatccaaccatcccaatatctttcagatgtttgagatgatgcgaggtagctggctgcgataatccgattgcatcagccagatcattaacactaacgcctacgtgattatcggccgcaccgagaatcataatcagcttttgccgacttgaattggataaggcatttaagtggccgatatcctgcttgaattcttttaatgcttcctgttgtgctgaactatatgccgccatagttggcctcctcatgaattgcgctgagcacacgcggtgaatcaattgacattcacaacgaataatacctgaaatcataacgattgcaacaaatatgcaaaccgttcatactatgcattaggataatcaatgactacttggaggtgcaatatgacaacgacaacaacctttcacggcttaggtgcggacaatacgttaaccgtttatgccgatggtgccaacgaattacttaatcaaagtgtcagtatgattcaggcttatgcgcatttgctatcgctttatgatgacgaatcgttgctaaccatgattaatgcccaggccggtaaaacaccggtccacattccggtacgaccggtgtttaatctcatcgcccaagcagtagcctggagcaaacgtggtctaggctacaatgcgttaatcggcccgatcgtcaagttatggcgaattggctttgccgatgcgcgtgttccatccgccagtgaagttaatgcagccctagctttaaccgacccgaatctagtcgagcttgattcggaaaatcaaaccgtctttttacctaaagaaggaatggttttggatcttggcggaattgccaaaggatttattgtcgaccaagtctatgatttatgggataaaaccggggttgaaggcggcttgattgacttaggtggcaaccagcgcctcgttggtaaagcggccagtggcattcctttgtggcagtggccaattgcggatccccgccatcccggccagcgcagcattgcaacgctgacaaccgagccaaaagccgttgtgacaaccggcatttttgaacgccattcagagattgccggcaaagaataccaccaccttatcgatcctaataccggttatccggtcgagtcgaacatggccagcatcactgtcattgccgataatggtcttatcggtgacgtgttatcttcagtcggtttctacgctggcgtcccggctggttacgatgcgatcgaagcagaaggtcaggaagcgatttttgtcaccaaagacacccgtgtttatcaaactagcggattacgcgaaacgcttgcggtgacgatgtagatcaaccgttttaactggcgactcaaaaagcagcagccattttttggttgctgctttttgcgatctctaatttagcacctctaacagctacctatagctacaatcccgactttttagatagcctgccaaatcacgcttccaggcggcaccatggttcccattggcaaaagtgaccgcagattagccggaacgagcttggcattcggatcttgtaaaacctgaggcgagcaggtggggttggctaagacgaccaacgtctgggcctcgttttgccggacaaagccgaggctgtcttcaaacgtgaacgggaaaaatgctgcatcggctgctaaggctggttgatcgatccgcgtctgtaacgcaatctgatacatatccaaaatggcttgatcttcgtgcccccatggataaaaggcgcggttgtccggatccttgccgccggttaatcctgcctcatcgccataataaagacaaggtacccccggcagccaataaagaagtgacacaatcaattgtaacttacgccgatcaccattcaacacggtcaagattcgcgccgtatcatgcgtgccaatgttattaaaattaaacgcaaacgcattgggcggatagttttccttgagcgtcattaactggcggacaaaaccggccgcgctgagttgaccgttgacaaaatcaatcaacatcgaccgcaacgggtaattcatcacggcgttcagctcgccaccttcaaaatactggcggcgtttgccataagcctgcttattcgatgcatcttcccaaacctcaccgatcaaaacccggtcaggaaactgatccaatgtcgtccgaatttgatgaataaagtcgtcagtcagctcatcggcgacatccaaacgccagccatccacgcccagatcggtccaataactgatcaccgaatcttttttagcggcaataaaattgtgaaaatcctgattgtctttattaatcgccgggaggtctttaaccccccaccagctgttatagtcatcaggaaatcttttaaatgaaaaccacgatgcgtacggtgaatccagactgttcgccgcaccaacatcgtcatattcgttcacggcattgaaataccggctgtcggcaccgacatgattgaacacaccatccagaatcacatgcatccccagctgatgagccgccgccagaaactgcttgaaatcatgcaatgtacctaacacttcatcaatcgcataataatcaccggtatcatagcggtgattgctacgcgcctgaaaaattggactcagataaagcgcattaatcccccgtgcagctaacagcggcaatttttgctgaataccggttaagttaccaccataaaaatcccagcgcaacacttcgccattggtaccgcgaatatacattggccgatccgactggcgcccatagataaaagaattggctttcggtgcgttgacgtggccatccgcattcccgttattaaaccggtccacgaaaatatgataaaaccgcgcatgccgataccattccggcactgggtcaaactcattgaccacggtcagctgataactgttcacatcggcattttccggataaacctgcccgatcccgccaaaaccgccatcaaccgcaccaaagcgttggcggccttcatcggtttgcagttcaaaatggtaaaaccataaaccagccgtctgcggggcaaaactcaccgtataaccattcgggcttttggtcattggcaatgtctcggtttgatccccgcgcccatccggcatgataatcagcgaggcttgcgtcaccgcaccgtcagctttagccgtgaaatgaatcgttgttgctttccgaactgccccaaaaggctgccgatcggtgaatgaatcaaattgaaacatctttttcctccatgtgacgcatcagttgcccaagccatcatcttctggcgtttgcgggaccacatgccaaatatcgtgaccatagcgctgaaccgtaaagtctgcggaaaagcgcccactttctgcaatgttcaccaacgccttcttcgcccaggcttgcggctgttgatacaaggcatccagcttggcattagcggctaaataactttcaaagtcagctaacacaaaatattcatcgttatacgtcagcaaggaattgaaaatatcgcggccttccgtttcaattcccggaatctgaccattaaccagcatatccaacaccgcatgcaaccgcggatccttttcataaaagtcgcgggcccggtaatcaccgcgccgataataaccggcaatctcgtcttcggttaagccgaaaatttcgatgttatcatcgcccaccgcatttttaatctcgatgttggccccatccagagttgctaaggttaacgcaccggcactcatgagcttcatgttactggtgccactggcttctttcccagctgtggaaatctgttcggagatatcagcagcagggataatcttttcagccatcgtcacaccgtagttaggtaagaaaacgacttgcaaataagggctgacttccggatcaccgttcaccatatccgctaccgcattcataaccttgatgatctctttagcatacacataactgggtgcggccttggctccgaaaatatgcaggcgtttcggtcgtttttcaccgcgtttaagcgctaaatacgcatctaaaattcctaatacatgtaaaagctggcgtttataagcatgcagccgtttaatctgcacatcgaaaatagcatccgggtcaaccttaacgtgcacggtttgatcgatgtacttagccaatgcccgtttattttcggctttagcggcattcaggtcggacaaaaagtgcggatcatcgctgaaatcatgtaacttccgcaatgccaacggatttttccgccaggtagtgccaatttttttatccagtaagtgcgccagcggacggtcgccgatttgaatccagcgccgtggggtaatgccattggtcttattattgaaccgctccggaaaaatctcgaacaggtcgtgcaaaacatcttttttcaataactcactatggatcggggccacgccgttgatcgcgtgggagccaatggttgctaagtaagccatccgtacctgcccgttacctaaaggagcaatacgatcaatcatggcttgcccaaactgcggaacaaaggccagacggaagcgccgatcgatttcctgaacgatttgataaatccgcggcaacagaccactgaacatatcaatcggccagacttcaagtgcttcggatagcaacgtatggttggtgtaactcataacctttaatgtaatccgccatgcctcgttccaactgacatgttcatcatccatcaaaacccgcatcaactcaggaatcgccatcgccgggtgggtgtcattaatatgaatcgcaacccgatcggcaaaccccgccatgctgttgtgcgtccgccggtaatgacgaacaatactctgaattccggcactggtgaagaaatactcttggcgcaaccgcaattcttttccggcattgtcagagtcatccggatacaggatctgggtgatttgattgatgcgttctttttgttccaaggtaaaccgcgagccggcattaatcggcgcttcagcggaccatagccgcagattgttcacgacgccattgtgatacccgaccatggcaacatcataaggcacggctagcacatcgtcagtttggtgatagatcacccgcaaattaccgctgcgacttggttttaattccacccagccgccgaatttaatcgtgaccgcccgattttccttgcgcgtctcccatgggaacccattgcgcatccaatcatctggcagttcaacttgataaccgttaacaaaggcttgtttaaataacccatattgatagcgaatgccattgccattgccggccatccccacactggccatcgcatccatgaacgccgacgctaatcgtcccagcccaccgttgcctaacccaggatccgcctcggcatcaaaaatcttctgcggatgcaagtccaaggcatgtaaccctgcctcaaccgcatccaaaatacccagattcagcaaattagactgcaacagccgacccggtaaaaactcgattgaaaagtaataaacctgtttggtctcttcttgatcataccgcttcttggtgtcagcccaaggttgggcaatgtatgtccgcgtcaacaaggccaatgcctgataaagctgttgtgaagataggtcttcaagcggtgccgcatacattttcaaggccatgtctttaaagtctgcgatgaattgttcctttgttaatgccatcaaatatacacctcatcaaaattaaaccatcgcaaccattttggcgaacatgaacaacgaggtctcatcgaatgtccgatccgcagctaagacgaaatgccgtcttgtcggctgcgactttcattcgacatgacctcgcgatgacactcatgctttacctaggatgcgattataccccttcaagtaagccgccgccgaatgatgccaatcaaagtccattgccatagcctgttgttgcaggcgggcataaacttttggctcatcggaataaacgtgcttcgccatgcacagaatcttggccaacacgccggcattgtaatcccagaaactaaaaccggtgccagcgccagtttcggcattgtatggcgtgacagaatcacgcaggcccccggtttcatgcacaatcggtaacgtaccataacgcatcgccatcatctgcgccaatccgcttggctcaaacgcgcttggcatcatgaagtaatcagccccagcataaattcgttgcgccaacgcttcatcaaaatcaattcgaaccgccagttgccctgggaaacgatcttgcaacgacagaagatcctcttccaagtcgcgatcgccggtaccgaggattacgacctggacgttattttgaaccaggaagttttctaaggcatcaacgagcaaatcggcccctttttgccgggtcagccgactcaccatcgcaaaaagcggatccgaacgtttcggcagatgcatttcttcttgcaaaacgcgtttgtctttcgctttgccttttaaatccttggcactgtagttatacgtcaaatgcgggtcggttgccggattgtagacttcatcatcaatgccgttcaagatcccgactaatttaccactttgtttgcgtaaagtgccatccaaatgctcgccaaatgctggtgattgaatctcctgagcataactagggctaacggtcgaaaccagatcagcaaagttaatcccgccttttagccagttcaccgagccgtcctgggcaaagccgtcatcattaaagctttgccgcccgataccaaacaccgtgtccagaatcgacggcggaaaccacccttgaaattgcagattatgaatggttagctgcgttttaatcgcttgataaggttgaatccagccatatttttctttcaatagcaccggaatgaacgctgtgtgccagtcattggcatgaatgatatcgggaatccactcaatcacctgcagcatttcaatcacggccatttggaaaaagccaaaccgaccgccgtcatcccaataaccgtataagccgtcacgatcaaaatattgtcggttatcaatcagataataggtgacatcgcctagtttaattgttttaaggccgacataaaccggttgtccgcctatttcaatcgtaaaatgggtcagatttttgactttaggcaaatacttcgctggaaatttgcgttcgtaaaaaggaattgccacccgaatgtcaacgccttgtttcttaatggctttaggcaatgcataggtaacatcgcctaagcccccggttttataaaacggcgcgctttcggctgcggtaaaaagtactttaagcacgggccgtcaccccctggccatctggttgaaagactttctgattcttggcaaacactaatggttcttccggtgtgccttccaaagccagattcggtccaatgataacacctttgtctaaaattgcgtatttcacgctggaaccggtcccgatcttggtgccttgcatcacaatactgtgatccaccaaggcatcgcgatgaatatgcacattccggaaaagaatcgaatgattgacttctccttcaataaaatcaccggtccctaacaaactgttggcaacatgggattcggttgagaaaaatgtcgggatttcgttcttattcttggtttcaatcgagttagcactatataacaaggcttggtagttttggtcttctaacatgctcatgttggcgtcaaagtaacgcttgatcgtattgagtttggccaaaaagccggtatattcaaacgcgttggcattgttttgcaaaaccgcttcccgcataatctgtggcagacgtttaaaagtcggcgcttccgaagaatcggtgagcaaatcaatcaagtcaatcgtgccgatcaggtaaatatccatgaacgccggaatcttgccttctttaaggtggccccgattctccgcggccggaacaaccgagcttgcggttcccaattcggtcatatccaaagtcaggtcttccggttgcatggcggcttccggcagattcttatacaccgccgttaccggactttcaccagcttgatggtatgccacaatcgcatcaatatcgacattggcgacattttgggttcccatgataatggtatattgagcgctgcttttacgcagaaactgaagataatcgtcaaaataccgtgcccgcagctgcggatcttcataatcgcggccagccatgtacggatacgtgaaaacaccacctgttatctggtccatattccaggttgagccgctgcggatatgatccgtgacactgcgacccgacttgggcaggaaaatcgccacactgcggacatttgcatgatccaatgacgacagcggaaaatcaatgagacgataacgcccagcaaatggcagcgttccaatcgggcgggctgctgtcaatggctgaatttggtcatctttttcattcagatcaatgattgctgctaaatcgccttttctcattctttttcagtccttcctagaacttccccataaccaacaacactaatttcgtccggtttgccaatcaccttaccgttatcaccgatgatcgcattctcaccaacaatcgcatgatccacagtgacattcttgccgatcacggcgtttggcatgatcatgctgtctttgatcacggaaccttcgccaatcttgacattctggctcaggatactgtgctcaatggcaccggcaacatagcagccatccacaatcatggagcctgatacttttgcggtcttggttaaaaacattggcggcaaagcttcattttggctgaaaatccgccagttgcgattgccgatgttcaatggattattcggattcaagaattccatgttggcttcccacagactctgaatcgtcccgacatctttccaataaccacggaacgcatacgcatagctggcttcgttatgggtcaggtaggctgggatgacatcgtgcccaaagtcttccatcgccccatcagtcgcatagctttcagtcaaatactgtttaagggttggccagttgaaaatgtaaatccccattgaagccaagttgctcttaggcttagctggcttttcttcaaattcgataatccgatccgtgtcatcggtgttcataattccaaaccgcttggcttcgtctttggcaaccggcataaccgccacggtcaatgaggcttttttggccttgtggtaatccaacatggcctgataatccattttataaatatgatcaccggatagaatcagtagatattgcggattataagaatcgatatacgcaatattttgataaatcgcgtgcgctgtaccttcaaagaacttttcgccttcacttgacgcgtatggctgcagaatcgtaaccccggcgccacgctcgttgagtccccagctcgccccgttttgaatatgccgattcaattcaagcggttgatactgggtaatgacacctgccgtattcacccctgaattagccaagttacttaaggtgaaatcaataatccgatagcgacctccaaaaggtaccgagggcttggcagtggttttggttagtttacccaaccgtgtgccttgacccccagcgagaatgatacctaacatttcagtactcatgatgacggcgcaacttgcgccttcccccctcacttcttcttatgcttcttaacaatcaggtcttttttcaccggttgcgttcgggcaggcgccgtcccccaatcgcgttgatgactgatggccggtcgttcctgatttgaaattgccagtggcggctgctttccggaaagtgcggctggccgctgatggtgcttggtcgccaactttttaggcaacggctgcagttttttgggaacaattagtaacgcgcccattgctggcaaaatcacatctaaccaagccggctcgccgtattgatcacctagctgggcggttaaagtcgcctgccacttggtccaggtaccgccaaaatcaaggctttccgtatttaaaagaatcgtgtacgtgcccaagcttgggactggcacgcggaagtggtctttttgcaccgggacaaaatttaacgcaaccaccgtgaagtcatctttttgcttgccataacggatgtaactcatgacatccggttcatccgccattgtgatcttaatgccaagtggttcatgatcctgttgccaaagactcggtcggtttgtatagatatgattcagcgttttcgtaaaggtttgcattttatggttcatcgggtctttcaaatcaacccactcaagctcgctccagtcacgccattcaaggaattgaccccattcactgcccatgaataatagctttttccccggaaacgtcatttgccacacgtacatggtgcgtagattggcaaactggttgtaccgatcgccaggcatcttgtgcatcaggctcttcttcccgtgaacgacttcatcgtgggaaaacggtaaaacgaactgttcgttatacatatacataaatgaaaacgtcaataaattcatatcactgtggcgataaaccggatcttcttcaaagaacttcagcgtatcgttcatccagcccatgttccatttgtaattgaaccctaggccaccgatattaatcggcgctgacaccttaggataggctgaactttcctccgccatcatcaaaacatccggatgcttggcaaacaccttcgtattcagctgcttcaaaaaggcaatgccctcaagattatcgcggccgccaaaccgattgcgatcattttctttgccggcgtcataatccatgtacagcatattcgaaaccgcatcaacacgcagcccatcaagatgacaatgatcaagccaatacatcgcgctggaaatcagaaaactttgcacttgtgctttgcctaaatcaaaattccaggttccccagcgaacattttcggcgcggtgcggatcggtatattcaaacgttggggtaccatcgaattgagcgagcatatcggtatttttaatgaaatgtcctggcacccaatccatgatgatgcccaacccggccacatgagcagcatcgacaaacctgaggaaatctgccgggtcgccaaaacggcttgtcggggcaaagtaacccatcagctgatagccccatgaagcgtcaagcggatgctccatcaacggcaaaaactcaatatgggtataccccaattccttaacgtaaggaatcagcttatcaatcgcatcttgataggtcatatacccgccatccggaccggcgtgcgtgtcgcggataaaagaacctaaatgcacctcataaattgccaggggctcagcatatggccgccacttactgcgtttgcttagccacgaatcgtcatgccatttgattcgcggaatatcaagcagtcgggcagcactgcctggcttacgttcaaatccaaacccatatggatcaatcttttcatgtgtggccccatccggaccgaccaccttgtacttatacaactgtcctttctgggctgcgagttcgccgtaccaacagccggtttctccttgccgggtcagcggactgccgcgccaatcgttaaaatcgccgacaactttaatctgttgggcatgtggcgcccagacgagaaacgaccatttgccaggtgaaacttcatgggcaccaaaccgattgtaactttgaaaatcctgccctgagttgaagaggtataaccaatcttttaatccttggatcatgatcactcccccaatcacatcatccgactcgttgcatgtggttcaagcatcacgaatatttccttccgccacaagtgtaacagcacgaccatgaaaaggctcaagaaacgctcaccggatcactttttttaaatctgaccactcttgctgccaagaggaatataatcctcctcgccgttaattgtaaccgctttcggaaaatattaacagtaaatacaatttttttggttgagttatttgtgagaataatctaacatataggctatattatttaatgaaaacacaatgttttctaaaccgatctcgggatttgtcaatcttgtgttttaacccacgcaaccacccactggagggatgacgatgagcgtcgatattgattggaacaatctaggatttgattacatgcaactgccttatcggtatgttgcccactggaaagatggcgcttgggatgacggcactttatcaagtgatcccaacttaactttgaatgaaggttcgccaattttacattatgggcaaggtgcttttgaaggactcaaggcttatcgcaccaaatcaggaggcattcagcttttccgtccggatcaaaatgcccaccgtctgcacaactcagcagaaaaacttttaatgccaccgtttcctgaagatcgcttcattgaggcggtcaaacaagtcgttgccgctaaccatgaatacgtaccgccatatggcaccggcgcaactttatacttacgtcccatgttaattggcgttggccctaatattggcgttgcccccgccaaagaatatatctttgatgttttcgcgatgccggttggtccttattttaaaggcggcatggtgccaaccaagtttgtggtggccgatcaacatgaccgtgctgctcactacggcaccggtcaggctaaagtcggtggtaactatgcggcctcgctacaagccggaaagtttgcccatgaacatggttatggcgatgcgatttaccttgacccgatcgaacataaatatattgaagaagtgggttcagctaactttttcggtatctctaaggacggtaaaacccttaaaacaccgaaatccccttcgattctgccaagtattaccaaatactcaatcttggcgctggcacatgatcgcttcggcatgaaaaccgaagaaaccaagattgccattaccgatttagaccagtttggtgaagcaggcgcgtgcggaactgcagcggtcattacgcctatcgccagcatcacatacaacgatcacgaacatgtcttttattccgaaaccgaagtcggcccacatactcaggcgatttataacgaactcacgggtattcagtttggcgacgtccctgcaccagacggctggattgtcaatgtacccgttgattaaagcaaacgtcacgcaccgatttcaaactgcaaattaaaagcagctgtcaacgcatcttcatgcgctggcagctgcttttgtattgccattgatatcgcgatctttcttctaaaactcatccaaacaaactgacgattttgattcacacctgttagcgagcaaaggcaattaagcgccaataatcaccaacacaagtctggagcgtaatgcgctgaccgccacctgtaccggtaatttcattccaaagatcctgaccgtcagctgtaacggcttcaggcgaaacctgaactaaccgataaacgtgatacgtgcgcggacttccggcggcatcggtcaccgtaattggcgaaccgataccaagcgaaagcatcgcagcaaacgctccgggattatgcccgataaagtgcgtattctgcccactgacgttgctgtagtttgcctgaccgccccaagttgcggcaccgttcattggcgcggcgtccatactttcattaccaataatgtacggaacggtgaccccggcaaacattaatacccgactcgcataagctgctgccggtttcgccggttgtgcttgcggctgagcggttggttgagttgctgattggttcgtgacggctgatgcggttttagctggtgccgctgcaacagtaaattgcgcggttgatgtgccagcggttgcggttccggctgacgcatttgaagcggatgcagcggaacttgttgatgaagcggtctgattggttgccggcgcgctaacagcacttggttgacttacttttgtctggccggatggtgttgggtcagacgatttaacgactgcttgacctgagcgaacactccaactaggatgcgctgccgcctgaactttttctggcgtcaccgcagcggttgctctgagtaaatcgctcgatgtgcttacatcattagctttctcccttgtgctggtgcgcaatccggccaagtctcggctctgaattgtatgactgactgtggtcgtaccaaacagcccgcccaatacaagagcgaaagtgatcagacttctgcgaaacatatagactcccccagtccatattgcaaaatgacttaccacactattaacttcgagatggccatctcttgatttagattatgcacaatttaatgaagcaggtaaacaaatatgcttacttttaaaaagtagattttgttatttataatcaggataatacttgatgataagcagtttccgttttttaaaaccaaattatcaaaggaatctttttaaaagttggtttacagcattttataaatatcgttatttttaggccttgatcagcgcgcttatccccgtcatttcaacaaaaaagcccagtgaacaaaacacgtcactgagcaatttatcatgatggttaacctttaaaaattcgaaaaaccgattagcagctcaaatactaccaccatgaacttcagtcgcagctacggtcagaataaaggcgtcgggatcaataccatgaatcagttcaatcaggtgccggaaatcgctttgctcaacgacgaccatcaacatctccctgttttcatctgaaaagccgccgacaaccggttgcaccgttaaaccgtgcggcgtttcgtcgcgaatccgctgtttcaacatatccagttgatcgctcatgatgtaaacggcttttttacggtcaaagccggtttcgacataattcatgaccagactcgtaatcgtgagtgcaaatacggcaagaataaaggcctcaacacctgacaccggaatattgaagagcgaaacgatgacatccgtgatcagtaacataatagacggcttcaagccaaaatatttcttgaaaattagcggcggtaccgtcgttccaccgctggaagcatccatttggtaaagcaatccgaccccaaaagcaaataccacactaccgacaataatggccaatagccgatcggtcacaaggttaatctcaggcgtgatccacaaaagtaatggcagcatgaaactgccgaaaagaatgcgttttaaggtgctgcgatcgaggaaaaaccatgctagccctagcatcagcagattaacagccatggtggttaagccaacttgaatcccggccacttcctgaaccagaatcgcgatcccggttgcgccaccagcagccactgcatgcggggcgtaaaacatattgatactcaccgcaataagcgcaagcgccgccatgatccacagccatttcagcaccggatgtcgcatcgttttttgcatcaagccaccctttctatggttatccatgtttctaacttattatgttaataactatacgggataaaatgcttgctgacaaacaacgctcattttaaaaccgtggttagtcaccattgcgtaactcagcaaggcgccgttttaacacctccacctcagcctgtagcgcggtgccaatatcggtttctgccacggtgcggcgccgtgcctccgtttcaacaactcggcgcgtggaaataatgtcggttaaattggcaatcgcatcggccttggttgtaaacggctgatgggtgaccagctgcatgccatacgaattatccaacaaagtatacccgccaataccggttgtcttttggtaaggctttgaaaatccgccgtcaatgacaatcattttgttattcgccatgattggatcggttccttttttaaccggcgtatgaccattaatcacgtgaccgacttccggatcaagcacaaactcacgcagaatttttttgatgaaatcaggatccttgcgcaagtgataataagcattacggccttctgcatgcgtcgcgggatccttgataaagtaccgctcaaatgtggtcatgtcgtgcttgccaaaaagcggcgaattcggaccggtccacagataccatagcaaatcagtcgccaagtctgctttttccgtgggctgactgtaggcgaggcgcaaattggcttccagcatgtcaaacaactgccggcctgtataagtcgtgccttcaatcgttaaaccaatgaaattgccatcttcatcaaccggcacgcacccgtgtaacagcaaattgcgattataccgcagatacatactgccgcgatccatcaaaaaatccatatggcgatgcaacttttccgaatgggtgaacgactcgactaaggaatcaatgacctcctgctcttccggcaacagtcggtaaggatcagccgggtcaaccgtcgcaaaacagccattggtgatgggataagtatgcccattcaactgaatcgtggaaaaatccgcggctaacttgtccagcaataaccgatgatccatttcaaattcaggacgccgcttgatggccgggccttcaagtttgaactgaatcatggcaattgcctgatgaatctgggtgatttgtaaccgttccgcctcggtaattggccgatccgagcgccccattttaggcgaaaaggccggattatcctgataatattgttccgccaagcgtgctaaatggcgcaaattaatcccataaacatcttcaagaatgctcaggttgttgtaccgggctgaaatccgcaccagattggcaatacacaacgccgaaccagctgcaccgccgatccataaaatatcatgattgccccactgaatatccaccgaatgtcgctgatcacgcttgatcaaactctcaaccacctgatccggcgccggcccccgatcataaatatcacccacaatgtgaaaatgatcgaccgtcagccgctgaattgtccgacacgtcgcctcaatccactcatcggcctgctccaaaacaatcaagttgcgaataatctgccaataataagccagcttatcaggcgtgtccgcatcgttatacagcagctcttcggtaatataaacaaactccggcgccatcgccttacgcactttcgaacgggtatatttagtcgcggtaaacgccagcaagcgaatcaaccggcgaaaagtggtcagataccactgctgcaaatcatccccttgcagctcctgatgaatcgcagtcaaccgttccgacgggtaatacaccaaaaaagcaaaccgctgcaaagtcgtctcggtcatctcatcccgaaaacatgaacgtatcttgctcttcacattaccgctgccattgcgcagaacatgctgaaacgcattatattccccgtgaatatcgctcataaacgcctctgttggcttgggcaggttcaaaatcgcctccaagttgatgatctcggtggcaatggccggaaccgtttgatacttggccgtcaattcactgtacaaatccatgatgcagctccctttcgcatagaccaatttttgactcatggcaatatgatagcataattccggcttttgtatacggtttcaacatttttcaagaaaatcataaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaatatctgctaaccctcagcgtgctttgcaacttgatggacgcacaagttggcgctgcagttctgccatagcgggtcaaaactataccaactaaaattcctgttggctgtgattcacgccataaaaaaagccaccatcaacgatattctgtatcgttaatgatggtcaagcaccgcacgtgacgctggttggtacacttcacacactcgatgtatttaacaaagccgtccaaagcttttgccgccggacttcacgtggtaaaaagacccggacagagtcttgattaaacccaaacaacagtcggcgttcatccacaatgatcggacggcgcaggatagccggtttttctgccaacaaatcaaccgcctgctttagtgatagcgcatcgaaatcaatgtcaagtgcctgaaatgccttagatcggcgcgagactaaactatcaacgccatcctccgaccgcgccaagagctcaagaatctgctccttgctgataccttgctttgacaacgaaatttcctgaaatggcaacccattggcttctaaccatgcccgagcctctcgacttgatttcgaagaacccgacgtatacaacttaatcatccaatcacccctcgcagaaacaacagtatatttctatcgtttcctagctaataccacccacatgctcgttgctaacaacattcactggcttatattgattcacccaggacacttttttattatcttaatgataacttaacataacgagactcgcatgacaataaataagcgtttgcaccatcaccactctggttatgactcatcaatatcaagccaaagcacatctagcagttaagtgatgaacggttattataaaacttaagtctcgccatcaataaataacagcatttacagccaaattaagccaatataagtttgtgaatttttagcataaaatctgatacatcagtttcatatcagcggttggttctctttaaatttagcacaagctcataccgctttcaataacaatttttgaaaaattaattttcgattactaatattcaaatattttcaccataatctgacatataaaatactggcgataaattgtcttttaataagccttcatgctgatcgttctaaaagttgtgggcaaaacagacgggcgcaatttatttcaaattttattatactactttttcaaagcaaaaaaagcggccgccaaacgatttttctcgcttgacggccgctgtgcgcattacttcgcaccgctagcttctttctttggcttgtcgcttgctggttgcacttcactgacgataatcgcaccatcaatcaagtcagcctgtaacttcttagccttcaggtgatccaggtagaagtcggtaaccttatcgcggatgttgcgttcaatgacccgccgtaatggtcgtgcacccatcgcttcatcgtaaccttgggcaatcaaccaatccttggctgcatccgtcacggtaagtgtgatgcctttcttcgccaaagtcttgttgacgtcttcaagcatcaagtcaacgatcttacccaaatcattcttggttaagtgactgaattcaacaatcccgttaaatcggttcaggaattcaggacggaagtaaggcgccaaccgcttcatcaaatcttcgtccttctccttctcgccagttaatgcttcattgccaaacccagcattggaagtggcaatgatgacggtgttcttaaagtcaacgacattaccttggccatctgttaaccgcccatcgtctaagacttgcagcaacagcgtcaagacttgtggatcagccttttcgatttcatcgagtaagacgatggaataaggattgcgccgtacttgctctgtcaacgtgttcttgttgtcattgtatccaacatagcctgcgctggtgccaatcagtttggataccgctgtacgatcgctatattcggacatatctaaccggatgatcgcatctttactgccgaaaagatctaacgccaactgcttagccagttcggtcttcccgacaccggttggtccaacaaacaggaagctgccaattgggcggttaccttcatcaaagccagcccggttccggcgaatagcgcgggcaaccatatcaacggcttcgtcttggccaattaccttacccttcaggcgcttaccaatgcctttcagccgttcaatatcggatgcacccagcttggaaaccggaatgccagtcaaacgttcaacagctgcagcgacatcattcggggttgcgacgacaggcttctcgttgttcgttccttcaagctgatgttgcttgtcggcaatctccttcttaaggttggcagctttttcaaaatcttcagcttttgccgctgcatccttttgcgcgttgagatccttgatttgcttttccagttccaccttgtcaacaatcgggtgcttgcttgctaagtgtgccgcggtcatatcaatgaggtcaattgctttatccggcaaggagcgctgtggaatatattgaatactataatccaccgccgccttcaaaacattttccggtaactgaacgtgatgatgctgttcgtaaagcttcttgacgccttccagaatcttgaccgtatcggcagcgctcggttcattgattgtgacatcgttaaaccgacgtgccaaggcgctgtccttcataatggtattgcgatattcatcttgcgtcgtcgcaccgatcacagtgatttcaccacgcgacaaggctggcttgataatatccgcgaggcccttaccgccagactcttcgccaccagttgcaccggcgccaagaatttgatggatttcatcaaagaacagaagcacattgccagcagctttcacttctttgatcagattctgaatcttttcttcaaagctgccacgatattgcgtgcctgcttccagattcgacagatcaatcgaccaaatctgcttgtctttaattgattcaggtacattgcccttcacaatcgcttgtgccaagccttcaaccaccgcggtcttgccgacaccggcgtcaccgaccaaaattggattgttcttcgtccgtcgactcaaaatttcggcagtttcctgaatttcgtgatcacggccaatcaccggatcaagcagaccatccttggcttcttgcgtcaggttgcggccaagcttttcaagaataccgcctttcttaaccgcttgttcgccagtcgtttcaaccgggatttcatcgccttgctttggcagctgaccagtcgcccgatactgcgcaaattcatccggcgtcatttcgtggccattcaccacatagcgggctgactcgcctttacccattccttgaagcatctgattgaatacatcgtccatgtcatgattgaaaaacggatcgttaaagtttgccatagtcgaattcctccttgttgggaatatgcggggaaaaggcggtggtggcggggagcttattaggatgcacaagatcttgctgctttcctaaacgcgttcgcagggccagaaacctgcgtgtaagggccttggatgcactggtcaaaacccgaccagcacatccaaggccacttacactccggtttctaagcggccctgttcacgctctacaaaaaagcactcccaggcgctctggcagtactttcgtgtcgtgcttattcacttgttggcacttatactgttgcgccttttccttgtttacataatgtattatagcatgaaattagcactcacgcaacccgagtgctaattttttctcacgctaagtcaatcaaggcgtttctcagttgattaataccgcgacaacaaacgcttttcaaccttacgctcattaaaccggactaacggatccccattaaccaaggcgcgagcattttcctcaaaaattcgggctttcttttcgccacgcttacgagtcaaccgcttgaacgctgcactcatctcataactgcgacccggtaagtgatgggcatcagaggcaaagacatgtgctaaccccgcatcgataatgtcttcggaaaattgttgtacctttttcccaaatgtgcccacatagctgctagccgtcacctgtgcaaaggccccacgttcaaccatctgataaagcaaaccgggatgcttcatcagtcgggtattccgctcaggatggacaatgaccggaatcatgccacgctgcatcacttcaaacaacatattttgggtataaagcggcacatcgtcagacggaaattcaattaacacataatgcccgctcacgtcacaagtcagaatatcgttatggtcaattgcttctaacaactgaccgttaatccgcacttcctgacacgggaaaaccgttagtggaatattgcggcggtctaactcgtcttgaaactcatccgtcatccgaatcacgtcagccgcatgattcgtataccgtccattcatatggtgcggcgtcatcaacgcatgcgtaatcccatcagccaccgccgcctgtgccaattcaagcgacgtggttaagtcttttgaaccatcatcaattcccggtaacatatggcaatgcacatcaatcatcattcagttccccttccaatactatctagtatctaatgaagcgctcccaaggtcaaatttttttgtaacagtttgttaacgtttcacaatagatcagcgagctggcagactttgcggtataatatgcaaagattacggaggaaatgaggtttaaagatgaaaaagatcctagtacgcgttctactcgtcgtactcgttgctgcgctggggtttggcggcttcgtgtactacatggttcacaactcgacatcgcaaatatattcctataataagaagacaaacaaatcttccgatgataaaaccaccagcaaaaagccggtcgcatacttactgctcggtacagacacaggcgaacttggccgctcctacaaaggccgtaccgacaccatgatcgtgatggtactcaaccccaaatcaaaaacaaccaccatggtctcagtcccacgtgacaccaaagtcgattttgatgacgtcacaatcaaaatcaacgcagcctattcttacggttcctccgacaccgccatggaagccgttgagaagctgttaaacatcaaattggatggttacctgctcgtcaacatgaaaggcctagaacagatggtagatgccgttggtggcgtgacagtaacctcgccattaagctttgactatgaaggcaaatcatttgttaaaggtcagtcatacaatttgagcggcagtgatgccttgaagttctcgcggatgcggtatgacgatcctcaaggagattatggccgtcagatgcggcaacagcttattttgacgtcggttatcggtaagcttaagaagaatccaacgactgtgttgagtcaaagcttcttagacgctgttggtaaaaacgttcgtaccgatgtctccctaggatcagttaaaaacctggcaatggattatcgtgatgccgggaataccattaagagtgatcagctacatggcacaggccagaacattgatggacaagattatgaagttatgtctgattctgaacttactcgggtgcatgatgtgattcagaatgcgttgaacgcaaaataagaaaacagataataaatggaaccaccatgaattgatcaaatttcaaatcaattcatggtggttcctttatttctcgggtaattgaagttaagttcaacttattgactgttcttcttgtacttcgcttcaaccgcagatttttcatcttgccaccaactgcgatggtcggtgtaccacttaatggtgtccgccaagccttcttcaaagtcggtatattgcggcttccaccctaactcttcgcgggtcttggaggcgtcaatggcataacgcatatcatggcctgggcgatctttgacctgatcataatagtcagtcggttttcccatgagcttcaagatcaattcgagcacggtcttgttatcctgttcgccattagccccgattaagtaagtttcgccaatcttgcctttagtcaaaatgtcccagatggcgctggaatgatcattggtgtgaatccagtcacggacattcttacccgttccgtaaagcttaggtttaatgccactcaaaatattggtgatttgtcgcggaatgaatttttcaatatgttgataggggccatagttattggagcaattagagatggtcgcccgaacgccaaaggaacgtgcccatgcatgaacaagcatgtcactggccgctttggttgaagaataagggcttgacgggttgtagcgactgttgatcgtgaacttttcaccgggtccttcaccatggccaggaagatcttcacgtaacggtaaatcaccataaacttcatcggttgagatgtggtggaagcgaacatcatacttacgggccgcttccaacaaagtataggtgccaatcacgttactgtgtaagaacggatccggattaatcagtgagttatcattatgactttcagccgcaaagttaaccaccgtgtccacttgacccatcaattgatcgaccagttctttgtccgcaatatcgccaacgactaacttaacccgatcgcccaaaacgtcttcgatattggctttattgccggcataggtcagcttatccaagaccatgatctgaacatctggatggtgctgataaacaaaatggacaaagtttgagccgataaagccggccccgcctgtaatcataagtttcatgtttaaatctccccgtaaataaagttattctcggcatcttttaattgcggatgatgctgatctttttccgacataatcagatgtgccgttgacatcggccagtcaatcccaatatctgggtcatcaaaggcaatcccacgatcagcttcaggggcataataaccttccactttataaacaaagttaacgttcggcgttaaggtaatgaagccatgcgcaaatcccttaggaaccaagagttggcgatgattatattggctcaaaatataaccttcccattgtccatatgttggcgagcctttgcgaatatccaccaaaacatcctcaacgaccccagtcaccacgcgcaccagcttcgtctgcgcataaggcgccatttgataatgcatcccgcgtaagaccccggcttcggccgacagtgattgattgtcttggttgaaatcgtttttgattccggcttcgatgaacttttcccgggtatacgtctctgtgaaaaagccgcgattgtcgccgaatacatcggtttcaactaacttaacgtcctttaatttggttggaataacttttaaactcaagtgtctttgcctcctaggcttcttcatctgccaagcgcaaaatgtactggccgtaatcgttcttcttaagtggctgcgcgagttcgcgtaattgatcgcgatcaatgtaacccattcggtaggctacttcttccagacaggcaattttaagattctgtcgcttctgaacggtctcaataaaactagccgcctcatgtaaggattcatgagtgccagtatctaaccaagcaaatcctcgacccaaaagctcaacgtcaagttggccacgttcgagatacgctttgttcacatccgtaatctctagttcgcctcgtggtgacggtttgagattcttagcaatgtccaccacttggttgtcatagaaatacatgccggtaaccgcaaagttactctccggatgctctggcttttcgacaatcgattgcacatgatgctgctcatcaaaagcgactaccccaaaacgttcaggatcgttgacttgatagccgaacaccgttgccccggtcgttttagccgccgagcgttgaaccagcttggacaagccgctgccataaaagatattgtcaccgagaatcaagcacacggaatcatcgccaatgaagtcagccccgacaatgaaagcttccgccaggccatttggcttttcctgtactttgtaactagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaaggaaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaactaatattgagtcccagttgtttaccgtcttttaacagatcctgaaaacgatcaatatcccttggtgttgaaatcaccaagatatcgcgaatcccggccaacatcatggttgacaggggatagtagatcattggcttgtcatagaccggtaccagttgcttagaaacagcttctgtaattggatacaatcttgtaccagagcccccagctaagataattcctttcattgcattttctcccctcgcgtagtttagtatgtagtgtttctaaagtttaagcaaaccctaacactaagcattttaccagtagaactttaaattgtgttgctttttatagaattgtatattagtttgttaatttattagttcacgagatccacttttaacaacttttcaagttaatacttagacgttgtaaattcaggaatttcaggcaagatcaattaactgtgaaagtctttttattggttgaaagagctccttcttttccgaaattcaaattaggcaatgcgatcaagtgtgcattcaagcgtgattattttaagcttcatgcctttaccctagatcaacggacttaatttccgcaagtatattcaatactactgatctactgaatcacccgctttttccgcccacagcgatgacaaggcattactggtttttttactaggttcgatgaggattcaggcaaactaattgcgaaaaagcagcctcaaaaaacaacggcttcgatattcctacagcataaagaatatcgaaaccgttttagatggaccttactatgtcaaaaaggcagattaaaacttctatgctacacgatgatagttaaaaagccccctcagccttaaagatagaagcaatatttttaaacaaaataatgagatcatagtggaaagatctgtgtcgaatataatatagctctaagtctgcacgttctggataaccaatgttacttcgaccactagcttgccataatcccatcgcaccaggctttgcctcaagtagttcattaacatgatcgccatactcagctaactcgtcttcaatgaccgggcgcgggccaaccatactcatatcacctttaaggatgttaataaactggggtaactcgtcaagtgaactctttcgaataaaagcccccaacctcgtaatacgtggatcctcaccaaccggtaatttgtaattatttgctacatacttcttataaagcgcagaatcccgatgcagtaccccttcagcatcgacaaccatacttcgaaacttataaattttgaatctatccccgtgtcgtccaacgcgcgtttgtttgaaaaaaaggggtcccttatttcgcccatacgaataaaacggaagtaagactaagctaactgcggcaactaaaactagaccagccaatccacaaaaaatatcgaagcttcttttttcaaataagtaaatcagtgaagcttgtttccgaatattagatatttcgttttcattatgcgtcgtcaacatctgtttttccaaatttaaattcctccccaaacgctaccccaagcgccaatttatttgattttataacattttttggcattgtacaagaaaacgtcaaatctaaagttaaacgttcaataccattcgagctagaccaatacaatgaaattagtttgtcaatccggcctatgcaagccacccgttaagatgccaggacccgcatctaagccaccctattcatgctaaaaagagactctcggattgaagacgagaatgactatgtcgctattcgcatagttaatattctaaactggtctaaccttggtgagaccaagaaacatcgatattagcattaattttgctcccatggtcggcgattcagatctcatcttgaacttctttgtgtaccaattttaattaaaagtcaaaggtagatgaaaatatataacctttgtatatgatttattttaaaataatagcagcaggttaattttgtctccttcaatcaagaccgcctttgcaactcctacacaaaagcatgaaaagaattaaaactattttaattgtcgttacacgattgtagagtaagctttgtaggtagagttggcagcgttcttatagctaaaaaaagaacgataatctttgccaacatgatcttttttattttgcatagctgataaaattgcctttttgacagaggaaagtctatacggattacactgaaaaccaaattcattgaatctataaaaatttattgggcaaaaatactctgttgatgtaacaacaggaatttcgcaaaaaagagcttcaatggtcgccaacccagctgattcttggaaggaaggcagaatatgcactgcagcatttgaataaacaaatgccatatcttgctgtgaaacttcaccaataaagtatgtgtttccgcgtttttttgcgtaagatttaacactttcgacataccggctatcacccttggtggatccaaccaaaacaattggaatttctggatgattgtttaatgccttcaaaatccgcaattgattcttgagttgctcaactcttgcaacacaaaggacatacttaccagaaagtctttccagaatttttaaattgtcaggaagctgtttaggttgttcattgactttaaaaaacttctttgcatctactgcattaggaataactccccattttttgttacttgtggtcgcatttggaaaggtcttcttgagaatggattcttcttcgggtgaattgggcaaaacaatatctgaatactgtaacaacttatcagcctttagaaataactctcgcgaaaagaaattcttcttttttaaaatatccctaaacaatagttttgacacaaacgttgccaacttaactactacttttggcgcatcaattatacctttccttgctaaagcaccattaataaatgattcatccagcctccagtatattggtgataatgcaatcttcatgccgagagctttggccatttcagcatatgcaagacttgaatctatagtctgcggttgcatgttaaatatatgcacaacatctaaacgtttctctttcagcttctcaggagatgtaacaatagtacaacgcgccccaaagtctgactcaagatatttcatagtgttcaacagttgaacactatcaccgccttttcgtgtgagaaaatccgatcgaaccgcaaatccgatatccataaattgctgtctccttaaaattgatttagttactcgacaattatattttttcgaatttagatcatcatttcaggtgggccttaggcgcaagcattaattctgatgacattcttgatctctaaagcacgtctggaatagttgttgaatatttcttacaagatgatcgaaccattttgaaatttctatgcgtcaaaaccaaccggtagactttccaacgcatccttcaacataccaccattacgaattttttgggagatgatttgaacattcgtttgaattttttctatctgtgtatgtgaaagtgacttaatgacaggttcaatttccatcagattatcaactgcgattcctaaccctagttgcagaacaacattggctaaagctgattctcgccaaacaatcaagggtaatccagaagctaagtacagtgatgccttgtgcggcgagtttaagcggagataatctcccgaaaccccactgatacgatcagtcgagattccatcccagaccaacccccagccatcaacaagcttggatggtaatacgccagagtcaatagcaccgtgaaaaacgaccgattctgggaattgctccgccgtcatacccgaaccataaacatgccacttaaaaatttccaactggggaagcttctttaaaaactttgactttactaaattgccagcaaaaactatatttgcgacttcgcttctaataggcggttcaacatcaactcgataatcaaaaaaattaatagtagccatcttctgagaaaggccttgatcttcaagaaaattttgcattgcttgattatggacaatcaaaaagtcagccctttttaattcttcgatttcctgtttaattgatacatttttagcctgtccttgaacagaaatgaggtcatgaacaagaaaaatacactttgcattatgctttaagagtgttttatgtaacaggctataatcaaaagaattaaaaggtaacggatattggataagaactgattggtctgccgacaatttctttgaaagactacgaactgctcgtagtcgttgaagttccctgtttatctttaaatttactcttgttgcaggtatctctgcagttttaattcccatcctattggagaagtatttgacatcggctcgtgctttaaagcctgcatcgaaacttttgctattgtacccgtcaaattcaatcatgattttcccactttcaaaaaacgtcgaaatactctctgataacaacatttataatatcaattattcaacatttgttgttaaaaataaataataaaacgatagagttccaaccaatgaggtcttttttgcccgatgtcttaataaccaactaaactttgacaaaaatctcttggatcgttgaatagaaatcaaagaatccaattctactttacggctcacagacaaatttttaccaaatcttgtatcaagtaattttatttgtgccatttgctttgaaaaaagcttcctctgattactatagtttaaagctttattaattcttgacctgaatgaatgatttaccccaacagcgttatccccatgctgacggtatccaatcgtggctgttggaagatacactacattacctaaaaatgctgctatcatagccatccaccagtcatgcatcacaattgagcgagtatcagacaaccttattctatcagctaaacttttgttgattagaactgtacaaccggtcacaatatttgtaactaagatggtgttgacagaaacccttgcattttcaggaacaatattcgattgaatcaaagtaccagatgcgtcaattgtatccatattagtaaatacgagcgttggtactgaagcactcgatgtttgctgcatatatgagccaaccgttagacctaccttattggggtaccaaatatcgtcttgatcagcaaacataaacaatggggcgctgatggaggtcaacatcattaagaaagaattggcagggccacgattacctgctgaatcgggaaaagaatgaattcggttatcttttagaacataatcatctataatctgctgtgtgctatccgtagaaccatcatcccgaattataagatcccagttctcataatcctgctgaacaattgagtccagttgttgttttagaaacctctcaccattatatgttgacatcaaaatcacaagatggtcaaaagtcattctgtattccctccctgtaaggcttccaacaggtgaagaacatgttcgcgcatatctaattgatcatatccgatttttttcattcgcttcgattcatcaactcgcacatgtttttcagttgcagtaatccttttgctccaggaatccgatgattcgctgagttttacaacatgaaccaaattcggtaaatagttacctagcgggactctatccgaaacataaactggtaaactatttgcctgagcttctatgagcgtaaagctcaacccttcattcaacgaaggaaagagtaaaacatcaattgcattatacagctgtgcgaggtcttttcttctccccaaaaatcgaacactatcacccaattcaagacgtctagctttttgtttcaacatttccctctgtgttccatcgccaatcactaacaatactgagtttggattacgccgaattatcgctgcaaatatgtctagagcaaagctaatattttttctcatttccagaacaccgattgtagcataaacaattttattttgaacatctaatgcttctcgaacttttactctagtggcgcgcttaaaagtatagtctgataagtcaatgccattcggtataacttcgactcgattttttctgagaattcgactaggaaacatccacttagctgcttcattagaaacagctacaaaagagtcgattagaaatgtagcggctatctgtttgccaataaggtgaaatactgtcaacgcaaacttcttcaccccatgtatttctgtaccaaaatacgtattatgaccatggacaacaattttcgcatgcattataaatttacagaaaaaaatcggcagtatattccaacttgcagaataattaaaataaacaatatcaaaagcatgcttatttcttcttgcaaattttaaccagtcttttatatgtcgaatatagttcttgttagccggagaaatatcggtaaaagtccatcctgctttttcaaaatgtaatttgttactttcatccccagcaattgcaagtgctgaaaaactgaacccttggcgctgttttaaaaaggcattttcaacgaaagtcgtaaccccactagccggcaagaagtctgcaacaactaaagttcttatcatagtttccagaccctccttatttatttcctattattggaaatatgcgtagttacgaacttacgtctgttaaacttattgaaaagaaaaccatagatttttctgatccaatgttggttttctgtaaacttgtaatcgcactctgtataaggaacttcatttgcctttagccagacatccaacaaaaattctgcaaggaacccatcaactctagtttcattgccttctagactattgaaatctaaaagttcatcaacttgatcaagaattgaaaataaccaattcgtataatcttggaagacttttttcttcataataaacatgttaaacatatgggctgatctggcatttaaaacctttctaaacgcgaatctataggcctcaggttgttcttccatcaccttctttaaacagtcaagtccttgacgatcgtgggagtgataaaagtgtgattctatagtctcaatgtaatagtgccgtttttttggaaccacaacatctgtatgagccattaatttttttatgtcagactgcttaattaagtcataagagcgacttccgaacttctttttattcacaaaaaatctgcgataatgcacaagcccaaggatatcaaaatcaagattgtacttagcccaataaatcgcagttaattcattataatgcgggtttttccatgaaatatttttccctgaatcatctcttagaaaacccttgggcgtcgattcatgaaatttgctcccaacataaacagggaaataagtttggtcatttggtacctgaacaggtttatgagcagctataataattttaatcagcaagttccccacccctctctgagccaaaaaagattatctttgtctaatactagacaccatttcaatcaagtgacgcggctttaaaagtaataagatcaaaatataaatgatcgtccctagcaaaatggttgttactagtttaaccatatttccaaacggcataaaatgcatataccaaaaaatatatgcacccatcaaactagcagaaagtaagtacttccaggtttccgtaaaaagtagagaaatatccatctgttttcttacataaacaagttgatatgcagtaacagcagcttctgaaataacggttgccgtcatggcaccgaccgttccccaaagtaaaatcataggaatattcaaaaaaatgtttacaattgcacctaatgcaacggaaaccgtaaaaggcctagtttgatttgtcggcagtagatattgtataccgatggcattactaattccaaccaaaataataacaagtgactctattgctagtagtacagcaactgcactgaacttgattccgaaaaaaacatttgtgaaaacaggagatatcgaagcgagtccagctgacataggaaaagctaacaacaatataaaatgcatggacttactaagggaggaaaaaacagccttacgatcccccctagcaaaactatgcgccacatgtggcaacaaaaccgttcctgtagctgtgacgatggctaacaatatttttataattttatctgagttgtcataataacctgcagcttcgaccccgatgtatgctcccagcatagtcttattcacttgcaaatatatctgtgaagcaatttgtggaataaacatcccaattgtaggcttcaagtgtcggccaagtctcatttttctcaagactggccactttacatatctagtaagataaggaatcagcgttaaattaccaattaactgtgatccgcccaaaatcaaaacataaatccataagtcattctttgttctaactaatgtaaaaatcaaaacaagtgaaataatttttacaaatgtatttcgtaccactgtaattctaaattcttccaaaccctgaaaaaaccacgaaacgtcaatcgctgaagctaacaacagtgaaccctgaatcaggtagaaaacacggtactgtttagacaaaaatataaaggtaagatacgcgataacggcgacgcccgttgtcaaaaattttaaaaaagttaactcccaaaaaacgttcgataatttttgagggtcatctctttcatatgcaacttcacgattaccataaacggtgatacccaaagtgccaaatagaatgaaatactgcacaacagaattagtatacgcgttgataccaattccagttggtccaagcacacgtgaaacatagggaattgtaatgatcggtaatagcaagacaaaaacctgataccccatattccataaaaagttctttactactgtcatataactctccgatcattggcctgttacctaagagtttgctttaatagaaacatgagaatcaaatttccgtcttaattcgttgcaaagaactttccttttacaaattgtagagcagcagtaataacttgatccatattataatatcgataaagtcctaaacggccaccaaacgcgacctgtggatattttttagtggcaagatctctgtattctgtaaataaatggttgttctttgtgtcatttacaggatagtagggctcatcacccttagaccattcagccggaaattcacgcgttatgaccgtcttaccttgatttccttttccaaattcaaaatgtttatgttcaatgattcgagtaaaaggtgtatcggaatcagtgtaattaactacagcatttccttgataattatcaacgtctagtacttcagtttcaaaacgaagacttcgatattccagcgcgcctaactgataatcaaagaattgatcgatcatacccgtgtatactacctgatcataacgagttaaatactcttccttatgggtaagaaaatccgtgtttaggtgaaccttaatgtttgcatgatccaacattttttcaacaatctgagtgtacccaccttcgggaattccttggtaaaggtcattaaaataattattgtcatacgtaaaccgaacaggaagtcggcggataataaatgaaggtagttctttaggttccctaccccactgtttagccgtgtagtctctaattagcttttcataaatatccttaccaacaagagatattgcttgttcttcaagattctgtggaacctttcccgccatggaagcccgttgtttatctatctctgctttggcttgagcgggagtgataactccccacatcttattaaaggtattcatattaaaaggtaaattatatatttcacctttgtagttggcaataacttcgtttgtatatctattaaatgatgaaaactggttaatatactcccagatttttttattactcgtgtgaaaaatatgtgctccgtatcgatgaacctgaataccttcaacttcttcagtaaaaatatttccggctaaatgactacgtttttcaatgacatcgacttgatccccttttagtgcacgctcatgagctactgtcgctccaaataagccagccccaacaactaataatttcattttaatacccccatatcaaattatgctccagattaacaaaatgtattactaattagctttggcctgtaggtgaccttgttcagcagacaaaacctttttgtctttggtgacaccttctgtcaagcttcctaagcacataaaaggaagtgccatatcaagggtgactaactttgtttcaactaacccaaaaagagctattgcagtgagccaaaacaaaagataggaatcgccaaaaatctttgcgcgaatgccacagtaagtcgaataaagaacttctagaactgcaccaaaccagccaaatatcataaccgaatacatatactgattatcaacgtatagatatctaacattaatagaccatgaataaaatgcgttagccaactctgcaatatcgccgccgaagaaacttttttgcgcgtaataatcataaacaagcttaagcagttctggacgcccagacatccattcatttaaagtttgaaagacctttgaactagatggaagaaatatggaaattgttaatgaacccagaaaacagattaacgggacaagtatgcaaaaactatataacagttttcgaaaacttatgcttttaaaagtattaaaaaccgtaaccaataccacaaaactcatcactgaaattagcgaaccacgcgagcgagtaaggacaaaaataagaattccgctcagaatcagcaaaacaataggcttaacgcttttccttgcgtacaaataaaacatttcaagagagatcatcattaagtacatccctaaagcattagggtgatgaaatccaaaagagaatctactgtatactccgagttgaataatcggactaaccgggagtaattgtagattattcacaacgaagagtgaaattgtaacaataatcctagcaaaaagatctatcctcaccagacttctaaaggaaactgtttgagaactccaaaccagaaatataaacgcaacaactgcaacttgttgattaacaaacagataaccataaacgataaccagaaagagaggcccagttataagccaatttaagagagaacgtcttttaagaaaacctaacactaggagtaatgacgcaaggaaatacgctgttttgttgccaaaagaaacaaaactcggataagcagatggttgatcaactggactgatcatcgactcggctgtgaagccaaagatgatgacgagccaaaaataaataaacaaatacgttttaaccaagaacggttgaaacgaatcttctaaattgtttgtttccatgtgtatcccctaagacaagtatgttattgtctaaacttgatatgatgggttacttctttccagtattcgtaccatacccataaccgtagccgtagccataccctcgatcgccgtgtttagctttaactcgttcaactgagccaagaattttagcattagcaagctttaaaacttcaaccgttcgtcgaagatcaccttttagagtcttgcccatattagccacaacaactacaccgtcagtttttggaaccaagacttgtacatcagatacggctaaaacaggtggggtatcaagaacgataatgtcatagttttccctggcccaattcagtaaatttgccattcttttagaatttaacaattcagagggatttggcggaataggtcctgacgtaatgacactcaaattatcaacaaatgtttcttctacaacagctccagcttcatcttttccaattagaattgttgttaccccgtctatattcaatgtcctaaacgtggcgtgaatagtcggtctcctgagatccgcatcaatcagcaaaacttttttcccagcttgggcccaagtaaccgcgacattagccgagaccgttgatttaccttcagacatggccgaagacgtaaacatgactacttggcaacgatctaaagcagccccagcaaattcaatattagtgcgcaccgttcgaaactgttcagacactacatgtttgggctcagcaaaagcgactagcataacgccattcttttgggtttcttgatcctcctgatgacgatgaaaaagtttagaaaatgataactgcatcatttattccccctcaaattcgacgacgactacgttgtggaaaatctattccatcaagatcgtcttgcacatcatttcctgaatccgttgctcgactttgttgtattgcctgatccatatctttcatgcgcacaacataattaacaattcctaggttaaccagccctaagtcatcagtaataaaatcaatatctttaatggtttggtcagtcaattcacgtacaagcccccagcttaacgcgattaagatgcctaaagccagcccaacaatactcaacaattttaatttaggagataccggaattgtattagccgttgctctagaaacaacagagacatttgagatactcatgattttagcaatttttttctcaaacaccttagcgatttcgtttgcaatatctcttgcgcgaactggactggtatctttaacatttacagtaaaaacctgcgaattctgttgtgtcgagaccgaaaccatcttcgtcaaatcctcttccgaaatattggaatatttggcgggtttgagtttatattttgcaggttgtgcttcctctgtgacgtacctttcgcgtgttcctgtaacggcattgtatcgtgttccataaacagcaggttttgctttcttgaccatcactcgctgcggactggtaagatcttccgccaccgcttgcaaaacaacgggacgtgtgatgatatccttatatgtattaataatctgaatatcagcttgttgtgcattcaactgcatgttcggatcgttgtcttgctttcgattaaccaacaatgatgtatctgattcatacttaggtgcaataaaagccttcgcaccaaaataagcagctgccattcctatgattccaaaaacaatcatagctaagaagctgcgtttgaacacattccacaactgtgaaaggtcgatctgtttgttcatgaactcttccccacctaattcaaaaattagtaacaataaattaaaaaacgagctgcaagctacacagccgcataaaaatagagacttttaaaatcccactccaaagcataataccctagcataagggtttaagtctacccatcttttaccggaatttcctttttactgtttatcgttaatcttttacgttagtctaatctccggtttagtgcttattgttaaccaaaatggactggtttattacagtctctttacaattttcaaaaatgcgaccacaatgtcccgaatttgtaaccagtatacaaacagttttagtttaaaataaacacaagtaacattggagggttaaaacttgaagaaaaaaagcggcttacgcttgcgtgacatcatactatgcatcgccctgggcctcgtcattgccggtgttggaggttatttctacttccgccatttccagtccgagcaggcgatcgcagttaatcagcaaacgcgtcagaagattaagaaggattcgaaggctaaggttaagaaagaaaaggttttgaatcagtatcgcctgtatggcctgaccgacagcgaaatcagtgccgccaagacgttaccggtgactgccattggtgattcggtgatgttgggaagttcggcttatttgaaggtgcttttcccgcagatgtcgattgacgctgaggttggccggcaagtgcaggcggctcctgctattattgatcagttgaagtcaagcggtaaattgaaggatactgtcgtcatcagtctgggaacgaatggaccgatgacggaagcagacattaatggcattttggagcagctggggagtaatcgtcaggttttctgggtgacagcttatgctcctgggaaggcttggattgatccggttaacaagttgattcacgccgctgctaagacgcatgcgaatctgcatgtggtggattggtattatctggctggcggtaacgatgattggtttgccgatgatggtgtgcaccctaatgacgcaggacgcgtgcattattacacgctgattgctaaggatgtcatgaagacagtgaataagaagtagccgtttatgcgcgttagtaatgctcgaaattaacaaatatatcaaaagtttcgcatcttctataccacaaaaaaacaccgattcactggccattttgaaagggcactgaatcggtgtttatttatgcaagttagccaagtttcgatcgcaatcacatttcttgatgctggtcaaatgttttcttgatcagctgaggtgcaatgacgccactgcgagtcacatcccaaggtgagccttttcgatgggttaagtggactagcccagcagccgtatagccgcggaaatcattatcaactttccgcaaaaggtcggcaatcttcctatcagattgaaccagattgaaatcttcgaaagccgatttttctagtgtttgcggaacaattccgcgtctaccattgtatttcttgtgaacatcttcaacgaccggtccgtatggcatggcgataattttcgatgtgaataactcaccgcctgtcttagcaatccatctgccgaatgcaaagtaaagcaacttaaccactttcatttgagttagttcttcagcattcggatctgtttttaagctgaagtagtttctaacacggaaccaattcgttaattgtaatgcagtaaattccgtgttgtgttttagtgaggtatccccagctttacgatcgcttagataggacgtcatttttttaacgatcttcttagataaattctgttgatttggagaaatgaatgatgcgagaaaatcgtcgtcattaatgagtgcctttaatatccgattattggattcagatggaaaagcaccggtttcatataaagcgatggttgtcggactccatcccattagatctgccaattctcgttgagacaaattcatacgcgcccggtatttttttatttcttcgggagaaacaatatccatctcttgtcgatactttgcattggccaatgctaccgcagcatcatcaaggcgttgatcaggaatcaactcgccagttctccgatcaaatttagctggtgcggttaccttgtattcttttccgcgaattagaaatgtattcgtgtggtctttgatgatatacggttgattcatactcgtcgcccctattcattataactttcgtggaaagaaataaacttaacccaatttgtatcctggttaattttaaatttcagataatagaaaacgccatattccgttttaaaaacccaaacgtactcatgactcccattacgatccagctcatgtttcttataatcgttgagggacagttgttgaacaattactttggctaagtccgcttcgactgcctgtgcgcgaggatttctccggttaacaaggctgaacctattttcgctgacaagatattttagcttagcgagtgtttcttccagtagattcataaccataccgtcctcgtatttgtacattgagcataacatctaagtttaataattgctacaattttgtagcatcaatggctctattaaaatcgcagtataaatatctggatgcgtacaactcaagaccttattagcagccacaacgcctataaacgaactcaagtcaagttggtgtaactattccactcgcctttttctgccaacacgttgccacaaaatgccagcaaccaagcgtattaaaaaagcgcccccaaaccatcgaggagacgctcacagatccgaaagtctaaaaactagaccttcgcaacttaacttaaaaatcacttatccaaatccacaaaccgcgtcagcaccatcatcacagcgccgccgactgccatcgaaagcgcttcgcctagcgcaatggtgccgtatgtcggccaaaatggtaccttgctgagcacgaccagctcaccggcgacggtaaacattgagagggcaaataagacgcccatgatggcaaatttggcccatttttggtggacgaacttagcgagccagcgactgagcaggatgaaggccaaggtgccgattgtgccgatgggaacgtcgagaatggcggttggtgatgctaagttggccaaaaaaacacccaacgtaaccgcccagacgtaccgacgattgaaaagcgccgtgtagttgagcatctcggagaaccgaacttgaacgatcccaaagcttaatggactaagcatgagggtcatcaccacatagatggcggcgacaatggcggttttggcgagactgacgattgaacgatgggtcatagatgttgtttgcatattgtttctcctttgtggctttgccagtaataacgacgatcaaaggaaataagtatcgtcgtggaagcgcgcggggcggttccgattcagttaatagttcttacaatgtttccagtttacttttccaaccaaccgccgtcaataggaatcacggtgccgtggatgtaatcggccgcgtcactggctaggaaaagtgtgagttgggcgacttcttccggcttggcccaacgtttggctggggtttcttttgcgacccaggtggccattttcccatcaccggcgaaatctgccgcgttcatgggcgtgttgatggcgccgggtgcaagagcgttggcgcggataccttgggcagcgtagtctagatccagttgcttggttaggccgatgaccgcgtgcttggcggcagtatatgccacgccaccgccaccgccaacgataccggcaatggaactcatgttgacgaaaacgccgtgaccacgcgccagcattccaggcagcagtgccttaatcatcaggaattggctggtgaggtcgacattgagaatatgctgccacgtggccaaatcggtttcggcaacggttttatagccatccaaaatacctgctgtgttgcatacaatgtccggcgtataatcagcggcaagcttctttcctgtctctggatcgctcacatcggcctgaattgcgacggtcacgccagtcattggttgcaagtcgacaccaatcacctgggcgccggccgctttaaaagccgccgcctgcgcagccccgatccctgatgccgccccggttacgaccacagtctggccgctaaaatcaaaccggttcatgcgtccacgagctgccaatcttcggccagaatgtcacagtcggtcggggaccacaagctgaaggcctcatcagcggttttgatcagaaaataaggattcagggtgtcgccttcgaacttaccttccggaaccagttgaacatacaactcggtaccttcccagccagtacgaacggccttttttccttcttttaatgctggcaaaacggcttcaaatgtcattgtcacttttcctcctttataagatgacccagcctgttcacagtgttactcgccaaggcccgtgtcatcgttgcggttaattcagtgcacttagtatacgcgatttttctgcctgcgaacagtcttaaccacatgcagcttttcaaaacgtgcgcagaattccgctaattggtagcaaacataacttttccgaaaacattaaaacggctctaaagacaaagtgtctctagaaccgtttttgcacttattggcaaccgccgcaagttcgcctacgacacgctcagaggttaatcacctgcatgagtacctcggagacgtgtgcgcgttcgttttccggcaaccgcgttaaatacttaaccaacgccaacgtattgatatcgctcatttccggggcgataaagaaatcacccacctgcatgtcgagtgcccgcgcaatgtcagtcagcttcttgacgctaatattgttgacatcaccacgttccatgcgggatatgagactgacagaaaccccagagcgttcggccagtttttcaatggttaagttcatactgcggcgttgttggtgcactaatttgccgatattatctaacatcatgttccccacctctaatgtgcggcgttatgctttaacattaaatgaaacgtccgaccatcaaaagattttataatattatttaataatccaaagacggcctattgtcacacaacgccggtgcaagaccccacattaactaaccatttcacttctcagtatcattgtaagcgctcgccttgcgaaagtgccaaatattggcttgataatttttttaataaaaaacaatgccgggtgggtggcattgttacttggtttgatattcacttggtacaaatgcccacagcgtgccgcgggtaaattgttccccgtcacctgtatccaattcactgatgctgttgttaggcggcatggtcatctcatcacgcgcatcgtccaactcggcgcctagataagtgctcattagcagcatgcccaacaacccatgggccaccacgagcaccttaccatccggatgttgctgataaatgccggcaatagcgcggcgcccacgatttaaagcctcagcgaaggattcagcgccaatccgcttataatcaaactcagcgagatggtgatagtaattatcaatttgcggatcgtcttgcacggaagcaagtagctgcccgtcccaatcgcctaaatcgacttcccgcagatcccgtaccgtcacgatcgccggctgcgaaaccttgctttgcgccacgatcaattcagcggtggtttgcgcccgcggcatcggactggcgtaaataccggcaaaaccggtcgtagcaaaataccgtccaactgcctccgcgcctgcccggccagccggagtcagcggcgtatccgtccgcccgccattgaaccgccgcgccaaattggtctccgtctgcccatggcgcacaaaataaaacttggtcatccttccacacactcctttaaaaccagtgtagcagaagattcgctgaaaacgttacctcaccataaaaacgcggcctagtttaaacaagcttaaagatcagaattagctattcgaaccgttttcttgcgccaatactgcggatatgacaaaaagccgaggacacattttcagtgttttcggctttttgttgtaagaatcatttttaaagattcgccctagcagaatgttatcatgtttgaccgcgttattctgctgccgtgcctgctggggccttatgatcctcttgtgcttcagctttatacgctgccacttcatcgtcagctgcaaagataaagtggtcaggatagacttcgaccattttacgttgcttattatcgccttcgaccttgcttgcatcataaggtatcggtacacgctggcgttcgatgtctggatcgggaactgggattgcagacaagagactcttggtgtatggatggaggggatgtgtgtatacttcttccgcactggccaattcgacaagccgcccgtaatgcataacggcaatccgatcagaaatatacttgaccatagataagtcatgggcgatgaacagatacgtcagaccttgccgatcctgaatgtcttttagcaagttgacgacctgtgcctgaatcgaaacatccagcgcactgatcggttcatcggcaataatgaacttcggctgaactgccagtgcccgggcaatcccgattctttgacgctggccaccggagaattcatgcgggtaacgcgtggcatgatccgcatttaaaccaacctcatccaataaagcttcgacttgatgatcacggtcggcgcgatctttagccaaatgatgaatatcaataccttctgcaataatgtctttgactttcatccgtggatttaatgaggcatacggatcctgaaaaatcatctgcgtattacgccggaaatccaacatttgtttggagccatttttcaatttggcaatgtcttgaccgttatagagaatttcgccactggttggatcatacaagcgaatgatagcccggccggtggtggttttcccggaaccggattcaccaaccagacctagcgtttcgccctcatagatatcaaacgaaatatcttgaatggcctttacttcgtctttctttccggcattaaaggtttgaaccagatgtttgaccgaaaccaacacttttttcttttgactgtccgccacgttagttcaccgccttttcgtctggatgtttacttgcccataatgcatgccgccgcgcgatttctggcggtaactcgactttgggtgcgcctggtgctaacaaccaagtagccgcagcgtgggttggtgaaatcttgaagaatggtggttcttcttcaagatcaattgccatggcatacggattgcgcggggcaaatgcgtcaccctttggcggatccagcaaatccggcggtgtccccggaatggcatacagacgatccgttttggtctctaaggtcggcattgcctccagcagtccccaagtatatggatgctgcgcgttgtaaaagatttcgtcaacggtgccgtattcgacaatcttacccgcgtacatgactgccacccgatcggcaatcccggcaacgacgccgagatcgtgggtgataaagataatggaagtatcaatcttagactggatttccttcagcatgtgaataatttgcgcttgaatagtcacatccagcgccgtggtcggttcatctgcgagcagaatctgcggatggttaataatcgcaatcgcaatgacaatccgttgacgttggccgccagagaactgatgcggataatctttcaatcgtgaaccggcgcctttgatacccactagttcaagcacccgttcagcttccttcaatgcatcggccttgctcattttgttatgcagcaacagcggttcagcaacttgcttaccaatcgtcatcgttggatccagtgacgtcatcggatcctgaaaaatcatggcaacatcattaccgcgcatggcattcaattgcttttccgactttttaagaatgtcaccgccatcaaacaaaacttcaccattggtaatcttggcgttgggtgccaataagcccatgactgtgcgcacggttaccgatttaccagagccagattcgccaacaatcgccaacgtctcgcctttgttcaagtcaaagctgacattgcgaatcgcgtggaccggtccggcataggtggcaaagtcgatttgtaaatcttttacttcgagaatcttactcattttgccacctcctaatgttcactgcgcggatcaaaggcatcgcgcaaaccatcagccagcaagttaaaggccagcatcagaataacgatgacaatcgctgggtataacaactgatacggcagcacttgcaggttcttttgcccatctgacaacagcgtccctaaactagcagtcggtgctggcaaaccaatcccgatataactcaggaaggcttcaaagaagatcgctgttggaatcgtgaacatggtttgaataatgatgatcgagcttaggttcggaatcaaatgtttaaaagcgatcttaatactcgactcgcctaacgttctggcggccagcacaaactcctgatcttttaactgcagggtctgcgcacgaatgagtcgtgccatcgtgacccagccagtcaaagcaatcgctaagataatggaagtcatccctggtttgaataccagcagcatcagaataacaacaaccaagtttggcacactagagatgatttcaatgacacgttgcattaacgtatcggtcaaaccaccgcgccaaccggagatgatgccgtagaaaacgccaatggttaaatcaaagaatgttgcaacaatcccgatgaaaagggaaacgcgcgtgccgaccataatccgagacagcaaatcacgcccaaggtagtccgtcccaagcaggaaatagacgtttttacccataccggcatatttgttttggccattcatatagccgtttagtcccggcaaatcaatgcctggccactttggcggtaaattagaataattaagactctgtttattcggattggctggtgatagccaaattgacacgatagagatcacaccaatgatgatcagtacccaaagtgaaatgaccgcggccttatttttctttaagcggcgaatcgcatcttgcgtgaatgtcaacgcaggcgtggcaatacgctcttgttcagccgcattcactttgacacgcttgaatgcctctggacttaattttgttgttgccattagtttgcctccccgctcagtcgaattcgtggatcaatgaagccgtatagaatatcgacaacaaggatcacaaccgttaacatcgcactgtaaagaatcgttaagcccatgatgaccggataatcgttcgttgtgatggacttgacaaattgttccccgattccgggaatggcaaaaatgttttcgacaaccagtgatccaaccatcaagtcaactgccattggcccaataatcgttacaatcggaatcatggaattacgcaaagcatgttttgccacaacctgccagcgcgattcacctttagaccgagctagctcgatataatccgagctcagcacgtccaccatctcggttcgcataaaccgcgctgtctgtgccaacggggcgatcgccaaggcaatggtcggcaaaatactatatgaaaacccaccccataacgctaccgggaatgtccctgtcttgtaagcaaacaactgcaacagcgcagcaaacacgaagttaggaattgagcgtcccagaatagcgaaaattgtagcttcggcatcaacggcagtgttctttcgaattgccgcaatggcaccaagcacaatcccgataagtgttccaagcaccattgcctgcgcaccgatctgtagcgaaggaccgagccgggaaacaatcagattggaaaccgtttggcccggaaattgataagacatcccgaagtcaccgtgcgtgataccaaccatatacgtgagatattggatccaaaccggcttatccagtccatactgtctcttcagaatttccagctgatcagccggaatcttggggttattaaatggcgtccctggcaatgccttcattaaaaagaaggtgattgacgcaacaagaaacagtgtcaggagcaggaagccgatccgttttaaaatatatttgaccatgattcactcctgttttttgggcattggccctaataagcaaacggcgttgtccgccgcaaaacacgtgacaacgccgcttgtgagaactacttattggaaacaagttccgatttaggaaaccctgtaagattcctaaacgcgttgatctgtctaacagttgctaagacaggtcacgcttttattacttaaccttggcatttacaaaatcgtaagagttagtcgggttatatttcaaaccggtaatggtcttacgttgcaaggttgtttgaacccgttgatacaaaggtacaacgccttgttctttagtgagcagttcttgtgctttcaacaaggtgttccaacgagcggtggcattggttgcatcggtcgtcttggactgtttgatcaaagcatcgtattcgctgtttgcccatttaccatcgttataactattatcggacgtaaacagatcaaggaaggtaatggcatccgggaagtcagcactccaagcggagataaccatgtcaaactgaccattttgagaacgggaaagacgggtcttgaatggcactgttgcaattgttaccttcaagcctggcagattctgttgtaaggtgctttgaatgtattcagccgagcgcttggcattcgtggtatcatcggtcaacagttccaaggttgggttcgtctgaccggtctctttcaagccttctgtccagagttgtttagccttagcaggatcatacttaactgtagaagattctgctttagtcgctgcctttgagaagtcctgtccattcttagcaaataaaccttgaggcgtcacattgttcgcagcaattgatgaatcattcaaaactttcttgatgtattcttgacgattgattgccatcgagactgcctgacgaatcttggtattcttgaagataggatctttcttctcattcaactcaagataaaatgttgcactttgcttaagcggtgtgtatccagacattgtcttagcttgtgctgcctgttcacctgacaactgagcaatatccaacttattcgattgatacaggttcaaagcagtttgcggatccttaaccacttgcccattgatcgtatcgatgtggacattcttagcattccagtaggttttgttcttcttttccttccatgaattaccagtcccattccaatcttttaattcataagggccattcgagagaaggtacttagaagtcgtgccatacttcttaccaaccttttcaacaaacttctcattctgcgggaagaatgccggattgactaacatggtcttaaagtaaggaatggcgtgatccaaggtcactttcagcgtggtcttgttaaccgctgtaacgcctaaggtactagctgccttcttaccggctgtgatatcgtccgcgttcttcacgccggaatacagataagcatactgagacttggtcttaggatcaaccgttcgccgccaagcaaaaacaaaatcctgtgcagtaacggcatcgccattgctccatttagcgttccgtagcttaaaggtataagtcttgccgccgtccgtcacttttggctcgctttttgcgatcgctggcttcaagtcactgccggaataccgatacaaaccatccatggtatcaatcaatgcttgccccgcaatcgcgtccgtatttgttgacggatccattgtggagataacatcactttccatccgagtgattgatgtacctttgctgctggaagcattagaaccacaggctgccagcaccccagcgagcgcaattgctgtgcccgcaaccattgtttttctaaatttcatcctgttccctcctaaaatgattgaacttaccttacattagaatctcattaatgtaaataagcgaatcctcaattttgaataaaaaaacttgtatgtcataaaacatcacaggaaaagaagcggaagttattgggacaacatcttgtgcatcaactatgcatatttttaaatctcccgttaaaacggggatttacaaggtactaaactgtttactttagatgatcctttggggaaaccgctaaacttttacagaaatccgcgaatattaaataacatcaatttatgtccctaaaattggcttgtttttccctgaccgccattctttcagacataattttcacttctgtcaaaccagaaatgaaaaacattgtcgccgctcagttaatgctaatcgttttcaaagtacatgcttattttttgtcagtaccgcgttcgcttgtcgttttcgcagactgcggataatgacaatgattaagcccaccaccgatactaaagtggctaaccaaaaaactgttgccagtgcgtgtagaaaaggggcgcccgattgagctgagatgcgggtcacaccgggcaattgggcaaatagtaacgtggcgccgaagctaataccgatcgttaagccaacggtgcgtgccagtgaattcaacgaaccggctactcctgagagtttgtcatcgacggctcccatcgttagcgcattgttcggcgaaaggaacagtgccatccctgctccgttagccacaatcgaccagataatcggtgccatagtgattctgactggataattggcatacccgatttgcgagatgattaacactaataagcctaaaatcgttaaatagtaccgattccaatgatcggccaaccagccggcaaatggcgtgatcaccaacatcgtgacactttgtagcatcatcagtaacccgcttgaaaatgctgagattcccccatagctttgaagataaaatggcaaaagaatgtttgatactgaattaaccagcatcacgataagcaagacgctaacagaaatcagatagtcggcgttatgcataatcaccggtgcaatccaaggagaccgggcctgctgatcttgcacaaacgccaggaccgtcaagaaaatgccgcctgccaacacccctgtaccgagccaaaattgcattggctgctgtaaccagtatccactggcaaacatcaggatcatgcccccggtaaacagattctgaccggtccagtttgcctgctgccacacgcgcctaatttcaccgggttcggggcgacgtaacggcaacacgcgcatacctgcaaggacaatgaagatcccgactggcacattaaataagtaaatccaccgccaactcgcccaggtaatcaggatgccgccaaatgccggaccggaaatcgagccgattgatataaacatcgaaatgaccgccaatgcctcagcacgggtcgcatcgggaaaatattcactgataatccccatcgaattagccataatcatcgccgagccaactgcctggaccacgcgcccggccatgatggtgaaataagttggcgcaatgccggtcagtagcgagcccacgatgaaaatgacctcgcccagcagaaacacgagatttttggagactaaatcaccgatatggccaaacatcacgagcaagactgccgttgtaatgaggccaattgaaacaatccatgttgctgcactgcttgagatcatcaagtcttcggagatcttcggcattgccaggttcgtgctagaaccagacaaagcggttaataatgacatcagccctaaaatgatcaagatttttatgcgttgcacccgcgccatcgccaatgctcccacaccctttcgcatgtattctatgctcgttagccaccagctacaattattccgccctgtagcaaataaggtgtgcgtcattttaattctggcctttgatacgcatagactctggcaatgacgcgctcaccaaaaaaggcgacgcatcattgcgtcacctttcgataatctaattaatcactatttttgcgcgcgtcccttataagcacccgtatccgtggtcaccaaaatgttttcgcctgctttgacaaaatcaggcacagtcaccaccagcccggtttcaagtgtggctggtttgccgccgcccgcaaccgttccgcctttgacagacggctgggtgtcggtcaccttgagttcaacggttccgggaagttcaagcccgatcacttcatcaccgtaaaactcaatttcgaccggaatatttggcagcatgaacttcaactcgtgctcaatacttgaagtcggtaattcatactgttcatagctatcactgtccatgaaataagcagtatcatcttgcgtatacagatacgttgcttttttccgatccatgatggcgatttcgattttttcactcggccgcatggtcgtcatgacattggcgccggaacgaacgtcatacagtttcatctgcatcacggtgtttcctttgcctggcttatgatgatttgattccaaaaccttgatcagtttgccatccttaacaaaaaccattccggccttcaaatcgattgcttccgtcatgtcgttatcccctttatttccattgtgctgttattgcacgtctcagaatttagtataccataataccttgtgcgggagccggcactaactagggatgaagtgtaagtgtcagccctttccttggttctactctaattaagtgatttccgatactccgagctggctccgcggtggctggggctggcgaccgcgcagctagagtggtgggcgcgacttcgaacccgcaaagaccgcggtttcgaagctcggccttggtctaaagcggagaagcccactccgcttaagaccaatttcaccactgagcccgccaccgctccgccagctcttgctttctatccctgcactcaaacaacgagactcaacgtatccttcgttgaagagtacgttccaattaatccgataagtataatctgtccaaccaaaaaagccgaccctagcgcagatacgctcgctaggcccgacttttcccgcaactcatcagctaaaacagtcgctacatatcctcaacgaccaaatacgtcatgtctagcggtccatggacaccgacgaccaaggtcatttcgatgtcgccggagttggaaggtccggtgatgaagttgatgttgctggtttctagctgtccggccttcattgcggcatcgtagcgatccatggcttggcgtgaacgtggcaggatgttgcttttcttgacgattgctaaataatgcgtcgacagaaaatggaagcctcggccttgtccgggcgtggtcgcaacggtgatggtcccggattctgctaatagataatccgcaaagccaatggccacatccgcagccgcagcttgcttcaagttgaagtcacggccttttccgggggtccagtacattggcttgggagtaacggtttgcgtccactcgtctaggccatagtcgtggtattggtccgtggttggcaaaatgagtgtcttgggcgcatcgtgttcgatgtaagcgttgagcgcggttgccaactctgctttggtggtggtttcaaacgtgacatgcaccgcttcactgttttgcttggcgatggcttccaactcatcttgggaatggccggacagagttgtttccggcaagtcgtttaaaggcacaaacggatgatccttgagctggtgccgcgggcggccggctttttcggcaatagcatttaaaaagtcctcgcgattactgtgatcaatcatgcttttccgcctccaatgctgctttgtgttgtttgaaccaatggcggaaattctcgtttttcttcggtggtcgcggcaagtcacgcacatcggtccaaccgcgggccagcttgggcatcatgccggtttgtttaattcggccgctgttgtattcattttcaacactgccttgatctttggttgccaaaacacccatcattgcgtggtccatatcaagcgccatgttgaacagaaccggcgcactggtgccgacgccgaccattttcatgattttatcgctaaaactgtgatcggttttcagcttgtccatcattacttcccggtgcttgattaacagatggtgcagcgggatgcggacagggcaggtttcggtgcaggccgcgcatagactggaagcaaatggtaggtcgccgaatttttcatagccatccagcactggtgacagcaccgcaccaatcggtcccggataaatcgaaccgtaaccgtgaccgccaatgtgccggtataccgggcaaacattcaggcaggccccgcaacgaatacactgcaagaccggctcaaatggcgttcctaaagcattgctgcggccgttgtcgacaatgaccacgtggaagtcttccgggccgtctgcttcaccggcaacttgtttaccggagaaggaacagtaactggtcagcttctgtcccaccgccgagcgcgaaagcatgttgtctagcgtctcggcttccttgagactcggcacaatccgttccatccccatcacaactacctgcgtcttaggaatggccatggtcagatccgcattgccttcattggtgaccaagttaatcaagccggaatcggcaatggcaaaattacacccggtaatcccgaagtcggcttgcaagaaatagcggcgcaaatattcccgcgcaaaccgcgccaaatgttccggatcgttatcccctttgtagccgagcttatcaaaaatcgtcttaacttgatcccgattcttggccaacgccgggaacacaatatgcgtcggttcagcccagtcgtcttcttgcaaaataaattccgccaaatcggtttccatcagctgggtgcccggaagtttcagtagctccttgtccagattgatttctgttgtcaccatggatttggatttaacgattttatgcgcctgcttttgcttggcaaggttggtaatgtaggctgcggcttctttgtctgtcttggcaaaataaacatgaccgccgcgtttttcgatattatcgctgaattcttctaaataatccggtaagtatttaatgacatgttgacgaatctgctcgcctaagtcccgccattgcggccaattacccagctctttacgcgaagcctcgcgcttgtcccactgcgcatcctgcgacttggcaacactggcttgcatgaacttatcctgttccgattctttaacccgctccaagaacggcttgtcactggttgaaatgctcatgggcgcacctcctgttcaaccccgagcggttcatgaaacttgatccgctccggattcacattgtggttcaatacttcggcaatgtgcataatcttaatcttttcgttacggcgggaaaaacggccggcgatgttcatcaggcacgcgggatcggctgaaatcagcacatgtgcgccggtactgagcacatcgttgactttttcatcaaccatttgcttggaaatttccggctctttggctgaaaacatcccgccaaaaccgcaacaattttcaatatgtggcaaaggttccatctgtaagtccttaacgtgatccagcaagacaaacggtgccgtgcgttcgcctagcaaccgggtcatgtggcaggagcgatggtaagtggctttggcatctaactcagcgccggcatcaatgacattcaagacgcgatacagaaactgggaaaattcatacgtcttgtctgccacttctttagccttttgggcgtattccagatcgtctttcaatagcacccgatattcgcgcaacatgttcacgcaagaaccggctggcccgacaatataatcggcatcaaccgaaagcagcgcgtcaatttcgttgcgaaacaccttttgactttccttcacatacccggagttgtaagtcggttggccgcaacaaatctgtttgatcggcatgaaggtttcacacccaaaccgttccaacacctcgaccatcgccgctccgacattggggaagaaaagatccacgatgcaggtggagaaaataactactttcataatgcacctcccatattacaatcattccaatttaactatacacctgtgacaacggattagacaccgaaaacggtttcaaaatgttaaatgttatttttattggcgcctctttttccgccatgctaaccgtgccattttcttcgcacttttgttggcagatgggtaaccctgttttaggagcataaccggtctggatagctacaatgtataccatttatagaaccataatcaatatcaatttatttatattggccactacccgacacgccgagagctcgttcttttcacaagcgtaaaacagtgtcttttcattgatataccgctgttcctcacggtttcacagccttgatttttttcttaaaaggactatcgttgaaggtgagttagggttacctaaataactcaaatcaaacaggaggcgggtttatgcggaagcaatatagggcaacattgcgggcgcttaactcagattgcattggtcggcaggcacatggctttgcaaattttgaagttaccgatgatgatgctctgcagattcgcattgaaatgttcaatacgccagcggacatgaatcacatggcagtcttggaaagctccggttccgatgcgccggtcacgccagccacaagtgctcaggatcagaatcatgatggggtcgtcgatgaagaagaagccgaacaagtttccggtaaagtctttgtccctctcgataatgcaccggataagttgaagttggtgggtggcaaataccctgaagccgacgacaacgggttctatatttaccagcagcgggttgtcgtatcccaacttcgccaacaactggcgaaacattatggtcatgatgttttcaccctagacaataccgtggtttacgtcaacggggttcaaaatgacgtcttgttaccaaaaaccgtggcgagtgatttagatgaaaaaaagccttatctcactttgccaattgcagtgggtaagttgtacaaggtcatgggctgatagttgcgacactgctaatctaataaaaagactggaacaaagcatctcatctttccagagatgctccgtcccagccttttggttatcttcgcaataaccgcgtgttttacatataaaattcattcattgtgcaactggcattgtgcaactggctatcacgcaatggcttaaagcgtttcatttgcaacggtcgtatttgcagccaagcgttgataaatcgcgaccacttcgccagccaagtcgcgaaaagtaatggcgttcatcagatgatcctgggcgtggactagtagtaatgaaacatctgcgtgcgctccgttggcttcggcggtcaataaatcggtttggacattgtgcgccgtgaccagagcctcatccgctgcttttaaatggctggttgcagcatcaaagtcactgttcttggctgcttgaatggcttcaaaggcttcacttttagcgttgccccctgccataatcaagcccataatcgtttgttcgttgacgttgctcatggggtcactcctatctgtcattattagtgggacacctgttttaacataaatgttcgccatggcttaagcagtggcaacaaggtcagatcttcatctgtcaggcggccgattttgttgcggcggccgtcattaggcaattcccgcaagacaatttgtagttcaccggcgtaccgcgtatacgtttcgttcacgacgactacatccccgcgctgcaagtgaccgctcgcatcatgcactggcaaaggctgcccggcataacgcacgcgtggttgggtatcgcgaatcagataatcagacgcatcaccgcgataaagatgggcttcgctaaaggcaattttggcttctaacgctgatggtgcctggtccgtgattacccgcaatgccggatacgggcaaaagaatgccaaggccgcggcttttaaatctgcttcgcttgcaagtgcattgccgatgagaacatcatcaatcacctcagttaggcgcaaatggtgaacctgactggcaatgctgcgatggcgatcgctttccaaagtcggtaaaccttcacttaccggccacggtccatgatccgcacttggcgccgtcacaaaagccgccgtccggacgccatgccgccgaaacttttgcgaataggccaaaaagcggtcatcgcctaagccggtatattgctgcggataaaaattatggcaacccagcaagttatccagtcgcggcccaaacgccatgattgcatcaatggcattcgtaccggcactcatattcagctcaattttcaagccatattgattatgagtcatcaaggcttcctcttgaccggtgaagccctcatcaagccgcaacccccatacgcctaattcatggaagaaactaaggtcttgataatcaatgcctagttccttgaacagcggcggcgcaatgtcgacaatcgtttgaaagcccaactgattcgccttggcaaccaccgccttgaaaatagcgagttgatcgcggccttgatgaccggatagttgcagtaatgaggtgaaaagacgccgataaccaaactgacgggccatggttaaataatcagttgcctgatcaaccgttatttgttcgggataaagactgattccgatttttcccatgtcaatctcctatattttttactgatggtgtggctgggtcactcaagccacgttcatccaagctgttttacaaccggttctttaaatcgcacacatttgccgcgccattttcttgaagcgccgtttacgcaaccaacctaaaaggaatccgctagtccggttgttcgctgcaccgcgagcggtacgggcgactagtgcttcttcataaaccagtcgactttttccggcagacaacggcgacaagtggtaccgcacggtgaagtcatcactcggggtcgccagttcatatgcgtagactgaatttggtgcaaactcggtaatcgtcagccgcgcttttcgcccattcggccaatttttctcgtagctaaagccctgcaaactcttggctagcggctcacgaccggtgtgctggcgaatatcggccatggcggattgttgcagttggttgaagaagacactggcttcaacgggtagattcatgacaattttcatattgacctccttttggacaagctgcgaactgaacgcatagttgcagcaacatgcttcagcaaacgttgcgctgcgatctactcttctcttgccagaccgagataccagcgtgtgcaaatggcagttgcgaccaccccgaatagacagctaatgattcgccaaggtgccggtaaaatggcactgaagacaatcacggtcatgctgaggttaagcaagatcaatggtgtcgtgctaggcttcaaatcgcatcaccttctaaattgcgatcaccattgcgatcatcggcaacggttttggcttttttcattggtggttcagggacagttaattcaggatcgagtttgttggccgctttgacaaacggtacgtaaatcaggaagccaatgaccatgttgacggcttgcagaatcggggcgcgccaatccattgtcgcaatgatcgagttcacaaatggcggcatggaccagacaatttggttcttaaccggtgacacccagccgagcatgtgggcgccgtacgcgatggataccatgacaaccggcgcgagaataaatggaatgaagtagattgggtcaaggacaatcggcagtccgaacatcaccggctcgttcacgttaaaacagcccggtgcgatcgacaatttggccacggtgcgttgatcgtcacgtttggagaacatcaggatcgcaatcaaaagtaataaggtactgccggcgccaccgatccacgcatacaagtcaaaggcgtttcgggtccagacaaacggcagtgcttcacctttcatgaacgcattcatattggcaatttgggcggtgagccagatggaatccagaaccggtcccaaaacgttggtgccgtgaagcccgaagaaccagaaaatttgtaccagcaacgtcatgagtaacacggcccagaagccttgcgacatattcaacaacggttcttgcacgatggtcgcgatgaattcgatgaccgtggtcttgtttaaactgaacagataattcacaacgccagccagatataaggcggcagttgctggaatgataccggtaaatgctttagcaatcgctggtggcactgcttctggcatccggatcgtcacgttctttttcattaaccagatgtaaagcgtcatcgccaaggcgcccatgatcatgacggtgaagaagccataggaaccgaagaacttaccaaagttgaaaaagccccacatgctcacgttcttgccatcgactaccccaccggcatcggtgattaacttggcagcacctttactcagcgtgccttttagcggcagcatgaagttttgcggcaggctcataataaacgtgcctaataccacaatgcccccggtcaccggctcaacttggtattgaactgccagctggtaaccaaacgtaaaggcaaatagcagacctaaaattgccagtgtgccggtccaaaccatggcgttgataccgatcagccactgcatggaatcgactatccccatccacttaaattgggtcggaatatcgcgaatcaaaacgttcaagacagtggaaaccgccccggccatcatcgccggcatgatcgcaataaacgcgtcacgcaacgccactaaccaacgaatggagcctatcttggctgcaaccggcacaacatgtcgattcaaccatcctataaatgcattcatatcactgtactcccttcagaattttaaataatgtcgcattaatacttaactacaattaaaattctacgggagtgcagatcggcgagtcaaagattatagtagttattatttataatttttataagcaaaaagtttgactttttcagcttgtttaagcgttttcacaagggcgcgtatcggtatcgtgtttgaacgaatgcatcttatactttgccgagtttaaagattgcttctctgcagggcgttgatacttacataaatctcgcttacgagcaaatataacctctattgcttataatagattaaagttagaaattttcagcgcaaccacacgccacaacgcgctccccaccgcagaagccggctcgcgctcacaggaggattaccatggcaaacatagaatacgacccgcaaaaacagcttttccacctgcataacgatacgtttagctatatcattcaggtgattcgcggctatttggtcaagcggtattgcggaccggcgcttgaacgtttttccggtactgccaagctggaagatttcagtcatgcgtttaacattcaaaatgatgcggcaccgttttcgctcacgaccttgccgcttgaatatagtacgctgatgggcggggattatcggacgcctggctatgccgttcgcaatgggcatggacaattgatcgggaatctgaagtttcatgattttcagattctggcgggaaataaaaacttcaatggtactttgccgaccgcgcgcaccccgcatgggcagacgctggtgatcacgatgcatgacgaaaccgatacgctggcggtgaatctcaagtacaccatcgttggcgatctgcctgtcctgcttaagcaagtggcttaccataatctaagtgacgacaccctcacgattacccatgcagccagcttgcaactggattttgatgatcacgcttacgatctcattactttgacgggcgcccatctcagcgaagccagcgtcacccggcaaccgctcacaccgggtaaaaagtcaatcgccagcaattatggtgccagtggtccacaaggggttccggcaacgattctggcggcaccggcaactgatgactttgcaggcgaggcgcttggtatggcgctgttgtggagtggtaattttagctacaccgcgcaagtcgatcagtttggcaacagtcggctggtgatgggcctgaatccggagctcttttcctggcagctgaagcctggtgaaccgtttgtgaccccggaagcagcggtggcgtacacgaccaatggcttgaatgatctcagtcatattttccaccgcttttttgccgatcacgtcatgccattgccgcggaaaaatctgatcgaatataacacttgggagtccacgtactttgatgtcagtgaagccaaggtgcgcgcggaaatccctaaggccgaggcgctcggagtcgaattgattgtgattgatgatggctggttcaaaaatcggccgaatgatgccggtcagctcggcgattgggtgcctgatccggtcaagtttccgcgcgggttgcggcccattgccgatgccttgcacgagcgcggactagcattcggtttatgggtcgaaccggaaatgataactgaaaatagtgagttatatgccaaacatccagactgggcgatgcaatatgttggccaaaagccgttacgttcgcgcaatcagttaattctggatcttagccagcgaattgttcaggatcatctgattaaggtgctaaccgatttggtccggaccaatcatattgattatttaaaatgggattacaaccgtcatttcagccagcccggcagtccggtactgccacctgatcaacaaggcgaagtcgcctatcgttacacccgcggcttgtatcgggttttgaaaacattgcgcgacacttttcccgatttgcttatcgaaaattgttcgtcaggcggtggccggttggatggcgggatgctggcctatacggatcaaacctggaccagcgatttcaccgatcccgtttaccggatgaaaattatgaacggcttctccttattcttcccgcttaaaaccttcgtctcgcatttcacgatgtcaccaaatttgcaggactcgcgggtgacgcctttgcaaacgcgggcgctgcttagtctggtgggcgttactgggattgagtgtccgccaagccagttgagtgacgctgaagccgcggcggttaaagccagctttgtcttttacaaagctaatcgcacagaattgcaaaatggcagtctttatcggctgcatcccagtcatccgaatcaggatcaggtatgctggctgatcaccaacgaagccaaaaccaaggcgctcgtcttaacgtcagctggcgtggtttccccgattccgcactaccaacatgtgctgttgcattatctcaacccggaagtatcctaccagattaatgacaaggccacggccaccggtgctgaactcaattatgccgggatcactttaccgctggcgcatggtgatttttccgctaccttaatgacgttgcgcgtggtgagtcacctgccacaaaccacggcactgcctggtggcgacatcggtgaattgcgattttagcgaagtcagcaaaagtttcttaagtagtttatcttatatagaaagtttggtttccacatgaagtttatcatcgcaccggctaagaaaatggtggtcgctcaggacgatttccccgttcaaagtcagccgcagtttcgcgatcaggcggcgtggctgttgcgtcacatgcagcagctcacccgcgcagaagcccaaacactgtggcataccagcgaaaaactcaccgacgcggcctacgcacagctgcaaaccagtgacgtgacggcgcaccaatcccctgcgattttcagctatgtcgggattcagtatcagtacatggcgcctgatctgttggatgacgccggcttagcctatattcagcaacatttacggattttgtctggtctatacggtattttgcgaccgtttgacggcattgttccatatcggttggaaatgcaaacccgtctggctgcggtaccgaatcatagcttatataatttttggggcgatcggctgtatcaggcactggcgaccatccccggcccgatcatcaacctcgcctctgatgaatatgccaaaactatccgtccttacctgcagccggctgatcagtttattaacgtcctctttgcccatgacatcaacggcaaactcaaaacgcgtgcgacttatgctaaaatggcacgcggggaaatggtgcggtttgccgccacgcatcgcattacaacagtggaggaactgacgcactttgactcgccgacttatcggtttgatgcgccactttcgaccacggatgagcttgtttttattgcaaaataggacaagttgacttccgagaatggcctacaaccaagtccagctttacttttgggcttggttgtaggtcacttttttagttgttaggacttttttaagtgacaaaatgactgtctgcgagttaatatataaacaatataaagaaaggtttgtttataaaatgacaaatagcatttccgtttataaaatatccgaattgcagcagggttactacctagaatccggctaccttcactgccactattgcgacactagtttcgccgaagatgaagtttacccacaagacggccgttacttcactgctgaagcgatgatcaaacgccacattcaacaggtccacaacggtgcattggccgccttactgcaacagccagctagtcaactcggtgtatctgccagtcagcaacaggttctgcgcctgtttgcccaaggattaagcgacacggtgattgcccagcgcttaaaagtctcggcttccaccattcgcaactatcgcttcaagtttcgggaaaaacagcagcaggcacagcattttctcgccgccatggccttgctcgccttgccggatgccctgatcatgccgcatgatggcgccaccatgattgatgaccggtacgcgattaccccacaagaacgggaaaagaccttaaaagccttcctcactcctgatggccgggtgacaaattggcccgccaaggaaaaacgtaaactgatcattttgtccgagattttcaaagacttcaacccgcagaaaaactattccgaaaccgcggtcaacgaaattctgcagcgacacgtatcggattacgtcaccgttcgccgcaatctgatcgaatacggcttcctcgatcgcaccgcagacggccgcacttactgggtaaacgctaacggactggcacgttaagcacgtagaaagttttaactggcattatcggatgcaaaaaagtcacgccaacaatgagcgtgactttttacatatatcaatgttcctcagacgatttacgaaccggcaacttggccaccgtctcaacaacttgattcaaaatatccagctgctcagcataacgcaccgaaaatggttggctggtggcatcaggcttttctgcctccagtgccgcgcgcggttggttaccttggcgttgctgatgatccaaccacgccagtatctgttcaaatgtgaagcggctgaagttatccaccgtcaattgtcccgatagcaggctgccgagtaagtcgtggcgggtgtccatgggataaatctgcgtccgcgccagcaacacccgaaagtcgccaaaaaagataaagcgtgcttgcgttcgcgtcaacgcggtataaaagctctgggcatttaacatatgatcggccccattaacaatggcgatcaccgtatccgcctgaccgccttgcgctttgtggaccgtgatcgcatacgccaacgtcaacgcccgcggcacgctgccaaagctgtaataacaatattgctggccaacttggacaaccagaaatcgccgcttggtatcaatatgggcaatcaccccagtatcaccgttggccataatcgtctcccgccaacgctttgtcccgaattcgtcggtttgctgcaacccattttcgcctaaaactgcacgccgctcccaagtcttaggatcaaccagcgccacatgcttgtcattttttaaaatcatgacgcgatcacgcattcgcaaatggtgcttttgcttggtcaccggatcgacataactgctgacgtattcttcctcaccaggcctggtcggattgaccaaggcctgcagttcggcattaaatcgcagtcgaccagtggcgcccacatttttattcacaattaaaagttgcgagtccagctcgtggccgcttttggctagcgcgtcttgatacgccttgattccggcatcgaaaacgcggccggcatcgcgctgattgtaaagcgccacattaccgctgacatagcgatcatcatccggtccgaatggtaatggcagccgatcccgaattcgattggccagcgccagcacccctgattgcgcatcctgacgataaacccgcgtcaaagttgtggccgccacctgcgaatcggctaaacaatccttcaaaaagttacccggaccaattggcggcagctgaaagacatcgccgacaaacaacatgtgtgcctttttgaaattcacgtgtttcaacacggtataggccaagggcgtggttaacatcgagctttcatcgacaatgatcaaccgcgcatcaccaaatgtctcccaatccgactccgcattgaaccgctcaagctcctcgcctggcagcaagtgcaagtacgcgtgaatcgtggcggcaggttcgtgcgtatacttcgccaacaccttcgcggcccgcccggttggtgccagcaacacacttttccccttcgcctgggcattgaaaaagtgaaccagcaaattggtcaaccaagtcttaccggtgcccgcactgccattcagcacacttagcccatgctgattcacattctgaaaagcagcgcgctgttggtcgttgatgacgagctgatggcgatccaaaaattgatccagtttgtcatccagttcttccggcttaatcagtggctctgcggttttctgtgccaccgtcattattttggccactgagccttccgtggcaaacatatcgcagctggtcaccaagtcatactgttcatttaacaaaaagccatacgccaacgcctgtttaggatcggcaaacatcgtcaggtcttcggcgcgcacccctaataacgtggctgcctgttgcttaaaccacgtgatcgtaatgtaggtcaacccttgcgtcaaaaccgccgtccggaaaatatactgcaatcccgcagcaaggcgatgcggatcattggccgcaaccccaagacttttagcaaacgcatccgccttcttgaaatcaaactgcgccacttgcatcagcaaatacggattggcatcaatatggtgcatggccaactcagcatctttatacgccagccagattttctcatacgtcatcgaactaagcgctttacgccagtgattggccagcaccgcgacctcaagtttaccgcgaatggccgtggcaattttttggatcgtcgccggcccgatccccggaatccgcgcatccttaatcgtggtctttgaaaaagtcgccaaaatcggctcgtcgtcggcaaacgcttcatgtaagcggcgtaaaaccgtgggctggtgcacgagcaaggtttcaagcaactgccactgacggcggggttctttcggtaagccaaaatgcagccgcgccactttataagacggtttccgatagcgcagtgaatcggcatcatcataaaccaaatcagcagtgataatggcgcgccgattgtaataacccatgtcgccggtcactgtggcttcttgtgtgagcgtcatcttgagcgccggattcgggttcaaaatccgcaccgcgtaaactttataatcgctgctatcactgttgaacaacaacttaataatctgtaggtcaacattttcataaacctgagtctgtggcaccgtgcaccaacctcctctctaatatatttcgcgttatcggtcacaattgcatccgtaatttagtcgtctcatgggtggcagcccgattaagcttggtggcaatacgaaaccgaaaatccgatggcaagctctggagttgctgctgcgcccattgttggataaacgttggctgatgccgcggctgataaaacgtcaagtcgcgacggtgcgtactgtacacaaccacatctccccgcttgtgacgtgcggtccattgcaaacccgccaccagcgcgatgaggcccgcagatggtacatagaatttttgcgccggtttgtaatcatcaggcgtgagttccgcgtttgccggggcatctgcatacgccagttccttgatcgcgtcatccaaaaactcggtctgccgcaacaacaactgatcgtttgcatccgtaatcttaaggccgaaccggttgccatttaaatcattcatccacgccaaatagaccttcgtttgcggctcaaaatcagcatggtcagcatcgtgctgtaagttagccatgccgcggtggagcaagacgcctttcgtggtagtgccatttggtaaacgaatctccggttggtgctcagcagcagccggctgtgaatttgtatgattggtttccattatatgcctcacttctaatcgtaagcttacccggtgcaggcagtgactgcaaaccgccctcaaaacggttgtgcctattgccaaaaaggttgcagctcacggtttgtgaaaaatttgtcacttttcaatttgaatcgctatctaaaaccaattaatcgcagtaaatctgctgtataccagttttcaagggcttgagacaacgcgtcaaaggtaagccgctcgtcttatcatcaggcagcctaaaaatttgagcatgtcaaccagaactgattagtattttcatataatcgcgtcattgcctagtctaacagtgaaagtctcaaaatttggcagtttttttcctaaaaatgagacaaaaagctctttttggaggagccggaaaattgctcgtaaagattaatttaccgaaaaggttcataaattaaccttttctgctcgtttgtgaattctccaaatcaattttctttgtttcccggaatatccggctacaattaaaagtgttccaaaattgtttcatacttggcataaagcgcttgccgacataaaggcttgtaactgcaagttttgccggctcacgctcaccataacgcgttcgccagcccagatacctgcgtgtaaggaccttggtcgcaatggccaaagcccggccatcacgcccaaggccacttacactccggcttctgatcgggctggctcacgctcactttaagtctggggggactttttatgtcaaagaaatactggatcggcagtgtggcttttgccggactgcttgttgggagtttttcagctggttcactggttttggcagctgatgcggatagtgggtcaaccaatacatctgtgaccgtcacgccgggttccattggactttcggcgccgaatagtttgacgtttccaagtctcagtgttgaatccattgtgaaaggcgatctgaacgaaaacgtcaatacttcggatagttccattttgaccgtcagcgattttcgtggtaccggcagcggttatagcgtcactgccaaggcttcaccgattgcgaccagtagtggtgcggagttgaagggtgcagtcatcaaactcgtccctgacgcaacaaccaccacgaatagcgtgtcaccggagtggacgaaaccagtcgcattgaccaccaccgaccaacaactctttgcaactacaaccactttggatggcgctggtattagcagctatgatctcaacaagaccacattagcggtaccgcaagataataccgttaaagccggaagttacagcggcgtcattaccttcacgctcacaccgggtcagccggctcaagctgcgaccgccaacccaaatccgtcttagcacgggaaataattaaccttagattgcgacaccacatcacccccgatgatcaaaccgggacagaaaggaggtgatcgccggcaatcgcagtgaacacaacaaactgtctcaagcgttggcggattctgatcacatccgaccagctgcttgcaagaccaaaaccagccgatctgatagtacaagtatcgggtaaatttccaccacgttcctagtcaaccatatcagctttggggagctgcatgttggctaagaataaagttaatgatgtagcttaaaggcgacctatcgccatcatccgtgacagccaagttgcgacatgtctgatcgtactgtcgtcaacagagcttggtttgcgcacgcctgagacgcacatagtcgattaacgatcaaatcggaaacgatcataggctagtcgcgtcaagtatcaaagaaaccgccgataacaagtcggcggtttttttctaacctttttgacgctcacgcaattaacgctgcaccatggccaaacgaccccggcagttgaacttgtgccgaggcaaatttggcggcgtggcttaacgactcggaaactttcgcgtctagcgttggcttttgcgacgaataaagtgtggcagcaaagcacgtgatatacgcatcccctgcgcccaaagcatccactgccttaacgcctagcgcctgctgccaagacatcatgtccgccaccaacgctgccgacccgcgaagcccgcgcgagcaaacgacccgctgacaaccagccgcggccaaacgccgacacaacgcctccacatcatcatccgacttggccttccccgacaaatacgccaaatcaatctgtggggcaatctttttgaaaatacgatcatcgtcaatcgttgaaaaatcgtaaatcgtcggtgccgtgattgcagataaaaaggcatccgcgccactttcattattaaggtaaacgagatcaaacgtattaatgtaagcaatatcgtcgcgactcagttgaagttcctgaaccggctcgccaacgatttgatgccgcttgcctgtggtgatcttcatcgtggtaaaagcgttgggaccgtcatactgtaacgaatggctaaggtcaacgccaagctcaatcaatgtccgccgcgcaaaatcaccgcgcgcgtcattgccaaacgtcccaagataagctgaatccaagcccatcatggtcgcaaaagccgcggtattcgcagcatggccgccaagaaacattttcttgtcagccggataaaggtcaacaacattgtctccgatcgcgatgattttcaagtgccgttccttctttccatcatgaagcttcgccaaggtgttagtggtaaccaaacagactacaatcaccaattcaagtttaccacaggtgtgcaagcgagaacctggtacgctgtccgtcccaagtctcgcccgcatcatgacagacttgtataaaaaaggaacgatatcccttcgtttgcttggaaataccgttcctttttaacttgcaacgatcacgatttgtctaggctttaactagcatcctttaccgtgtccgccggtaaccactcaaaagataggtggcggcgctggcgacaactaggagtagtcctaagatgccagttgcccagttattttcaccggttgcagggagttgttgcgccttcttcttactttcggatgccgaagtacgactgctggttgtggcatctgcagctgattgattattgctgtcaactgagacgctagagcttgaggcgactgaagattgacttggctcaataactttactggaaggctggctgctggcggtactgctgcttgaaatgtggctgctcgtgcttgtgctgctagtggtggcgtggctgctgctcgtggcactgcttgagctgccagcagatggttgactgccactttccgagccgcctgaagtggttttatgcttgtgcgcagtaaaagtagcttgatcaaccacactgccatccgggtgccgcactaacaaagacatcttatcgccggtcacatgcagtgtcaggtaaactttttcatccttgtctttttgaacgacttgccacacagcgggctgggttggttgaatctcataagtcttatcgccggtgtggccggtggcgatgtagaccgtgccgtttttggcttgcttgtgattaatcagcggataggtgcggccgtatgagtgatcgtggccgtttaagacgagatcaattccgagttcgtcacaaactggtgccagcatatcatggaacatcaatgattgagcatcggctgggttcttgttgtagaccggctgatgggtgagcacgattttccacgtcttctcggtcgcctgcatgtcttgtttcagccaggtcatttcggctttcattgtctgctcgttatctgtccagccaatcactgcgatatgcatattgccataatccaccgaatacgtccctaacttgttagcagccgggccattggtatttggcacgccaagcatctccgctgacttggaaccatcatcacccatgtactcgtggttaccaagcacatgaatcatgtccagcgaatcaaacgcgggatgctgattaaacatttccgcagtcttatcagcttcggaaaagacactctggtcatcgttaaaatcaccgacatgaatcgcaaagttgctggttggcttggccttttcaatactgctcaacaccgtactgaaatcgtctaagccagtatcatcggaaacttgagtatcgccgaaaacattgaatgtgtaatcactgccgccgtgaagtgtggtgaacgtgcgcggcgctgaccaattggtgccatctccgactcgataaacgtaagtcgtggccggctgaagccctgtcgcggtggccgtactgaggcggaccgcgctgctatcggcagaataagtggcaacattagcgcgccctgttgccattttaaacgctgcagctccttggtctttgtacgcggattgcgttgcgacttgcaacaatgccttgcccgttcctgccaccggactgctcatccaagtgatcgtcttggcatgttccggatcctgggtggcaccagctaaaagattcgtcggcacggcagttttctgggcagtgtaattctgcgtagcgactggaaagctgtaaccgtccttttccgcttgcaaggcaaacttgccaacctgttgcgtcagcgcttgggtcgtcagctgccccgcatgatcggtggtcccaagctcagttgttttgccatccgcgttcgtaaccgtaatcgtggctgaggaaatggctttatgctgagcatccgtaactttaagtgtggcgggttggccgataatcaaatttggtgccgtgagttgataggctgcggtaacgccaactttagcttgcggcgtactgaaggtaccagtgacgtcactggcagatcgagacgtcacttctccttgcgttagcgcataggtcaaggctttgtccgcggtagtactggctggaaccgtcaccgtaatccgcgctagatcgttttgctcgatgttggtcagtttcaacgtcaacatgccagtgtttgcgtcgtactggtagctccctgtgttctcaccaaaatcaactgtcttcacgggaaaaccggttggcagagcaatggggcttgtcaatgactgtgcctgcgttgacttatccgctttaaacaccaactgatacgtcccgcctaatttcgccgttttcgtcaaaccggtcaacgaaaagccattctgagtaccggttgctaccttgaagtccgtttcacgatcggtttcattcccgaacttgtcttgcacactgactttgacgtgatgcgtgccatcgcgccacttgtaaccagccagcgtgaacgttccgtctttgtcgatcgagtagtggccttcagcgttcgtgtactcggtgccatccacccaaatacgggctttggtccaatcaactccggtagcatgcggatcgctggtatcatcatgcaccgcggtggtaatgctgacttgcgcatttttataagtctggttggcaacgttgatgctgctgataatcggcgccttcaaatcgtctatattcgtgccatataccgcccggacattatcaatatataagctgcctttagtcatcggcccgccatctgtctgaccggacttcagcgacatcatccgaatcatttgttttggaaaagtcgtgaacggcccttgataaccggcaggaatcggcgcttcgacatacttccagccggtccaatcaatccccgtatcctgtggggttaaatcaatcggcttggccgtcccggtggcatccgtcacaaacatccgcaaccagtatccttttgcttccggtgtcgcataaatccacatcccaattcctgtgggcatccccggaatcggtttacttgtcgctgggccggcataaacgccaagggtcgcactcttggtcccatttgtgaaatcgtaatccagttttagcgcgtgctgcccaaagcgaacctcaccatccgtggctgaactcaagccaatgttggagacctcgccacgtccggcagttgatggcgcccagtcgcctaagccggattcgaaatcgtagagaactttcggcaattggccaacctgaactgtcatctgggcattgatattggtacctgttacagtggcttttacagttccgctggccatggttttgcttgtctgcaattgattatccgccgtcatagtgccgagttgactcggtactgaccattgaatatcaccggatttcaaattaacaggtcgtccctgataggtcgccgtcagtcctaagtcttgctttgcccctagtctgaggctcaactcattttgcgaaaaagccagtttatcaggttggaaaatggtaacggttgcagcacctaatactttgccatcgagagatagctgagcagtcacgtcacctaatttgccattcgactggaaaacaccagttgctgaatcaatagtgcccatacttggatccttaagctgccagattggtccgctacttggcagaggtgctgcattgccagatgcatcaacacctttagctgagaatttgacgctactctttggcgtatacacctgatcatccggtgccaccgttgcactagctaatttatgatcagcagttgccttagacacaatcaaccatgaattcgccactagacgttcattgccatctgaaggactattttgaaccgtcaagctcgtgtccccaggttgccgtgccacaaaagttgctgacccgccaccgtcaagaaaaagtgcgttaactgccccgcgttctatcatcaactttgcaaaatcaccgacagaaataccggttgaaagcggtgcctgtcttccatcaataacgacaaagaaaacggtaccgtccgctttaatacccaccgccgtgcatggctcattgccttcacttcctgccacttgggtcgcattaaccttaccatctttaacaaagatactcggcccaccaacggcctgctgcaaatctccttttctttgctgataagtggcagcagtgccaatcatgggtgtgccatcctttttaattccgaaaaaagcctcattcgtgtcaggtgccgagtaaatttcagtcccatttttcaccacattgcctaagggagcgcccgttgccatattgtaataatcggcattcaccgctgccacaacctgttgaccatggctaatagccgcatttgcttggttccgaaccgtctgcattcccggcttcgtgccatcgtttggcatccctgctagcaacgttgtattcggattcttgggatcaagcgcaaccgagtaatacttattctgcacgccattttgattcagatatgtaagcttttgttcggtaatcccaggcgctaaagttgcttgctgctgcccaataatcgacttgatcaccggatttgttgcagcagcctgtgtgttgttaatcgcggaagtcttcccgctggcagtagtggcgctactagccttctttgctgtgtcagcggcttcttgactagtgctggtttgcactttggcatcagttgaattcgccgcactcgatgccgccgatgcagtggtagaactcgatttttgggaggccgtcgcagcagcgctcgaaaccaccggcgtatccgtcgccgtcaccgcaaccaccggcgccgcaacctcgccacccatcaaagccgccatcaacagcaggctgccaaccaccgtccatcttttcctaaccatccgtcatcctcctacatgtaaaatatgattgttatcgttgtatatcagtttatttatacctaaaggatgtaaagaggttgtggtggttttgaaaaggttgggtattggttgtgtaaagtgctgcgactcatactatgccgacctgatatcagcgaaaaagcgacaaataattccagcaggctttgtcaaccgccgaaattttttgccgctttttgaactaacccaagtctgataacgattatagagtttgatgatggttctcgtctgatcgaaagattactcaatatatgacttccttgatctcaggttcttataactcaaactttgtaagaaacttttcagaatcaattttttcgaaatcttttttcctaagagcgattatcttgcttaacttgcctgtgggtgcgtcaataggcaaacacttcgcaacttcagagataatgacttttctatcatcaatatcaacgaacttcaccaaatacccagcatcagtcaacgataaaagtttgtaaatggcaccatcatagcggataaatgtaaagtatggattatatgccttaattgctctatatgcattaataactcccaaaattgccacaagaaaagttaccagagctccctcgtgcatttcttcacttgagtcgtttgaggtcacaatatttacaatagctatgatgaatgataaactcgcaaaaaaatgcaaacgtaatcattacaaaaacaatgattattgtacctgtgcttcctaactggtattttcctttatttaaaacggaaaaacgatcatctccgctaaaatgatttaaactaaacccaataagaagcgagacaattgaagttaatatattttcaaacattttttcacctttcaacatttagaaaagtcttgaaagtacaggacatatgccaacatacccgcctgattctcgaagaatttttactgatgctatctttatttagccaaattacccacaaccttgatcttcactcgattagcattctccggatgatatgccaacgggacctcatcaacttcgacaacttcaattgtattttcatcagcaccggattcaatcgccgcttcaatcgcttttttcttggcgtcagccattgcctgatcacgcggaatttggttgtaggggtagatgcggccatattcaccggaaacttgactaatggaggcaccgatcgcattggccacgccgccgaggggatcacgtactagtttgccaacgccttccaaatgatgtggggcaatgatcgcaccgccaccgactagtacaacggtcgctggctcagggctggttttcattttgtcaatggcaaccgtgatcatctggccaatggtggtcatcgcggcctgggcaaattttagcggaatttgcttgaccagttcgggattgccgacatcggacagaccgagccgcacagccacatctgtcgcggtcacgatattaccgccgaaagtcagcgctttttcggtaatctgatagccgactgaatccggaccgactgtgacactgccatcgcgctgctgccggacgatcgaaccgccgcctagcccaatcgacataatgtcaggcatccggaagttcgtcgccacaccacccacggtcacggcaatcgaagactcacgcggaaagcctgcttgcaacaccccgagatccgttgttgttccgccgatatctaccacgatcgcgtttttaagatgcgagagataggcagcaccgcgaatactgttggttggacccgagccaatggttagaattggaaaatgccgcgcatagcttgctgtcatcaaggtcccgtcattttgggttaagtacagtgatgcatgtttaatgccggattcagccagcgcccgctcgaagccatcaacggtattttcaatcacgcgaaacaagccggcatttaaaattgcggcattttcgcgttcgattaaaccgagggagccgacctcatgcgacatcgtaaccggaaaagtatcgccataagccgcatgcaccaaatccgccgcttgttgttcctggtcaacccgcaacgccgcaaagacaccgataattgcaatagcgtcaacctcaccgcgccattttgccaatacagcattgatttcatcagggtcaagtgcgtttaagacctgcccatcatattcatagccacctttgacaatggcatattttccggacaacttggcaaccaagtcttccggccatgcagtgtacggtggaatagcttccgttgcgggatacgccaaccgcaacactccaacgcgcgcaatgtgcttgcgttccacgatggcgttggtgatttgagtcgtccccaacatggctttattaatttgatccaagtctagctgctgatccgccaaaaccgcttggatcgcgttcgtaatgccggtttgaatatccctagttgtgtgccgtttaactgaattgatgacatgttgctgatcatccaaaatgatggcatcggtattggtgccgccaacgtcaattcctaatcgatacatggaaatccccctatttgtgagtgttcaagtcagtgcggaagaaggtacttatccgccgctcatcaaaacctcagtccgcctttgccaccaagtcttctactggctgatagtcataatcaaagccaaaataccgcggccctgctgtttgaataccggctttggtccgccaacgcgcatcggcaggggtagctaggactttgacccgcttgccatacttaatcacttcagtcgtcaccggcaaaagcgtatcggcatccacaatttcaatcagatccggtgtcatcacaatcggctgatcattacgcaacgccagcaggttttcattttgaattaaaacgctgagatgttgatcctgaaagtcattgaagccatcaatcttaatatcaccaacgttaaagccgcgctcagtccggcgaaccacatcaatgaccttaccttcaaaaatcaaatgaccactcgtcacttcaagaatttccgccaaggccttcgcaggattcaggtgggcatcgcgaattcgcaagcctacttgttcgcacaaggtgacaatgccgcgaataccattttgcttaatctgcttgccgttcgaaggatacaacgctactgttgcgctaccacccatttccacagtttgtacacgggccaatcgctcagcccacttggcactgatcgttttaatcacgccggcattacctttttcatccgtaatgaccatcggcgttgctgccacgccgcctaagtaaaacgtcaccatctgcaactccggaaacgcgcggcccatcccatcgcaatccactagtggaattcctagcgatgcggccagcgcaatcggcaccatcgaattcaccccgccggcctccatgggaaaagttcctacaaactcatgaccggtatactggcttaacattttaaaaacccgttcaaactcatcacccttaggaatcttctccatcatgaccgcgggcgcacccataatcgctgctgggcaaaaataatcatcatcgttaatttctgaaacatcaagcaacttcaccggtccgtgctttttaatcgcatcaagggccatcaatttacccaagaacggattaccgccaccgccagcaccgaaaaaagccgcgccggtcgctatattttcaatggattcctgatctaaaagtcgcatattgttctccttttaaacttatcttcagtccgctaagtcatacgagtcgcgcaccaacactgggctaaacaaccgaaagtggattcttttgggatcaccttggtcaatgtttgcctgctagttcaactctgatgctttgtcccattctggatgaatctttgcgcctgcataatacaggacaaacgcaagaataatcccgagcaccggaatgtttgggatcgccggccacagcacgggcagcacgccgatcaccgcacccagcgcccacgcggtcaagccaagccagttcactccggcgaccggctgccagctatgcatctcaccacgatgaatcacccaataagacgcagccatcgctccggcaaccggtggaatcatcgctgaaaagatcgtcatgaccggctcaaaataatttaaaatccccagaatcgacaaaatcgtgccgccgacgcccaccaagaacagcgtcaacttgcgatatttctccgggatgttgaaaatgtttgccactgcaatcccgccagaataggcattcacaacgttcactttccacgtgccgagaataagcgccagaccaccgataaccggcgaaccgattttcataaacaaactactaatatccgtcgacttaaacgcaatcgtcaaaatcgcgccaatcgcaatcatcaggacaccagcaggaataacgccaaaaatagcagctttaaccacatcatcgcgctttttggaaaactgcgcataatcaccgacaatgacgccggccatcgcaaacgacccgactgtagaagaaaagccattcacaaacgacaagctgccactgggatgataagccgcaatcgttgccgccgcgtcctgcttggcaaatgcgaaccacaaaccatataaaatgacaatcaccagatacggaacagcaacatacgccaatagccgaatcaacttcacgccatacatcgcagtcaccaccatcagcaaccccgtcagcaatgaagccaaccacgccggaatcggcaatcccacatacttcagcaaattcgccacggccaaaccgccaacgttcgcctgaatcccaaaccagcccaacgccgcaatcgcgatgataatcgaaatcaccttcgatgacccaaccttaccaaatacctgctgggcaaccaccaccgctggctttccttgatccacactctgcatcccttgagaaatcatcatcaagacaataaagccgtatcccgccaatcccgtcaaaattgcaactggaagcgacatcccggaaaccaaactcccgcctaaaatcaagctaggaatagacaccaaggcaccacataaaatcattgctaagccgaaccatgtttgatcgcgtttgttttcttccatactgggcacctcacatatttttttaataattgcagtcattttggccgaattcgatggttaaggatctaactcgaccggaatgtaatggtttgattataaaattatgagattgaaagtcaacagtttcatttaatttttatgaaattccagtttgggaatattcgcgcatcatttatgacaagtagttaactggcaacgctactattaagtctcgtgttttcggcttatgctcgccaaatcgctattaactcgtcccaaaaagtttcagattttatatggctccatcaaaaaagaaccatccactcggcacacttgcaccagcagacagttctaccccaactacaacaattattcgctaatttcaaaactttgaacggtccagtctctgaacccagacaactaaactattttacccatgcaaatgactgcacacatctgaggtctcaccccactatttgccgaatcgccaaaagcaccaaccccgccgccgtgacggtcatgacaacattaagcaccttagacgttatacgccgctcgcgctcatccatatcctcaatcatgctcaaactatagtcattgtaaggcccggcatcccaataacccacataataactcaacagccgcttctcacgattagtcagcggctcaccatcatcacgaagcaacaactgatcgtcaaacaacgcgtacatgtcatcgctcaacatcgccgccttccgatcccgccgcgcctgctccttgacccacgcgtacaaccgtcgaaaccgcgccaattcccgctcatcctcatcattcaccggcacccacgccaccagtttccggcgaaaaatcgccatcacatcgtcaaaatgcttacgctgataccgattgccaaggcttaaataacgattctgttcgttcagatattttgtctgccacgtctggtaaatgaaaaaggcaaacaaccacagcgtcatcaacgcattaataaaattgccaagattccaagccgtcaacaacttctcaaaactgccaatcacccaaaaagtaagaatcatcaagctgacaaacaatgataacaactgtttctgccgcagttggggattccgctgcatttcggcataaattgtctgccgatgcttcagatacatgacaaaatagtccagaaagtctaatgaacggacttggcgatagactttgacaatgtagataagcaggatgacaagcgaaaccatgttgatcacgcgattgatggtgtcgattgcggacattgaaagctcctttcaggttattggcgtagcgttgcattttaaggtgcttcaattttacctgaaattgggttaggcaaacatctttattttagtcatgattaacagttctaattttcacattaacatcagataaatcgtaatgattgcctaccaaaatccgtttaatgtgctgaacccgactccaggcactatccccgcctgcataaacggccacatcagcgtctcccaactgccgatacttctggtcagcctccacttcattcatatgcttaactaagctatcatcactattcgccaagacaaaaaagttcgatgggtccgcgtcccacaagagatcaattaattgattgtaaagatccgtccaacttttgactgccacaacttgataatcaccaaagctaaaggcgaccggctttgttccggtgggattggctgcaaagatcgcatccaacgaatcccacgtactcggatcatcgctcgtcacttccacatcaacttccggccgcggccaaaccttaagcgcccgcgccagcaagtccgcctggcgcttttgtaacgttgcttcatcccaatgatcaaactgtgcgacccactgattaagcttaatcccagacttgcggtagccgtcagccatatcgcgtttatcgataaatgtcctgttgctcatttgcccattgaatcccgtcagcgtaagatttgccaaccgatttagccagatattgtgcgtcagtcgccaatccggtcccaaagcattatgccaactggtattcagcacctgtggcatgatgtgctcgatcgaatattggccatctgccgcagcctcaaacagatgctgcttttcaccgtcagcattgttcaattcgtccaaaatgaaccaaagtgacgccgaactcatgtggtaataatccttttccgccaatgcttctctcaatgcctgatcagttgggaaacgcttattatctttaaccccttgtgtcagcatcaccttcaatgcatcgacatagcctatttgtgatttggccatcatatgttcaacctgccgatttaaagctgcaaaaagttgattcaaccccgttgtcgggatcccgatgaaaagccgccgcgccaaataagccaacaacacctttaacaccgcaactaaatcatctgtagacaattccccatcgcgcgctttagcaaaaacttgcaacaaatacggcgccaaaatgtcattattcaaatgtcccaaacgaatcagaaaccctcttacccgagcatcagctatctccgctgtttctggcgatgtaatctcggcaaagagtcgagcagcagcacgctcctgtttcaactgcgcaatccgatcaaagccctgcgtcaaaccaacataacggcggtagtcactatagatttcgtcttctttaaccggtttggaactacgcgctaaagaagttaaatagtgccggtaaaatttagacagcccatcactacctaccaaatgttcattttgttgccaaatctgaaaggccgcagcttgctgatcaccttttaaccccatcaataaaaaatttcggattttatcggattccgtcaaattcatacccgtagaatttaggctttcaaatatcagctgagcatcatcatcctgatcgacaacaatgtccatcacttgaagtcgccgctcaagcaaatcaagccattcatgtgcgcttaaatcagcttgctgcaaaacattccaaaagtaggcataggtcgttttaaaaatcgtgtcggcagcattcattccgttctgcaaaacgtcaacatattgctcctcgtctcctggcaccggatgaagccgatttttggcaactgaatcatagtcatacttgttaatcagaaattcttcgttaattcgttcatagttaggatcgtcattacccagaaaatctcgcacagcaattaaaaacaaagaaatcgtcgtcagtcgctgttgtccgtcaatgaccgccacggtgctaatgccactcgttgcatctaatatcaagctacccagaaaatatctttgttgcccatttgaataagcggttttcaagtcactaataagccgctcaagctgttcccgccgccaactgtagcgccgttggtaaaccggtatgttaatggttttgttgtttgcgattgtttcgctgacgattagatctgcattacccttcatgaattgtcaccccaaagtgtttgattgcgccaactagagacattgacaacccttccggaatagttgacggttaatctcggcttaattcatcctcaataaataaagtcaaaccattctctgtatcaaagctgttcattaaaagaccatctgccccaaataaatttcactagattcagccaacccccagagctttaaacgctgcatccttcacagaattgtaaaagattaaattaaacgaactcatgagatcagtcggcacactgctgatgtcactagctgcagcagctggcaacaaaactcgcttagcaccactatctaaagctacttgcagggtgtctgccaagtcatcgattcgcgaaattgttccaccgatcgtgaaatcccctagaatgacaagcctatcaagtgttggttttcctaaagcgatggaaacaagtgcaatcagtgttgctagtgaaatgtgactagaaggtgctgaattgtttagattcgtcgcactgacgaagaaatcccgtgcatcggcattaattctttggtcaattgatttgtaattggcttcaagataattaaaggcggtattcatagcttcttttgcttttgtactagagccaacacctgagcgatttagccttccaagtcccggtactgtctgcgtttctaatttaattaagcttaatcgcttgctatcatcgtaggccactgtataaacatgccccggattctcttgcccttccggaataagtgaacttgagcctgactcaggaacggaaacatacttctcctcaaacgatactttatcaatatatgaaaagttaacatcgtagaattccatgccgccaactcgtttcagctgctctttaacgcgtcttcgcatctccatcgcaaattcaagaattttggcgacatcatcttttgtaaagacgccatcaggaaataaaagcttcactagtcccgaaaccgtcgttctaacagcgataacatcacgctggttcaactgttttccaaatgaaaagtattcatcaatggcgtcagcatatgaaatcttccgtaactcacgcataacctctgcaaagtaatcggtgatgaaaccaaagccctttgtaaagaactccggacgatactttggaatctcccagccgggtaggtaattatgaattcgatcaagaaaggcagtatcgttacccatcatctctggaaatggttcaaacagatttgatgtccgcaacaaaacatcgacactttgattgatatttcccacaaagaccatacctgccgaagcttgaatttcgtttcttcctctggcaaatgatccagaagccatatagtccttcatgatctggacaccatctttatctttgaagtgaattcccgccacttcatcgaatgcaacaacatcccacatgccgaccaaaccaacctctcgccgcgacatattgtaaaacagatttgcaactgtcgtttgtccgcctgatacaagaatggaatccggagagagttctttgtaaacgtgtgacttaccagttccacgaggtcccagttcaacaaagttataattattttccacaaacgggattaagcgtgacaataacagccatttctcgcgttccgtgaactgagtcggctccataccagttgtccgcagcaaaacgtccaaccattcatcagtggtaaatgccttccgtcccgcataaacttccttcatgtccacgaagggtacttgaattggattcaatttctgaatggaaaaatgatcgagactttcatgatcatagctaacgcgcacaattgaccatataccgccgattaacagacgttcataatcttgtacatagcgttcatcaacaggcacaccggttaatcccagattactaaaactagcctcgtaacgatcttcaccttcattcaaatgaacagtgagtttatcaatgaccgtataggcgccatcttcgcgaatctttgacttaaccttttcggcttcatcagggcggacataattatgcgctaaggtcttcttaacattttcaacgccgcgctcgatcgtctcctcatctgaactattagcgaattgaccaagcaaaaactcgagaacgtaggttggcacattagccccttccttaattctctgagtcaagtcctttcgtacgaatcgtccgggaaagttttgttccaacttgaccaacacttcatcattttttacggaatcagcttgcgtgtcatcagatgtcaaagtcaaaccctccccctacagtgagatccatttgatagtcgattgaagttgttgtattcgcctcaacgttttgaatgattagctgatagtgaccagcgcgatcaaagtcttgatcaatgagcgggatatgtttacgaatcagccgatcattaacattgacggacgtactatctgcttggacaacttgttcaccggaaatgtgccgcccactcccatctacaaagtacagagcataagtagctggtcgatgtgtctcatcaacagggtcattttgcagcatgttaacgatcacctcatgactcgtgatacggcgggtggaatctgtaaccgataacgtaacataggttgcctgcgactttctgctttccgtcaaaacatgtagcactggaacgatcatttcttgcggagaacagccaccgtggacataattttgaccggctccagggaccgaaaagacattcgcgttgcttggatagaaaaccattcgctcatcgtcattgttcaagatgtcccctaacttgacacgaccaacaccgatttcgtcaaaatcctgtgaaccaatagcataacgcaggttcttctgctcgaaatccacctcagccggcaaactgatcttatccgttgaatcaagcaaatgccgccgataaataaacccgtgatcagccgttacataaatatttcgaatggaaatattacgtaaccggtcaattgcgcgcgtaagttcttcaatcgcatcatcaactgcacgaaaaacgttcgtttcagatgcgggcttatcaccagttgcatcaacagtatcgtgataaaaataaatcactttttggttaacaatatattttttctgatctgccaagctcattgagataaaatccttcaaatgcatggcccgactttgaggctctaaagattggagaatctctaagcgttgttctaggttgacagctttcttaccgtccaccaataattccttgtcgccttgatatgtcagtttctggttaggcaacagtgatggcatgccaaagtaagtgacagaaggcacccccgtgatcgcataatgcatgtcggttccgaaaacatcgcgcgaatcaaggcgttcttgaagttctttagccgcctcaaatcgaaaagcgtctgagatgattactacaacccgatctttattaggtgctacgacagaagaatagaagttccgctcaagggttcttggctcaactacatttggcacatactcttggcaccaatcatgaatcgttggagcaagatggtcattgttatacgcagcttcgaccttctgtgacaatttctcaaacacttcaacttgcgacgtaggcaattggtccgaagcattcgtatatttgcgatacgcggtgtcaatcaaataaccgtcagtgatataagcatgaataagatcatctaacttgccagtatcgtgaatttcgcgtttcgtcaaaatgctgtgggcctgaacgaccatactataagcaagttgattctcttcggcaaaatacatcctgcaccgttttccagcaatctcaggcaagctcatttggtcaatcacttcaccaagatggccttgcagaagctgttcaaccagccactgtacaacttgctgatcaaactgaataaaagtatccgtctttaagcgttcagagatcttcaagttcttgaacaattgatagccatcaagttgctgccaaacgtctgtggctatttttttgtaaaccgctcgagtatcccttcgattacgccaattaagcataaaggatacgacattattgatataactgacctcatagctttgaagacttgttggcaagtcgagctccatctgataataggcaaagttaatcatcattgtcgccaatagatcttgtaattcatgtttgccgtggtaaccatacgcccgatcgacaaaactccagaaagttggcaacaattgatatttgtcgaatccgtccaacaatgccggattcttgataacttcaatcaaaatgtttgaaagctgcagatcagacgtcttagcaattgcggctaattccacttgctcgggatttttgccatgctggtaacgttgcttaaatcgcgcaatccggggctttgcgccaaaaaacttacgctgatcttcaacaaaactaagctcagtctccggcaagccaagctcatgcagcaacataacattcatgtctgctgtaaacttcttcgaatataaaatcatatcagtcaagagattttggtgaatatcgggttcggcaaaattggcataaacaagcgccttttcaccagcttcttcaatctttataagtttgagtttcgtctttaattgcgtacgcaccgccatcactacgattggctcattcagttcttgagccaaatcatcaatgttttcagcaaactcaccatttttgtcataccaaaagacaaaatgtgtcccgcttttaaacaatttctcgatgccagtgacgacatccttcatctctacctctgccatactttatctactcctaattaacgcaccggctagtattctagcctctagtataactaacagttaaagccgtggctataatcctactttctttttgttcactccaagctattcggttggggtcattcgtgatcttgtggatgatattcgtgaagatgattttgacgtggacaagggcggtcaggttgagattattgggtggctgtatcagtattacaataccgagcccaaagacagtgcctttaagaaaaagaagtatttgacttctgatattcccccagtgacgcaactttttacgccagactggatcgtcaagtaccttgttgagaactcccttgggcgatactggatacgcgttcttcttgaacgaggagataagcgtacttctgctgagattgctgaatcatttggatggcactattttatgccagatgttaagcagaatgattcaacgccttatcccaacatggccaaaaaacgaattgaagacattacttttgttgacccagcaatgggatcaggacatattctgatctatgcatttgatgtcttcttgcaaatttatcaagcagaaggctattcgcgtcgtgaggcagctcaaaagattgttaaagacaatctttttgggtttgatattgaccgacgtgcatttcaactagcctattttgccatgataatgaaattgcgtcgtgaaaatagacggacttttgatcttcatttaaaacccaatatttttgaggtcccaactacggccttaactccagatgatttttctgagactataaatgcaagtaaaacggacaacgaacagttgaaagagtttttaacaaagttcaacaaaggtaaagaactcgggtcgctgatagatttcaacgccgatatctttaaaaatgccctgattaatgagatcattcataaccagtttactggacagctcacgttcgatacgtcaaaccaactagcacatcgacatgagttaaagagcctggttcgggtggggatgggtttaagcagtaaatatacaatcagtgtgactaatcctccctacatgggttctggcaagatgccaaaacctctttcagattttgtcggaaaaaaatatccggcaagtaagtctgatttatttgcagtcttcatagagcggctccagcatatgacaaagcaagatggcttttttgccatgattacccagcaccaatggatgtttctttcaagctttaaatccttacgtgaacggatgattaactggccgattataaatatggcacacttagggacacgtgcatttgaagaaattggtggagaggttgttcaaacaacggcctttattattcaaaagcaagcgagttcaaactttagcggcacttatgagcggctggtcgattttgattcacaggcacataaggaaaaagcttatcttgctgccgttaaagatccaaatcttaagtatgtttatcgtactaaacaagcgaactttgagaagatacctggaagtccgatagcttattgggcgagtaaaccccttatttccgattttgaaattggcataccactcaaagacttagttgatcctaaagtgggtctgcaaactggtgataacagtcgctttctacgtcaatggtttgaagtaaatgtgcataatattagttttaacacaaagagcaccgcagaatcgcttaggtcgatcaagaaatggtttccttacaacaagggtggatcatatcgcaaatggtatggcaattttgactacattgtaaattggcaacatgatggcttcgaaatacggaacttaaaagatgcaaaaggtaaactgcgatctcggccacaaaacacaaattattacttccgtgaagcgattacgtggtctgatgtaactagtggacacttcagcatgaggtatagagagtccggctcgatcttcgatgtggtaggaatgtcactcttctcattaaaaagagacattttagaaaaaatacttgcgttttccaatactaaagtgatgaactttattatgtctttgctaaatccgacgatacatgcgagcattggttatgtcagcttaatgccgataatctcttcccaagatcctagagtgaacagtctgtcaaaagaaagcgttgacgttacgagaaatgattgggatacattcgagaactcgtggaacttttcaaagtctccattggtcgaatatatcgctgagcatcagaaatcacctccagcaaaattcttgaccttatttgagttttgtggcaaatatgtgccaattcagtttaggaggttgatttttcatggtaagttatcaaaaacgaggtaaggtatggcaatatgaaatttcctacaaagatttagacggaaagttcaaaaaacttcgcaagtcagggttcccgcgtaagtcagacgctgagcttgcagccagtcaggtcaaatcgttttatcttgatataaagcaatatcaggccggagccattacactatctgaatactttgaccgctggattcatctctacaaaaagaattccgtcacggcagttacctttatcaaatatgaaaataccctgagccatattaagcagctgttcggaggcattctcctacgtgacctcacacgtaccctgtatcaggaacgactaaatatcttcgcacagaatcatgctcctaggacagtagcagctttccataaacaaatccgtgccgcgttgttagatgcagtggacgaacgaattattcatttagatccaacacgcaaggcaattatctcaggccgtccaatttcggcaacaaagcgtgcactagattatcaagaatggcgacagctcattcaaggactggacacttcaaacacagaacaaatgatcatctatatagcagcagtgaccggcatgaggtatgccgaggtcttgggattaaccaagtcagatattgatcttactagtggcgaaatttcgatcaataaaacttgggactacaagtatcatacggggtttaaaaaaacaaaaaatacatcgtcagttagatcagttgtactaaaccccgcgtcaattatgaaactggcacatttcttggagctacataatccagaatcgtcccaaaccccgatctttgcttccaacggtcattctctagtcagcgcagagataaacaaagtactgactcagaagttaaaatcactcggactaccgcggattactttccacggactgcggcacacacacgcatcaatccttctttaccaaggtgttagtgtcctatcggtatcgaaacgcttgggccatagtaacattacaacgacacaagcaacttatttgcatgtcatcaaggaattggaaacacaagataacgagaaaatcctatccattttgcaagcaatttaattggcacatttcttggcacacaaatgggcgatcaacacagatcgcccatttgtgtgctcatttaagtggcgtaaagatctttgtgtccgcctgtgcctttgcgtgatttaccaagaccccatcatctaagtcaagatctatatgcaaattcgcaacatgttgcaacttttcatcatacttaactagctcgtcaagttgcttggtgatcgttgtaatctgctttttgatagcattcttttgccgagtttgctgttcattcgcttcgaagctcttcaattgatcaagtcgacgctcgtaagcttcttgcaacgggtgaagatactttgttcgaatcatcgccatggtattcttgtcatatcgatgaaggtacattaaggctttaaaaccgccgttccggccagaattaagttcccaatagatcggccgcttctgatacgtcgacaaatgatctttcttaaagaaatcgtctcgaagataggcgcgtattatctcttcggaactgctccctcgcttgcctaatgcgtctgcaatgaactgcacgttttcatcgagatgttcggttccaaacgtggcagacaagaattctttgaaacgatttacaacgtctcgattatctccaaaataatcgtcatcagttaagacaattacgtcatcttcattcggaagaaaggtcttgtagttgctatcatcccagtcaccacctgcataggccagtccaggtgtatcaatcgagtatctaccaaaaacgcaaccaacaaagtacgacataaacgcttttatatcacgcgacagatcggcacgcctgacagacacatctttatcttcttcttcaggactaagttcatcctgtaacccgtaaagatcaatgaagattcggtttaattcttcttcatttgccttcagttggttaaaacgtttatcagcttcttccttccactgattaaacgcagcttcaattgtccaatttcgatgatgctcagcgatgtattcaacaaatgggaaataccaaaaatcccaagaaacttctgaaacattccagtcactcttagagatttgttcattatccctcgtcaaattacgaactagaaattctcttttgttgggaagcactggtaacgcggcaatttgtccaatctcatagttcagtgttggggatagaaaggccaatatatccattgcagtatttgagtttaagaaccctaacaatatctctaatttataaggttcattcgaaaataagcttgtccccgcaacatcaaacaatgagccgacaggaacatgtcgaaaggatatctttccgctagatatttttgaccacgtaatcgcttcacggaagtaataattagagttccgaataactgaacgttgcttgccatttgcaaaggtaaaatgctttatttcaaaaccatcatgttgccaatttacaatgtagtcaaaattgccataccatttgcgatatgatccacccttgttgtaaggaaaccatttcttgatcgacctaagcgattctgcggtgctctttgtgttaaaactaatattatgcacatttacttcaaaccattgacgtagaaagcgactgttatcaccagtttgcagacccactttaggatcaactaagtctttgagtggtatgccaatttcaaaatcggaaataaggggtttactcgcccaataagctatcggacttccaggtatcttctcaaagttcgtttgtttagtacgatatagatatccaaccgatggatcagaaacagcctttaaaacgtactttttctgcacatccataccgcctttgaagtctgaaagcttcaggtatgtgccttctgcctcactatctgatttattcttcaaaacaaaggtgttaataggaactgttgcttcttcaaaggctgaatattccatttgaatcaaagtggaaatctgcttcgtgttcaagatggcttttctaagtccttcataggttttaatgaacatccaaacaaacggcgtcatataagctgcatatccgtttgttgcggtcatctcaatattcttccaaatgaaaactgagaaaagatcccctgaataaggtttgtagaatttcttcacatacttcttgagatcgccattcatgcgatttaggtatggtggattagttgccaccacatcaaatttagtctgcaggatttgagcgatctttaggatattgtgaagactatctttagctgattgaagcccaaataaatccagttgtgtggactctggcaaggaatttactgcactaacaagcttatcaaaatcaaattgtttgtcgaagtgcataattgaaccgagtagtttggcttgtttaaaagtcgcggcaagcagttttaaatcgtcaatgacctctttaggagctttcatcttttcgaaagcctcgtttggcacatcatcgactgtttcgaacacatgcagattatggtggactgactcgtttaagatgcgccgactatactgccgagctttcatcattaaagcaaagtaagccaattgataagcgcgcttgtcgatctctagaccatacaaattatgtgccaaaatcgcacttgcggcctcacgttgaccatagccttgttcgatgtacatcttgattagcaaatcaaaagcatagaccaagatatgaccagatcccattgcgtcatctaaaatttttaacttggtgatgtcaaattcatcagttcgtttttcgataggccctggcagtaaataggttaaagcttccttaatgggcgagtcaggaaaatattcaaggtataagcggcctagtgaattgtcaaccatgtaccggacaacccagtccgtcgtaaacagttgggtggcggcagggatgtcgtttgtcttgatgggaccaccattgatgttgactactttatcgtgcggttcaatgttgtaatactgatacagccacccaataatctcaacctgaccacccttgtctacatcaaaatcatcttcacgaatatcatccacaagatcacgaatgaccccaaccgaatagcttggagtgaacaataattgcatgaaatcgtctgttttttcgaaaagttcagggagatattgatttagcgcgttcgcttgcttggtaaacagaatgacgtacgcagcatccatgtcggacggctcttcggtatcaagggctttctggatgattgcacgctcatccgagctataaccacctaactcatcttcaatattaaaagcttcgcgcaggatatcaggtactttaagttttgttcccgatgacagcactcgaacgccactcgggaggtaatcatttacttccataaatcgaatggcaataattcgattaaaccatgtatacgcaacttcttcgatgaggtctgaaaatgcgtcccgccattcttcctgcttggccattgttttaagccgagaaaccaaatcacggcgacgcttaatatcttggccactgataaatagccccttatcaccataatattcaatctcactggttgatgccgctgatttctcctcaacaccattttcattaataccaagattctccatctttaacctgatacttttaatcagatcacgtctagcttgaatcgcaaatgtcttgattgcctttttatccataccggttcctttccatgactgccaaactttatactagtcaatttgcaaggtcacaaccgtgttatctgacaattgtgcctcaagtgagcgcttaaactgagcagtcagcttatcaatatcagccgaggctgtgattttgtagtcacccttgtgaagaacctcttccagtttgacaatcttctcctgtggtgaaacgaccgtgggacccacaggcttatctggatccttatgcttatcgtcagttttgctttcacctgagtggtcacccgctggtattaattgcgcctttgcatggttaattcggtccgtcagttgatctaattgcgcactagcttgagctggttttgctacaacctcatttaaggttgtggcatccgtggctgcctcagaaatagctttaattctattttcaaaatcatgagctagtttatctttcacgttctgatcaggtatcgctgattcttcaatacgtgtcaagccacgttcacgaaaatcatcaatgtccgctaaataaccagctgccgtcttatcaaaagccgcactaaataattcatcaaactgcttatttaattcgctgattttaacggctgtatcgccctgaagtttttgcaagtgaagcaactttgccatcttgtcaactgtatcctgtagctgattgtcacttaagaaatcacttgactccccgtaaacgcgcaacgcatttaaacccttgtcccagatatcttgcattgactgcgagtaataaaagtcacgaatgccatcatcaagaaaatcatcgttccagtccagtaagtcgtctttgtgtttactgatataatcataaaacgcaccagaatcagacatttcagtcaatggacgtagtaactgaagtcctttttgtaacaacacgtgtcctgggtagtcttgagttttatcttcaaagcctttcagagtttgatacttagtcacgattagttttcttagttctgcggccctctgttcatcgttatcagcctcaaatgatttctttccaaacacttcagaagcaactgtctgcatcgctttgatctttgaaggcgcaacttcttctttaatctgaaaggccaaattacgaattgcttgcttcttagtaaagaaacctgcaatttcacgcggtgtccgttcaccacttagcggatctattactgtaccattgtaaaacatcttaagtttgccaatagcgaccaattttgcgacgagccattgaatatcttcatccgtgtagccatatggaatatcattaaacttcgacaagatgctttccatggtgatatgcgtattattctgtgactcgcgccgcatataatccagaacagcatcaaccgcagcttgattgtcttgctcgtcaagcgccaggctggagatactttcgaaaagttcgcgaatatccttctcagatttggcaacagtgatgtactgcaaactgcgatacgtattgtcaactaagagcttcattgcctgttctaatcgactatcgaaccctgcttcgccattaatcaattggccgttttcataaatagctgcattatcaagcgatgcgatcaactgttcatgagcgtgctggaactcttcattttgctgagattggcgagccaacaccattccctggtaacgtgaatcgcttgatgcactgctattaacaacaaacttctgaattcgtaatgcatttcgaatttcatcgacaaagtttgacgaacgtggtaaagcaatcaagacatcatgattccacgcaccagtcgaaacttgtaaataatcgttgtcactctgaaattcatcattcactggcgtaatgatgtgcactgaaagcttgtttcgctgtgcgccaaaaatattgtccgttttccgattaaaagcaaagacatagcgaccattcagtttgggataagttaaactcgttgcaatacctggcttggcattgaacaagtaatccccaatttccttggcaacctcattgtcaatcacttcttgtttcgaaatttcgcgtgtaatatcttgttcagcatcagtcaaaaagtcataacccttgactgttttttcaacgtaaccttgtccgactagaacctcaagtgcatcgctaacttttttcttaagtgcaattcgatctgcatcgaccgaactaatcatcagggtgatcaaattgttcaatgatgcgttaaagtcagtaacatacttgaccatgaacaatactttaagcagctgcagtgcaaacggattcttctcgtcgttcggattaacagcaggattgtcgtgggcacgcactagtacgatgtgatgggtatgatccaagaattgttccaaaccatcgaaaaagcgactaaatggtgcaagcgtctctgtgtccgcatccatcatagcttcagctgactcttggaagagggaaagcattgatcgctcgccttcagacaaatgtttaccatccgaaccgttttcacgaatcgcagtcagcacctgttgtaagagattaaactgatatggaataaacggatagttttgtgcaaaatcttttggcgacttatattttggccgctctacaccatcatcgaaatcaattgaattattaatagctgcagcgtttgcagaatactgatcttcaagcatctgctcggcaacatcagtcttttccaataaccgcttacgaataacttcatcaacattagccgagctcatcgacaaacgtgttttgaagcgaccttgaattttcgaaaagtcttgtccagatgcaatatccgtcactttgtcaattgcctgctgagaagtcacgactacccatgacttgccgcgtgtcatcgttcccagttgttcgacaatcgtctgcaaattaagcatccgctgtacactgtcacctatgaactggccaacctcatcggccaagaaaatgacccggcgtccagttttgtcgatataccgtttcaccaaagcagcaaaatcatcaatactgatctgatattcggtgctcagcgtttcaatgaaaccctgagcatttgcctcgtcagagaatccggatttcaccattgcttccttgatcgtacctttattcaggtaataggcgtcacgcaactctatccaagactgatgattggcattgatcgctttaatttgctccttaaaagcatccatctttccagcttcagtcaaacgccgctcaaggtcagcaatccaaaaatcggcgtcagtaaatccttgcatttcgttgaagacccgcatgaagactttcaaaatgctttgtttatctgacccaactgtgtctttcgccttagcatcgatattgaacagaatgacatcattgtttgccgccgcagcagcatgcatctcattaagaatcatctggtcgtctattttgtcgtcaaaataatcaacggctggttttccatcaacaattttgtttgccaaaatatatgacacgatttttaaaaaatgcgatttcccggatccaaagaagcctgaaatccagacacccatatcgtcagtcggagtctgtaaactattatcaaaagcactaaagaacgctgcaaaatggtcacgcaactcacgcgtaacaacatactcgtctaattcctgtttaacgtttgcttcgtcatcttgatcaactttaataaccccttgaatgttgcggtcaattgatcgtttaaaaagatccttaattttcattccccatgtcctcctattcgatccgaaatgcacggtagtagtttttgtcatcaagcttgccaaaagcacgtaagctcaaactgttgtagctccctgggtaaaacatgacaacaggcgttttatcaataacctgattcatggtgttcaagactcgatgagcacgaatcaatggaaacacctgcccgatcccggtaatgaagatgatgtttcgctcctcagggtgttcgagatgatccaagatatagcttacgatcagattacgctcgtctcccatttttagcacgttattgatctgacgaatgaccatatcgataccatcgtctttttcaatctcaataaattgctgcaagtatcccatctggtcaattaaatcaataacaacgtcaaaaaggttgaacatttggacatttgcgccaattgaagcagttgtcgaatcatgagcaatatcttctacctcatttcgaacatacagctcatcttcggggtcgtagtcaaagatataaaaaccaacctcatttgataacccgcgattctcttgaaatgcaggatcgcgaatttttttgcgaaaccggtcaaatcggtcacttaattgcgtcataactttctccctgtcagtgcctgaatgtaattagccttgccactttgtttcaacaatgctattagggaaggatccaataatgcacgtttcagagccatccctcccttaacatcctctgctaagccactgtacgttaagatctcgtgaaatttcgtttgaattttcttcaacgtttcatccgtccacttggctgtttctggatgctgtagtggtaagtcttgcaaataagcgctaatttcatatggctccagcctcatatcaccttttaaaaactctttttgaacgaccgttagaacaaaatcttctaccaatggcctttcaagcatgagtgcaataagattcaccgacttttggttactgagagataactgatcaaagatgtcaacgaatccgactggcaacgtactgattcgtaatttcatctcccgcgccagatcttgtgcacggttgcgtgacgacatttgaaaactgttctcctcaacaatagctttcgtgatatcgtcccaatccttaccctcatttagcagtgagatcaccgcagaaaattcagtaaaccagacgcttctggaaataaatcctgctgaaagtttcttcaagttgatctcctttctagaccatttttaagtcacactagactaactacatcatattgtatcaggatagtgccacaagcggcacacctttgctgcagaaataatgcacatgcttgcaatataaaaaggcgagcttgatatgcacggctttctaaagatcacatggtgctaagcattatcaaaagcctcagaaacagcaataataaaacttatccgatggctggcaggaacctaagtatcacctcaactctcaaatgtgctacagtaagtttctgaacaaaacatatcaaacaagttggagcgtgtagaagaaattgactaaagaagcacatcaagtcgtcattccggatgccattatggaggatcttgatattaaagatggcgagcaggttgaggtgacgttgaaggataaagaagcagtgattcggccgaaacggacggatacggggacgcagacgatttcgttgcggtttttcctgattccaacggttttggcggggctgttttttctggcttactttatttattttcagattttgcaggtgccgatgacggggaagaactcgattgcgcagatggtgattgtgctgggtgagttgagtggcatggggacgtttgcggtgacgtatgttcagaatcatcggcggattcatgggcgtgatcatcggcgccggtattggcggatttttccgacgttgttgctggcgtttgcgattattctagcgtttgtggcgtcggtgttcttttgggcgattggctacatgtttgaaggtgtcagttttgatatttacacggcgacagggttgtttttgctgtttatcagtattgtgaactacctgatgatttattcggcgctgtcgatttcaacgtctttcattacgactttgtttttgtcgacattcgttggtggcgttgtcggagcgattgtgacgaacagttcgcggcagtggtggcagcataatgtcagttttttgggaacgagcaaggcgttgaatgcgtggcagtttaacttaacgattgcggtgtcggcattgctgtggattgcgctggtggactatttgttcgtgccgttgatggcgcatcggaaaacggattggcggctgattacgatgcggattatgttaaccgtggcggccgtagcgttactgggcgttgggctgtttccgaataaccgcggcatctggcatgtccttcacactcaaagcgcgtggtttctgaattatttcctcattggaatgatcatcgccgtgcgctggctgctgccgggggtctcacgcgaatttctcagcaccagttacatcatcggcggcatcattatttttgccgcgattctgttccaatttgtccactacctttcgctgacggcatttgagatgatcgcctttgccctcgccatgtcgtggatcatgttgctgctgcagaacattcatcgcttgtatcaaaaagacgaatccaccttcgttgtgacggtgaccgcgaagaaggaaaaggcagaataatcagcgactgaatcgaaaagtggcgtactcacaacgaggcgtcacttttcttttgcctaaaaacttgtccgtggcgtgttgcatggttcctacactgtggctgcaacacgcacagtttcgaaccttaagccttcgatcgccagccctttcactagcctgactccacggcaatcaataccaaaggatagcgttcttggctgccgtgcacgcgcccacagcctgtctactttcgaacacttgcgcccttcaatacccttttcccacacgcaaacaggcaatgccactggctgatcaccagcaacattgcctgtttcaattgaacaatctttacttttgccacccgcacgaactactcgatgattttcgactcgcgcgtcttctcattcatccgctcaatccacgggtgaattggcgctttcaagaacagtcctagcaggaagaagacggtgccgaatgccagaagtgccgcgacatcaatccagagatttggccagtagatgccgccgactgtttcgcgtaggagattgacggcgtaggtaaatggcagccatgggttgatcatctggaagaacttaccggataagacgacagggaagttcccgcctgcaccggagatggaaaggactaagatgatgatcccgatgcctttgccgatgttgccgaatagcgcgattaaggcgtagagaatggagacgaagaccagactgagcatcatggcaaatagcaggtaaagcggcttgttgacgacgtacgtgccgattaagaacaggttgccgagtgcagcgatgaggccttgcagcatccctaggccggcaaatgtcagccagcgtgcggtgtacatctgcttaaccatggcgtcgctgagcgttggcggcagtcgatactcggtaatcaggatcgcacccagcagcagtgccccgacccagatacagagtgccaggtaaaatggcgcactttgcgaaccgtatgtcggaatgtgatagaagctttgctgtttgagttcaaccggtttagctaagaagccggcttctttggtggcgtcgcggcgtaacagtttgattaactgggataaatcgacggacttttcgccttttttaatggccgcggcgcctttttgaatcgcttcttttagcgtcggccagtcgtttttcacgaatttctgggcgtcatccaaaccgctttggagttgcggcattttttcgtttgccaaggccaaggtgttggtgaggtcggattcgacgccagggagatcttgattgatgaagtcggtggcttttgtcagcttggttttgaggctagggaaatcattttggtataaatccgcgacggttgtgatgccgctggtgatgagatccatgtgaccgttaagcagcgcgttggcgtcggtgagttcctgcttgagtgccggcagctgctttttcgctttgaccaaaaagttgtgcgcctgcgtcagtagatccttcgtgccactgagcagtgacggcatggatggcaggatctgctggttaatcgtatccagcgtggtgttggcatcgttgagagccgctttgaaagcattcaaaatctgcttgacgctggtgccgagatcaagggctttgagtgtattggccgcgtcggcgaactgattggcagtgttggttaaaacgccgagccgccgctgcaattcactcgtacttaggttaggtacatccttagccaaagcttcggcatcgcgttgaaccgcagtggctgtcgcggcaacttctttgagcttggcaatggccccgtcaagcccatgatcatccttgccggttaactgattaagagtggtctgcacccgggttaacgtgtctgctaagctagtggcgttggcggcaaccttgccttgacgattggccagtgccgtcagcctttgcgccatcgcttgcttcaatgccgcggtgtccttgctgctgtctaattgttgtaattgttgctgcaacgtggtcaagtccgcgctcaagctggtgttggcagccgcaatcaatgtcagcccggcgtcggttgcattttggaccacacccaaggccgtattgattttgggaatcacgtcatctttggtcgttgccaccgctgcttgggcatttttgccaaaatcggttaaagccggcagcgtgccatcgacttggttaaccaccgtgatgccttgatccgtcacctgaactgctttggtgacaccggattcgagctggtcaaaattggtcaccaccgtattcagctgctggcctgcctggcgaacttcgggtagcttgcctttaacattcgtggcgagctcaccggcatcttggaccatgggcagatagccatttgcccccgtgagcttttgagccatttgattgatttctggcagatatcccgccatttcgttagcggtttgcagtttggcgcgaatcgcgggcattttagcctgtagctggtcgacttccgccagatacttttcgatcgttggcagctgatcgttggtattggtaaccaagctggtgaagcggcgaatcatcggcaggttttgatctagcttgatgcccgctttattgaaggctttcaccaatgtcttggctgccgttgagataaattcgtccgaaattttgttttgcagcgtggtcgcgccggtgctggtgattttaggcgccaccgcgttgattttttcgttgacgtaataatcgagtttcggtttgtgaattttgccatcaacgaagctcagcaagtcttttgaaaaatgctttggtaccaccaccccggcgtagtacttaccgcttctaacgcctttttggacggcttgtttggagtcgacaaagcgccagccgagttgtttattatcttttagttgatccatcagctcatcgccgactgccactttctggttgcgaaaagtggcgggttgatctgccgagtacacggctacttttaaatcctgcgtgttgctgtaaggatcccacagcgcccagacgttgaaccagcagtaaaggctgggaatgacgaccagcgctgcgatgagtaagaaggctaaaggacttttgaaaattcgtttccagtccagcgccactaatttgccaatgttacgcataacgtcctccgagtcctagattgagatattttctgattatatcacaggtgtttggtcacgcaattggacaaaaagcagaaagtgtcgggatgaagctttggctttgtacgtccttcatcctacacgctttcacgttttttcggtactcctaaactaacgggataaaaaaagccttaatcccatccccagtcacaataactagggcgataggattaaggcttatttcagcatcttttacaaggacgctggtgaaaccgattcgactttgacatcttcacgctgcactgccaacagatcagcgccggcttcaaccgtggtgtcggcaactggttcgatccgggcataggctttgctattggtgatcagcaccatcgttgtcggatcaaggccggccttttcaatggctgcgcgatccatggtccccagcaagtcgcctttgttgacgtgttgcccggctttgacggccactgtgaacggcgcaccgtgtaaattaacggtatcaatccctaagtgcaccagaatttccatgccgtcatcgctgttcaacccgtaagcatgacccgtgtcggcaacaaccgataaggtgccggattgtggcgcgtagattttgttgacgccggcattttctggttttatcgctaagccgtcgcccatcatgccggaagcaaataccggatcgcttaccttattcaaagcaagcgtttcgccgctgaccggtgcatagaccttgttgtcactcacggttgacgaaatcactgcattcgccgtttcgacatcacgatcgggcgccaagacttctttaggaatggcaaaagcgttggtggcaacaaacgcaacgacaatcgtccccagtgaaacgatggtgtaccacagcaaggcgtggccgttgtaaatatacatcaggtatgacggaaccacggcgagtccatatgagttggcggaaacattgagaatgctcaagaccgccgcgccaagtccggaagttaacacggtgacaattaatggccgaaaattataacgaatcaaaaccccgaataaagtcggctctgaaaccccgaagagttgtgaggtgaatgcccccattgaagttgccttggctttaccggaacgcgcgcggaggaaaatcgccaacgccacgcctaagtttgcaaagccgtacatggcttctaacgtaatcaacggattcaagccggtggacgccagcagcgaagtttcgatggcaatcatggtttgatggatcccaatgagcaccatcagcggataagctgccccgatcaggaagccgccaatgccaaatggtaagtgaatcaccgcctgaacaccaaccagcatcccgttttcaatcgcatggacaagcgggccgacgcctaaaatcataatggcaaacgtgaccagcatcgttagaaatggcgtcaggatttgctccaaaacattcggcatgtgacggcggaagaacagctccagtttcgcaccgatgaacccagcgaccaaagcggttaacactgacccctgactgccaaccactggcaaccagccgaacagcatgatcgccttggcactgccgtctgcaactgagtaggcattaggcaaaatcggcgaaactaacataagaccaatcacaatcccgataatcggcgtccctttaaagtagcgaaatgaaagtagcgaaatgtcgaccacacaatcaacgccggcaaaaaggcaaacacggtgtcggtcagcactgaaacgaccgaggtgagactggcgggaatgtcactaggcacggcgccgaaaagctttaatacctgagcgttggtcgccgcactttttaatcctaagaacagtcctgtcgccgcaatgacggggatgatcggaatgaaaataccggataacatggccattaagcgttgcacccaagtcttatgttcatcgcttgccgctgcggtggtgtccgcatcgtccttgccataaatcgcattcacggtccccagcttggcaatcgccgcgtacacatcgttgacaacgccggtaccaataatcacctgatactgaccggatccatagaaaacacctttgacttccggcagctgctccaacgccttatcgtcaatagccttgcgatccttcacaacaaaacgcagccgggtttggcaatgagtcacggaatcaacattattgacgccaaccaacttcaaaattgcttttgcttcttgttcataattttttgccatcttaattcacctcaatgagaatcgcttggtagggtttcaacgttggtgctgcagccggataattgttcagccagattcggccagccggtaagtcgatggtcgccggtgcagcgctgagattgacatagatccgcaaatgtttcccgcgggcatatgcgatgacgtgttcgtctgccaccgtaagcggcgaaaaatcaccatcaatcagatccgaccgcaacggcgaatcattacgcaactggcacagcttttggtaaaagtgccagaccgaatcgggatcgatctgttcatcctgccagttgacgccgggtgcttgttgggccaccggtagccacggctggtgatcgctgaacccgccgtttgcctcgtcgttccagagatacggtgtgcgggcattatcacgcgagcggcgattgacacatgccagtgcatccgcttttgaataaccttccgctaacgcccgccgataattatcatgcgccgacaaatcgttaaattgatcaatgctgctgcgaaccgcattcaccattcccaactcctgaccttgatagataaacgggcacccgcgcaagcagaaatacaataatgccaatgctttggcaccggtggcattgcggtacgccggttcgcgaatgtatttactcaaactccgcggctgatcatgattttcaagaaaattagctccccagccgacgcgttgaatggccagctgactttttgcaatcgcatcgcccagcattttcggcgtccactgcgtctgcttgaaccactccgaaccggaagctacatcaatatcggcataatggaaatcaaagatcatggaaaagtagccgtttgggccgatgaaatcgcctagttcatcataggcgaccccggaagcctcaccgattgtcacggcattggcaggcttaaaggtagcagcgttcagttctttaaggaagcgcgctaggccaggccgattctctgccttccgcttcaccttgcccaggccatcgttgccatctggcgtaatcgctgcaaaatcctgatcctttttgatgaaagtgatcgcatcaacccggaagcccgccaagccttttgccagccaccagttaatcatctggtaaatcgcctgccgcagcttgggattctcccagttcaaatccggctgctgcggggaaaagacgtgcaggtaatacatgtcggcttcaccgggaaccgccgtccacgccgagccagcgccgaaattagagcgccagttattcggcggctgtccgtcatgacctttgcggaaaatataatactggcgatagggtgaagtcggatctttcaacgcggcttgaaaccacggatgctgatccgaagtgtgattcaccaccagatccatcaccactttaatccctagttctttagcagcggccatcaacgcgtcaaaatcagccatggtgccaaagcgcgggtcaattgcctgatagtcggagatgtcatagccattatccaccatcgggcttcgataaaccggtgacaaccaaattgccgtcactcctagggccttgagcttcggcaactcactggtaatccctggcaagtcgccaatgccgtcattgttgctatctttaaaggacgccggataaatttgatagaaaatttcttgttgccaccatgtgcggctggtttcgttaagcatgcgtaactccttcttcataatgtggtatcgattccatatttattaaaaataaaattcaggcgctttgcctgatttttaacgtcaaagttaacggttctggagccacagccggttcaccgcggccaagtccggctaatagtaagtccgttgccacctgcgccatttcggcaacaggctgatggacggtcgtcagcggcacgcgggcaaacggtgcaaacggctggtcgtcataacccatcaccgcaatgtcatccggaacggcaatgttagcagcgactaaactgtccacaacgccaactgccacttcatctgagttcgtaaaaatagcatccggacgctttgccggtgccagcgcggcgatttggcgtccgagcgtttggccttctgttgcggtatgcacctgctcaaacagccaggcaggttcgactggcaacccgcgcgcttgcataaaatcaaagaaagcttgggttcgactttgaccgtggcgggcacttttaatcgcaccaccggtcatataagcaaaacgacgatgaccttgtgcaaataggtaatccaatgcatcgcgggttgcctgatagtgcggtaacaccaaagacttagcattgggaatctgcacatccgcattgaccacgacaactcgcccaggaaatgctttagccacggtcgccacccgcgctggtacttcaactgacgctaagataacaccatcaagttcgcgacttttcagctggttcaaaaaccgctcctcggcatccggattatcgtaagtttgcgaaatcatgacttggtaaccgtgggcgtgcagtgttcgctcaatggcatcaaacaagccggcaaaaaacgggttcgtgactcgcgagaccaaaacgccaatatttccggttgcctgggcgcgcaaggaggtagcggctgcgctaggcgtataacccagcgtcttgatcgcagcttcgatccgcgccttcttatcagcggaaatatacggatgatgattcaagtaccgcgataccgttgtcaccccaacgccggctgctgcagcaatttcgctaatcgttgccatgaatggcgcacctcctgtttatggaatcgatttcatactgtgagtatacagcgctttcaaaaattgtcaaggcacaactgaaaaaattcgattacttctgaaaatgaaatgcctcggtgcacagatgactgcagttgattggcaaaaaagcatcagccaatgtctgcacaaatgacatttggctgatgcttttttatttattggcgcaaataagttgtttaaatggtggcgacatggttgatatcagatgtgctttctactgacatcgcttcattcagtttcaaaagcggcctatagcccgccattatccttccgcagattccacgcctgcacgttgctaaccgcagcaggtggattcacacgtgcggcagtggggcaagtgtccccaaagaagcgcccggaaaccacccgataaccatcgtcaatgaacaactcgaaaacggagacgtccacaaacaaccgaatcgtgaccgttttgcctgctgggaaaccaaattgccgcaggctgccgccattattacggttctcgcgctgaaccatcccttggccactatctgagtcaagattgatcaacagttgatcgtgatcaccatctggaacatggacggtggctttttggccggcagctaacgtcatactcagttcgaacgcaccgctcaacgccgtgactgaacattgatccgtattttggctgacaactggtaaggcatcagtagcagtttcccgaagctgttcaatgttgggatgtggctttaggcaaacatgaccatcgcgtaaatccagctggcgcacgtaactcaagacgccttcccacccgtctgcatccgttgggtaattcgtgtcgggtaagcctagccaggaaattgctaaagtgccatctttttcggtattggcaagccgggttgcgtaaaagtcaaaccctttatcgatattttgcaggcgctgatgggtcagtgtgccagtctccggatcaaagctgtcggccacaagtgcaatattaggataaacattttcgtattcgaaaaagtcttgatccaagccttgtggacaatatactaagacgactttgccattaatgaaagcaatgttcgggcattccaccatgtaaccgcaaaattcgtccgggatacttaacggggccacaaagcgccaggtcttatccggttgcttttcatagagtaggatggcgccggtgtgatcggcccgctgaccaccaattaagacataggttttatcttgataattaaatagaaatggatcccggaactcttgggtgtagccagcaggcggattagcgatcaatggcttcggatctttatataaacggctatctgcgcccagaaccgcccctaattgcgtggactgtcgatgccactgctcatcccgcacattaccggtgtacatgattcgcagcgtaccatgcgtcactaatgccgaaccggtgtaagcaccttgcgcatcgagttcgttatccggcaataaatcacccgggactcgccgccagttgaataagtctttggatacgacatgtgcccacgacttcaaaccatgaaccggaccaaatggaaactgctggtaatatagatgccacttgccattaaagaaattcagactgcagggatcattgatcaagcccgtatccggttgaatatgcgtcttagttcgccattgactcgcagcaacctcagctttcaagcttgccacatactctggtgtccacgtcgaatacggctgataccgcttagccatattctcaattgagtccgtcatgtacttaccaccttgtgtttggaataatacccttatcttatctgagttcgcggcattgtcaatggaagcgcaaacaatgcggtgatccgggctgcttaatcattgattacgcacgaatgacccattatgccacgggtacgactaaaaatcaccaagaaccgcacccctttttaaattcgcccggttaaaaagcgagccgcccaactttattcagcttaaaattcaacacaaaacccgcggccatcagctgcgggtctcagttttaccaatcggagggtaccaattggcaatcattattttggaggagtagaaatgaaaaagttgggttggggtttaggaatgagtgggtggctcatttctatgttgttaatactaccgacgaactttgaacattctgtgacggcaaatcgctctttgtgttaacaagattttctgccgtgtttcacgacattgcgttccaccgccaaagtcatttttccggtaaaaagtcgcgccgataatcgtggacatattgcgaaaacgtgattgccggtcgcccaagcacttttggcaacgttgtggtcacttctttggcattccccatttgcgtgatcagatacagcatgaccatcacattcacataattcttcggcaagccgcgcgcaatcatggtgtggcgaaaacgcaatagacttggccgactatacgttatcgggacgcctaacactgccgtcatggttttagcgacctcggcatatgttagcgcctgatcgccggtaatcgccagcttttggccaatatattgcggatcacacaggacagttgctgccacggcaccgatatcgcgcgtatcaatgaaactcgtccgagcgcgtccagccggtacaaatagatcatggtgggccacaatgtcatggcgatgcgtggtattgagattttgcatgaaaaagcttggccgaataaatgtgtacggcaacccaagtgcttcaatgcgtttttcaatcttatgatgcggggtcattggattgtgttcaacgcccagtaacgagacgaaaaccgcctgcttaatcccatggcgcaccaaggcatcaagaaacggatacatgtccgttttgggttttgctaattgcggcgggcgcacgaagaagaccttgtcaatggccgccaatgccgggtcaaaagttgcggcgtcaagaaaatcaaatttgcgtaattgaaccggcaagtcccgtaaagttgcacgcgcatgagccggcgaatgtacagcagcaaaaagttgcacgtctgcacgtttggttaaagcttgaatcagcggcagtccaatattgccggtcgctccgatcactaatatattcgtcaagttgaatactcctccataaaagaaaagcacccctgaaggtaccttttcaaagctgtcgtatccataaaccgttaactaaatttccggcactattcgtacatatagtcacgggtggccggcaagtccttaccagacggacccttgctaatcagatactgcatgacatcaatgttaccggcctcaaaactcgcagcggcggcttgcaggtaaacatcccacatgcgcgtaaattcataaccgaacttttgctgaatcggattacggtgattattgaaattcgtatcccaaatttcaagcgtccgctgataatggcggcgtaatggctccaagtcgtccaactgcataccggaatcaataatatgggtcagattttccgccatcccaggcacatagccatccggaaaaatgtacttattaatccaggcattcacagccccgccttgctgccgtgtaatcccatgaatcaacgccacaccatcatcttttagcagcttagcaacatctttaaagtactcttctagattttccttaccgacatgttcaaacataccgacagaggtaatgtagtcaaacggttcgcgatctaattcgcggtaatccatatatagaatttccgccacgtcattcaggtgttccgcttcaatccggtcagaaaccagcttaaactgttccttacttaaggtgatgccaaccacatgcagatggtaagtcttggccgcccgtaacatgagcgtcccccacccgcagccgatatccaataacgtccgacccggctgcggattcagtttgcgtaaaatgtgatcgattttatttaattgtgctgtttccagatcgtcatcccagttctcaaaataagcacaggaatacgtcagcgttggatccagccatagcttgtaaaagtcattacccaagtcatagtgtgaatgaatatcctgcttggacttgcgctcggtgtggctttgcttaggcaacacgcgcatgagtttgttgttacgcataaaactgtctgcactggcataggccgccgcaattaattgctgcaacggccgcttaccaccaagcacctcaatgtcaccacgcatgtaggcctcacctaatgcaagcgaagcattctttagcagcaaacgcactgggatcgcttttttcattttaatcgtgatcgtcggctcgcctgttccatatgtttcttccgtgtggtcccaatactcaacacggaccggaatattgaaagagtgactgaacatggtatgataaaactttttttcgagcatgatgacctccgttttgaaaagttacaaccgtaattataaagctttttgaccaaagaaaaaacaccgccaatgaaatggacggtgtgttgccgctttcattaaaattttcggaagcgggcttgacgctgggtaaccagtgtctgcggatccaatgccataagggtcgccaattttggcttaacctcggctttgagtgcgctggggaagtcggtaccggtatccgtaattatccgatcacagacttttttagccaataaatcccgcggggtcagctgcatcacttcagctgcttctttggcgcggctggaatctttccacaaaatcgccgcaaagccttctggtgacaagatgctgtacatgcttttatctgtcatccagacttcatcaccaaacgccagcgccagcgccccgcctgatccgccttcgccaaccaatattgccagaatcggtgtcggtaaatcggcgcacgtgacgagcaagtctgcaatcgctgccccttgcccatttgcctctgcttctttacctggataagcaccgggtgtattaatcagcgtgacaatcggacgatgaaacttcgccgcctgtttcataagccgcaacgccttgcgataaccccaaggctccggactgccaaaatgggtctgcaaccgttctgtcaagtcattgcctttatcggtcgcaatcacagttacagcttggtcatccaaccaaccgatgccgccaatgacagccggatcatcatgactggaccgatcaccatgtaattcatgaaaattggcgactaagccgttgatgagttcgcgggtggtatagggacgtggtgcgcgcgccgcttgaacggtggcgtaggcggatgtttcttttttgggcatgccagggtacctccttgcttcgtgttggtgctggtggggatgttttccgatgctgaaatgcgttcacagtcgcagaaatctgcgtgtaaggacctcggccaaagaccggctggatcggaaatagccacttttgttgcggttgggggatgttctccgatgctgaaacgcgttcgcagtcgcagaaatctgcgtgtaaggacctctagcctaaatggccaaagaccggctggatcgggaaagtcacttttgtttcggttggggacattctccaatgctgaaacgcgttcacaggcccagaaacctgcacgtaaggaccctgagcctaaatggccaaagaccggccatttaggctcagggccacttacgctccggtttctaagcgggcctgttcacgctctgtgcatttgtagcatatccccaatgtaactaacctgctcacttcttggaacaatggcgtcgatgaagccgctttggaggacggtttcggcgcgttggaagttttgcgggagtttttggttgatggtttgttcgatgacgcggcggccggcgaatccgatgaggctgtggggttcagctagtgtaatgtcgccttgcatggcaaagctggcagtgacgccgcccatggttggatcggtgagcacgctgatgaacaataagccggcattgctgtgattcttcacagccgcactgacttttgccatttgcatcagcgaatgaatgccttcttgcatccgcgcaccgccacttgcacagtatagaacgactggcaagtttgcttcagtggctttttcaaacaaacgtgtgatccgttcaccagtcacggttccgagtgaacccatcataaacttaggatccataataccgagaccgcatacctgtccgccgattttcgcctgaccggtccaaacgctgtcttctaaaccagacgcctgacgtcccgcggctagtttcttctcgtaacccggaaaatccagcgggtcggtcgtggttaaatccgcatcccattccgttgcatctgttgctaccagggctaaccgttttttggccgtgatgcggaatccataatggcaatgcggacaaacctgagcatcgccgagactttcacgataactgccttgcttgcagtatggacattgaatccataagttttcaggcaaagccgcctcacgagcaagtgcttcttgggttagttgtggttggaacatgcagcatccttcctttcatcctgccattgtggcaaaaagtcacggttgagataagccgtatcagcttctccagccaataccttgggtgcctggaaaagtgccagtgcaaagtcgcggttggttttaaccccttgaacgtctaattccgtcagggctcggtgcattttagccaaggccgcttgtcgggtttgaccatgaacgataatcttggcaatcatcgcatcatagtacgggctgattttatcgcctggcgccacgccggtatcgacgcgcaaacccagtccgccagtcggaaagcgtaattgttccagcgtcccgacatcgggcataaactgatgatccggatcttcggcattgagtcggcattcaatggcaacgcctgaaggttccggcgtggtcaactccacgtcttcgcctgccgcaatgcgcaattgtgcctgaaccaaatccacgccggtcaccatttccgtgatcggatgttcaacctgaatccgcgtattcatctccatgaaataaaaatgatgttgctgatccattaagaattcgatcgttccggcattaaggtaatcaacgccgtcagcaattgtttcggctaaatgcaacagcttagcccgttccggtgacgttaacaccgggcagggactttcttcgatcattttctgactgtgacgttgcaggctgcaatcacgctccggaaaaacgctcacgtgcccttgctgatcgcgcaatacctgaacctcaacgtgtttagccgggacaatcaccttttccaagtacatggtgggatcaccgaatgcggcttgggcttctgcctgcgccccggcaaattcggctgtcaggtcatcggcactcgccaatttacgaatacctttaccgccaccgccagcactggctttaagcatcagcggatagccaatcgcctgtgcagccgccaatgctgtatcgacatcctgaagcggccggctgccagggatcaccggcacaccaatatcaatcatcgtttgacgggcaacggctttatcacccatttgctcaatggcagtcggcttgggcccgatgaaggctaacccggcatcagtcaccaacttggcaaattcggcattttcggataagaaaccaaaacccgggtgcaccgcctccgcaccgcttaaaatggcggcactcacgacattgcgcatattcagataagaatcagttgcccgcggaccaccgatacaaatcgcttcatccgccagcaagacatgtaggctgtggcgatcggcgttcgaaaacaccgccaccgaggtgatgcccatttcccgcaacgtttgaatgatgcggaccgcaatctcgccacggttggcaacgagtacttttttgaacacagttccacttccttacacgagtctgaatcgggtcgatttaaccaattgcaaagacaagttcggcactgcaagccatatcttcgccgacgtaaaccttgccttttcctaagccggcattgtcgatcaatttctctaaagtgacctcgatgcgcaaaacatcgccggggcgtaccatgtgacggaacttagctttcttaatgccgccgagataagctgttttacctttaaagtctggcatcgaaagcaaagcaattgcccctgcttgcgccattgcttcaatctgcaagacgcccgggaaaatcgggttaccgggaaaatgcccctgaaaaatctgttcgttgatagaaacgttcttttgtgcaaccacagattcgccgggtttgagatccagtacccggtcaatcatcaacatgggatatcgatgtggcaaaatcgcctgaatttcttgtgcttcaagtgtctttttggtttcgagcatgaatgctatcctcctaaaacgtgtttatggagccggaatgcgactcggtttacgctttgtcttcttgtacgatgagcaacggctggtcgtattcaactaagctttcgttatcgactttaaccgctttaaccgtgccgctaacggtacttttaatctcattcatcattttcatagattcgatgatgcagacaacgtcaccttttttaacgtgatcgccgacttgaaagtacggatcagcgcctggtttaggagccagataaacgattccgaccagtggcgctttgaccgctgtgccttcatccgcttgcggcttgtccggtaccggcgtgacgggtgtcgctgccgtattttccggagccggggtcacaggtgcaggcgcggcagcagggcttgctttgaccaaatgtagcgagtcgttaccaagcgtcagttccagctcgtgcagcgaactttgctccaactgtttgatcaaaacttcgatcattttggtgtccatgacactcaccaccttttgaaggccaaaacggcattatgaccgccaaagccaaaggagttgctcaatgcatagtcgaatgatgtatcacgattgtcgcgattaaccagcgtgaccgggcaatcctcgtcttgagccgcatccaccacattcattggcaaccggccgctttgtaaggcacttagcgtcatgatcgcttcgatggcaccagcagcacccagcagatgccctgtcagtgccttggttgagctaaccaacacatcgtcaccgaaaagatcatggatggctttactttccatcgcgtcattggctttggttgctgtcccatgggcattaatgtagccgacttcacttggcttaattccggcttcttcaacggccaattgcatcgcacgtgccgcctgagagccacttggatcgggcgccgtcatatgataggcatcactggtggcaccatagccaaccacttcacctaaaatcttggcgccgcgtttttgtgcatgctctaggctttcgagaatcaatgcaccgccgccttcgcccaaaacgaaaccattccggtcagccgcaaatggcaggctggccttggttggatcggtatttttggacaatgcggaaagcgcagcaaaaccggcaattccgatttcgttaactgaagcttcggcgccgcctgtaatcacaacatcggctttaccggtttgaatccgcatcgctgcttcaccaatcgcattcgtagctgaagcacatgccgttacgacaacatagctggggccatgcgtaccaaagtaatgggaaattgtccctgcgaccatgttactgatggcttccggcacgaacagcggactcacgcgatccgggccttttacatacatcttcgtcacttgttcctgaatggttgtcaaaccaccaatcccggaaccgaaaataacgcccactcgatctgaatcgaccgcatcttcagttagaccggattgttcatatgcttcaatggcactatagagaccatattgggtaaacagatccatccgtttacttaggcgtttgctcatccgttcttcgggtttgaaatctttgacttcaccagcgactgtgattccggttttttcagcatcaaacttggtgattggctggatgccgaccttgccagcgtccattgtcgccacagtttcggcgactgaatggcccagcggattcacagtacccattccggttacgactactcgttgcaatgtcattcctccgttcatgtacttaacctaatccgccggcgacagtcactgtctgaccggttatgtaggcattttcgaccagaaaacgggccgtgtgggcaatttcttcaggttgaccgaaccgcttcaacggaatctccgctagaatctggtcctgactggattggctcaaggcagcggtcatatcggtggcgatcatccctggggcaatggcattaacgcgcacgccacgcatagccccttcacgagctagcgtcttagtcagcccgatgatgcctgctttacttgccgcataattggcttgaccgatattaccggtcaaaccgaccacactggccagattgatgatgacgccagcgcgcgcctttagcattttcttaaaggccggttgggtaacataaaaggtgccatccaagttaacctgaacgaccttggcaaaagaagcgggtttcatgcgcatcgccaacatatcgtcggtaatgccggcattattgaccaacacatccacgctgccaaactggtccaaggcagcggcgaccaattgatcaccggttgtgggatcatccacactgcccagcacggtcacaacaccgtggccatagtcttctaattctttgatcaaagtttccggaaattcatgccgcgcattcaagaccaagttggcccctgcttgcgcaaaatttctggcaatcgcttcaccgatacctcgtgaggcacctgtgatgatcgcggttttatcagttagtttcaatctgccttcactccgttattcaaatctgctacctcattgagacttgctgcatcacgaatcaggtaggttgtcatcttgcggtcaatgcgtttaatcattttactaagtaccggtttcgggcctaattcaacaatcgtatcaacgccttgtgctttcagttgtgcgatcacggcagcaaacttcgtcggttcggctacttgtgccgccaataccggccggatgttgctagctgaaaacggcttaagtgccgtcgtactaatgaccggaatcactggttcaaagacatgagccgctgccagtgccgcttgtaatgacggttgtgcacttgccattaacggactatgaaagcccccggcaacctgcaaaggaatggcgcggacaccttggtctgtcaaccacttttcaaccgttgccaagtcatcatgtgtccctgccaaaaccgtttgcttcgggccattgtaattagccggccaaacatgttctgcctgctgacaagctgttttgatgatggtctcatcgccgctcatcaccgccagcataccgcctggttgttcttgacacgcggcggccatcgctttaccacgggctgcaacgagctcaagtcctgattctaagctcaacccgccacctgcgattaatgcgctatattcgcccagactcaagccggctaaagcagcttccggcggcaactctgctgaggcaacctcatgcatggccacactataagcaactaaggccggctgtaggtaatccggatgggccgcaaaatcaccgttagccaaaaactctggcaagtcaaagtccaaaacggcatcggcacgatcaataatctctttgaatatcaaagtattctggtaaaaatcaatccccattccggggacctcggcaccttggccgttaaacacataagcaaattgcaaaaagtggtacctccttgcctgcgtttgggttacgcttgcacgtcaacctgactagtgagcaaagccgccattttcgagccggcgacaatttcttttgcctgctgcatgacttcttcaacaatgtccttgctgctttcttcgcgtttcactaatccggcaatttcgcctgccataaaggatccatggtcgcgatcgccttctagaacggctttacgcaaactaccattacctaattcttccaccgctgtaaaatcagtggtgccagaaagcgcaatttctttttccagtttgagataattgcggctcatcgggttcttcaagacgcgggctgcatgaccgacatacataccggtaacaagggtatcgacgtcttttgctttaatcacagcgtctttgtagttttgatgaatgcggcttgaggttgaggttaaaaagcgggtccccatttggacaccaactgcacctaaactaagcgcagccgcaacgccgcgaccatcgccaataccgccagctgcaacgaccggaatatcaacggcatctaccacttgcggcactagggccatcgtggtgatactgccgatatgaccaccggattccatgccttcagcgatcacaccatcaacgccgtcacgagccatgcgcttagccatcgcaactgacggcacaaccggcatgaccacggtgccgttttgctggagccgttccagatagcggctaggatcgccggcgccggttgttaccaaggcaactttggcatcgacaatcacatcaatcacctgttcgacaaacggcgacagtaacatcacgttgacaccgaatgccttgtcggtcattgattttgctacttcgatctgttccttaacccatgaagcaggtgcatgaccggagccaatgataccaagaccgccagcttcagaaaccgacgcagctaatttgccgtcagcgacccacgccatgccgccttgaaaaagcggatatttaacgcctaaacgttccattaatggactcattggcccactcctctccagtgtcttaagcttcagccttttcagtgatgaacgtaaccaaatctgaaaccgtttcgatgctttcgtcagtatcgatcttaacgtcgaattcgtcttcgatttcattaatgatttcgaaaatgtccaagctatctgcatccagatcattcttgaagttcgtggtcaaggttacttcttcaggcttcttgtccaattggtcagcaataatactttgtaccttaggcaatacttcttcgttagtcatgtttatatgttctcctttgagtgttaagttttgaccgtttcattggtctgtcaattgtaaccgttagttagtaagtcatgataagtgagccaacagacaagccgccgccaaaaccgctaagcactattttctggccgcgttttaactgaccgctttctgccaactgtgccaacagaatcgggacgctggctgcgctggtgttaccatactcatcaatattgatcgggaattttgcttccgcgacttttagctttttattcactgattgaacaatgcgcgcattcgcttgatgaagcaaaaaccagtcaatgtcatctgttgtcaggttagcttgttccaaagcccgattgatcgaacgtggtacttcgctaatggcaaactggtaaaccgcgcgcccattcattttgaaatatggtgacggttgcgcttgttcatcggcaaaggggctttgatttgcttgctccccagccaacaacaccatctcggtatcaccgaaactctttaaatcaactgcttgaaccggggcgccttgatcactaaccaaaacgccgccagcaccatcagcgaacaaaactgctgtgcgccgatcatgccaatcaactaaccgggaaaggacttcactcccgatcaccagtccttgatgaacgttgggactggtcatcagccgatcagcgacatgcagcgcatattcaaaaccggcgcaagcaacattgagattaaacgcaaatgcgtgattcgcatttaaagctgcttgcaggcgattagcctcggccggggtggcatagtccgggctcatggtcgccacgatgatgaaatcgagctgatcggcggtgaccgtcgatttttctagcaattgttgggcgacatcataggctaaatcaaagttacgctggtcagtgaccacatgccgggttttaatccccgtgcgttctctgatccattcatccgatgtgtccataaattctcgtaactgctcgttttcaatgcgcgtggctggcaccgagtaagcactggccagaatctccaagacggggccttctttctaatgacgatattcgtcaataaattcattgagattatcaagcgcgcgttcgattagctcgatttgcggttcggtaaatcccttaacaaaactggcaaccattttttggtgaaaagcaagatgcgcccgatacatgagtcgtcccttgcggctgagtcgcaggttcacaacccgtttatccgactctagatgcaaccgttcaacatagcctttgcgcgccagattgttaatggcgacgcttaaagtgccttgggtcacatgcagcttcttggcaacatcactagagctaggggtcgcatgaataccaatcgcatcaatggtatgcatttctttaatgcctaaatcccggaactgacttttacgtagttcctcttcttccattcgtaaaatatccgaataaacgcgaatgagcttatcgtttatccgcttgacgcttggcttttgggacattggtgtgcctccgtgtacaactgatttgatactcaaagtatcagttgaaaaaaaaagcctgtcaagtggactaagcatttgcttctaccacaaaatgcaattctgcgtggcagacaagctcttcaccgatactggcggtcgttgtgaccacccccatattcgcccgaaccttacccatcttgactgccagtgtcagcacactgccagttggaacgggtttaaggaattctgttttgccgatacttgccagataagcagttttgccggcaaacttcggtgacttcagaatcaaaatcgatgctgcctgcgctagcgtttcaataatcagcgttggcggcatggttaactcaccgggtagatacgcaaccagatgatcttctgccacgctcacgtatttctctgcgacaatcgattcatccggtactaattcggtcacccgatcaatgtaaaagagcgggtaacgatttgggattagcgtttggatggttgaggtatccaaagttgtcatagcctcgcctcctctttaaccgcggcctcagatggtgacagtcgcgaaaatgtctaaaagcagttgtgcgatattttcgcgttgaaccgtcatcactggttgccggtttttgtccaaccagattaattggatgttcaaagcatatgcagaactgttttgattgtcaaacctttttcgtcattattcatttgtgagaatattgatattcctgaatgaatgcggtctcagataatattgttaagggatttaagggttgccataaattgataaaatatgcagaaaatttatttattaaattttatctgcgaacggtcgattgacgagccacccacaactaatttggtgaatgacagttggttgatcatgacggcaaatcggtttcaacttgaagctgataatatctggtgatgtgttgttggcacgatggtagtcgtttggaaaacactgcctgatatgtggatttctaactgcgccgtttatgctcactttctataacgcgctccccagcgcagaagtctgcgtgtaaggaccttaagcgcaatggccaaaaaccgggccatcgcgcttaaggccgcttacactccgacttctaaccgcgctggctcgcgctcacataaaaacggccatccgccttgggataaccgctttttcgatttaagttcgtttaagcctttttactgctaatgacggctgacggcagcgcgtagttcactgtcttttagtttcagccgcacaatggttccgactttttccgggtcatcaatccatggttcatggcccgcaccgttgatcgttgttaattcaccatgttggacaacagcggcgatctcctgacctaattcaggattggcaaatgggtcgttggttccccagattaaactcatgggtaccgttagctgccgtaagtaccgttccggcaagacgttggattcttttgaccgatacatgctgcgtaataacgacaaggtggttaattgataatgcggtaaatgtgtaaacgcataaacacaatcagcaaagctttgcggcagtgcgctcacggcggccggatctgtccccatgcgatgaagcggtccccaggcgcgcttggctgatttcgggatctggcgtttcataaaccagcgactcaagaccggatttaaggccgccttcaatggtgctggcgtactggtcatcagcatccggcccggattgcctagcaaaatgagctgatccactcgttccggataaggcagtgcaaaccaggttgcccagtgtgcggccagcgagtgggcaatgatcggcactgttttcaaatcaagctgatccatgacttggccgatcaattcaaccgcaaagtcatgcaccttgacctgttcataatcaaagccgtcacttaacccactgcctggtagtgcgagcacaaataaatgataaccggctaattgcggcaacaatggcgccaattcatacggatcgccggtattgccagggatcatgagtaccggatccccgtgaccaaattctaagacgcggacacgcaaatttgcttctgctgactccgtgggtgcgattttaagccatcgcgttttcggttttaagtgaaaatcaagccaaagttgattctccgcattacgcgccgcctgaaaagcaaccgaatcatgttcaagaatgggttgcgtcaccaatcaattcctccttttttaatcctgtcctccagttagcgactaatctaagctgtcaaaccattcgtcatggaagcttgataaatcgctttgacgtcttcttcagataatggcacatacgcgcgggtttccagactggcattggccacagccgctgttgccatcgcgtcaaaatgcgcttcatcggcaattccgacttccggtaaggtcatcgggaagcctaaatgctgaatccagtcaaacgttgcgtcaattgctgcttgggcaaccgcgtatgtttcgtctccttcaaggtcccaaacatgccgtccgaatcgcgcaaatatttccgcggtggtcggatctttggtcaaaataaactccatccagcgcggtgtcaaaatgccgagaccaacgccgtgcgtaatgtcatagtaggctgataactcatgctccaaactgtgaaccgtccaaccattttcgttggccacgctcacaagaccattcaatgccatggtcgcactccacatcaagttggcgcgggcatccgagttatgcggctctttaacggcgatcggtgcccacttaataacagtacgcattaggccttccatcattcctttgctggcgtcattatttttcgaacggtcaaaatattgctcgatcaaatgactaaggatgtccattgaaccagccgccgtttgccgtactgggacagtataggtcaagctcgggtcaagaaacgaaatggcgggggtattcgggccagtggtacccaacttttcatgggttgccggattagaaatcacggagccgctgttcatttcactacctgttgccgccaacgttaaaatatcaacaaccggtacctgctgcaacttgtgccgcattatcccgcgatccttcaccaagtcccacgggtcaccgtcatagaatttggcactggcaatgactttagcagcgtcaatcaccgaaccgccgccaactgcaagcaccacgtcaatatcgtgttgctttgccaactgttgaccttcacgaatcgaggcaatttttgggttgggctcaataccagccagttcggtaacgtctaagtctgctaaaagccccttaacggtatcatacaagccggactttttgatggaatgaccgccataaacgaaaagaacacgtgaaccaaagcgactcacggcatcatgtaactcagtatcaagccggccggtaccaaagcgaatatcggtggcgttttgaaatcgaaaatttttcacagtgccatctcctatcatataatgtcaacttaattgtaccgttgttggcattaaaaaagaaaccggattcgtgccgaacacgggcatactgtcctcggcttaatttcaagatagccaatacaccaagccaaatttatgcgaaccatgctgcaaagaaacaatgaccctgatttgtaagcgaaatgccgatttttgcattcttatgttgttcgaaagccaaaaatacggcaaaaggaatgagtgacacctccccttgccgtacttgattcaatggtgcaacaaagtccaatgactgttacacccctaatattgccactgagtcattcttaatgtgctggttcaactggtaggttcatcccttgccatccttccaacgcacctgccaactcgaaagccttaaacccatgcgaaagcaaaatcaacaaggcttgtttgcccaaagtagtaccgccagtccagtcatacaccacataggttttttgctggtcgagttggtccaatttagtgacaagatcttttgccggcatggcgcgggcacctttgatttgtacctttttggcttgcgtcggtgcattacgaacatccagaacttcatatgtttggtcaccagcctgtaacgcatgaagaactgtgaagtgatcaatgtaaagacttaagtaggtttttaaaaaatcaattttagcttgttccatcatgatgtgcccctttctgagggtatatgggttacttggtcccgagcagtaatttatcgagtaatcggttgagttgtatttgttcatcgtgggttaggttggcaaagagccggttaaccgtttgataattcaccggtaaaaaccgatcaagtaacgttgccccttctgtggtcatctgaattaaagaagcgcgtttatcagctgcggtcgtcgtcttctcaaccaaaccacttgcgaccatgcctcgaactaatttactcgtggttgctttagttgccccgagcttttcagctaagaccgtaatacttaaagcttgcggttgttgatggtacaggaacattaggatcaaaaagcgtgattccgacaacccaaactgatccagaacctgttgatagtcattggcaaccgctctgaagcaagtgcgaaaattcagaaaagtcaagactgattgggtatcaacatcgggataaactttgcgcattaggtcaagccgatgttcatccgggcgatcagtaaagtcaaaattcaaaagtcatcctcctcatgttgttagccggctaacaacatgagtatgtaactcattctcacgcgtgtcaagcaatgttttatcgaaaaatgggtttatacaattgttattcgatgatgactttgaaaatgcttagtcgtgatgcgaagacagggtatttatatcagctatcggttgtgagcacagagcacgactttctactctggaggatttgcaagtttgatcttactctctataacgtgttcgtcagtccagcattctgcgcttaaaggccttaagcgcagtgaccaaaccccggcaggccgcttacactccaattgctaaccgcgccggctcgcgctcacaccaaaaaagcccgatcatcatcgggcttaggatgctgctctgaaactaatgactaactttgacggcataaacaacgcgaatcggggttgagcggactcgcagtagacgtgctgcctcttggttgccatggctggcgcggatacatagcatgcgtcgggcctgtttagcgactaacagggttggaaaatcttttggaaatagtaaagcgaacaacgcttcgttcgttgcgccaatcaatgataagggacacctttctgcttgctgtaatttgtgcatagtgtagcatgtttcttctcaggcgccaagagaatcttgaatgttttcgttattttaatctaaatgttactttagccatccgccaatcatgaaattgggttgaacacagaatttttcagaacccttacctctgtatgtaaagacgaataagctggggttcgcacggaccatcaagttcattgcaaagcggttaacaatcgttccaaggtgacggtaagcgcttcaggatctttaacattggtggcgaaagctttttccagcacctgaaacagctcatggacttccgcagccgccgcttgtccatcagccgtcaaaaaaagttgccgctcgcggtcactgtgcggcgccatccgtttttctagcagaccttgttgaattagccgcttgatcaggttagaaacactcgccgggccacgacttagatccacgctgatctggcgctgattcgtaccgggatgtgcagcgacaaaagtcaacaccttagcctgatcgctatttaagttgagtgtgccgagatgttgattaagaaaatatttttgtaatttagccagctgataaatcaagccggaaatgtttgtttcggtttgcatgtcgaacctccatacccattagcatacacgtttgacttgcaaacacaacagtttcgttagcgtcttttctctgaatcccaatagcaaaccgcgtcacaattgaaggacatccaaaaagacgcctgccacaatctcattgtatacagacgcccttgtcttcttggcgcgattaatcatcgctgtctttaataagctcccatttgcctgaatcatcatcgtatttgctcatttggtcatgaatctcatcgtagcggtatttattgtacagttcgccactatctttgtcgtaaacatcgacttctttcatgttaaccgctggcgatgtgacttccacgcggtaatcgtcaagatcaaaatcatccagatcggcggccattttggcaacatcgcggttacttagatcgccgctgctgctgttgtcggtctcatctgagttatcgcgactttctgcacgtgacgcgctggcattagcgagtgattcactggcggcttcttgagacgctgccagtgagctagatgctgctgcctgcgatgcggacgccgaggctgaagcaattgaggctgaggaggcacttgctgctaaagcactggccgaactcgaggcggcttcttgcgtctgctgactgcgattttgaaaatataagacaccgcccacaatgacaaccgcagcgagtaatgctagcgtcacaattagccatggtcgtttcgggtggttgggggatccgccactggtttgtcggcgacgggtcaccggtggcacgctgcctgattgtggtcctgacgccgatgctgagctcgtctgaccgccaacattttcctgctgattagctagcgcagcattctgattttctaatcgataggccttaagattgaaaccgcaattgtgacaatatgcttcgtcagcgctaacctgaacgccgcaatgtggacaaaattccatttctacttcctccgtttttgatatttggtatcttactaccctgtcatatcaacgattgaacgccaagctagcactgacgatcgcaagctgtatgcgctactcacttatttttttaggaaccggcagctgtcgcaacagccattgataagcttcaggtaggatctgttgccaataagtaaaaccgtgcgccccagcagcgctccagtgcgtagtcggatttaccccggcagccgtgagttgatcggaaaactggctaacatcctgaaatgataccgttgtatctgcctgaccggaagcgaggaaaacgtgcaacccggcagtgcgatcacctgtcaacattttagccggcgcttctgcttcccactgtgcctgattccattgtccggcacgcaaaaatgctggcatccgtggccgcgcagcttcaggaacttgttgccagacagccggtgacagtgctgcaaccgtgcgaaatgctgtcggaaccgctaacgccagatgcagtgcgccataaccgcccatcgacatgccgccgaccgcatgggcatccgcctggggcaatatggcaacttgctgctgcaaatgcggcaataaatcctgcacgatcgctgtctgcattttttctgctggcgaatcaacgtaaaaactattgccgccatcaatgaaaaccacgactgcgggatgcttagtggctgtcaccgcttgatctaacatggtttttgaatcaaccaacttcaccagattggttgcatcaccatccatcccgtgcagcatcaagataagcggatactggcgtgatgaggtatagccagccggaagatacgtgaaatagcgccaggaacgattcagcgtcggcgaaaagaaacttgactcattgagactgctagccgcttgtggtgacgtgacactcgactcagatgaagttgatgcgctgatagtgctgcggttaacgattttggaagcagacgccgatgtcatctgccgtggcgttgacgttgaagattgacccgattttgaaggtgcccaagatggacccccccagatcaaaaatacgaccgcgatcatcaaagcagtgattaaaataccaaagattcgcttacgccgttgcatggttgtgcaccttaacccaagccaatacgttcctttgtttcggtttcaaacccttaccccataactgcctcttgtgaaggacttctttatcgtacaacactcaacaccaatacagaacatattttattttatcgcaacaaacgttcagttgcgaaacgcgtcaatcacgtcgcaaaagccgtgccgtgacgaccatcactaatgcagcaactatcccgacaacataaccaataccaggattgagcaacccttgaatttgattcgttccgctgctcattaacggtgcataggcaacatataaagccgcataccctaataatcctaacatcccgccaagtcgcatcatgccgcgcgcccggaaaagcccaaacactaatcctaaagctggccccacacctgccaacgctagcgctacataaggcagattaacctttgccgcacccactgtcccagtggtagcagccgtcgtttcggccaatgtactggcactgcgaaccaagtcatacaaactgccgcccaccgttgtcgtaccaaccccgctcgctccaaaaggccaagcataagcggcaattagggcaagaaacgcggccgctaaataaaccagccagatcaagctgccgcgccgatgtgattttccggcaaattgcagccaccaacgcgacgaaccgccactttgggaattaggtgaaaaatttggctgacgattaggcgtcgaatacggaggcacctgactagcttgtccagatgaaggcatcgtccaaatatcatcatcatcggactgatcgctacgattccgcggctggtaaggtgccaccggtcgccggttcgccacgacataaaccgccaccgcactggcaactgcaagcacccaaccgatcaagaccgaaaagctaaagacacaaaataacaccatgacgccaattaacgtatacacaatgtgaacagccagccaatcaagaaaatgctgaaagctgtcgtcagttaagtctaggcttttcttaccggccggcgtctgactttgacgtcgccgagagcgctcaccaactgttggctccttgtcagcaatcgaatcttgcggctccgcttgtttagtcggtcggctttgcgtggattgtgccgctgtttgtgccgcaatttgggcatcaaaacgcaccaaatccatgccgcaatttggacagaacttaacgcctgccggtattttaaaaccgcaatttggacagtaccgcatctttccagccaaatcggtttccctcccatttttgttgtttaaatccatcttgcctgcttccgccaaaatagtaaagtttctgccaactttttaacgaaaagcaagcgattttgcaaaccatgaatggcatagtcagcagtcatcttgccgctgaatttttgtgaaaatgaacattggctgcttccaccctcacttacttatgatcgttccgaaacaaaaggaactgggacacaattctatctcaggatgtgatgcttactaaagtccgaatactttaatagaatgggtcattaaaacagttccgggccgtgccaaactccgcaatctccggccagatggggtggcgacgcgaagctagagcggagacggcgcttggagcctgcaagcccggcagtctccaagtcgcctaacaacatacccccgcgacaaaaaccggtcgctgtgttgtttccacggctgagccccatctggcctacgattgctccgccttggcactaaagtccttaaagtctatttacactaatgtaaggaatctaaaaagcaaaccatttctcgattttagcgagaaacgattcgcttttattttgaagctgtgaattgttgctcagcctctttaagttactagcttattctagattaagtcagtgcatccgctacttttaagcttttcaagcggaagcgccatcttcacgacaaccgcttaaaaatggcggtcgaagccatggggaccacctgccccaaagctgccagggtagccgcggcggggaccatgatgcccgtgatgaaagcgctccgcccacgcccgcatatcgtcaaactgttttccttctggccagctgagatcatcgcgattagccaaatccgccgttaatttttcaattaatttcaacaactcagcttgttcatcgtcagtcaaaccgctaaaaatttgatccggtaaatcggttttcagctttccggtggtttcaatgaatttgcggccatcgtcagtcaaagcaatgagttgaacccgtttatcggtttccgattcatggcggttaatcaggcccagttcttccagtttctgcaccaaagccgaaaccgagctagggcgaatgtctaaagcttcgactaaatccgagttcgtcagttcaccgtgctgatcgagtaagcgcaacaaacgcaattgattaggttgccgctgctgatcaccaaaacgcaggctgctggcgatggcccccataaatggccgcttttggagtaattgcccgaatgcttttaataatgcttctgaagtttgtgtcatcacacttctccttttgaatacgaggtttttaaaagttagttttgtttatatccgactaactgacattagtatagccatctatttagttagtgtcaattaagactaacataaaatcatcaagaaatttgagtgaccgcctcaaaacaacccctgagactgtcgaccacaagttccagcccaatgttgtaatgctcttcattgccactctggttccaaatgctagcaaaaagcccgcccctatcattcccgggcggactttactttattgaattgctaactttttaatgttgccgttccccatccagataagcgcgaacgcacgcaatcatgtcgcgtgattgcgtattgaataatggtggcaactgatcgaagttaaaatacttcaaggcaagcgtctcattcggatcagcttgctccaaaccgccacccactggctttaccagatatagtcggcagataatctgggcctgatcgccatttggatacgtggtaaaaccctgctcaaaagtgtgtaacggcttgacaggttcaaccagcaagccggcatcttccttcatttcccgtttcagcgtctcaacaaacgtctcgccatactccatcatgccaccgggtaaactccaatttcccgcgtctgtacgctgttgcagtaatatttgtccttggtcattgacgacagcacccgcaactgcatttagaaaaatcggcatatgcccgaccttgctgcggatgtcttttatataatttgccacttggttgcctcttttcttgatttcattacattgattattcaatagatgcttggcaagtgcaagcgactcatcacccggatcaagatttcgcacacagttgctggagccaaaaactgacccgattttctataaaaaattctaagcaacaccatacaaaaacgaccatcaccctcaagcgtcttatcaacgctcaagggatggtcgtcttttcaattatgcaaatgagttagcggatcattagtccaacttggtcttgctgttaacgttcaacttttcatcaaagtcataaacaaccggttcgccagttgccatttccaagttcatgatgtcagcatcggaaatgttttcgatgtacttggtcaaggcacgcagagagttaccatgtgcggcaataacaacattcttgccgtccaacagatctggtgcgatgtggtcttcccagaatgggataacccgttccagcgtcactttcaggttttcgccgccaggaatgatccgcggatcaaggtcggcataacgacgatccttagcagcagagccttcgtcagttgccttcaacaatggtggcaaaacgtcgtacgaacggcgccagatgtgaacttgatcggcaccgtatttgtcagccgtttccttcttgttcaaaccttgcaatgcgccatagtgacgttcgtttaggcgccaggttttcatttctggaatccacaattggccggattcttccaagacgtagtgcagggtcttgatcgcacgggtcaaaactgaggtgtaagcttggtcgaattcaagaccagcctgcttaattaattcaccggcatgctttgcttcttcgacacccttttcactcagatcaacatctacccagccagtgaactggttggacaggttccattcactttgtccgtgacggatcaatactaatttcgccatatcagagaatacctcgcttttatgatttgacagtcttctgcctgtttacagaatctcatgttacaccattttcagtaagttcgcacccgctttctctggtatattggaaacatagcaaaaagaaaaggtttaacaacgtttgtaattggtgcatcagttacgacacacggtgcgatgtcatcggtagcaaccttgtcagtacagggtgccgctgcgcatcggattaatgtcccttatgacttatgtgctcagtaatttggaggttctcgtgaaaaaaatttggctcacaattggtggtatatggttgatcagtgtcatttattttttgatttatatcaacttaccggcgatgcaactggcagtgaatgaaaacggctttttatcgttggttcatggcatcatggatctgatcttacttggcggtacgtttgccttagttgcaggaggcctttatcgtttatttcatcggcggtaagaaatttcccgtcattttagtcagtattgtgtctgtcttttgttatgattaagtgacgattgtttttgaaaatggaactgggtttaactttggagggaatatcatgtttaaattatgtccaaattgtggggcacataacgcacccactgctaacttctgtacaaaatgcggtgcaaatctggcgggggtggccgccactcaaccgcaagctccggcaacccctgacacaaccaacggagaagccgataccgttagtgcgactagccaatcacctgtagcaaccgcaccaacggcagacgcaaaatctggagcagcaccggaaaccacgaaaccgatttccactcaaaccacccaagctgatacggccgccgattcacaagctgcccaaagctcggaaagctcagcggccgcaacgcaaactgcgccgactaccgacaatactgctaccgatgctccaaccagtcaggcccctcagccaacgccacagcctaatccaaccgttgaggctaccaagcagtatgcgggcagttactggcggtatttagtcgatagtattaagcatccggccagcattgagcgcacttatcatagttattttggactgaccagtctggcgattaccatcgttagtctggccttgacgattgctttgcgcgccggctcggctttttcatccttgcccggcagccttgccagttctgtcatgagtacatttttgaagttgctggtcttagttgcgattctggcgattggcgtgattgccatttattatctgggcgttcgcggcatattaggtgatcggcggcgacgttttctcgactttacgacagattatgcgttccactgtaattggatggtgttcttctccgtctttaccctgttaatgcagatattgggtctcatcaacgttggttcggcaatgttaatttcgttattattgaccatcagtcttagcctctttttcttagccggtccttatatgctatttacggctcagtcaactaatcatttcgacaagatttacgcccttctcatcgtcagtgtgctactagccattgtcttcatggtgattaccatgtttggtcttgccagcatcatgggtagcctttatcaaggactcaacgattttggccgctcgtttaattactaatacagctggctcaatcgcgtattaaccacctggaatgcttgtgccatcagtcagacgcataaggcactcgcgctaaaaaaacaagcaattgccgttcaacccaaaactggtcctaatgacatctatcttctgtcattaagaccggttttcatgttcccgcctgtttattccactaacgcttctaagttctgcgccagcgtcaccgtgtcggttgtcatcgtatgattaccaaacaacacaacgccgctggtcgcattagcacgaaaataagcaagggtactgaaactttccggattgtcgttgtacatgccttgcaataaacgctgatcgtccaaccacgctaccccgctggcatactgattactgtctgcataatgtgccgcgattaactgatgatagacttttttaggaataatcttcccggtttctgctgcaatgatcaccttggccaagtcggtcacgctcatgtagacactcccactgccaagtaaactcgacaaaagcgcctggcttaaatcatccggctggtacgattgatcatcttcgctcagataaccttgcgccactggcattttcgccgataacgcatcgaagttacgggtatgtgtgagttttaacggtgccagaatcgtttggtctaatgccgcagcgaaaggcttctttgtgactttgcgaataatccccgctaataacgcataattggcattagtataaataaagctatggtcgccggtggatcctagttgattcaaattccagtcgagcgcgtttttttctgatgtcagtatttgctccggtgtaagttcatccatttgaatgcccgagcgatgatccagcagctgccgaatggtaatgtcgcgactatgatcaatgtcgggataaaacttggctagcttagtggtgaatgacagccggtgatcggcaatcagtcgcccaatgacaagcgccgttaaatacttctctaccgaggccagcggaaacatcgtcgccccattattcgccaatttgcgcgtatgatctgcttcaccgacaccgcctgtataaacaatccggccttttttgatcaaggcaacactgcctctaaagtcggtcgcatcaatcagtttgcgaacatgccgccgcaactgtgcttggggaaccggtcgcgccgtaatcttactggcttgacgctgatgctggatccagcccatcgtcacgccgccagcgacgaccaaaacacctaacaccgccaaaatgatcagccaccggcgtttacgcgtcattttcatgatgctcctttggctgtgggacagtgtcataagtcgaatgatgtgctttggttccggcaatctttttgacccctaagacatccaggaaaaaggtgaagatcggaatacctacgatcaagccccaggtcccaaagagtcgttctgccaccagcaacacgacaaaggtgaagaagacaggcaattgcgtgcggctactcataaacttaggattcaagacatatgcttctaacacatgaatcgccgcaatcatgatcaaaatggtgatgacatcttgccagccgccaactgtatagccgatgatcgtcaacggaatgagcgaaataatcgccccggcaaccggaataagcgataacaggaaaaccataatcgccagactcggaatattcggcattttcataaacaacagcgtaatcgtcgtaatcaccgtgttaaccaccgcgataaagatctgggcttccatgacaaccccgaacgtattgatgaatttcaaggcaaaataacgcagatctttaaagtaccaaccaaacggtgaatccaaaaacagttgcccaaatgccggtaagctatccaactcgatggtaaagaagaaacttaaaataaacgacaacaccaacgtcaagcccatcgcaccaatgttaccggcatattcaagaaccgttgacaggccagtcttaagttgttcggtgaggttcaggctcttggtactctgcaaaacccactgcattacctggttgttggcaaaggcatcgctgttataaaaatcctgtaccgaattaaacagcgtgatcgtttggtgaataatggctggaacataatggaccgctgcatagatcaaccctaaaatcaccaatatgtaaacaggtacaacgatcacaaacggccgaacatgaacatggcgttgaaccgcgtgcactaagcgactgactagaaacgcaaaaataaaggtcaacaaaatgtcgctcataatgctacgggcaaaccacaaaaccaaaaaaaccgagaataaaaccactgtacgtcggactggcacattgttgataaacttttcgtacgctgacatcgtcttccccaccatccatttttcgctagttaaatcttagcgtgccgcaaaaataaaaaaagtgcaagcattcgccagcacttgttcaaattataagaaaattttcagattcttttgatttgctttcttgaccgactgaagttctccttgcacaatgatccgatccacttcgccttctgtcggtgacgcacatgtgactaaggtgatcagtttcttccctgccacatcatcgatccattgcacctgggtttcgttaacaatctgtttcgtggtcactttgtaagtgtaaactttcttcatattcgtaatcgcgactgtatcgccagtttggacatttttcaaaggtgaaaaaagaatcccttggttggtcatatagtggccggctaacgcataattgccttcacccatcttctgatcagccttcatcgtcccggcgccggcactcaggttatcatttgacagccccttgagaatcggcaacttcagatgaacgctggtaatggcaatcttaccaatcggatgcaggttacgggtcaacgcggcattcccgaccgtgttgatatcaagcgctttaacacctttaaaatcaaacgtggcacttcttttttcgttcttatcaactgtattgcgatcaatctgccccatcgtccattggcttaaatgatcaacgacaaacagcttaatcggttcgttgaaaaccagcgctaagcccagaaggacaccgagcgcaaaaatcgtccgccatagccagcgatgcttacgtggggactgttgtttacctgatttcgtcatcgttatcctccttgcaaagagcataccttgaaacccactgagattcaagcaggcccatgacacccaagtctcagcctttcgctaacaaattgtaagtcaattaggcggataaacgcaagtcaacagctcagtcgtttttttagctgcgcactgacaagggttatcgttaatgtcagtctcgcatgaaccttataaaaagcatctcactaccactcagcttgcatggtatactgacaccattcgtgcgcagccaaacactgcattgcatcaaactcaaagctaggagagatttaacctttgaaaacgctgattcatctatataaacgctacgaaatgatcatcaactacttatttatcggtggactcaccaccttgatcaatttcgtcaccttttttgtgatgcgctattttgatattggcttggtcttaaccaacacgaccgctaacattgtcagtgtcatttttgcattcttcgccaacaaaagtgtcgtcttccacagtgactattcaagcaaaaagaaattctggttcgagctaaccagttttctaatcctccgtggcgtttcactgttgctggataacttcattatgattgtcggcgtggactggcttcacggcaacgagatcctggtcaaaattctggatcaaatcatcattgtcgtcgctaactacctgttctcaaaactgatctttgtccgcaaacggtagctatgcttatcgagttctagattgttaactaaaacgtgccccaaaagtaaaaaccgcttttggggcacgtttgcgttttcatcaatcaaattcaacccaccgaaacatgatgcgccgctagaaacgaactaaacggcaccaaattatcagcataataacgtttcttgaaggcagcaattgtagcggcatcgaaacgatccggatctaactgcagatgctcgaccgggattggccgctcattcgtaattttggcatcaataagtgttggcttgccagcgatgcgattggcctcggcttcatcaaacgcagccgcgagttccgaaaccttggtgacggtcaaaccggtcatgcccattcccttggcaaccgttgcaaaatcaattgctggcatatcaacgccaaaccattcgtgtccgtcatcttcttgctcatcttcaatataacctaatgcattatttgaaaaaacaacattgataatcggcaggtgataccgcacttctgtatccagatcctgcatgaccatcgccgcggcaccatcaccagcaagattgaacacttggcgctgaggaaaactcaactgtccggctaaggctgccggcaatcctgcacccatcgtggcgaacagtccgctggttgtccacgcttgccgaccattcactttcaacaagcgcacagcattttgggtgacatccccgacatcaatcgcaaaaattgcatcatcggtcgcaatgcggttgatctggccaaataccggctcaaagcgcatatcgccagtggtccgttgcatcatgtcatcattgtactgatgccaatttttgacgttatcgacattggcctgataccagccgctgctaggagcctcatcactgtgggcaatcattttcttcaaagttgcgggtgcatccgctaagattgccacatctgtgtgatgccgcttgcctaaggttttgggatcagcttcgatttgaataaacttggctttaggcgaaaacataacttccgcaaatggataattcgagccgacaaacatgatcaaatcggccacccgcaatgcttcattggccggtttcgatgcgacccgtgcagccgaacccaagagtgcttcaaaggcgtacggaataatcggcttgcccagcgctgtcgttatcactggcatctgtaactttttggctagcgtcatcaccgtatcagctgccccgcgaacgccttgaccgacatacatcaccggccgagacgcggtacgaatcaatcttagtgcctgatccacctgttcatcagtgccggccgctaaaatcggggtggcatgggtcgccgcggcactgtaatacccattcgccggaatcaactcggcggccaagtcgttaggaatcaccacaatcgccgcaccatgagcagcatatgcccgccgaatcgcctcatcaatgacatgcggtaaactctgcgctgtggtgacggtacgtgcatagacagccgcatcctgaaacattggatcttcatctaattcctgaaagaaatcagcattcataaaccgttgttccacttggcccactaagaacaaagtaggcactttatccattttggcatcgtaagcgccttggaaaagatgcgttgctccggggccagctgacccgaacgccaccccaatatgacccgtcagctttccatcggcgaccgctgccaaggccccgacttcttcatggcgcacatgaatatacttgatgcgcgacttttcctcatgcaacgcgtacatcatgttattaaatgtgccaccggggatgccgtaaatgtgcgtgacgccccaactctccaaagtttgtagcgctgcaaccccagctttaatcgtctcaaccatcataagtcccccttttatttaaaaaccggcaatctgaacctgccagttttggcgtgttattaaagctgcttccgcggttatactaggcacgaaaagatgagaaagcaaatcatctgcctatgtaaaaacgccaaggatatgatccgtcttcatgacgaaccgtaccctcagcgttttaatgatggttacttcaaatcttcaatgctattgatattcttcatatactttggaacggccaaaccgacccgagcgccatccatattcacgccaagatcaacaacctggttcttataatcggcgtataacttggcggcagtgtttggcaaccacgccgatacctgtgcatctgctgctttagtcgcaactgatgcccaaaccggctgcggctccatcgcgcgaatcgtcactttataacccatttgccgcaaaacggtcgccacaacgtttgtggaggcaatttccgaatcccaggcaatataggtcagggttaatttaggactaccgctaacatgactaacacccttagtccattgagcaatttgctccggatgtttcttcacgtatgcttttgcagctgcagcaggatcctggccattgttcaccgccaacatcacactagaaatttctttgggcgtccagtgaaattgatcaagcacctggtaggcttgcggagcatcttgcttaagccctttacgcacaatcgtatgaatctgttcggctttaccatagacattcttaggatccttcaaaaatttcaacggaaacttggtgaacatccagtgcggcgtccagccggtcaccacaatgggccgcttatcggcaatcgccttttgcagtgtactggtcatcgccgcggtcgagcttggttgcaactgccaattcttttcttccagtccgtatgccttcaaggccttatcggtactgctcatgatgccggcacctgcatcgattccggtaatcgtatagttaatttgcggccctagaggctttttggcatcgtacttaggttgggtactgctgcatgcggtcaaaaagccaaccgtggctaccatcgccagtgccgcaatgatttttttataaaaagtcaaacagccacctcctagcgcgtgcgattgagactttgggtaatccgatccagaatgattgccagaataacaatcgccaaaccggcaacaaacccgccgccagcgtcgttacgacccacagcaaagtaaaccttggtacctaggcccattgccccgatcatggatgcaattacgaccatggataaagccaacatcatactttgattaatgccggccataatggtgccgcgggcaaagggcagctgcactttgatcagctgctgccaactcgtagcaccaaatgcaacggctgcttcattcaagtcagctggtacctgttcaattcccaattgcgtcatccgaactgtcggcggcatcgcgaaaatgactgacgcaacaacgccgggaaccatcccgataccaaagaatgccacggcgggaatcaaataaacaaaggctggcatggtctgcataaagtccatcaacggcttgacaatcgccgaaacggttttactttcagcagcccagatacccagtggaatgccgatgacaattgccaacaagcttgcggtcagaaccaaggtcagcgtctgcgtcatatcgcgccaaaatcccagattccagattaacaacagccccactaattcgaaaatcagcaaactgcgatacttctgccctcgcttaaggtaccaagtcagcgccataattaagatgataaacagccaaatcggaatgaaatcaaagaccgcttgaaaggcattgacaatcgttccgataaagttcgtcagcacaccgaagaacccggcaaattgagtgagccagtccacgaaggaatcaatccaatgtgctaatggtaacgttgggatggtaactaaaagattaaacattgacattgacctcctgtcctgagagtgcgccaagaacggcaccgcgaatgataatcccgcgaagtcgtttctgatcatcgatgacagcatacggaactgaagtagtcgacacagcatccagcaggtcagctaacggcgtatccatttttgttgtcggtacgtcggtcttaacaatcgtggttaagtcctttttcccgctatcaatggccgcacgaacatcatcggcatccaagattcctactaattgtcgcttggtgttgacaacatacaagctggaaatctcgttgtcacgcatccgccgtgctgccaaacgcggaccatccttgtcgatattcacggtgttagcgcgaatcataacattagctgcggtataaacctgactccgatccacaccttcaatgaacttctcaacgtaatcatcagcaggttgactcagaatctcttctggcgtcccgatttgaacgatctcgccgtctttcataatcatgatgtgatcgccaatccgcaacgcttcattcagatcatgggatatgaaaacaatcgtcttgtgcatttcttcttgcagatccaacaattcgtcttgcatatcccgccgatttaacggatcaagcgcagaaaaggcctcgtccattaagagaatctcggcatcactggccaacgcgcgcgccaagccgacacgttgttgcatcccgccagataattgatcaggaaattgatcggcaaacccgtctaatcccactaaatcaagcgctttgttggctttagcttcacgttcggatttatccatcccctgaatttccaagccaaacgccgcgttttgtaaaacagttcggttaggcaatagcgcgaagccttgaaataccatgctcagcttttgccgccgcacttcacgcaggtgttgcttgtccaacttggcaatatcatcaccatcaatcagaacttgtccggcagtcggttcaattaaccgattcagcattcgcagtgtggttgatttacccgaaccagaaagccccatgataacgaagatttcaccttttttaatggtgaaatcagcttgatcaacacccacggttgcgcccgtagcctttagaatctcagccttggttttcccttgctttaacatttctttggcacgattgattcgtttgccaaaaatcttggttaaaccactcacttcgattttggtttcagcatcattttcaatcttgtgttgcatttgctcactcctctcaggccccttaacgaattaagatatcgccttggtgcccggtactttttaaaatcgctacttacctgatgttgcgattttgttctgtttcagaaacagttgtcatcgaattgaaacaatgctaaccattgtacgagtcatttgtgtgtgattcaaatcacggaatctcattttcattttcaagacacgctggcgttttcacttgctgaaaattttagccacaacaaaaaagccctcatcggcataggattgagggctagggacgattgatgacccgctaatcgtgcatcgtaatcgttgtcaagttaatatgaaaatatcatgaccgaattctcatatttcacaaactcgtcaggttcatttccgtaaatggcagatgctcgtcaaacaggatcggctggcccaaagtaataaaatccggacccgtcatcgtgtcataagccaagacgcgcacaccgttttgcttggcagttgtgattgcggtgacaagctctggaaaccgttcacgataaatcgtcatttgctgaatattgggtaactgcacaataaaaaccaaaaatgcctgatagcctgccgcttgggccattgtcagcgtgtgcacatgcttcagcgctcgcgtggtgggagcatcgggaaacgccgccaatgtttggttggctaatgtgacgcctttagtttcaacaaaccatgattggccatcagccgcagttcccgcaaaatcaagccgggaatcgcgccaggtggtctcgggacgaaccgcataaggcaaggataatccgggcaatttcatggtgccagcctccaagcattctctggcaacgtggttgggggctaagctgtctatattaatccaacgattctgccggtttaccgcaagcagatcatagtgcgtcttccggttgggatgattcacataacggacactggccagcgaacccggcactagaatttccttattccggccagtgttgttcatatgtaccgatgtcgtcacgccatcaatcgcaagttcaaccgtaaaccgactcacgcgccggatcagttgcccgacactgacattttgatactgcataaacgctcctcatttcgattttgcctgacaggtagcatagtgcttattaaccgcgctgacttatgctcataacgtgtttgctggcgcagggatttgcgtgtaaggaccttggttgcagtggccacttatgttctggtttacgcccataacgcgctccccggcgcagaagtctgcgtgtaaggacctcaggcgcaatggccaaagaccggccatcacgcctgaggccacttacactccgatccctaaacgcgccggctcgcgctcacacaaaaatagcagccgcggactttaatcaaatctcacggctgcttatttgaatcatagcactgacaattaacggacaataataacggataccgctgcatcgcgggctacttcgcttgcaacgtggcccagtcgcagacggccacgacgtacgtgtgaacccatgataaccaagtccggcttgaacgctggaataacctcgtcaagcagtgccgctgccggtcgaccttcagcgataatcggctgggccttctgcacgccaaactcacgggctttttcaacataagtattcaggttcttcgccattttttcccgtgctgcttcaacatcctcaggcgtcaatgactgaaaaatattcagatcgccggtttcaagcaccgatacaatccccagcggaatatcatagatcttggcaaccgtgcaggcgtagttcaatgccttgcgcgaggagtcgtcatcatcatcatcaatcgccaataacagccgattataatgtacggattcaatcgttaaatcattttcagtaaccaaaagaaatgcccccttgcaagtttaggtgtccctaacatgtttattttatcacacatcgcctttgttttccgcaaaatactgcttaaagcgaccaacataattatgaaacatatatttcagtaatagccagcgtttaagcgtcatatctggtttgtaaaagaccgtcgtcccgtagcgcttttctttgatcaacttcaacgcttcccgcttggcctcgttgtcggcggagtattgcttgaagacccgttcaggcaccccaagccataatttgtacttgctgcgatcggaattgccataaacagtcggcgcatttttgagatcgccggtgatataatcgcgcaccggccagctggcaagattatagccattcagggtcacgaaaaagctgctgcgaccctgccgaatattaatttcaaataacttaaacgtgttgtcgcggtgatcatacttcatatcaaagttagcaaaaccggtaaacttgatggcttcgagaaattctttgatttgatcatacaatgtctgatcaaaagccggcataatcgccacataattcccgatggacgctggtgtgggatcttcaagtagcggatgacccagacacatcattttgacatgatgatattggtccacataacaattcaacgtccgcatattgctgtcatcacccggtacaaagtcttgaagaattaagtcagatgtatacccattgtcataaatcttggcgatggtgttggtcaattcgacttgggaatgaatcgtgaatgcctttttacgcccttcaaagtggatattcaaccattccaccgaatcggtcggtttcagcgccactggaaattcaaatggcgccgtaattgtggcgttgctttcatacattgacttggtcacgatcttagtggctgggtaaggaagatggtattcttcacaaacctggtaaaagctttccttactgttaaggcgttttaaaagatcatagtcaacatatggacagataaaccactgacttaattcatctttatgtttggataccaattgtgcatatgtgtcaccgcacgcaattagcagcagacggccagccgaagccgcgtgcagatgcgcaacttcacgcattttttcgataaaagtcgggtcagaatcaaattgcttaatcagatggacatttacgattcgtgaaaagcgtgttggggccagctgttcacgcgcatagacatcaatcgccccgccgatcatctcgtggaacgaacgcgccataccatacacgttcatatcactgccaagcaggatgggggtaaaactaggtgtatctttcatctgaatgataatctcctcgttcgattaggtgcgggcaaaagaatgccgggtaccatgaaattttcattgaaagtgcagtggcaagttgtctcagcgggtccaaactgcactaataattttccctgagcggttggtcaaaatgaatattgccttcagctcgtcgccccagaattataccatactggcaatctgcattcatgaagatactaataggataacagtttttcaagatttagacgcaaaaacgccaagtgtcagggcttggcgttttttgatattgttcagctttctgaaacccgcaccccttctgtactcggctggacgatctgcacgcgccatgctggccattgttggctggcggctgcttgcaactggcgagcagccgctgctccctcaacgattgcaagcatggtcgatcctgaacccgagatcaacaaaacgccattggctgcggtaaccaattgacggacagcctgatagtccggaatcaatgtggcgcgataaggctcctgcatccgatcatgggccacttgatgtaaaagcggtaaatcaccatctgccaacgcccgcgtcattagaacacatcgtcccatctgataagcagcatctgcgtaagtcatcgttgtaggaaggatttttcgtgcttctgcagtgctcacagcataatcagggatgaatgtcactaactgcaactgtgagctgaccggatactggcgcacaatgggctctgcatctgccaaaatagtcgcacacagctgaccaaaaattgcaggggcagcattgtccggatgcccttccattttcgctgcaagcttcaaaagctgagtccgatcccagccggcatgaaaccacgcattcgccgcggcaattccgccaacaacacacgtggccgaacttcccaagccgcgcgaactaggaatgttcgaatcgaccgtaatccttaaatttggcactggttgatcaaccgctttggcaaatgtcacaaatgcctgataaatcaagttatgctcattggcaaagtcgggatcatccccaaaaatctcaagcttttgggtgctcgcttcgaaggtgaaccgagctttgagatcaagggctaatcctaaaacgtcataaccaacgcctaaattagcgcttgttgccggaacggacacgctgatcattgttaaaaacctcctttgcggctgcaatgatcgcctggcccatttcttccggcgccaccacgtgtttaggttgggcagtcaaagttgccaagcgcgctagattagcaggaatcggaacaccactcatttgatgcaactgggtcatcacagcaaagtcgtcacctgtcaccggcaagtcaagggcttgagcaaccgcgcgtggaaatttgtatggactagccgttgcgagtagcacattaggggtcgaatcaccggttgtctcccgatattgctgcatcacatggtagccgacagccgtgtgaggatccaacaaatagtcgttttgcttccaaaccgcagcaattgaagctgcaatctgtgcatctgcggcaaaaccgccagcaaaatcagcctgaatcgctgccaaaacatcgggccgtacctgatagcggccggttgtggccaattcttccattaatttagccacataactgctatcttcaccactcttatagtagagtagccgttccaagttactggaaatctgaatatccatacttggcgccaccgtctttaggaacggacgattgcgatcataaataccggtttcaagaaagtccgccagttcatggttggcgttggccgcggcaattagttgatgaatcggcaaccccattaacttcgcatagaaaccagctaggacatccccaaagttgccagttggaacagtgaaattaaccttttgaccaagctcaatggcacctgattcaaccagttgcaagtaggcggaaaaataataaaccacctgaggaatcaaacgcccgatattaatcgaattggcggccgaaagcgttacttgttccgcctgcaaacgcgccgcaaaaccggtgtcggtaaagagatctttaacggcactctgcgcttgatcaaagttaccgccaattgggaaaacccgtgtgttattgccggttgtcgttaacatttgccgctcctgaatcggactaaccccatgatcaggataaaagacggtaatcccggtttgggcgacatttttgaacccttgcaacgccgcagtcccggtatcgccactggttgcggctaagatcatgatgcgatcttccggatccagtgccaggcgcatcagttgcggtagtagttgcaaccccaagtctttaaaggcgctggttgggccatgaaacagctctaaaacatgaaaatcacccacagaccgaacaggcgtcagccggcgatcagaaaaatttttatgataggcaaattggatcgcctttttcaacgcagcagtgttaaaatcaggcaacagggtcgtgagaacattctgagcaatcgtttcataatctttacctaataaattttgaagattcaagcggtaatccgttagatgcggtaaaacaaataacccgccttcttcggagatgccttgcttgatcgcttgttgtccagtcttgctaacgcgctgatcccgtgtacttgtgtatcgcatgtgaacgactcctatctgatccgacttgtttttggaataaggatatgataatctgttcgcattagaaaaacaagtgtctatattttatatacaaggagctgaagaaaatgaatattgccatcttaggttttggtactgtcggtagcggcgtttatgacatcgttgaaaatggtgatcgccgaatgcgggtcactgctattttcattcgcccaacccacccagctacgatgcctgagatgacaacaaatttcgacgctatccttgctgaccccaacattgatgttgtcgttgaggctattggcggcttgcatcctgcttatgattatatcctacgtgcactgcagcacggtaaacatgtggtgaccgccaataaagctgtcgttgcgcaacacctgcctgaattcatcacaacggcggctcagcatcacgttcgcttttattttgaagcaactactggtggcggcattccctggattcgcaatttggaacgtgctgctcgcattgaccaaattgataccatcgaaggcatctttaatggtacgagtaattatattctggatcaaatgcagcgggcgcatctcgattttgacccggttttgttggcagctaaagacatgggttatgccgaagccgatcccagtgcggatatcgacggtgatgacgtggtaaacaaactcaaaatttcggccgccttggcttacgatatggttccgccgcgcgatgttcctaagtttggcattcgtaatgtcaccaaagccgatattgactttttcgccagtcgtcatcaggttttacgactaattggcaagagcagacgggttggcaaccattatagtatggtcgttgaaccgcgcctttatccggcgactgctttggcggctaacacgtttgaaaacttcaacctgatccgactgcacggccagaccattggcgatttgcagttttatggtcaaggcgccggtaaatatccgactgctaatgccattgttcaggatcttttcgacattctggaaaatgccccgcatctgacgcggcactttgatcagaacttacaattcgatgcagatctgaatactgctgattacttgctgcgagccgatccgatcacgtttgccatgtttaacgataaagacaccgaagtcgttcgggatcatctcttaatcaaacaaatcccgaccggcgaaatgcatcggctcatgcgtggcgttttggcaattgacgctcatgccttcatggcagccattggcgatagtgaactgaccacccgtaacgttaaagaacaagttgatcagggggtaatcgaatgaaagtcgttaaattcggcggtagttcggttgccgacgccgggcagtttcaaaaagtcaaagccattatcaaccaagacccgcagcgccaaatcgttgtcatcagtgcagccggtaaatatggcgatgcaacccgcaagttgactgataccctttatctgattgcggatggattcgaagccggtcgtgatgtcaccccgctttttgctcaagtggcagcccgactggaagctatcaatcaggctttacatttgcatgtgccgctcataaaactcatgaatacgattcgtcatcacatcgccactcattactcgcgcgattatctggtttcgcgcggtgagtttttaaccgcccaactgatggctgcctatttgggctataccttcgttgatgctgctgatctcctcttttttgatcaaaacggggcgattgatgaagccaaaacattagctgcttatcggcggctaccgcgtcatcatgggatagttgttcccggattctacgggcaaaatgctgccggtcacgtacaaatcatggcgcgcggcggttccgacatttccggtgcgtggttggcgcggctggctcaagctgatctttacgaaaattggaccgatgtttccggaatcaaaatggccgatccgcgaattattcaagatgccgatagtattgacgtaatgagttatgatgaattgcgcgaattgacctacatgggcttcagtgtttttcaggaagaggcggtccagccagtgcgagaaagtggcattccaactcgcattcttaacacgaacgtcccagaagatcccggcaccttgattattcaagatgatgatccggcaaatgatatgcggatcattaccgggattgctggccgcaagcattatctggtggtgacgattcggcaatatcaactcgcattacacctcgatatcattcagcatgcactggacgtcattgctgaccatcatctggtcgttgattatctccccaccggcattgacagttttagtctgttaattcgcgaaccacgccatcagatttccgttcacgaactcacggcagcaattaaagcagcgtgtcagcctgataaactcgaggtcactgaaaatgttgcgctcattgcgatggtttcccgaaagttacggcaacgaccggcaattgccggtaaggtcctcgcctatctagacgacaacctgctcaatgtccagcttgtcagccagaccaatgatgacatcaatttattaattggcgtaaatgataaagactacgacaaagccatccgcgtgatttatagtagtattcatcaaaattttcaccgcccggcgccatacattgaaggaattgcttagcgtattaatttctttagacatcaaccaaaaagtggctccgttgcgattttacaacaatcgcaaacggagccacttttttaattaagctcaatcattctgaatttcactcatgactacttttgcttctcggccatgcgcgatggtgtacttgatgccgcttgctcggtagtggccggttgatcactctttggcgccggtgctggttgcttggtgtcaggcgctttggctgctggttgctcgtggtgcttgatcgcatcgacaaccggttgattaccagcctgatgcatcagtgcgccatttaacatcccgcgaatatcgatgccggcaacttcttgcaacatgtccagttgcttgaccaaactgccgctggtttgattcgtcaggtcgccatcgccataaagcttgatcgagtcaacatttgcatacggactcatagcagcctcaataatcttcggcattgcttcaatcgtcatcttgaagcggccagactcatcaagttgccgtgctgcttccgcttgtttagcaatcgcttccgcttgagcaagcccgatcgccttggtcttgccggcttctgcttccccaatcgccttggttgcatttgctttggcttcggcatccaattcaacctcttttgctgatgcttcagcggccgcgatctgggttgctttttgggcttcggcggcacgctgggctttatacaagtccgcatccgcttgtttacgcacggttgcattcagttcctgttcctgcaactcggcgttcttttgggctaattcaatgtctttttctttttgaacctgcttggccttcatctgttcaacaatcgcggcctgatcagcttgcgcctgggcaatttcttgttgctttttgaagtcagccatcttgacctgctgttcccgttcggcgtcagcaatttgggtctggcgttcaatttcctgctgctttgcttcctgatctgcttgtgcctgttgaatccgggtatcgcgattggcagctgcttcggctacagcggcgttcttcttaacttccgcaatctgcttcttacccagtgagtccagataaccgttcttgtcggcaatatctttgatcgtgaacgaaataatctgtaaacccattttggctaaatcggaactcgccacatcctggaccttttcggcaaaggcatcacgattctgataggtatcctcaaccgttaatgtgcccaaaattgcccgtaaatggccttccagaatttcggtggcttccgaattaatctgctcgtcatttttgcctaaaaattgttccgcagcggttgcgacttcttcctgactggagcctatttttaaaataaccgtcccgttgacgataatcggaaccccttgttgcgtgtagacttcaggcgttgcgacttcaatggtccgcgtatttagacttaaaacgtcccagcgctgcaaaatcggtaaaataaaagacccgccgttggtaatcaatttgacacgattgccattgacatcgcgaaaactgtgcttgccggaaatcaaggcaccggaaataatcagcacttcgttaggcaaagcggtcttacgatgggtggccagaaaaataaagagcaagatcaataaaacggccgcaataatccacggcatataatcagttaaaatttccatcagttccctccttagggttgtgagtagccaaggcatcaacataggcaataccttgtttgagttcaatgatcacgacttttgtgccctgatctagcggctggcttttatccgaccacaacttggccggatatgtctggcgggcgcgtccaccaccggttaccatgacttcgccagtgtgatgatgcgccacatctaacgtcagcgtaccgagtaagtaatcccgatcgctcattgatgtggtgttctcaaccggcgacagtagccgttgcaataacgctaataacggtaacagcaccagcgataacaacatccataagagaccgccaatgatcaatagcgccaccaccccgacgatcatctgtaaccacagttcttgctgtgcccaccatgccaacacgacactcgcctcgctttcaaagggactaaaatcttcctcattttatcatgtaaacggttatacgcctataccaataataaaaatatttagtggtgctttgcatgctgactgcggggccaacaccccgtctctatgtagtctcggtggcatgaagaagctactctttgtttgccaccgactaaagcttcaaaagtcacgtatgttgcgtgaatgcttttcgacctgccattagtcgtaatgcaaggcatagtcttccgatacctgatagtgcagggttttggtaaacagcaaattgctaagataggcgagtccaatcggcaagatgaagaaaatgaccgtcaattcgagcacattccccaccgtcaccgccttcattgcatcaagtgcagcaagtggcccgactaaaccagaaaagccaaatccggcactggcaggcgttccttgaatttgcaacgcggcgccgataccaccaagaatgccggcattaagcgccatgggtaagaagagcttcggtttagacaagatgttggccatttgcattttcggcgagcccagaaaatgtgccagcgatgtcccaagcggattcgctttccagccataagccgccagcgcaaaacttgccccgacaatgccaaggttagcagatccggcaccgatgccgttcaacataatagccgttgcaatcccgactgtactgatcggcgtcacaattaaaatggcaaaaatgatccccatcaaaacccccatcgcaatcggctgcaattcggtaatatcatggacgacaacgccaatatacttcgtgattccggaaaccggtttgagggtgagcatccccaccccacctgcaatcagcaatactaagaagctgtttgaggtctctattgacgagcaagcaggatccctataaaggccatagcaaccatgactttactggtatttaacttgcgttcgcaattgaacaaaagccgtcgccagttggttaaccaactgaaactacgttccacgacccagcgctgtggcgttacttgaccgttcttcagatcactttgtttggcgataatgacatctgcaccaatgattgcatggaccgactgggcgaagttgtcgcctgtatagccaccatcggccatcactcgctgaacaagatcaaactgctcttcatttaacgcgagtaaagcgatcgcaccgtcccgttcggagacattagctgtggtaatgtggatcgcgaatgggagaccattaatatcaacggcaaggtggcgtttaatcccactgattttcttgccgccatcataccctttattttggggtgttgccgtatttttgacgctttgcgcatcaagaattacgaacgacgttcgtaccgatcgtcccattcgtaatcgctctcgagcgacaatttttttaaaagcaggtcaatcagggaatattccgaattagctaatggttttgaccacatggcaaagtaagtgtaaacggtttgccatttcggaaaatcatgcggcaactgacgccattgagcgcccgtacgaagctcgtaaagcactgcattgaagacatcaaataggtccacccttcgaggacatgtacgcttgcgaaacgtctcaaggtcaacgcgaatcaattcaaattggtcacgagtgatattgcttggataatcagtcataatgaagtccttttttcacatattttaccggaaattcaagcgtctttcaaagacctcaaacagtttctaacgatggaatcagaagaatcgtgtacgccttgagcgcattgcccaacaataaaatgactaaatagccaatggcgagggtgatcgccaaattaatcacatccccggttccggcaacactcaagctggttttggtcagatgataattaccggcaccaataatggcagccagtgccagcgaacttgtttgaatcggcgtaaacttcgccagcattcccacgcacacagccgataacgccggtaacaaggtcatcgcagcggtcgtcatatacgtgacaacggccaactgtggaaagctaggtaaaagcaacttgacgagcgcatttaagatcgcgccaggaaccaaggcaacaataatccccactgataaaccgtttaaaatgttcatcgtcacggtttttacatcttgtttcatcgtcttcctccgtttaattaacttggtgcggtgaatgcccaccgactaaaatagttttgacgtcatccaatgaaatatcgatcatgtttttcacggctgcatccgtataaaaaccgatatgcggagaaatctcaacgttcggcaaagcctttaaagtttcaagattggtattgtccacgccggattggctgcgatcaaccccaaaaataccggcttcaccttcaattgtgtccaaagcagcgccggcaatctcaccacgttgcagcgcctcaatcaatgcggtcgtatcgacaatcggtccgcgggctgcattgatcaagtaagccgtctttttcatctttttgaaggtggcggcatcaagcatatgggtggtgatgtcgtccagcggtgtgtgcacggtgacgatatcagccgtggccagtaaggtgtcaagatcgacataacgaaccgtatccgccaattcagggcgcgttaccggatcagccacgatgacggtagatcctaaggcgcgaaaaatgcgagcgacggtactgccgattttgccagcgccaatgatgccaatcgttaattgatgaacttcctgcgcttccagaccaccccagctataatcatctttggcttcgcgcgccgtagcctcacccaaatggcgaatcaatcgcatggcatgagccaaaaccagttccgcaaccgatcgcggcgagtatgcgggcacattggtcacggccaatccattggcagccgcagcatcgagattaacaatgtcatagccggtaatccgcaaagtcaactgcttcatcccgaatgacttcaacttctgataaacaagcggttctggaatggcgccatgctgttgaatgacaaccccatcgtagcccttagccagatcaaccgtatcagcattgaaggcaacggtattggtatcaacttgaatatcattggcagcaacccagtcatcaatcgctggttgttcgtctggtcgaacactatacattaaaattttcttcatcatcattcccctttgagcgcgttatcgtccaactgcaaacctgcctacctaatgcgttgccataaactgcttaatgcgctcagccgccagtttcaaatccgccatcgaggccgcatacgaaatccgcacataaccttcaccgcctgggccaaaactggcaccgggaatcacggcaacctttgcttcacgtgccaacgcataaacaaacttccagctgtcatggaaccggtctggcaacttagcaaaaatataaaatgcgccatccggatgaggaacttccaagccggcttccggtaaggccttcatcagaaaatcgcgccgttttcgataagcttgcttcatcggctgactatcttccatgccattcttcaacgcctcttcagccgcgcgctgggcattggtcgtgacgctggtaatcgtaaactcgctaaccttgccgatttgttgaataatcgcagccggccctgccgtgatcccaacgcgccagccggtcattgcgtgggattttgagaccccgttaaggacgatcgcttgatcagggagtatctcgcccatcgaaacatgcatcccactgtaggtcaactctgaataaatctcatcgcttaagacaaaaatttcatactgcttgatgacatccgctaatgcgctcagatccgcgcgattatacgtcaccccagttggattagtcgggtagttaagaatcaccgctttaaccgtgtcccgattggcttcaatcgcctgttgcaatttttccggcttaagaatgaacccatccgccgaagtgtcgataaatattggttttgctccgtttaataacacgattgggatgtataaaggaaaaatcggagttgggataatcacggtatcgcctttgttcaacatagccgttaaactcgaataaataccgccagtagccccagctgtgattaaaatctgtgtctccggatcataggaggttttatactttgttgccagataatggctcgccgcagctcgtaatcccggcaagcctttgctctgggtataatggctctcatcattttcgattgattggatgcctgctgccttgacatgctctggcgtcggaaaatccggttcacctaatgtcagcttaacaatgccttcaataccgctgatttctgcattgaattgtaaaatgtcgctcggtttgagttgccgaacctcgtgattcatacgatcgactaatgccatgaaaatccctccatctttttacatccagtaagttgaaactaaaataaaagccccgcagtcatcgattgaccgcggggcacgaaatgggaatgattctcctgattccagccacacagtcaattgcttgatctgtgtgaccgctcactcaaaggtaactggtctcacagatcgcgtctgaaaaaccagaaataaaatgattggctaccttgagtcagctttgtcatcatgatgagaacctcctaagaaactgtttgaggtctttgaaagacgcttgaatttccggtaaaatatgtgaaaaaaggacttcattatgactgattatccaagcaatatcactcgtgaccaatttgaattgattcgcgttgaccttgagacgtttcgcaagcgtacatgtcctcgaagggtggacctatttgatgtcttcaatgcagtgctttacgagcttcgtacgggcgctcaatggcgtcagttgccgcatgattttccgaaatggcaaaccgtttacacttactttgccatgtggtcaaaaccattagctaattcggaatattccctgattgacctgcttttaaaaaaattgtcgctcgagagcgattacgaatgggacgatcggtacgaacgtcgttcgtaattcttgatgcgcaaagcgtcaaaaatacggcaacaccccaaaataaagggtatgatggcggcaagaaaatcagtgggattaaacgccaccttgccgttgatattaatggtctcccattcgcgatccacattaccacagctaatgtctccgaacgggacggtgcgatcgctttactcgcgttaaatgaagagcagtttgatcttgttcagcgagtgatggccgatggtggctatacaggcgacaacttcgcccagtcggtccatgcaatcattggtgcagatgtcattatcgccaaacaaagtgatctgaagaacggtcaagtaacgccacagcgctgggtcgtggaacgtagtttcagttggttaaccaactggcgacggcttttgttcaattgcgaacgcaagttaaataccagtaaagtcatggttgctatggcctttatagggatcctgcttgctcgtcaatagagacctcaaacagcttctaagaaatagattagttaaagattactggttaacggacggtttgtcaaccggaatgaaactgattttttaaaaggacgaatttaccatttaggtccactacaattagctgccatcacgttaccggcaagtcactaactcactttttcagaggaaaatggacgcattttggcaatggaatacgctacaatgaagacaatcaagaaaggggctttaatgatgaactataccatctcggccaacaatacgtttccggttgtgcagattgcgctacaacaagatgaaacgatccagatcgaatctggctccatgatctatcacaatggtttggttgaactaagcggccacatgaatagcaatggcaaacgcggactcggcggcctaatgagtgcgattggacgctccatgaccagtggcgagagcttttttatcacaacggcaactggtaaggcggctaatgccgaattggcgattgcgcctggcaaccccggcgttatcaaagaattgacgctcgatgccaatcatcaatatcgcctgaataccggtgcgtttttggcaatggacacgtccgttagttatcacatggtcagccaaaaagtcggcggtgccttatttggagggactggcggattcttcatcatggaaacggatggcaccggtacgatgctggtttcggcttatggcgacatcattccgatcgaacttgatggcagccatgaatatgtcgtggataacagtcatgttgtcgcctgggacagccagctagattacagcatccagccggctagtggtgtcatcggttttactaccggtgaaggtttagtcaatcggttcactggttccgggaccgtctatattcaaacccggaacatcgaggcactggccaacctgattcaaccgttcatccccagcaatgataactaatcactaaggagctctaaacgatgccaactaaaataggccttcactacaacaaaattggggttgggaaaaccatctactttttacatggcatggggttagacggacacagcatggcagctttttatgagccacgtttgaccagcgaagagcggcattttgcccgcctctatccggatttaccgggaatgggaatttcaccggccacgtcagcattgcaatccgctgatgatgtgttggcacaggttcatgctttcattcaggcgaccggcgaagggccatgttatcttgtcggccattcttacggtggctatctagcattaggcctgcttgcccgatttcctaccgagttttccggtgcttttttaaccgctccggttgtactcgcggagaaaacagcacgtacggttgcgccactaaagcatcttattagtgcgccagtgaccagtcagtcaccggaatttaccgactatcaacacatgaatgttgttatcaatccttcaacctggcgacaatatcagaaacttatcttgccagggcttaaaacttttaaccgcgatttctgggttgccatgaagaaccgccatgcttatcgtctgccaattgaatcacgcttaagcagcctgattaagtcaccagttacgcttgtgttaggtgaaaatgacaatgaagttggctatcaggatcaagtggtctttgcccataaaggcgcacacatgaccacaaccgtaatcccaaacgccggtcataatttgatgatcgatgcgcctgaggctgtcatgaccgcgtttcatcagtttctacacaaatagtgccaaaccgctacgcttgattaaccgtcgctattctgcggcggttttttgcgtcctctttatatccgagctgttaactgttcaggcgttaggtggcgtgtggtgcgaaagatgctgtaaaccgattccggtgagcgaaccggcgtttgattgagccagtaaacaattaaatccacaaccccttgactgacaatctcctgagcataatcgctgggcacatcacgatcatcagcaactaactcactaccgccttgccgcaacaactcaacaaccaattgcttcactttcgcggttagttgcgtttgattttcattcaacagtaaaacggccagatcccgttggcgatacaaatacttgaacaactgaaagaaagcatcgcgctcgggtaacgggtttgctgcgtgtttagcttgaagcggtttgggaaaataggcaaaaatgcttttcacatgtccgatcatttcatcttcataatgcgccaataaatcatacttatcgaaatagtgcagataaaaggtgccacgactgataccggccaacttggctaattgttgcacgcttaacttgctaaatccttcctgatgcatcagcgtcataaacgcctgctgaattttcatttctgtttcaagcattttcgtactactagccatcgcgtcaacctccatgaacatactgttaattaccattctcattgaacaacaatttttaccccgaagcaattgacaaatcgtgccaaactgttcacccatttaagcggcgatcatcagcgctttttccgcatgctgccggttaaaagtgcgttcagagactgaacagatggctcagattgtttcttgtctgaccgccttaaggccactatgatcgtgaatgaacagagtgtcaatttgaaaggcggtcttaccatgctaagaagtgaatggcattatctcatgaaacacaaaatgatggtcgttgtcctggtggcaattgcgctcatcccagccatctattgttttatctatctttcgtccatgtgggatacctatggcaagatggatcagttaccggtcgccatcgttgatcatgatcggcctgttacttaccacggaaaaaagattgcgattggccagcagttaaccgccaatttgaccaaatcaaccgcgctagattttcatcatgtttctgcttccactgcgaccaaccggctgcaccggggcacctattacatggtgttgaccatcccgcgtaacttttccaaaaaggcaaccaccctactaacgaccaccccagaaaccatgccgctttactttcggttcaattccggtcagaacttcattgtctctaaaatgaccacaggcgctgcgactgccatcaaatcaaaagtggcgagtcaagttaccaaattatatgctggcattgtgctaacggcactacatcaggccgataccggcatgaccaaggcggctgccggcggccaaacgttgaccaccggcgctcaacaactcacaaccggcaccgcacaacttagcactggcctaaaccgcctcgcaaccgggcttcagcaagcaaccaaaagtcagggacagacgaatcaagcagtggcttccctcaataccggcgtcacccaattaacaactgccgccaccgcactcgcagctggctcgcaacagttacaaaacggcagccaaaccttagccaaccaactgacaatcggcagtcagaagttggcaagtatccaaaccgaagcgactaacgctgctgctttagccgcgcctgtgcgtgaagtcacgtcggatgtcgccaaaatccccaacaacggaaccggcatggcgccttttgccatcgctatcggcctctatgtcggcggaatcgcgctgggcaccatgtacgaaggcttcctgccgcatcgtaagccacgtcatgcactaagttggtgggccagcaaagcttcggtgattggcaccgttggcttattacaggcaggattgcttgatatttccttattggctggtaatcatttgcacgtcagcgatcatggcctattcttcatcgccattcttctcggatcctggttgttcctgtccttgatcttctgtctccgattgctccttggcggtttcggaacatggctggtttcaatcgtcttagtcctccagctagctggctcaggtggtttatatcccacttatttagtggatggtgaaaaactataaaagtactttaataataggatttaccaatagttcggcgtataataagtgcaacccttatttgcccgaaatgcctatgctttgggatttacccttgcacttatcgctgacctatcggaggaattgatcatggtttatcgtcaaaaagcaacgcaactgtcatttgaatcctttggaagcgctctgggaacaccgctcagcccggacaacgagtgggttcaatatgcagaattgatcccatgggccaaacttgaagaggcataccaattacagtttccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcgggttacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactatttagtcaatggctttgcaaaagcgattaatgaatggctgccgatgacctatctcattgacgctttaagaagcttaattgcaacacatcaagcgattggcaccgacatggcgatcatgatcggcttaatcggactatttaatcttcttatgctcttccgttttcagatcggcttgcatcaaagcttcatcgaaattgatgctactgaagatgcttaacgcgctccccggcgcaaaagcctgcgtgtaaggacctcgaacgcaatggccaaaaccgggccatcacgcccaaggccacttacactccggtctctaaccgcgctggctcgcgcttacgataaacgcgttcgccagcccagaaatctgcgtgtaaggaccttgggcgcaatggccaaagcccggccatcacgcccaaggccacttacactccgatttctaaccgggctggctcacgctcactaaagaaggtgtttgcgatgttaaaaagcaacaattcgctcagtatctcagccttaattgaacaacacggtcatgagaagattcgtcaggcccggcgtatgctggttatgaatctcatcgtctacactgtgattgccgccattgagctatggttcggcgcgaaggatcatgccgttgcgttaaccgccgatggtcaaaataatttgactggcattgtcaccgtctctgctttgattgtcggactatcgtttgccacccgcccttctgatacatttcatcttgaaggtcactggcaatttgagaatcttgccgtttttctagccggcttgggtatgtttcttatcggcctgatcaccatctgggaaggtctgggcgcaactttggccttactatccggacacgccgctgcgccactcaaaggccaagccgctatcatggctgccatttcagcggtgtcaatgctaatcctttgttggttcaaccacctcattggccaacatacacaaagtagttcactcgcggcatcggccaaagattttctcggcgatgccttgacttcaactggcaccatgatcgccattctcggtgcttcctattggcacatccactggattgatccactggcagctgttttgatcgggctattcttgatctggaacggcagccgaattctcagcaccagcgccgaaaagctctccaacgggttcaatcctgccctccgcacccaacttgtggacaagctgcaaactgttagtgggatactcgcggtcagcttcgttgatggtcggtatgctggcagcaatattattgtcgaagccgaaatcgtgctcccagccggtgatagcctcgccaaatcctaccgcatctgcaaaagtgccgagcaagtcctccaaagtgactttccagtgctgtactgttgcattcaggtcaaacccaacttacccaaaaatatgtctagatgatgagctcccaccacacttgccagcgcagagaactgactaacacttaaaaagcacaagccacagacagaatgagttctggctgcagcttgtgcttgtttaggttcaaaatcgactaggcttcgagcttttctttgtttgaatccgccacataatgcggaatctcatcatcaatgaaataaaccttataccaaactaagaaggtataaatcgtccaaactttgcggcgatcattgcgctctttgcggtaagtcttatcgagaatatccaaaattgcgtcttgatcaaagaactctttaacccagtcttgctcaaatgtttcgcgaacctttttataaaaaggttcatcttcaagccactgtttgaccggaaccgggaagccgagtttttcgcgactcgcccattcttctggcaagtgacggttggcagcttcacgcaaggcgtacttagaattgtgcgagttgatcagatatttggttggaataccagccgccactttggcaacttccttatccaaaaacggtacccgcagttccatagagttggccattgacagcttgtcggccttcagcaaaatatccttaggcatgaactggtgaatatcaaggtactgcatcttcttgacttcatcatcgtaatggcgcacctttttgtacgattccgttacgatatcacgaacgctcttactctggcggaagtccggctgcaagatctcatcggcctggccttcatggaaaactaaggcctcaccaatgaagaactcttccgccggggccgtggattcatacagatgcagccgtccgtggaagttcggcatcttcttcaacccatgggcaatgcggtacttcacgccgcgcggtaacttacgcaaaccgtccgcgaagacccgaatcgcatggctgcgggtatgaaagccatagttggcatacccggcaaaaagttcgtccgccccttcaccagacaaaataaccgtcacatctttgtgagccagtcttgtcaggaagtataacggcacgcaggaaggattggaatccggctcgtccaaatgatattgaatcaatgggaagttatccaatgcctctttttccgtcacgatatcactagtgttatctaagcccaatttgtcactgagttctttcgcagcgaccccttcatgatacttcttgttgtcaaaaccgatggagaaagtgtgctctggccgcaacagcgcggtaatatatgacgaatccacccctgaagaaagcaaggagccgacttcaacatcggaaatccggtgggcatcaactgattcggacacactcttgtcaatggcagcaaccgtatcttcaaaactcagattgttcgccttgaagtccatatcccagtacttcttaatcgtgagttcattatccttcaacgtgaagtaatgaccttccggaatgcgataaacgcctttgaagaaagtttcgtccaacgcagagtactggaaggtcaaatacggtttgagcgcttctttgttcagttgcttcttaaacttaggatgtttcaaaaaggccttgatttcactaccgacgatgaacgtgtcgccatcgtggtagtaatacatcggcttaattccaaagaagtcgcgcgcaccaaacatttctttcttgttgtcatcccaaatcaggaaagcaaacatgccgcgaatctttttcaacagttcttcaatgccatactcttcgtaaccatgaagcagcacctcggtgtcggaatgggtcttaaacacatgtccggcagcaatcaaatctttgcgaatgctctgaaaattatagatttccccattaaagataatcgcaacagtaccgtcttcgttcagaatcggctgcgaaccaccctttaagtcaatgatcgacaaccgacgaaatccaagcgcaacatcatcattgatatattcgccactcgaattcggcccccggtgtttgatcatatccatcatgttattaataactggtttcttgttcaaaattgtcttgtccgcaaacgcgatgattccgcacatacagttaaccccttttcgcgtgaatgacgatcattacttgtttcagtataaagatttgacaacgcaagtcaatcaaagagcgtgagccagcccggttagaaaccggagcataagtgtccttgagcgtgatggcccgggcttggccattgcgctcaaggtccttatgtgcaggtttctgggctggcgaacgcgtttcagagcagagcgtgaacaggagcgcttagaaatcggagtgtaagtggcctcagccgcaatggccgggctttggccattgcggctgaggtccttacacgcagatttctgcgactgtgaacgcgtttcagagcaaagcgactacaccctcaaagtcggcaccatcaccttttttatgtggcctccaaataagcacacgacacggttaacgccatttaattatcaatattgattttcttttacccaacacgctaggataagtatcaccatgatttgaaactaagatggaatatgaaaattcaccattgactagcaagatagagataaagagcctgttattaggatcaatcacaggcaatttttcatggatagtttgattgcctctttttaaagcattcttaaatggagtagatatttgacttggaacgtctatcagatagttagaatagtttgccatgctgccagattcaaattgattaagaatgttttttagacggtttccaatggaatcttgtttacaagtatcaccgtaatatatattcaaaagcaattttcaaaaacgctaatttaaaatttaatacattgtagttgtatctaaaattaatctttagtcaactttcttcaacttccgtatttttaatttttttcaaggctttatctataagcttctgtggaacatgctgcctccttaccttttttaattatctgagctgtttcttttttagaattcgccataactgaaaagccattatccttttcagttactttaggaatatatttaggacctggatctttgtctaatattatggtgttaccattcgaatcttttccaagtcttaacacttgtggcatattccacttgcacccttctaactctagaatctctctttttatttcaattgttgcaccaagagcaccatcatagtctgcacaaactgtattcgtagtaaaactattaatgccaatagcttcaggaataacatgttctaagctagattttttccccacccaaaatatacacgtaattttcaaggttaatccccctaaacaagataagcgatatagtttaatcaacaaaatcgattgccatacttttttgcaaaattgataaaacccaaattcgcataaataaatattcttgtctatttgctcactatttttaaacttaatcattttcaaaacttgctttgtaaattctagcggcgcagcaccattagcagtaactaaattatgatcgcgtactgttttttcttgaaagaagtctgatttgttttgatactggtcaaagtctttccacagatattgtgcgttaccagtatgtttgaagttagtaagtaatccatttttagcgagatagtccacggcactacagatcgcacccacgaacttgttattcgttagctaatcttggattagctgttttagtacactgtttttaatttgctatgaatttccaccaatcaatattaatagctcacaattagccggtattttccgatttatagtctactgtggttctaaaaccaccaattgaaactacctcttgcttaatggaagcagttttaacttcctgactaggggcttgatttaatgtacttgaaaggtaagcgtctcccaatcagcatagtcattcaacatcacaaaaactgcttgtttcataataatggagtctctattctattgggattagtatctcacagaatcccaaactgactaatttctgtttatatcgttcaataattggcttattaagcaccttaagttgtttttcgcagataatctggttcaactttttataaaattcattaattgctatttcggtatgaggtattttaaaaatagcgtactttatggaaggtaaaggcctttgcttaatacggttattcttcaaatgttccttattaataattaaacaaacatcatatctacaattcgcatcaggaacattctgcggattatctaaagctatacctagaatagttgatccttcgaatagaccttctgccttaacccattgtttaaaggaatgcattaattttccattttcactaccataagggcccattcgtctaaaataggcaacgtttgtttctttcatatattcaatatgcacttttctgtactccatttttttacttggacgtcctgtgtcattagcataaccccagttaaaatgaaatacactactgatttaaaaatatgtttctaaaacaattgtattccctgtacaatggatcaagtagagaagtgaaagcggtggctatttccgatcggaagtggtgcttatggcgttaaccttcaaagcccgtaattcctaacgaaaggagtagcctaagtgtccgttgcggacgcttacaattagtgctggctttcgatacgtttatcgtagccttgatcgcattaattgttgagctgatcaaaagtcagcaaaaaatggtcaatcctaccaccaccaaaaacggcaaaaaaatagagacccaagttcctacagtcgaacttggatctcctaagttaaggatttgaccgatgcagtcatgttgttacattgactggtactaattgtaaaaccctcttcaataaacctaatactgcgacacctctacaaaaatcttattcacttgtacggaacgacgagtgttgaaatgatgttgccagataacttggcgttgtttggtggttctatgacacacccgattgaacatctatgggaagctcattgtcccgtttggattactgagtcttgttattagcctcatacctccatgtgtgttcatctttagatctcatggaacatgaatctgacgataggtggcgcagatacttactgcaccaacgctctattcgttttactcgtgctttgcgacacacactttcgagccagttcgtttgcttgttactgaacgaaggatcgtgattcttggttcctgcatcgaccttgatgttcttccttaacttcaaataaagtgtatcatgtaagcgctatcttggcaagccctatgacctgcttttttacaaaaaaatttttaaaccgtcaaaaagcaaaccggcgaacccggcttgctgcgccatagccatagagacttaaacgccgacgatcaatgtcaacactgacaacatatccggcatattcgctaggagtaccaaaatgtcgatcaaaccggcgattaaatttagtcgtcaatccgtgatggcgacccatcagtgcactggtattttgtaggctgtaatgaataccattcacctgatagtccgcttccaagtggtagtgtccggcgagatacgcaatgatccgacccgtgttttgggtgaaatcaaaccttaactgtccgccaaattcaggcgttttacctgtattcaacaccccactggcatgcaaattaaatgcacgcaacaactcatggacggcccgaccgttaaactttaaggctggttggcctttttgattcatcgccggcgcgtgactcatgattaacacatcacggttcaacgcgccttttaacgctaaagcaaagtcgcgtaactgcgcaaacgaaaccgctaaagtcttcttgacatcgtaaactttatgtccggcatgtaacggtacatcagccgtatttaaaacgatcacgcgtaatcccggatagtcccgcaccaataagccttcacgcgaaaccgcaacatcaggctgcgcggcatctgtcgcaaatatcagctgacgattaacatccggcaagaagctgcctttgtgaccgggccgcttttcggcgaatttatcattgtcatcgtgattgcctttagtaaccagaaatggcaccgcacctcgccgataatcagccatgatattgcgcaagcgcattttggttagccatggcaattccgagccatcaaccatgtcgccaagatgaacccgcaagtcaagtggcatccgggtgctcaaccactgctgctcacggacatgccaaaatccagtcgggccataataagtcgacgagaatttggctttgtcatgagtatcggtaatcaaggcgaaattcaaggctgaaggcgacaataatggtgtcaccgcatcaataaaatgacccaaatcttttttaacaaaaggacgaattgtcatggcctgcttaacctcctcacacgtacgctttaccgcttagaaattgagccacaccccaagcgccaaaaagactacctgcgctaaagtggtgacgaatagatttttgatggcgttcggaaacgtcagctttttaaccggattagcagcaaatccacgcgcatttttgacgaccagcggcacggtgatcaatgtcagcagcgtcaattttggcaacaggccgagtaataccgaaataatcagcatcaagaagcctgccgtatacaaactataaaagaaaacaatactgcgctgacgtccgagataatggacaattgtgcgccgtttaagcgtctcatcttcatcctgatcagcaatgttgttggccagtaacaacgccgaaatcgcgcattgtgccaacccacttgccagataaaccgacgcaattaatgaccacgaaaagtcaaccacgttaaagacgttgacataaaccgcgatcagaaaaatgacaaaccccatcgtaaatcccgagaagaattccccatacggtgtggcggaaatcggccgcggaccacctgcatagccatagcccaccgcaaagctaaacagtcccatcaccaacaatggccatccggtacggcttaccatccacaagccaagcactgcgctggtgaccatcattaccaccaccatccagccaatcatgcttggattcagatgattgacgccaatgatattggtcttttcgcgaaaatgtagggcttctgtcttttccgaacggcgataatcttgatagttgtcattcgcatcaaccgccatgttaaacaaaagcatggcaacaaagaaaaccaacaattccggaatatgtaacgtatgataatggtaccaggcaaacaacgtccccaacaaaaaggggaaaaccgatgctgttttcgccttaatctcaactaattcaagaaatacagatattgacataacaacctccaacaattgacttttaagaatcaggtacagtagagtaaatatgtctttaggaaagagagaaaatgcatgattcatcccctgtggcaccgattccccatggtctatcaccaactcgaacagattcagcagcggctggaacaggtcgctactttacgcgaaccacaagtgcatacgttgattcagcaacaaatcaatgcaggcggcaagatgttacgaagcgggcttatgcttatgctagcgcgttttggcgaacctgacaacgctgagcttgtgacggctggtgctgcgattgaagcactacacctagccacactggttcacgatgatgtgctggatcatgccgatattcgtcgcggcatgaccacggtttctgccgagtccggaaatcgtgaagccatctatgccggtgatttcctgtttgccatctattttcaattgcttagcgaacaggatcccgaaaccgttgatttaagaaccaacgcccgcatcatgaagcgcatctttatgggtgaagtggatcaaaacggccccagcgcaccgctcattccaaccgtcaatgcttatttaagtgccatcagcggtaaaacagccgctttgtttgcgctggcaacttatacaggcgcaacgattggtcacctttctgccgcccagaaaaaggccgcttaccgatttggccggcagctcggaatggcctttcaaatgattgatgatttacttgattatacccaaactgccaaaacattgaataaaccggcgcttgaggatttaaataatggcattgtcaccttgccgctcatctacgcctatcaaactgtgcctgaccagttgaagcctttaacgaaaacagccgaacaaatcgctgccaatgctgatgaaatcgctgcgattgttcgtaaacacggtcttccacaggcacatcagcttgcgtttacctatacacaccgagcaattacagctttgaacccactgccttcatcgcctaccaaagcagccttgaccaagctcacgcagcagctcttgcagcgaacgcattaactaatttgtgatttctttagcgatcccagcttcaattttggttgcctgtcagtgcaaaaattgttaaagaatcgccgccaacattgcatatttcaagaaatcatgccaaaataataattcatttaatttttaaaaattaacaattagcacaatgtttcacaaacattgtgctttttaagtggtatgatacagatatagcaatagtgaaagagtgatcaaacatggtaaaaatcctctctatcaatgccggcagctcctcacttaaatggaagttgtttgacatgcccagcgaaagacaagtagcagaaggcgcaactgatatcctgcgtcagtcgacggttaaaatcaagtatggtactgatcaggtttatgaaagtaccactccgattcgcaattatcgggaagctgttagtaatttgctcagtcacttgcaatctttaggtctggtgaaccgcctcgatgaaattaccggcatcggtcatcgcgttgttgcaggtggagaactattttccgcacctatcgtcattgacaatcgggtgttggcccaaattcgggcgttgcgggattacgcgccactgcacaatcccgtcgaagccgattgcatcgatattttccgtaagatgatgccgtgggcgcttgaagtggcggtttttgatactgcctttcatcagactatgaaaccggtcaattatctttacagcattccttatgaatattaccaaaaatacggcgttcgtaaatatggcgcacatggcaccagcgttcggtatgtcagtgctcacgcagccaaaatgctaggcaaaccgcttgaatccatgcgtatgattgtcatgcatcttggcgccggctccagcatcacggcgatccaaaatggtaaatccgtggatacgtcaatggggttcacccctgtatccggcgtgacaatgggaacccgcgccggtgatgtggatgtttcattgattgcctacctcatgaaaaagttagacataaccgatgttgatcaaatgattgacattttaaacaccgaatccggattgcgtgggatctccggcattagccacgatgttcgtgatcttgaagccgccgccccgacacatccgcgcgcaaaactagcgctggatattttcgtcaaccgaattatcaaatatatcggtgcttacgcggccttaatgaatggcgttgacgtgcttgtcttcacagccggcatcggcgagcacagtagcaatattcgtgcccgcatcatgcaatcgcttggctatctgggcgcccggattgatcctgagcgtaatttacagattcacgataacgccggcgatattacggcagcggatgcacgcgtcaagaccctcgttatcccgacaaacgaggaattaatgattgtccgggatgttatgtcattaagccaagttgcccaacaagcggaatgaatccgattttgatcttcaacctgccttaacaattgaatcactgctttttgaatgcgccagaagtcattacagcaaatgctgcctgacttctggcgtttttgggttcaaaaaagttgccttatattcacacaaatgatagccgctcaacccccgtaaatcgccgcagctgacaaatcgtcatcaaatttccaaaatgctgcttgcaattccaatagtcgctgtttatactgtgcatatattacatatacagtataaacacacaaaggagatgttcgctatgctcaacgtcaccaaccttaccaagcgttttggaaataccaccgccgttcacgatgtttcttttgcggttcgacccggagaaattctcggacttatcggtcaaaatggtgccggaaagaccacgaccttccgcatgttactgaacttgctgcaaccggatcaaggcacggttacttggaaccagcaaccattggccaaactgagccgcgagacaatcgggtatttacctgaagaacgcggtttgtatcctaaaatgaccatcgcggatcaaatttgtttcttcgctgaacttcacggcatgaaacgtccagcggtcatggcagtccttgatcaatggcttgaccaatttcaagtcaaaggcaagcccaccgacctcgtcaaagatctgtcaaaaggtaatcagcaaaaagttcaactgattgccgcgatgattcatacaccccaatttattattttggatgaacccttttccggtctggatccggttaatgcccatctgctagaagtcgggattcgccggttgcgtgatcaaggcagcgcaattatctattcgagccacgacatgcgcaacgttgaagccatttccgatcggttggtcatgctaaaaaacggtgccgttgtcttatccggcaagcttgacgaaattcgcgaacagtttggtcaaacccgactctatgttcaatcccccttaacccaacaggagctacaggctttccccggcgtgatcacggtgacgccacgttctcgcggcttcttagtcaaactgaccgatccgcaagttggccatgatattttcgccgctgccacacaccaaggctacattcccgagtttagtcaacaagcaccatccttagacgaaatcttccgcatgaaagtagaggcctaatcatggaaaaaatggatgtcatttttcgccaagtcttcatcaaaaaccttaaaagtaaaacctggttgtggattgtcctgggtccgttagtattagcagctatctttggcgcggttttctggttgatgaatcaaaccaatcaaacaacccgaatcggcgtggtttcggacagcccggcattggttcaaacgtttaaaagcagcagcgacaacgatcagcgctatacgcattacgccaccacggctgcagctaaacgagcattggcggccgaaaaacttgatgcagttttgacagtcaccggtcagccgactcaacaggcaagtctcattcagcgaacaaatggacaaagcatcaaccgcacccaactgcaaggcgtgctggctcaagcccacaccaaaaaagttgccagtcaactacagctatcgaccacccaactgcagcaactttttgcgactcccgccttggccactaccagtgtcaaagtagatgatggcaagcttgtcacccgctctgccaaatcccaagcgtccggatcggttgctggtttcatcgtcggtattttgatttacacctttgtcatcagttatgcttcaatgatggcgcaggaaattggtacggaaaaaggatcacggatagaagaatcgattttaactgcgattacgccgcaagctcagttctttggcaaactgcttggcattctggcgttgatggcaacacaaatcattatttatgctgtcgtcggattagccagtctcgtcgccttacgccagctaccgcaaaatcccctgtcaacgcttatcagccatcttgacctgagtagtgtgagtccaaacatgattctgtttagtattgcgttcttctttgtcggcaccttgacctataccgttttggccgccttaactggttcgttggttgcgaatcaggaacagatcggccaggctaccacaccgattgtgatgctgggaatggttggctactttggcgctatcattgttgccaatggcgcctcgcctattcttaatatcgccagttatgtgccatttttatcaaccatgatgatgcccgtacgactgggagcaggccaagtcagtgctgcggccggctggtcagcattcggcattaatgtgatctttttaatcgcgttcacctggctaacggtcaagctttatcagacgaatgtgttaagctattctgatggcgggattttcaaagcgttcaagcgttcgttacaattacaacgtaccgcccgcaagcgtcatccggtcaaatcatgacacgaaatgaggttaaccatgcggatcgtcatctcaaatcaatcgggcaaaccgatttatgaacaaatcgaagaccaggttaaaaccgcgatcctcgccggccagttaaaggcgaatgaacaattgccatctatccgcagtcttgctaaagatttacgtatcagcgtgatcacaacgacccgcgcctatcacgaacttgaagcagccggattcattaccaacgttcagggtaaaggcgcctatgttctgggccaagatagcgctttggtccgggaaaacgcactgcgcgacattgaagcgtccctgaatcaagcaatcgacacggctaaaatggccaaaatcacccccgccgagttgcacactatgttagatacattactgcaagcagaaggagaagccgatcatgacaactgatttactcacagtttcgcacctcaacaaacactatgaggattttcacttggctgacgtcagttttcacctgcctgccggttatattatgggtttcatcggtccaaatggcgcaggtaaaacaacaacgatcaaagcgattctcgacatgcttcaacctgacagtggtgccatcaatttactgggccaaaccaccgttgcagctcgaaaacaggttcgggatcagcttggtgttgttctggatgggatggtttatccagactcatggcaatcaaccgcggtgaatcggtttgtcggtccttttttccctagttgggatgcggtttattttaaacagttatgtcacgattttgcgattcctgaaaaaaccaaatatcgtgatttatcaatgggtaccaaaatcaagctgcaactggccgcggctttagcccatcatccgcagctcttaatcttagatgaacccacgtctggcttggatccgattgcccgtgacgaactcattgccattttgcaggattttatcagcgacgatcaacatagcgttttgatttcaacccacagtattatcgaattggctaaagtggccgattatgtcacttacttgctagcagggaaagtaaccttcactgggccattaagtgacctgcttgatcggtatattatgattaaaggtggcccaaatgagttaaccccgggcattcaagcaacgattatcggattgcaacaaagccgcgtcggattctccggtatttggcctgccgatcaagccgatcaactgcctgacagtattgttcaggaaacagttgatttggaaaccttgatgattgcttttggcaaggggaggcgtgcacatgcgtgatttggtcaaacttgttggcttggacctggctgtatttcatactaatagtaagaagtatttttggtttggtactttgatcagtatcgttttgttgcttctccctttcttgaacggtgacttagcaaccccgcttgcaggcggcattacgggtcttagcattggcttattgatgatgccttttgtcggtgttgatcgccaaggaatggagaatctttacaccatgttaccggtccgccgtactaccattgtcgccggccattatctgttcggtttgatgacagtgggcttaattgacgcgtgcagcatgcttatcattggtctgggttggatggctcgcgttaatcccatccgtgattcacaagctttcgggtggatgctttgttttggtactgcgctcatgctctttcaaattatcttatcgtttccactcatgattggcttggggtttaagcgcgcgcctcttgctgcttattttccacttgccattctcttaattgccatctttcttgaaagaagcttccaagtagacttagatgccctcaagccttggttcggagtaattgtggcaatctttatttcagctttcatcttctcttggtggttgagcaccatgctgtataaaaaacgcgaattctaacccgtaaacaaaaagacgccatttcataatcgagatggcgactttttgtatcttctcaacattgatcagccctgtccgtctttaaacgcaggatataatgtcatccctccgtcaataaatagggtcgtgccggtgacgtaacttgactctgtcgatgccagccaggctgctccggcggcaacatcttccggtttacccagccgtccttggggaatcatggcgacggtttggtcatactgcgccttatcagcaaacttttccgcattaatcggcgtctcaatggcaccggggccgatagcgttgactcgaattctgcggttagcgtattccatcgcaatcgtctccgtgaaaagtttaactgcccctttagctgcagtatagctggcaaacgttggccagggaatctgttcatgaaccgatgtgatgttaataatattacctggctggtgatggtcgagaaaataattcaaagcagcacgggcgcctaaaaagaccccggtttgattaatcgcaatgactttattccagtcatccagagacacttcatgcgtcggtgcttttatttccatacctgcattattgacccagacatcaaggcggccaaattcggactcggctgttttaaccaaactcgctatccccgcttctgtcgaaacatccgcatgaatactgactgcctgaccgccatttttgatcactgtatcggctgtttttcgcgcgccttcgtgatcacctaaataattaatcacaacggccatatgctctttgccaaaccgttctgcaatgcccgcgccaatgcctttggagccaccggtcacgactgcaaccttaccattcagatctcgatacatatccgtcttcctttcatcaattcaggaattcagcttgctggattcacacttcacacaaccgctttgctctagccttaccgaatcttacaccacgccgccgctgcttcaactggaaaaatgtgcaccatttaccacatttaatcacgacttattaggaaccagtttatcgcgacacgttaatggcattgatcctgactcatcaagcataacaaattattcctaagttcgtcacaaaccaagcggcatcgatcacttactttttaaaattttgcgccagaaacaaaaagtagctgtcaatgataattttgcatcacccaaacgacatcaccaacgtcaagctcagtcactaccaccttcatgcatccaaaaacaccacctgattccaccgaatattcggatggatccaaatggtgtcctttttcgtgtgaatttcaactagctaatccatgcgcgccaagatttaagccagatccgtgccatttgaagcaatgacgcgccgataccaatcgaatgactttttcttactgcgtgccaatgttccttcaccatcatcatcaagatcaacgtaaatgaagccatagcgttttgacatctgtccggaagaggcactcaccaagtcgatgcagccccatggtgtgtaacccatcagatcaacaccgtcatgaatcgccgcacccatttgcttgatgtgctgccgcaagtaatcaatccggtaatcatcctgaacttcccccttttcatcaggccgatcaatggcgcctaaaccattttccacaatgaacagtggcttgcgataacgatcgtaaagttggttcaacgcaatgcggaggccgattggatcaatttgccagccccattcactcgccttcaggaacggatttttcagaccgctcaacaaattaccaccaacttctgcatgatgctcctgcgtggtttcaatcaccgctgacatgtagtagctaaacccgatataatcaaccgggtaatgcttcaacagcgccaactcagctgcggaaaattcaagatcctggaacttaacgccgtactcagccatcatggcatcggtataagccggatattcaccgcgcacttgcacatcgccgcagaaaaagttaaatgcctgattctgttgcaaagttgcaagttggttgacaggattggcatcatagctataggtggtcgcatacaacaacatgcacccgatctgcagctgcggatccaattcatgacccatcttaaccgcccaagcactggcgacaaactggttatgccacgcttggaaaatattgcgcttatcgtcggcaccattgcttgcgaccagcccttgactcatgaccggaaaagaaaacgcgctattaatctcgttaaaggtcatccagtatttaacctgtttaaaatatcgcgtcaacacggtctcagcaaaccgtttataaaaagtgatcagttttttatttttttatttttccatccgccatacttggttaccaaatgaagcggcatctcatagtgagaaatcgtcacgatcggttcgatgccatactttaagcactccgcaatcaatgcatcgtaaaatgctaagccagccttgttgggtttttgctcatcgccttctggaaaaatccgcgaccaagcaatggaaaagcggtaacatttgaagcccatctcgctaaataacttaatatcttctttgaaatgatggtaatgatcaatgcccaaatgattcggatagcgatacttgctttcatcaatcgtccaatcaaagtccggttggttcacaatcgcaaaccggtcttttccttgaggcaacacgtcggcaattgataaacccttgccatcttcgtgataagcaccttctagctgattggccgcggttgccccgccccacataaactgttttggaaatttcaagttagtcatcgtccaataccaccttttctatgccagtgtcattaatgcatcgtcgtcagttgcaccatctgatcgggtctcaacctgatactgatcagagttcgtcacaatcatcgtcacagtcggcgcatacccggccgcttgaatcgcttggtagtcaaattcaaccagcggcgtcccaacggtaactttttggccttgttcaattaaagctttgaaatgtttgccttttaggttcactgtatcaatcccaatatggatcagaatttcggcccctttgtcagatgtgataccgattgcgtgccccgttggataaaccaggctcacggtaccggcaaccggagacttgacgacatcttcttctggttcaatcgcaatcccttgacccatcgtacccgaagcaaacacttcatcaggaacgtcactgagggcgaccaatgttccttttaccggcgcggccaaagtttcggcgtgatcagcaaccaccttagccgcagcttgctttttagccggtgcattaatgccgccaaatgcgagcgtcaacccaacgcccagcacaaaggcaaccacatcgccaatcaccgaaacgccaaaccctttgcccaaataagtcggcagtgacaaaatgcttgccagtgcggccacattagcgccagcaccggacatggcgacgataatgccgccaactgcaccggcaacacaggcacagtagaatggctttttcagttttaacgtaatcccataaatcgttggctccgtgatcccgaaaagtgcggtgatcgtactggagcccgccagacttttcatcttggcatcccgcgccttgaggaacacggcaaacgctgctcccgcttgtgccaacacagcaggtagaagaatcggcatcatcggatcggtaccatacagcgcaatgttgttcatcatcaccggaaccaaagcccaatgaacgccgaaaatcacaaacacctgccagaatccgccaagaatcatccctgccaagaccggcacactcttattcaacgacacaatcgcagttgccaagccattgctgagaatcgaactaaccggaccgaccaccagcatggttaacggaacaatcacgactaacagacacaacggcgccaaaatgttccgcacagattcatgccagatcctgttgaaaaatggctccaaaaacttctgcaccacgaccaccagcaaaattggcagcacggttgccgtatagttggcagccaccaccggaatgccgaaaaagtcgatactcggcttgccaaccaacgccacgatgttgggataaaccatcgccgccgcaatcgccatcgcaacaaattgattgactttcaactgtttggcagccgtaaatgccaaggctaacggcagaaaatagaaaatgccatccgccgcggcccaccaaatctgataggccccgcttttcgtcgtcagccaaccaagcaccaccgctagcgataacaggcccttcaggatcccggcaccggccattgcacccaaaaatggggtaaaaacgccggaaataaaggttagcaagccgttgaaagcgcgcttaaaggtcattttttcatgggtcacggttgccggtccttctgtgccatcactcaacgatggttccagtttcacaacttcctgataaacatcgctgacattgttgccaatgaccacctgaaactgtccactagcctccacgacggtgataacgccgtccaaggcttcaactttttctttgggtaccttgtcttgatcctttaacgtaaaacgcaaacgggtggcacaatgccagacctgattgatattttgcttaccgccaaccagtttcaacaactgtttggctaatgctgtttcgcccatttcaaactgcctcctttagtttacgctcagcacctgcagttgcacccgctgctgatgccggctttaacgcgttccccggcgcagaagtctgcgtgtaaggacctcagtcgcaatggccaaaaccgggccatcacgcccaaggccgcttacactccgacttctaaccgcgccggatccacgcttactttctttaacgcgctccccggcgcaggggccggctcgcgctcacataaaaaaagccagaaagacatgacttgtggtgcacacaagtcgtatctttctggttttgcctaattcaatagttacaagcccaattaaaatgtattcgttttcaacatcatcatcttatctgatggattagcgttcgtcaactactttttaaactttgcccctgactcttggctaaacgggcgatgtggagggttagataaatttgttcgttttttgaaatcggtccgggtaatttttgctgcataaacttaaccacatcttccatgcatcggtatgcctgcgtatagtcttgttgcagatgtgccagcaaggcctgatcatatggctcgggtgataccggtgttttcgccgttgaagttgcataaacacgttgaagaaagaacttaagatgaatgaccaagcgttgatactctggcgtcttagcgttcatgttcagtccgagttgatagaaaataattttggtaatgttagccagcatttgcgtgaacgccaccgagttaacgggatgttgttggctcaaatcgttgctgacaaatttcaacgcaataaaacccgcctcatcttccggaagctgttccccgatctgattagcaatttccgtcaacgcccattcacccatgcgaaaagccggctcgtaggcaatctggatctcccacagcaatttgttatgcaggataagctgttcatgcaggcgcgtcacggcaaaatgtatatgatcggctaactcgattaacaaataactgttgaattttgtgtgtaactgaacttcagcttcctgaataatccgcgcggcaatcgttaaatattcatccggcaagctggcaatcgtcgccatggcaatctttagtttggcgtgatcttcaggcacataaactttcatcgaatcctgcagcgttaactggtcgccttttttagcatgaaacccaataccgcgttcgacgacaatgatatcgcgcttatcacgtcgcacgacaacggcattgttattaagaatcgcatcaatgatcatagctagccctcccccaaggcggtcaggtcacggttcaatccgcatccagattcaggctaacaatttttcgagaaaatgacaacgtaaacgacttggcttcaattttcaccgcacttttttcagaaggctaactattcagttgctaagaccacctgatgctctgcaaaccgataaacccgatccgcaaacgctgctgattcaggccggtgcgagatcagaatcacaatgccgtgatagtaagttttaatcgcctctaaaatcagccgttcattttcggtgtctaagttgcttgtcggctcatcgagaaccaacacactgcttggatgcaacaatgcccgtgccaactcgagtcgttgctgctcgccgcttgaaaatggcacgtgactagccgcaacgacggtatccaagccgtgactcatttgctccagtcgcgcccggagtttaacttgatcaagaactgtccaaatctgctgatccgtgatggctgggtcatgcagcgtgagattatcccgcaccgactcggagaagaataccggtgtctgcggcagataattcttttgattgcgtaatgcagtcggcttgatggtcgccaaatcgttaccgtcaatcaaaatctgcccatgactaaccggataccaacccatgatcagcttggccaaggtacttttacctgatccgctcgcgccaacaaaaccaacgatttcaccggcattcaaagtcagcgtgacgtcttttaataccgcttccggccgaatgggataactaaaagcgacatgatctacttgaatttgattaatggtcgtgactgtttgagttgcgttgggcaatgcggcatttaacggctgttcctgtaacagcttgaacaaatttttcgccgccgcaaaaccgtttagcaacgaacccggcagattatttaatgccagtaacggtccaaaagtaagcggaaaaattgcgaatagggcttgttgaatggtcgtgggttgcggccaaccactaagccaaatcatcaacaaccaaccgccaacaatcacaacggttgccgccacatttttcaacaattggctaaactgcgtctgctgaaaggccgttgcttcttggtcaaaaccttcattaccttttgtcatgcgttgcttggcgatccctaattgccgcaccaccgccatgccgcgcactgattccagtaaatattgctgattggcagctttcaaacgatcggctgcctggattttggctgtcagttgccgatgacgcgcatatggcaccaccattccaacggcaacataactaatcagtgcgatgattgcagccagccaatttagctgactataaatgccaactaccaagagcccgtataccaacccgatcgcaaccggaaccaaggtatgcgcgtaaaaaatttccatggcttcaatatcactgccaattagcttgagcgacttaccactagcttgcgtatcaagtttagccggtgccagtttgaccaattggcgataaaccgctccacgtaagtctgccaatacgtgaaacgcaacataatgtccggaatactgctcgccaaagctgcctaagcctaataaaataatggcgatcaatccaggtaacagcaattgtccagcattttgcggatcaaaaagcatcatagcagctaaaaccaacaccacgactttagctaattcagccaccataccaattagaaaactaataaaaatagcgccggtcagatgatgcgtatagcgtaacaggcctctaatcattgggattcacctcgttttccatcatctccgggttgtctaccagttgccgatatgcaggctgtttttgatatagcgtctggtgattggcaaccgttagctgatggtcatgaatgaaccagacttcatcagcctgcgtcattgccttgagatcatgggaaatgaacaaaacaatcttatggcgactcaacttcttaaccgcctgaaggataatcgcctcattggcttcatcaatactcgatgttatttcgtctaataagtaaaccgtcttgtccgccagcaacatccgggcaaacgccaactgttgtcgctgcccaggtgaaagcagccgtccgttttcgcctacttgggtcgcgtaacctttttccagcgatggcacaaactgcatcaatcccaacgatgcgagtttggcttgccattgatcaccgaaacggttgcctaacaataagttctcctgaatcgtgccggaaaaaagatattcgttggcagagacatacccaaacacggccgcttgttgcacattgcttagagccgaaaccgcagtctggtcagccataatggcgccggataaaggtttcaatcgtcccaaaatcgcttggattaacgtacttttgccggttccattttcgccagccaaaccgtaaagcttacccggaaccagggtggcattaatccccgttaccagcggcgcatctgcggcatatccaacgttaacctgatctaaagtaatttggctaagcgggcgattatccgtgattttgacggtgtctggcacctctttagccttggcgatcgtggccaaaatggctgccaatgatgggccatttgatttcaccacatggacaaaataaccgagttgacgagcatttaccatcatcatcgccaatgtaaaccaagtggcaaacgcgcctgccaccggtaattggccagccaccagctgaactgccgtgataaagccgccagcaaaaaccgtcaaataaccaaagccgttaatcacaaacaaggtctgcaattgcgttttcaaaagattcattgtcgcctgccgaaaaaactcgctatcatcggcaaacttctgggcataacgatctgcggcatcatacatcactaaggtggtcatcccgcgtaaatcatccatgaaccggccgcccattttcaaaaatccactgagatgtgccttgttctgtgctgacatgcgtttacctaaaaacatcatggccagaccaattaaaaacacacagccaaacggtaaaagtgccaaccacgagcggtaccaaaacgaaagcccaattaaaaccaaaaacgtcatgcccgcctgcaaaatggttggaaatagcgtgctgtaaaacatatctaaattattgagaccacccaagtcgcgctgaatcaccgcatgatccgcagcagtggttgcaacagcatcattgcgttggtaaagcgcagtaaaatagcgatcccgcagctcccgtttcgcactcatggcccatgcgtggcgatggtgaagttcataacccaccacgtaacccaaccacaccgccattaacaccagtgttgtcacgagcgccgcaacctgatgcccagtacccaaattaagcgcaatcaagatcggtagtaaggttggcaaccaatcaaaaattgcttcaataaccccagcccaacgttgatcacgtccgtatttcagtaatccaaacaaaggcttgcctcttttctcactttgaatatgcagcgtttcaacctaccgctggccctcagcgcaatggcagattgttgttacagtttaccacgggaagtcatcagtactgcagcaatttttagtgcaagccgtcaaaaccgatctgtcagtagtctatccattttcaaaaaagccgatccctcgcacactgatcggccgccaccagcttgtattatgggtgaaccagtccgcctgcatcaccattggaaccatgatttccctgagccggcttaatctcaatgagcaacttatgcggcaaacaaatactctgctggccaatgcgactaatccagccagtatgcaccgcaatctgatcaggcgaattatcttctttgtcccgaatacgttcaccctcaacttcaatgatattgtactgaccttttgccggataaagcgtgaactgctgatggcgggtgtgcgctcccagcttaattcgccgtttgacctgaccattaactgaaattaccgccaccttttgactcgtattcacattggcttcggtcagcgaaaaaatccccgccggaataaagcaggcgataaatagtaacacaacaatgatataatctagcggtcgtacatagcgtttaagccagcgcattcttttcacctcggtttaaagccttcaacatttatcttacacgttatcaagtcgtaagtacggcccactgcctgtcagtgccgcccatcaggattagtccagttattcaggccaactaaaaagccacgaacttccattcgcagctttcttcttattctgaccgcacgattattttcagaacacgactattttgcagcctttgccgccttgataattgccgccaagtaaccggccgtgtcggtgaaagtagcgccagacacaacgtcactggccttcttcttaccttttaagtcactaactgctgtttcaagttcggcaacggtcttccccttagcaaattcatcaatagccgttgaattttcctgccaggtctttgtcgctttgccttttgacttcataatggcagaataagcatcagagtttgcccgcttcgaagccaaaaccgtgcctgccttaatgcccttgccaaaatcggtattcgaattaggaaccgcaccgaagtccttggctggcatatattggaactcatccaagaaaacattggcaattttatcgccttgcatagcaactgtcacgatgccaaacgactgagtcccatgcggcgccgccagaacctgaccttccgtgagattcgtatcagtcgtttgaattccttccgcaaccattccggtcgttgccgcatcataaatcgcttgcagatagccggctgtatcagcaaaggtcgcaccggaaacaacatcgctgaccttcttagtgcccttcacttcagccacagccgcttttagatcactaatcttcttacccttaacaaaattcgtaatcgccgtttcgttttcttcccacgtgtgagttgcctttgcttcctttttcatcaacgctgagtatggtttgctattttccgccttagcaatcaaaatctgaccggacggataattttttccaaagtctttattggaatttggcaccccagtccaatccgaactctttttgacatactggaactcattgattctagcggacacaatcgtatcgccattcagcgtgacattcaccgccgcaaaagactgcttgccgtgtggtgccgcatacaattgccgcatcatcaaagtaccggcagccggaacttttgcattcgcatccgcacccgttttgatcttgactttggcgttgctcgtttggctggtggtgctgctgctcttacttgaactagacccagacccaccgctacatgctactaacccaacactaagtaaaagcgttgccccgatgatcgcaacttttttcatgttgtacccccttgcttgaaatcgcttacatttatatgatgaattttagcacaaggcggctgtgttagtacacgttttttgatgttaaagtcttttagattagcatattaaaccaacccagccataccactcgaatctatcgttttcccctacatttccacacaagtccggtatgccaatttctgctttaggacaatcagcttcgttatcatgaccgaactttcacgaaataaattatatgcatatgctcattaatcgttgtttcccgatctggcagctgctgaaagccgactttacgatacaaatgtaccaatttaggttcttccgcaatcgtgtctacataccatgtttgaatgagcggaaactgttcttcaatcaactgtagtccgagctgagcgtatccctttccttgataagacggcaagattaaaaatggtgaaatacggactgccgaatttttgcgatctgttacaacgcgaatcaggcctatgtgtttatctttaacgattataaagaagaaggcattgttatgccgtttgaacttttttctgtaagctttccaacgattcacagtaggggttggtttcccgatcttgatatttgtcgtaaatggatttgaacgcctgttgatacatgtgacggatttctttgagatcagtgtaaaaggctggggaaaggattagtttcgcttttgacattgctgttgccttcttttgggatttgcatagcatttatggggtgaggtttcactgaagtttttttgatctgacatctacctgagactattcaaactgcatagcaacttttccaagtattcttgaactgattgatctgacatctacctgagacgaggcatgttagacgtcatatttgctgaaacctcttgaactgattgatctgacatctacctgagactctcgacaacaacccgttttggcaccacaagctcttgaactgattgatctgacatctacctgagactgaaataattgttgacacgtgagaacacaggctcttgaactgattgatctgacatctacctgagacactggcatcaatcatcatgaagtatgcgatgctcttgaactgattgatctgacatctacctgagacttagtggcagagaggtaatgatgatcacacgctcttgaactgattgatctgacatctacctgagacgcatatagcttgatattggccgcaagctcggctcttgaactgattgatctgacatctacctgagactttctgtcgggtttgtggaatggcactgtggctcttgaactgattgatctgacatctacctgagacgtctagcccgagaagttccgcggcttttttgctcttgaactgattgatctgacatctacctgagaccataaggtggcagcggccatttgtgtttttgctcttgaactgattgatctgacatctacctgagactttaaatgcgtattttcttttctcaactgtgctcttgaactgattgatctgacatctacctgagaccgcagtcttgcaagccgtaatgctcgatctgctcttgaactgattgatctgacatctacctgagaccccataggcctagctgtcgcccgtaaggcggctcttgaactgattgatctgacatctacctgagacacagccgtcttgatcttgtcagcatcacccgctcttgaactgattgatctgacatctacctgagacggggcttctgcaatctggaatgcccttggagctcttgaactgattgatctgacatctacctgagactagaatactaccttttggcacaatattattgctcttgaactgattgatctgacatctacctgagactcaatcgtcatgccaagcggcatagcacctgctcttgaactgattgatctgacatctacctgagactagtgatcatattcatgcaacacaaacggtgctcttgaactgattaatctgacatctacctgagacttgacaagtcaaagtgctcatacaagtatggctcttgaactgattgatctgacatctacctgagactgaactcatcgcttaccggcaaccagtcatgctcttgaactgattgatctgacatctacctgagacggtggcatcacagaagcaaccgaaacaatcgctcttgaactgattgatctgacatctacctgagacaagtggtaaggtccccaaagattcgatgatgctcttgaactgattgatctgacatctacctgagacagcatcctatatttccatgaatactgatgagctcttgaactgattgatctgacatctacctgagacaagcaatccagaaactcgggatcgtttcttgctcttgaactgattgatctgacatctacctgagaccggtgttttcacacagtctcttaatcaatcagttcacggctatccatgaaatctttgtcaatatagatatactggcacctctcaaaaaactttctacgttcgacatccgaaaattcaatgagaagtaattctaacgatgtttccttaacctgatctaacagcttgttcaaactatcaacatctaaataatgactgatgttggtaaaaatgacaagacgtttctcctcaagtttcgccaaagtcttaattgccgcttcaactttcgagaaaggctccgtgagtacttcttcatcaaaatgaacattacagtatttcatgatttgttcaagttttccaccaggttcgactgtgactggaagttcacttaacaacggctctctcaataagctcattgccagtcgttgtgactgctcaatcaactcaatcagccgccgatcctctatcaattgacttaccttcttgatgatcaagcgttggaataacttgtccaaatccagctctaaaaccgggtcaccaatccataatgatgctttacgcaactcttgaatttgcatttgctcgttgctcaagacaatgccgtcatcgtcattgcgaaaagcctgaaccagatcaagcaaaactttgggtaaccctgtgtctattactgttatgacggagggcttcgtagtgatcagctgaaagggataatacgccaagttcaaatcatcaccgtcctatcagccgagttgcgaatatcctgcttttctgtcccgaccataaaatgcatggactgatactgtgcctctgtgaccatcagtgtttgaacgataccagtcggcggcttaaccgttgctattcgctgctccatataagcagctgactttttagttttgcaaactcgcacataaaccgagtattgaatcatcaaaaagccttcatcaatgagtgctcgccgaaaccttcgataatttcgacgatcttttgaagttgcaaccggtaaatcaaacatgatcattaatcgcatggctcgatacctcatctggaaacttcacctcaattcgacacaccttagctttgccatctaaaaaggccagacaattttcaacatgatcggccactgcattttggagtaaggctttcttaccgttgaacgtaatctctaggtttaacaaatcaatcaggccatatttgacatctggcgtcagctctttaatccgatgctgtgccacccaataatcgactgcgggacgaaaaggctccattaaatccgagccgagattatagggatttgaagcactgtgatgatgcaacccaacctctgtcagatgccctgtgctgacaattgctcgattagtggtcgaaagtagcactgaatacccgtaattcaatgccgcattagttgcacagatgtcggatcgagaaaaatcatcgccaaacatcaacttaaaatagcgacgtgcggcactagcctctcgattagatacatcatttatttcaagtgcgtcgagatcatccagtagtccttgagcatcatgtccacaaagctttgccacttgcgcctgattactgatcttagctgcaacaatttttgtccaaacggtttcgattaaatcgagtggccaattaacttgtaagcgaacctgttcagcccgccgtcgatcagaatacaaattcttagtttcggttacgggttgcccgtcccgcccagagaaaataactttcgcgttcgcgtccgctaaagctgcaatcgcatcagctgaaatcaacgcacgtgtcgttgtaaaaataacttgattcagatcatctattggcatcgtatacacttcaccatttgtttggacaacaagcgaatgctgcttcgttgtcactttacaatgctgcgtgatgatgaacgagcgccatcccataaaatcaccccttgtaatcgcttccctaatatgctttaatacagttgttgagacgacatcctcaacaacttgaattgattgatctgacatctacgagttgagatcaaacaaagcttcagctgagtttcaatttctgagcccatgttgggccatacatatgccacccgagtgcaaatcgggtggctttttttgctttaaaaatagtttacaagtcagctagcggtattcgacgtttgaacagaccgcttggagattgataaacaatttgtgtatctttatcaagcttaatgccgctcccaacttgaagaagacccagatctgtcttaatacctaaattttttacattacttcgggtgccattagcttgtaacccaattaaaatctgtcttaaagtctcagttttcccgattttattgccatcagtatttattggtaatttttcaaaacgttcgatagcatcagatagtttcgctcgaaattgattaatgtcataaagcttaaagaacttctctacctgatcgatgatggccttatagacttgtaaagcatcgtggttcatttgggttttctcatactttatggaaaacagtttttttagcaatttttgattttcacgagataaccacagttcttgataattacgataataggtgtctgagttcaccataaacaggccatacttagcattctgaaataatgtccccatcccaaagcgagggatgacaattttaaaggaattagctgacggcttccaatttttccttctcttagcaagctgctttactacaatttcgtttaatagctgtttccctttttcacgtgattttaaattggctgatgcaatttttgaagcattttgtgctgagatcttaataacttgataagcagttgtatcggcttctgctactcgaacaagagcattataactccctgattcttgagtataacccccataaacctgagtcggatatccctgcttcttaggaatcaattgcttacttccgccacgttctttcgaatccttggcagcataaattgtttgcttgaacaaatcagccgtctcaaaataaacctcatgcgttatcagcatccgcttgaagttgtatatccgatccaactctcggatatcacgttctttatcccaaacaatctcgccggtatctttagcgataatattcttcttagcatgtgtcagtgcaccaatgaagttgaattcgcggaacttcttaacatcaacttttgcaaattcgccatatgtgaaaaatggtgccaatttcggataccgcttaagcagatacgtgccaattcgcgctgctaagaaggcatcaaatgcatgatgataatggttcacgtcacgattctttggaaaatctagttcttcgcgtaattggtgggataagccagctttgactgcaatgatcttggtgttcggatattgggcagcggcaatctgttcggttaatttaatgatctggcgtgtttcaaccaactgacgcgcgacaaatcctttcgcaaacttatcgatctcatcagggcgcagcatcaagtttctaagtttacgtccactgattaaaccggcttcgtgccacttacgccaagttgccttcatcttgccagcaaacaaggttgaagcaaacacgttgttcttttcgcggttgatggttgcgttaacgagcacgcggttatctaaagagtcatccttgatcagcgattgtggcaatatgtgatcgatgtcataatggctgagttgatcgatattcaacggtgcgccggtataaatatcgcgcccgccttgcatgaagtaaaggactagccgatcggtaaagctggccttgtctgcaatcttatcctccaattcaccgcggacagcactatcaatcagctcttgggcggcgttggcataaactgtttgaatttgcttttgccgtgactgagtgcgcttgccagcagtacctgttccgtctgccgtttcaataaacagccaacttggatcttgaccatttgctgcatgcttgatgtcctcaacaacccgtaacacttggcgcaaagcttttttattgcttggcgaagtatacgcatcattgatcacatcttcaatgtcgtctgtcttcagcttgtcttgattcaactccgtcatcgtttcttttaatgtttcatcggccaaaatttgcatcaagttatgattcgaaagcattaattcctgaattacggtgtggccattgcctagtttcaacccatctaaaagctttcgcgagaactgaccccagccacgataccggatgccacttaattcattgattttctttggatccaaccattcaatttctgccaacttggtctcaaaaattgtgtgatcttcaaaaaccgtcgaccacgtaataatattttcgatatcaagtaattttgtcgggtcatcaattgcctcatgtaagatttctttcaattgatgataagttgaaagcgaacttaagaaacgtttttcatctgccagtccgcgaatctccggtcgtcgggcaaaatctccatgagcaaccaaattatcagcaacttgtttaatggtcacactgctatgccgctcgaacacctcacggatcaagcgttgtttttggtccgttccaagacattcattgttaatgcggacattgttcagctcattcagaacttcatacttttgatacaacagactttgtttgggtaagacatcttcgccaattaaataagtgtcggtcgtcttcatgcgttgaataaacgtgtttgccgaagcttcacgatcaaccttctcatcaaaattgtaaggagtaatattgcctgaaggatctttacggaccatccatgcgaagacattttctcctgactcagcctgttgttttggcgtgatcagcggtcctacatagtaagggatatggaaatttaacaactcgtctaattgataaggcattttccaccgatgcgcttctactggatttggtgcggctagccagtcgtagtattttgattgattggcaataatctggtcgagttcacgttgttgcagttgtatcggaatcgcaccattggccttagttcgttgtttgagcatgaagtttgcctgtcccattcgattcaacagctgctccgacacttcatttgggtgtgcggttacttctttggttaaggctttaacaaagtcttccctcaaaaaaggcttagcatcatcgccattaatatatcgatcataaagaccccgaattgttttagctaattcgtgatcatttagtttcttgaggtaggttttaaacagctcaagatcttctttatgttgcccatagtcagcaacttttgcctgggataagctcatccccgctggcacaatgccatttagcaatcgtgctcgataaagttcttgaatttgttcaaatatttccgttccttgatcggtcatggaagtttcgatgttactccacttgtcgtccagctgccccatcgagaattgccaatttgacgcatcagcttcatctacttctgtacctaaagcaagattgaacttggtttttagccctgtgatcgctttggcaaactctgtcagcacttgtttgcgtttcttgacgatttctttctcaccatcactgcttaataacaagttcaccaaggccttctgggtatcgctcggcgtcgcttgttcatctagcaattttgccttgaagtcatcagcctttgccaaatcaaaagttaactcaagatcgggataaacttgcgcatatgcctctgtcaaggcaggaaaaatatcttctaaatcgactttatccgtattaaagtctttagcagcacccggcgtcaaaaaatgcccgcgacttttcaaaatatgatggattgccaagaaaatctcacgcggatcggctttatgcgtatgcgtcatcaaatgcagacgcaagtgatacatactcggatagtcctcgtaaaattcagcatccgttcgatcattaaacagacgcttttcatacttaaacctgtccttgtctttgggcgaaatttcggaatacttttgccgcaaaaagaaatccgggtcaatttttgtaatatgcggggcaaagaaatcgcgtaaaaagcttaaccgccaccgagttcgactcaaacgccgccgagtcgtccgacttccccgccgatcagcggctgattgcccctctctaaatagccgtgcaccgatggccgtttctcctttcagccgcaagaggtgactatttgcatccacaaccgcaaacccaatcgaattggatccaatgtcaagcccaattccatatggttgatttaattttgtcatgttaactcctccgatcctttgacataagttcagtatgaagggtgctgcaatcgttttcaacaatttgtactatcgcgaggctttctaaacgcatttttggcttcgaatgtttcaattgacttttaagagtgtcctttaaggtcaaatcattttcaaggctatctgctgcttcagatttgacttaataaggcaaaataaaagcagctcgatcactatccaaaaatagtgtctaagctgcttttcaaatgcaccagccgtggcatgcctttactccagcactacctcaaccctgcatccaatgcataaagattttgataccgtttattctgttcagctaaatgttgcggcgagtcattcatcgttaaccgcccgtcttccaggaaaatgacacgatcggtttgactgacgccttgaagatgatgggttacccatagaatcgttttaccttttaaaaccgtgaacatagtatccaacaaggcttgttctgtaatcggatctaatccgacagtcggctcgtctagcaaaacaatcggggcatcctgcaacagtatccgtgctagtgacaaacgctgccgctccccaccggaaaagccaaagcctgcttcttcaacgctgctgttcataccgttgggcaactgagcaaccagttgatccagtttaaccgctttcaacgctgccgcaacagtttcatcgccggcatcttcatttcccaaacgcacgttattcacaatcgatgtattgaagagaaaggggctttgatcaaggaccgcaaacaaattcgtgcggtgattctggtagtcgagtacatcttgtccgtcaatgagtacgtggccatttgtcggggttaaatcacctagcaccaattgcaagagcgtggttttccccatcccgctggggccaagaatggcaattttttctcctgcctggatcgtcaaatcaatgttcgtgatcagttcgggatcagacggcgtataccgaaaactgacatcatttaattcaattttattgaaggtagtcggtactgactgctgttgtggcaactcgcgcgtaaccgggtgtagatcgtttaggtgacggatggcatcccgataagtcggccattcaccaaccccttgggcgattcccgaaaacgcctggtctagcgggaagacaaccaagacaaacgcgccaacccaattagccattgactgattgccggtccattccaaattggtccaaatcaacatactaacggcgattaaagcaaacaaaagctggccgataaaatcgcgcccccactgaaatcgcttggatttggcggtagaggcagcaagttttttgggtgctgccagactttgcttcatgaaatcttgatcgcggtgggtaatcacccaatcagacaaacccaacactgaatcggttaacgacacataggcatcatgattcagccgtttttgctctgctttacgaaaacgttcaacgaccaaaccccaccatggaagaatcagaatctggaagagcaacagcagcaatatccacaaggcaaatccccagttaaaccagcccaataatagcgttgcaatgaccgttagaccggcaccgacaaccgtgggaaaaatcattcgcagatagaggttttggatatgtccgatatcgtccgccaataagccgagaatatcgccagtctgatgatgttcggagacaaatgccgcgtcggtttccaagactttatataattttcgccgcatgtgactggtgatccgcaacacccaattatgactggtcaaccgttcagcatattgaaaaactggccggccaaccccgaatgcccgggtcagcaccactgtgacgtaaattgcagcaaacagtggcttggtcgcacttttatcaattagaaatccagaggtgaacatcagcgcaccggcaaagacaaaagtcataatgcccagaatcaatgaccaaaacaacagccaccgatagcgcttgagatcaggccggatccaatgttcatttttcaaccaatgcattgaattcacctcgcatttcatggaccaacgcctgatacggcttagagtgggcggctaattcagtcggggttccttccgcaacaatcttgcccccgtcaaccacgatgacccggtccatttggttcaaccagtgcaaccggtgcgtggcaaagataaccagccgattggcaaaaagcgggactaaggtttcttttaacgcggcttcggtttcaatatccagatgtgcggtcggttcatcgaatagccaaatagaacgatttgtgtcgattaacgtccgggcaagggcaattcgttgcgcctgaccaccggagatgccacggccgccttcaccgattcgcgttgcataaccatctggcaacgaattgatccaagtcgtcaaaccagccgattctgcggcatcccgcactgcctgatcagaagcatccggccgataaaaccgaatattagccgcaatcgtatctgcaaatagataaggatcttgcggaatatagctcaggtgatcctgccaggccgtctgcgtcatatggggaattttggtcccgcgcaccgtgatatcggcagcttgtggctgtaaaaatccgccaattaaattcagtaacgttgattttcctgatccactcgcgccaataatggcaattttttccggtccagtaaaggttaaattagcatcctgaatgcccgctcgcttgtcagcataagtaaaatcaagatgctgcatgctgagcgtatcttgcggctgccatcccttaaacgctggtagcacgtgcgtatccgttggcagcggctggtcaatcaccttccagatcgccgtcatggcattcttaccgttcaaagtggcatggtaatccgttccgaaatcacgaatcggcataaaatattcaggagccagaatcagcgctaccatcgccggatacagcggaatcgtcccatccattagcttaatgcccagaaaaaccgccacgactgcgattgataaagtggtgaaaaaatctaacgcaaaggtggaaagcatggcaattcgcaaaacgcccatcgtctgcttgcgataatcttcagagacttcatagacgttgttggcatactcgcgactgatacccatcagctgcagtgtttttaaccctcgcagtgaatcaataaaatgattgctcatcttttgaaatccggcgtactgactttccgacttatcacgcgccgccaaacccaggatgaccatgaacaagataatgattggaaacataatcagcaacgtgaatccggtcaaccagttttcataccaaatataagccaccaaaatccacggaataatgctcatatttaagatcttatttaaaataagttcgatataattttcagcttcgggaatgccgtcaagtgccatcgtgactaaattaccagtaccttctttagcaaccgctgccggaccaagcgcaaaaagatgtcgcaacaactgcgcttgcagccaggcagcacttttcatcgcaaacttggcggcgatacggtttcgtacccacacgatcaactggcggaccgtaaaagccgcggcaaacaagccaagcggcagccataaaccagctaaactttgacgattccaagaatgaacaatcccttcagcgagatattttccttggagtaaaataacaaaagcttgcacgagtgcaaacccggcaagcattgtcattgtttttcgcattcccgaaaggcgcaacagcgtcttatcgatcattcgctaaccgcccctttggcttgaatgcgtttgtggaagacaacatagctccaaatgaagtaggccaaggcaattggcaaaagaataactgccacaatggtcataatggtcagtgtcaatgggctggcgctggcatccttagcgagaatcgacatggccgcattttgaccaatcatcacccgcgggaataaaccgttgaagatgacgccgacaacgccgaccaaaccaagggcgctgccaatgaatgacaagacttcattatcttttaaaaccccgatatgggctgcgaccgttgaaccaacgatgacaaccagaatcagcaacgtgctaatcggacgttccttgaagaaatcggtcatgaagaatagtaagacagcgaaaacaacttcgccggcataaagcagataatacaacttgctattccagtcacgtgctcgcttccgcaagtcgcctgtggtcttcaagcaaatgaagttcagtccatgcatcaacatcatcagggtcactgcaacgccgccgacaatcgtcaatagattaatctgattgcccaacgtcgggaacacatccccgtttttggtaatcggcagcggttgaatgatcgcggtgaaaatcatgcccaaaataaacggcggaatcaaactgccacacgccaacgcccaacgccaaatgttgcgcccggttttggtttcagcatgtgcggcaaattcaaaggaaaccccgcgaacaatcagaccgaacaaaacaaggaagaacatgatataaaagccagagaacaggcttgcataccacatcggataggaagcaaacatcgcaccgccagccgtgatgagccacacttcattaccatcccagtgcgggccaatggttgctaccaactgatcttcttcatcgctattgtgggccaggagcttagttgacatcccgacaccaaagtcaaacccttcaaggacgaagaacccactgaacaggacgaacaataaaaagaaccataaaatctgtaaccagctcattttgcgaacgcctccttagcaaacggatcgctgttgaccccataatcggtgttcaaatcgccatctggtccattcttcaaaacgcgatgtgaatagtaaatcatcacgccacctaataaggtaaagatcaagaagtagcaaatgttggtaaacagcaattgaccggccgtcgtggttggcgaaaccgcatcggcaatcgtgtacaatccataaacaacccacggataacgacctaattcggtaatgaaccagccagcggtattaatgataaacggcagccacagagcaaaaccgagaatgtacaataaccaccgctgatctagcaacgtatccttcttcttacgactgaaccacaggcctaagacacccagcaagaagagcaaaacgccgccaccagccatgacccggaagctccaaaatagggtcttgaccggcacataataattcttatctttgccatacttggcttcaagttctttattagcagtctccatgcctttaacggaaccgttcatcttatgataggataacaagctcagtaaatatggcacttcaatgttgccgctagttgtgtgatctttggtgttgattaactcaaccaatgtccaaggtgccggatcgctggtgtctttgtaaatcccttcagttgccgcaaacttcatcggttgatccttaatgatgaattgcgtctgcaagtcaccaaagccaatcgcacaagcagatgcaatggtcccgacaaccaagccgaccttaagggacttcttgtaaaagtcgacgtgatcttttttaagcaagcgccatgctgccatgcccgcaaccgcaaaaccggctgtggtaaaggcaccaaagatgacgtgtggaaattcaacccacagttgcggattggtgatcaccgcaccaaagtcaaccaatttgacccgaccagttgtttgactgatcgcaaaaccggtgggatgttgcatgaaagcatttgcggaaagaatccaaattgctgataacgtggtacccaaccaagtcatccaaataaagatagcatgtacagctggcttgaagcggtcccaggtaaacatccacaacccgatgaaagtcgattccatgaagaatgccaacaaggcttcaatcgccagtggcactccgaaaatatcccccatgaatcgtgaataatttgaccagttcatgccaaattgaaattcctgaataataccggtaacgaccccgacagcaaagctcagcaagaaaatcttgccccagaacttggccatttttttatatgtctcatcctttttgcgtacatacatcgtttccatgatggcagccacaagacccataccaattgaaaacggtacgaaaaagaaatggaaaacggtcgtcatcgcaaactgaaaacgagctagcgataatacgtccattgccattagcatatgtttctcctcctttaatagattgattacaatctaagtataccccgatatttattttttaaaaaccaaaaacccaaaaaaccagatggaaatcatgcttcttaggatatttcatttcacaagattgttatgatattctccgacgtcaataatcgcaaccgctttccgggaagtcgatttcctatcttttcacagcggagaaaacaatcgcatctatttgtgaaaaaacgtttacggtcgaatcacttcatgaattaatggcaactttttcggagcagttgtgccgatatgataagcttggcgcaccaactctacaatcgcatccacatgttgatcgttagtgtgcagcatgaccagcgtatcgcctttagtcaccggcgttcccagttttttgtgtagaactaagccgactgccaagtccaacttgtctcctttttgagcgcgaccaccacccagttgcatggccgccacgcctagggcattcgtatcaatcgcagtgacaataccgctttgctcagctttaaccggaattcgatatgctgcttgcggtaacttccgcggatcatcaaccaccgccggatcaccgccttgagcttgaatgagctgtttaaacgcgttcaaagctcggccatcacgcaaggcatcttctgctagcccggtggcaatttccagacttggtgcttttttgcctaagaccaacatctgtgcggctaatgcaaccgttaagtcgtggacatcccgtggtccgcgattttttaaaatagcaattgattcggcgatttccaagctgttaccgattgtaatgcccagcggttgattcatatcagttagcaaggcaacacttttgacgccggcagactgactgatgctaaccaaggctttagctaaagcacgcgcatcttctgaagtcttcataaacgcaccattgccaactttgacatcgaaaaccaaggcatcggtcccactcgccagtttcttactcataatcgagcccgcaattaatggtatcgattccactgtcccggtcacatcgcgcaatgcataaattcgccgatccgctggggcaacatcgcgactggcactcacaatggcttggtggagtgtttggacttggcatttgaattgggcttcagtttcgttaacattaaagcccggaatactttccagcttatccagtgttccgccggtatggccaaggccacggcctgaaatcatgggtacgggaacacccagagaagccactaaaggtgccagcggaatactgattttatcacccacgcccccagtactgtgcttgtcaaccttgatgccgggaatatcgcttaaatcaaggacgtcaccggaatgcaacattgcaaacgcaaaatgatcgcgttcagccgcactcataccgttaaaatagactgccatcaagaacgcactcatttggtaatccgggattttttccgcggtgtactgctgaatcatccaggttaattcatcatcggtcaattccccgtgatcgcgtttttttgtaatcaagtcgaccatgcgcatttttatcacccttcactcggttgttatcactattgtaacgccctacttgctgcctatgttaaactcaaatcaatctattcattcataaaggagaacatcatggattttgctaccttacatacgctgggtaaaacggaattacattgccatctggacgggtctctgtccttaaattgcattcgtcaactagcccaaaaaatcaatcaaccgttgcctgccgatgataacgccttacgcaagctggtccaggctccggaaaattctgaaaatctggctgattacctaaaaacattcgactttatcgcaccccttttgcaaaccaaggaggcgctgcagatggcggcctttgatgttgtcgcgcaggctgcccgcgaaaatgtccgctatatcgaaatccgatttgccccggtactttcgactgccggcgatttaacattgagtcaagccaccgaggcggttatcgcaggtttacatcaggctatggcccaattcgatattattgccaaagccttagtttgcggcatgcgccaattgccaaacgcagacaatgcagccatgtttaccgccaatgctcctttagtcggtgataccttggttggcggcgattttgccggtaacgaagccgactatccgactaaagtttgtgcacctgccattgaaacggcgcaacgacttggcgtcccgttaactttccacgctggtgaatgccactgcccgcaaaatattgccgaggcgattcgcttgggtattccgcgaatcggccacgccaccgcttgttttgaccaacctgaactgattcagacaatcgtgaaaacccatacaacgatcgaactctgtctcaccagcaacttgcaaaccaaagccgcacggtcactggcagaatttccttatcaagccctcaaaaaagccggggccgccatcacgattaatacggataatcgtactgtctccaacaccaccctgacccacgagtatgaacggtatcaagcatattttgataccaccaccgctgactttctaacttttaacctcaatgccgtaaatgcagctttcatccccgaaaccaccaagcaaacattacgtatgcgcttaaaacaagattacgcaccttacctgtaaactcacccgcttaagtccacactccatcagcattattgcgtttcgagctgcaagtgttatcgaggcttcatttttcttaacgtccttaacctttgcttagggaaaaaaccacacgtttatcattatttatccccaaattcatcccgactgattcgcgataaagccacatggacaagctatgctggttctatcaacaaatgaaaggatgattcttatgttgattaaccagacagatttcatcgcaacccaattacagcaaattgtttaccctaatatcaccgccatcactgaaaccggcgcgtcaatcacgattcaaactaaccaaaaacagcgcgatgaccctgctttttggcagagcatcagcgctatcctaaaagcccatctttgggttccggtttctaaaaaatatcatgaactcaccgatcatgactggttagcatcgccagcataaaatttatgcttgatgcgtggcaaaagcattggcagctaaaataagcgtcaaaactgcatcaggtgacaatgcggcactgacagttttaatgtgcccgctggttgcaaccgcaccgattacttcaagcccatacttcacaatattgagatcgcgttgaggtgcataaccaccgtcaaaaaccggttcatggttatatgtaaagtttaaatgatcatctttaatcgaaccatcaacgtgattcaccataatccgatcatgtgccgccgttaacggtgcctgatcatcgggcagattgagtttgtgatccgattcagtggtgtaataatcagcctgtttcatgtgcaagtatttttcagccggtttcttaagtacctttaaataatccacaatggcaaaaaccttcgtgggatccagctgggtggtcttagccatgagctcatcattatgggcctcaagccagtctgctaaattactgatactaaactgatccatgttgtgcctccatattcatcgcagattcttacgccagtatagcatggacatcgggtttgatgtgcatgattgttataaacttgtgacactttttggttctataatgatgttaaggggatgagcatcatgccgacgaatcagacaccatatccgattattgactatttgggtcgtccaatccaactgcagttatttgtcacctatcgtctgcgcgtcaaaaacggctacattctcgcattacgccgcaaccagcaccaacaagcacttcccaaccttctcgttaaacacgcaagttaagcttgattttgttgggacatgctgcatcgcaattgcgacaagctttgatttgacgagcataggttcaagtttccacctgagaaacaaacaaagaaaaggacaaatgaattttttgcgagccaagcgctatcaagggttcgttcatttgtccttctttttttgcctaaaaataggttgcgcattagccacttagtcggaacgatcctcaagcttaggtccgcgtggggtcatgagtgccatcatcgccacggttaaaataatgatcatcccacccagtatctcagccacacctagatgcatatgcaaaaaaatgaccgacaccaaggttgcccccagcggctcaaacgcgtctaacaaggtcgcggctgtcggtgaaataaactgtaggctggccaaatagaccgaataagcaacgatcgtcccaaagatgacaataaaccagtaaccggcccaccctgcttgatccaagtgcggaatttgtttccagaaaggatcgaaaatatcaactaataagccacccagtaattgagcccaagctgtcacgacaataggcgaatgccgcttcagtaatcccgccggcaataatgtatacgccgctgcggctaaggcggccatcaccccccagaaaaaagcagacggcgaaatagccaaatgtgttaaccgtccctttgtcaccactagcatggtaccaagcatcgccatggcaatcgtgaacaaatcaattcggcgcggtttttcacgtaatcgtaacgccaaaaaaaccaaaacgataatcggtgatagatattgcaaaattgtcgcagtcgctgcgttagccactgcaactgctttaaagtagatatattgcatcccgatcatgccaaacaatacaaacaagatcagctgtatcgcatcacgccgattatgccacggtgacataatggcagcgcgatctttccaaacagctaacgtcatcaaaacaacgccggcaatgatcattttagagctaatcagccaggaaactttaatgccttcatcaaataaagcttcactcactggaccggatattccccataaacttgaaccaaggatggccagaaaaatcccccataagcggatgcgtttcaacgctcttgcccctttttgcgctgattggatcagtcttgcatcacaacatgatcatcaattaatcctgcgccttgcaaataattatacacgattaccgggccaacgaaggcaaacccgttctttttcaaatccttagcaattttcaccgataatgcgcttctggttgggatctcagccaatgatttaggtcgattgacaagtggtttgccatccacaaatgcccataaatagtcattcaagctcccatatgccgcttgaattcgcaaaatagcccgtgcattcgtgatcgttgcttcaagtttcatgcgattgcgaataatgtcggtgcgttgtaataaggcatcaatgtccggctcatccatcgcagccacttttttgatatcaaactgatgaaacgcatcgttaaaagcggctcgcttatgcaggaccaattcccagttcagaccagcctgaaaaatttctaacgatagtaactcgaatagcttttggtcatcatgaaccggaacgccccactcatggtcatgataagcacgcaattccggtgacattttggccaaccagtccgtgtattgcttacgcgcctgatacttccgcaatgccgcctctgttttgacctgctcagcgcgatcatgtgcatttgtcattttaggattcctccaagtttttatcgttgttaacgatacattacgccgtcagttgcgagaatgccagttaacgtacttcggaagatgattgtgttgcgtttggggctgtggtagcttggaggaattcttttttcggcaagtggcggcgttattctctgttttctataacgcgctcgcagtcgcagcaatttgcgtgtaaggacctctaacctaaatgggcaaagctcggccattttaggccagatggcccttatgttctggcttacgcccataacgcgctccccggcgcagaagtctgcgtgtaaggaccttaagcgcaatggccaagtgcgggccatcacgcttaaggccacttacactccgacttctaaacgcgccggctcgcgcttaccaaaaaagagtccgcaaccttcgctgccgactcttcatcgataaaacgcttattttgttttgacaatcagaacatcacatggagccgtgcggttaacgtattctgtcaccgaaccgactaatacgcgctcaactgcattcaaaccggttgcgccgatcacgatcaagtcgttgtgatgatcgtggggaaagtcggttgcgataactgtcttagggtttccaaaccggatatggatgtccacatctgtcaggccggtctgctttgcctgatccttcaagttctctaaatattcctgtgcgtcctgtgtcagctgataaactgcatcacctgagatcatgccgccgtaactgccgataaattgtttggtatccagcacatttaacacatccaaatgtgcttgattggccgatgcaactttaactgccttgttgaaagccaattcagcttccttcgatccgtctacaggcaccagcaagcgatcatattcttgatccattccgctcacatcctaactttctaattaacttaagcatagaacggtgaggaaacgaatacaagaaataaatttgcacttttacatggtaatctatcttcacaccatgtaaaatatatgccagtaacatccttgaagcattaacacacaacttgcagaatggctatcattatttattaaaatatgctttacttttgcggttttatgattgatttaatgcgtaatgatgctatattaaagtgagtaagctgaattcttaatttttaaaaatttggcgttcaaaaagaaaagaagcgtggtgaaattaatgattacaaatggtgttggcagtgttttacggcaaatccgtaaaagtcgtggcgaatcaattgtagaagttgcaaaggcaacccatacttccccggcaagctttaccaagtgggaaaatgatcaaacaattccaagtgaacgcagtattcgtaaacttgcggaatactatcaaaccgacccactggaattgctcggtgttgcataccctgataagtatgcgaaacagcaagaacaggaaaaagcagctgcagaaggctcaacgatccgcattgaagatctcatcggaaacaattccgttttgacctacaacggctcgccgctttcttcaggaaccaagtcactcgtcgcagcattcattgctggtcttattatttcacagcctgaatagttgttcgaagtgatgaaggagtcgtctgaaaacggctctttttttgtgagcgcgagccggcgcggttagaagtcggagtgtaagcggccttagccgtgatggccggtctttggccattgcggctaaggtccttacacgcagacttctgcgccggggagcgcgttatgggagtaagctggaacataagtggcgtgaggcgtgatggctgggctttggccattgcgcctcaggtccttacacgcagacttctgcgccggggagcgcgttatcgtcacgaaaaactattcagccgttgctggtcaccatccatttcgcgtatactaaagtcaaacgttttcacgatggaggaattaaatttggaaccatttgttcttaatatcaaaaacggcctcaactttcgcgatcttggtgggtacaagacgaaatcaggtcaagtgattaaatcacgtaaaattattcgctctgccagattaagcgaactgtcagatgacgacctgcaatatctggcagactatggcctgacaaccgatatcgattttcggtctccggaagaacaagcagccgaacctgaccgttatcccgaaaacacgacttatcatttcgtcccagttttcccaacagatgaaaccaaaagcagcgaacaagccgatgctctacaaaaaagtttttcacgcgatccccacgctggctttgaaaatatggtcaaaacttatgccgatattgtcaaaatgccttccgctcaaaaagcttatcggcaattctttgacatccttttaagtcatcaggaaaatgacggtgcggttttatttcactgtacggctggtaaagatcgcaccggcatgggcgccgtttatttgctgtcagcattaggcgttgacggccacaccattcgccaagactatctggcaaccaacgatcttattcagccaatggtcgagaaaaatcttgctgccgctcgcaaacgcggtgcaaccgatgctttgcttgccaacattcgcgatctcggcacagtctccggtgcatttcttgatagcgccttagccaccatcgatgctgaatatggcaacatgcacaattacctgaaggaagccttgcaattaaccgacgccgaaaagcgtgatttacgcgaactttatcttcagtaattagcgccaaaatcgtcatattctgttcacattttagcggtactttaacatcgtcgtgaaaagcgatgttcacctcctgcccattatcctgcactttccgaagttaaatcagggaagtgcgtaatgtaaaagcgctgttcggcctgaccgcatggcgctttttgtctattaaaatgactgtatcataatgcgttcaccgacgcaggaatctacagtatggcgattttttgcgttcgtcaggtcatttagctaaaataatggcaaacaccattgttaggggtggcgctcatggatcttaaagctacgattaagcagcacgccaaagatctgggtattgacaaaatcggatttacgacagccgataactttgctgcattaaaaccaagccttttagcacaaaaagctgccggccacacaactggcttcgaacaccagaatctggacgagcggctctatccggataaaattttcgaccaaccgcaaagtattatcgccattgcgctggcttatccctcgaaaattcatgaccgaccaccgcgaaccggtcccaaacgtgggcgctttgcccgtgctagctggggaattgattatcacacggttctcgaccggaaaatggcagcactcattcgctttattaaaaaaaccgccaagtcacagactgatatccgctttaaacccatggtcgataccggcgaattaattgatgtggcagttgcccaacgagcagggctgggttttatcggtaaaaatggtttattaattacacccgagttcggttcctatgtctatttaggcgaaatcataaccaatattaaatttgcccctgatgaacccatgtcatgtcaatgcggcacatgcacccgctgcatcgacttttgtccaccacatgctttactcggcgacggtcgaatgaacggacaacgttgcttatcttatcagacacagacaaaggggtttatggacccggaatttcggccaatgattcgcaatgttttatacggctgtgatatttgtcagcaagtgtgcccgttcaacaaaggcaaggattttcacgttcatcctgaaatggagcctgacccggatactgtcatgccggaattgatcccgatgctgacgctaagcaataaaggattcaaaaaccgattcgggaagcttgccggcgcctggcggggaaaaaagcccttgcaacgtaatgcgatcattgctcttgtcaatctccacgatcgcagtgccgtccctcatttgcttgaagtgatcgataccgatccccgccccatgattcgcgcgactgccgcatgggctgtaagcgagcttgccgcaaccccaaatgctgagttgacaacattcctggagaaagcgcaagcaaaagaaaccacagctttggcgcaggcagaatttcaaaaagcacttgagcgaatcgcgcaacgttgagcatgctataatagaaaataaagatgagaggtgcctattttgaaattatatcaaggacttacccaagtacaggtcaatgaagaaatggccgatgatgcgccagacttcaagatcacaaccgatctagttaagccgctgcattacgcgccatcggaactctatcattacttagacgctgttttgaaaccaggtagtcggcacgatcaaaacaaccttaaatatgtcacagatgccgccttcattggtgagaattttgacttcaattcggtgccttttaccgctaaattgaaagattttgaggccaagatggcatttgcccgaaatctggtcagtgatcttaaccgccacgttgccgtcaatattaatacccaagaccttacgtttgagcttttgtttgtcgattaatgacgtcatatcgaccagtcattcttcccgttttgattggcattcgcccatcgtcaagaataatcctaaaaataccgcaacccgatcacatgaaacgccgatcaggttgcggtattttttaattgattgatgaccaaattcagttctggcgcaacgccggaataacagcggtcagttgctgaacaactaacacggtcagtgccattttaagcaagtcgcctggaatataaatcagaacgcttaaaatggcaggcacaaatccgatacttgtcgtgaccgttagccataatgcgcccaaaagttctgtcagcaaaacgccgccaaacgtcatgccgattgcttttgtgagccagaaatcccgtttcaggaaatgcgtgatgcccacgtacgctagcggcgtcagcaaccagccatacataaagccggctgtcggtcccataaagacagcaataccaccgcgtcctccagtcaacactggcaatcctaacgcagccaacgccagcaacatgccgatcgtaatggtcgccggacgcgtcggtaataacatggcgaccaacatgacacccatattctgtaaaacgattggtacacccaagaatccaacggtaattggtggggcaaatgccaacccgattaatacagctaataataaccccatccgtgtcaacgtctttgtatgcatgacgccacccttcctgcttttgtatttcgttaagcataccatgttttgtttacaattgatcaaaaaattcgttcatggcctgtctctttagtgttctttttaatctggttaatttaaactgacgaaccatcgtgccatctcgctcaagaaccaccgcttaattgcatcagcgcaaacacaacatgacgcggtacccggcgcagaagtcggctcgcgcccaaataaaaaatcgcggacattatcgtcatccgcgattaaggcctgcccaggctggattcgaaccagcgaccctttgattaacagtcaagcattctaccactgaactactgggcaataagtatgtatagtatattctcatgtttcttagagaaatgcaatacttttgtttgaatttccgacattttttcagattcctcttagacaaggcgctgacaggtgacgcacttgctttgaattttgagttagcatcgtgatccctcctaccagctatctcgtcacacatcgttcatctttttcctctataatgaacgtgaaaggttgtgaacctatggaaacgccatatcctaatatgcaagataaccccaacctgccagttgaatcaggcgatcatcaaccgatttggcaggcactcatcaagaaaatgccaccgttgactgacttgcgcgtccttgtcattcattgtggcgatggctggttttgccgttatgctttgaaccacggtgcgacagctgttcttgggattgacaccgataccgaagccattcaaaatgcgcgtgcagctgcgagttctgatcggctccgctaccgaatcatgcccgatcggtggttgaaattgctgacgggtccctacgatttgattgttggcgcattcgaccaatcgccagcggaattaaaagcgatcactcaggttcttagtgctctgctgaatgccaaaggacagttagtggctgccgttgcaccgccaaaacaaccaactggtgatcagttagcggttgaagaactgatcagctcacaattggtcattaatcgttggtaccaggttaccgacaaacggctggctgaaaccgcacaactttatctactactgagttcacgggtacattaagattatctttctaaagcaacccacgtaaaaagcacgcgttagcaattcccaatgctagggaattgacgcgtgctttttaaactgattttaactgattaaagtttgccgacgcttagttgatcacttcaacggttgcagaaagcactccggctgatggaatggcactatttggcattgcaacgtcaagctggcgcgggttgctatatgcaaatgagccagtatcattaacggttcgttctaacacttgtccgttagacatggtgattcgcagcttagtacctttagggaagacgctcaggtttgcagccacaccttcgtaacccatgttgctacctaaaacagacgggtcatagaaactaattttaaaagtgcccttattagttgatgtttgggtcgtctgggttgctggtgcttgctgttgttgaacagcagcctgagatgcagctgcctgctgctgtgcttgttgctgagcagcggcttgctgttgtgcctgttgttgagccgcagcctgttgctgagcttgttgttgcgcctgctgttgagcagcagcctgagccgcgctggaagcagcagcgttggatgccgcaacactggaagctgcagcgcttgatgcagcggcgctagaggcagccgcattagaagctgcagcactttgagcagcagcatcggatgcagcctgattattatctgtggatgtttgcgcaacctgttccgcagtcgaggttgtctgagttggcgcagcagtggcatcagccttcttggtcaatgatgataattgctgcaaggtgttgatgctcaaataacgttctggaacccaaccatggtcagatgtttcgtaccagatttctgcgtaaacttttttactattaataaatttaaggtgttcaccggttgctacataacgcttaacttgctgtcccacagtcggtgaggtccaaacggttgttgcaccgccattataagtgacatcagcttcagtcttatcactggctggtgcgctgacggtggtgtcagtatctttcgttgccgcgttaacgtgacctggttttgacaaggcaacggcagataaagcaacggctgagaataatactgtacttaagagctttttcatgttcgagttcctcctgaatttgtgtggtgacttaactaactgtcgcttagtatagtcagtgagtattacgaacatgtattcggcgtgttgcgtttaggttaagttctatgacaaaagattacattagattacagctttaacataacagtcggcacaatcgccctcatttagtctgtgttatccagccttcaatccgcaaacagatcactatttaaccgctacaaagccacctggtttcgtatttgtttacagctcggcaacatgcttcatcattgtcgatcatttaaacagccgttctaaaatagccgtcaaaacctgatgtcccggcttcaacagtgcttcgttgaccggcgcttgcggtttatcagctgccgcaccaatcgcagcaatcattgcaggcgtgacttccaaatgaaattgcaagcccacaatccgctcatgataagcaaagccttgcagtgcgtgctcattttcatacagtatctgactgccgggtaatcgactcatcgcttcgccgtgccaatggaaaacattcaataacgtcccatccgttccttttactgtcccgacgccttcctcaggtttcggcatgcgatacacattggcaccgagcgctttggtaatttgctgtgctccaaggcagatacctaaaacaggccggttaagtttgttcagactgcgaatcaaaatccgttcagcagcaagccaatcgagatcatcattcacactcatcggcccgccaagcacaatcaacccatcaatatcagctggatttaactgggcaattggatcgccttggtccggtcgataggtgactgtttcaatcccctgatctgcggcccattctttaatcaccccgagatcttcggcatctgcatgttgcatgactgtaagcttcatccgcccatcacctctcctttattgttcatcttcaccttttagcaccgcggcaaacgcctttattgtcgtcatcccaggatcataaactgcaaaataaacccgtttaaaggcaccggcgaattcaggcatcaacaacgtgtcgcgaaaaatcttggcaaccggtttgacgggattcccaaaaacaccggtaccaaaagcacccaaaatgatctgatcaaccgcatgcattttaaaagcgcgcaacgtttggagaaccttaaacgcaatatcatgcatggcggtttcgttgtctaagtgtggatctacccgacgatcaggggcagctactgtgacgatatcaacatatttattcggtaatcgccgaccttgatcgtcaaacacctggcgcacatgttcggcataaatcagtttggaactaaagagcccgcgattggcctgttgacaattgacatcatagtaatcggccatatgttgcttcatgccgggcaccaggaaagttcctttggcaatcgattcttcttgggctcgggcgccaaacatcacaccaccgcctggatgaatcggactagcaaaattcatcaccccaattttgcctgtcaattcactcataagctgaaaaacatccacattccgaatagcaatttgcggcgaagtagaaccttgtgccggcgtttgcggtaatggttggctgatcagttccgtctttggcatttccggattcgctttaaaaactttcatcgtttcccaatacatcttaacctgttccatcttaatcttgctcctattcaaaataagcgtgatcaaacgcgctcagcactcggcgtatacgcgctttatggtgtggtcactcacgttttgacatgacaacacagattcttacgcgcagataaccacgctgacagacgctttatatcaaatgctgccatctaatcaagccgccgcaactaccccaaaataatttctgaccgatctcagcataacatagaagcaatcaactcatgaattatcgttcatccggccaattcaatgttaaaattaagtttgtaagtaacatgaaatgaggaatggaatacatggaaagtggccaaatcgtccccaatttattggtgatgctcgtcacctttttcttcgcggcattttttgtcgcctgtgaatttgcattggttcaaagtcgtccgagtgccttggaagatatgattgacaaaggcacaggccgcaaagcgaaaatcgagcgcgccttgcgaatggtccacaacttgaatgaatatttgtccacaacccaagtcggcgtttcgctggcaggtattattttagggtggattggtgaaaccaccgttgaattcctgctggtcgatttgttcgggttgacgcatttaagcttgcctaatggtagtttacatgcggtaggtgcagttttaggggtcattattttaacttatttggaagtggtgcttaccgaaattgtgccgaaaaacatttcgattgactatccaattaaaactttaatgttagttgtcacccctttgcattatttccacattttgttcttccccttcgtctggttactgaatgtcagtgcgaccgccattgtcaaaatgatgggcatgaagccggctgatgaaggtaacgaggctttttcgcaagccgaaattttgagtcttagtaaaaacgccgtaacatcaggcgatatggaacaaaacgatgtcatctacatgcagcgggcattcgagttaaacgacaagaccgccaaagatatcatggttgatcgcaccagcttgtttgtgattgatattaataccaccgttaaagaagccttacgtgattatttaacccaaggctatagtcgcttcccagtcgttgcaaatggcgataaggacaaaattttaggctatgtctacatctatgatctggttaaacaaggtcaggtagatccgtccgtcaaggtttccaaactcttgcgctccatcattaatgtaccggaagtaacgccgattcataacatcttagcccagatgatcaagaagcaaacgcctatcgttgtcgttgtggatgaatacggcggcaccagcggtattgtgacagataaagatatttatgaagaacttttcggcactgttaaagatgaaattgacgatgtgtctgatgaatatattcgcaaaaccgacaatcctaaagttttccgagtcagcggcaagaccacactttgggactttgagcgctatttccacaccgacattaaagcgttcaccgactccgaaatcattaccatagccggcttcatcatggaaacacatccggatctaaagttacatgacaaggtcaaaatcgatcactttaactttacggttgccgatttctcccgcggttttgccaactggtttgatgtgactgaagacccaaagccggttaagcaaaccgttgccgaagaggttaaggaagccaagagccagcgtcaagactaatgttgtcacgtcatctgcttttgttggtgaagtttttagctcaagacaaaaatatgcggccttattaaaacaatcaagacccatcatttcaaaataatagcgtaccatttctcgacttttgcaagaaatggtacgctttttgactctttcgtattagtaacgttaactttaacgatttcagcgcccgctacctccacgccactgcctcacgcctcatcattcggtggctacttgccccagataaactgcaacatcgcgcggtcaacggcgacattgtgttcatgcaagcggctgtgttgggcatgcggtccggtcactgctaacgtttgatacttcgttagccctcgcaacaaatagcctagactcaaagccgaattaacgcttacgaccgtatctgtgtcactgccgtcttgaacattaccataaatattcaaaacggatttagctcggaagtgttcacggctttgcaaaagtcgcgcgtactcgggtcgaattaaactaggccgcccatcagctgccaattgcagttcatggggtttgtcattccatcccagtaaaccatcgtacgggccggcaatcacaactaccttttccagttctaccggtgtttgtgccatcgcggcggcaatcacggcataagcgcccatactatggccaaccgcatttaaccgggtaacgccatagcgctgatgcaacatagttagaattttggccagccactgactatcgacttcttcgccagccgtattgttttgaaaaatcacctgaataatgggtgcagctgtggcatgcaagtctccttgcacatttaattggccatttggactgacggtcacgaccatgcttcgtttggccacccccgcagcctccgccgattctataagttggttagtggaaaacgcggtcccccgataaccatgaacaaatatagtcggtgtcgtgtcggcttcgactaattgaccgcttggggccaagccaatgattagaaccgccacaactagcagtattcgtttaattaaacgcatataatcctccaccttgccagcgttcgcgcacatagcggcccgcgtaagcaaggaaaagaggaatcgtcacaccagcagcaactaaaacaagtaaattcggatcgcccaacttttccagcacatagccgaccgccttgtgcccatacattatgggtagtgtactacgaccaatgcgatctagccagtctccaagcacggttccggttaatgttttcgcaccggcaaataaaccgccgcagataataaccggcacaaagctagcaagtaatggatccgttagatggtgcgacttcatgtaaagcaagaagtcgatttgaccgcgcgactgggcaacaaataaaccggcaaaaacaccaagcgcaactagcataaaccatggttgcgtgacaatatggcgagcgtaatgaaataaccaccagcccacaaacatgtaaggcaatgcaaccaatactaaatcaagattgccgggaatcggaaatcccaaaacagtttcagcgttagggtaactaaaccctaaccagaacaatccggccattaaaattgcttcgtgccagacttttggcaaatacccgcgcaataagctaaacagcaagctactgaacgcatataccgtcacaaaccaaaaaactgacaagtagccattcaattcggtcccaccataaattaaccgtcgcaaataatcaacggtaaacgctggggtgcgctgttcaataataaagttcaacaagattaaaccgacgccgtaaccaaagtattgtttcaataatggccaaaaacgtcgcgctagaaaagcttttaaggttggcagcgttgtcggcttaacaaaaaaaccgccaatcatgaaaaacaacggcatgtgccaccaatacagactttcataaaaggttgtgttgcgcggatagaaatgtcccagcacaaccgcaatgattccgaggcccttggcaacatcaatccattcaattcgctgatgcgatgatcggactttcacgtttttaaacgcccctttcgttcgactaacttacttttagcctaacaaggtgagtggggtatttctttgatccctttttaaagattttgtgaaggccatttacccaaaattgtcagtttacgtgctagactagattataatgtttttagaaaggacacgatattgttgacaacaactgatgttaatggtcatccttacaatcgtttgctgcttgtcattacgctactgatcgggacctttacgacttttttgactcaaacgattctgacgactgcctacccgaccttaatggcggattttcacattagcgccagcgcggttcaatggttgacgaccggcttcatgctgattatggggattatgattcctgtttcggcttggctgctggataaattcaacgttaaacatctttatttaaccgctatgacgattttctttttggggtcgctgctatgttggctcgccaatgattttcaaatgttgctgcttgggcgactcattcaggcaatcggcgttgggatgtcgatgccaactttccagaccgtcatgttcaccattttcccacctgaaaaacgcggtagtgccatggggttggccggcattgtgatcgggttggcgccggcaattggcccgacgctttccggttggattctgctgcatcacacctggcgcgcattgtttgcggtcattatgcctatcgctgccggtgttgttcttctggcgatttacagcatgcgtcaggtgctgcctacctcacatcccaaaatcgatgtgccgtccattattgcctcaacgttaggttttggtggcttattgtatggcttttcaacggttggtgacgctggctggacagactcacaggtactcatcagtcttgcgattgggatcgtttttgtggctcttttttgctggcggcagttgcatctcaaaaccccgctgttggagttacgggtttttaaatcgaaaacctttactttgagtgtcattttgaccgctgttgctttcatgtccatggttggcgtggaaatggtgctgccgatgtacattcaaacgattcgcggcgaaagtgcttttcactctggaatgatcctttttccaggcgccattatgatggggatcatgagtccgattactggccggatttttgataaaatcggagctaagcgtttggccgttgccggtttatttctcttagtcgccggtacgctgccattgatgactgtcaccgcaacaacaccactgatttacatcacggccatttatacggtgcggatgtttggtatcaccatggtaacgatgcccgtcactactgccggtatgaatgcactgccaacccatctcatcaaccacggcactgcggttaacaatacgattcggcaggtcgcggcttcaatcggcaccgccatcttggtttcggttttatccgtcgtcacaaaaggggccacgccctcggctagcgggaaagtcctggatccaattgactacaccaacgcgatgcatcaagcaactcttgccggctatcgtgctgcttttgcagtttcgttggtcatggccgctttagggttagttctgagtttctttttgaataacgatgccatggatcggaggcacccatcatgattattctgctgttgattattggcgccgttgccttcttttggacgatggtattgatgaaacccaaccggcgtcgacccttggcaatcgctgtgagcgccttgctaattatgataccggttgtacttttgagtttgaatgatttgtatcacatcggctttacgattgacgaaaccactgaattgcaaccgctagcacccatgaatgaccagttacaaattcaaagccaccccatcggcacggctaagaaacacatggcctatcaatatcgtatttcgggtgatgcaacgattcataccgttaaaccaagtactaccgtcaaaaccaaactgacacacggtacgattccgcaagtcgccgtgactgcgcagaaactccagtacaccaatattttcaccgctattatgttcgccggatccggtgaacaaggcaaaaccattggcaagatttacacgttcactttaccgagtaattggcaggttgtgagtttttaaagtatctatatccgtaaaaagccgtctaaaaagccgtccctagatttctctaagggcggctttttataacctctgaatttccatacggttgaataaaagcgcaaacgccttacgccaacaacattcgatacaacgtactgatcggcaaacccatgacgttgtaaaaatcaccattgatcgccttaaccagtaaagctccggcgtcttgaatgccataagcacccgccttgtcttgataggcgtcttcttgtaaatacgactcaacttcggcttcatcaagcggccaaaaagtgacatctgtggccacgacttgctgccgaatcgtgccattgtccagacgcacccacaagcccgtatagacttgatgggtttggccgccgagtgcagtgatcatttgcttggcttctgcacgactatgcggtttacccagtaactttccttgaaaagccaccatcgtatcggccgcaataattgttgcccccggatagctcggtactaacgattctcctttggctttggccagactctggacatactccggtggtggcaaaatcggcaacgcccgttcgttaattgctgcaggatgactttcgaatgcaggaataatacgcttgagtaatgcttggcgccgtggtgaatgactcgccagaataatcatgcctgcatttccccgctttcatgactgtcttgaatccgcttgaacattttctccagatcggtgttggaaaagtggaccagaaccggccggccatgcggacaattgaatggattttcgcattgtggcagtttctgcaataacgcccgtgcctgctgatcgtctaaatgatgattggctttgatggcccgcttacagctcatcatgatcgccgtcttctcccgaaaagccgcgacagagatcttgccgtcacgcaaaacccaatcaaccatctctttgatcgtgtcttcttcctgaccggctttgaaccacgtcggatgatgctcgaccacaaaactattttggccaaaatcctctagatacaagccgaccgcttccaacacatcccgatgcgtgcggatattgatcgcatcggccgcggagtaatccagcacgatgggaaccagtaaatgttgctgatcgttgctgacttcaccaattgcctggcgataaaactcataattaacccgttcttgggccgcatgttgatccaaaatatacaagccgtccccagcttccgccagcagataggtcccgtgaacttgggcaaggtaggttaaatcgggaaaacgttcagtcggctccggtcgcttcaaatccgaagctgcggtatcctccaccaaggcaggcgcaacattggcgtctaacgtttgataacgctgatcccaagcagccaagcgctgtggctcatcaaaaattggccgatcatctaagtcgttgatggttaaatcgactgctgcttctgtctgcgctgctggttgagaagtcggcgtattgccagtgttagtgtcggcgttttcgcgcacttcagcaccttgattcggcactgctgtcgttttaggactgattttattgagggtcagttccagttgatcaagatcatagcgctcgcgtttaggcaaattatccatggcatcgggaatcagattttccttggctaagcgcgcacgaatggcctcactgagcaagtggctgagctgatcttctttacttaaccgcacctcggctttggttgggtgcacgttgacatccaccaaagcggcatccatctgaattgaaatcacgcccataggatagcgcccgaccatgagtttggagccatagccggcaatcacggctttcgtcaactgaaagttcttgatatagcggccattgacgaccaagctcagataattacgcgacgcacgcgtggtttcaggcaaactggtcaagccactcaccttaaaatcaagatcctcggcctgaaagtcgaccattgaccgggcgaccggcaaaccgtaaatgccggccaatgtctggcgtagatcaccttgaccggctgtccgcaccatcatattgccgtcatggctgaccgtaaacgcaatcttagggttagccaatgccaaccgactgacaatatcaacaatcttgccaagttcggtctgttgcgacttcatatatttcagccgtgccggggtgttaaaaaacagatcgctcacttcgacatcggttccgcgacgatgcgccgctgtcgtttgactttctacctgtccgcctttgacatgaattttagcgccaatcccggcatcggtagcggtcgttagcgtcacatcggcaaccgctgcaatacttgccagcgcctccccgcgaaatcccagtgaatgaacattaaatagatcacgcgtggtcagaattttactcgtcgcatgacgcaagaaagctgtcgccacatcgtcagggtcaatgccgatcccgttgtcgctgacatgaatggtttgcaaaccagccgctgacaccttcacgtcaatttgggtggcttgggcatcaatactattttccaccaattctttcaccacgctggccggccgttcaataacttccccagcagcaatttggttacttaaagtggcagatagttggtgaatttttggcataaaatcacttcttctttaaatgcttttgcaggtcaaaaattaaattcatcgcatccatcggcgttgcatccatcaaatcgaacttagcaagtttggctaaaatcggactattcttgggtgcaggtttaggttcctcaaacagtgataactgctgatcctcgacttggctggtagctgccgggacggttttttccggagttgccgcttcgagttgtttcaaaatagtatccgcacggctcaataagtcagctggcaaaccggctaatttggcaacgtgaatcccgtaacttttatcagccggacccggcatcatcttatgcagaaacaccagattgccgtgttcttcaactgccccgacatggacatttttcagctttgccaatgaatccgataaactggtcaattcgtgataatgcgttgaaaaaagtgtcttggcatggacatgatcgtgcaaatattcgataatcgcctgagccaatgccatcccatcatacgttgccgtgccgcgaccgatttcgtcaaacaggattaaactcgatgcggttgcatgactcaaagccgcatttgcttccaacatctcgaccataaaggtactttcgccatttgctaagtcatcggcagcgccaatgcgggtgaagatttgatcaaaaatcggcaaatccgccgtgtcagccgggacaaacgatcctgcttgagccatgatgacaatcaatgccagctgccgcatataggtgcttttcccggacatgtttggacccgtgatcagcagcatatccgtatcccggtccatgatgacatcgttaggaatataactgtcctgccccaaaacatgttcaaccaccggatgccggccgcctttgacgttaatgtcatgggtcccggcatgcatcgttggccgaacataatggttattctcggcaacggtcgcaaaactttgcagcacatctaacgccgaaatttgagcggctaaatgctgcagccgtttaatctgagccttgactttttcccgaatatcctggaaaaggtcatactcaagcgcggttgaactttcctgcgcctctaaaatcagcgtttctttttctttaagttccggcgtaataaagcgttcggcgttagtcagcgtttgtttgcgttcatagcgaccttctggcaccttatccaggtttgacttggtcacttcaataaagtagccgaaaaccttattgtaacggattctaagattgtgaatgcccgtcgctttccgctctgaagcttcaagttctgctatccactgctttgaattcttcatggcatcgcggtaagcatctagcttttcattgtaaccgcgcagaattaagccgccatccgtcacggaaatcggtggctccggctcgattgaccgccgaatgagtccggccacgtcactaaccgggtctatcttaccgcgaagttctttaaaactgccatcgtcaagcttgctcaaaacatcctgaatcgccgggacttgatccagcgaggtttgcaactgaatcaaatcgcgcccgttaacggttccaaaggccacccgtcctgctaaccgctcaagatcatacacctttgtcaaccgctcttgcagctcactccgctcaaaaaagtgttccagcaaatcctgcacctgattttggcgcacactgatggcatcaatgtccaacaatggccgctccagccactgcttcaataagcgcccgcccattgcggttttggtcgcatccaataatgacaacagcgtatcacctttgcgtccggtacgactattttgtaggatatcaagattgctgcgtgcatcctgatccatttccaaatacgcggacggttgataggcgactgctttttgaatatgtgccagactgcgcttttgggtgttcaacaaatacgccatcaacatctgcaccaccgcggcttcggcaggatcagttaaatcttgggaaacataactgccttcactggtcggcttcgtgtcttgctgcactgatagcagccgctcccctttttttagcatcgcggcatcttcgtcgttcaggtcttctggcaccacaatctctttggtggccaacgcacttaattcattttgtaaggcgaacttgcttttcaggtccgtgactttcagttcgccagtggacacatccccgtaagcaaacgcatacccggctgcgtgcggcaaaactgctgtgatatagttattggtcttcgccgcaccggccttaatatcgatattcgtgccaggcgtgattaattgaatgaccgcacgcttaaccataccaaccgcttttttaggatcttccatctgttcacagattgctaccttatagccatgatcgatcaaaatatcgacatagctttgcacggcgtgatgcggcacccctgccattggaatcggatcatccgcgcttttattccgcgccgtcaaggtcagctcaagtaactgcgcccccttgatcgcatcatcattaaacagctcatagaaatcaccaatccgataaaataaaaatgcatccggatactgcgccttaatcgcattatattgttgcatcatcggcgtatcgctggttttttgcggcacaaaattcaccctttatcctttgactttctctgacgttctattattcatattttaccagttccgtcaatcccacagtttaaaaagtaagtgtcaacttcttctcggttctaatctaattaagtgatttccgagactccgagctggctccgcggtggtgaaggctggcgaccgcgcagctagagtggtgggcacgactttgaacccgcaaagtgctgtattaaagctcggccttggtctaaagcggagaaaggcactccgcttaagaccaatttcacagctgagcccatcgccgctccgccagctcttgctttctatgtcaatattcatcacaacgctgctggaatcgtctaaactgagaagcacctttatttgccatacacgtactccaagagaaacgctaatgcctaaaatccggccagattcaaccaatccagccggcagcttaccgaaacttatttcttcaaatgataactgtacgtcgcaataatcacattttcccggctagcaaaagcagcccgtaagcggaaattggtttggttgtggagaatgttctgccactttttgcgcgggacgaactgtggaatgagcaccgtggtcgtgaaattacgcttagctgcattgcgggctacgatgtccacaaaccgaatcgtaggcgcttcaatcgagcgatatgacgaatggatgtctacaaagcgaacatccggaaagtctgcccgaaactcgctttgggtctccttttccttgttaggattctcatccatcgacacatgcatcgcaatgacataatcgccaatcgactgggcataattcaacgctgctcgggtaacccgcgtcacattgccgacaaggacgataacggtgctaccgtcatagtcatgctcttcaacatcggccggcaaccgtaactgcgccgccactttgtcgtagtgatcccgaatcttgtagaacaagaagatggcaagcggcatgacgatgaagaacggccaaatatcaaacaagcgataagcaaagagaatgactaaaatggcaaaggaaattaaggctccggagaagttggcgactgttttgcctatccagcctttaccacgattgcggaaccagtgaatgatcatgccggtttgcgacagcgtaaacggaatgaacaccccgacagcatacaacggaattaatcgctccgtggacccctggaaaatcgtgatcaatgccgctgaccccagcgccagtgtcaggatcccattggaataacccaagcgatccccacgatccaggtacatatgcggcatgaacttatctttggctaaattaaaggccagcactggaaacgcagaaaagcccgtattcgcagcgaccgccaaaatcagcgccgttgcaaactgaacgacatagtacatgattccagtaccgccaaatgtttctttggccacctgcgacaataccgtcacttttgccattggcaccaaaccataccagtagtttaaaaatgtgatcccggcaaagaagaagcccaaaatagccgccataatggccaatgttttcgccgcatttttttcttttggcaacttaaagaatggcaccgcattgctgatcgcttcaaccccggtcagtgaactggaaccactggaaaaggcgcggaagattaacgccatggaaacgccgggaattgcggcaccgaccatcgatgttgccttataaggaatggccccggtcacaacttggtacaacccccagataatcatcgcggtcataaccaaaacgaagagatacaccggaatcatcaggaaattagcggattcactcattccgcgaagattcatgcccattaaaataaagataatgacaagcgagatggcaacttgatggccataaagcgctgggatcgcactggtaatcgcctcagcccccgccgaaacggaaaccgaaaccgtcagcatgtaatcaatcagaagtgaagcgcccgccgtcaaaccggcattcttgcccagattttcgctcgcaacgacataagctccgccgccacttggataagcgtggataatttgccggtaagaaagtgtcagcgagatcaggagaatcaacacaaacgccgcaattggcaacgaataccagattgctgcagctgacaaggttgtcaaaaccaagacaatctgctcagtaccatatgccacacttgacaaagcatctgacgacagcatcgccaacgctttgaagatgtttagctgttgtccgccttcttcggaagatttcaatggccgtccaataaacagccgcttcaaatgcatcattttaaactcctattaaccttaattgaaattttaaaaagtaaacatgcaccagtctacgctaaaaattgcccagcgcctaccctcttccatcttaacctatattgattggcaacaacaccgccattttacgaactcgcacaaaccaaaagaaaagcgatcactctttcgtctgaccgaaaaagtaaccgctggcaattaagccttctcgactatcacaacatcatgaacctttagcttgcgatggacttcatgttcaatctcgcttttggcagcatgatcgattttcaattcatcttttggcgtatccggcaataacttttccaagacaaaatcaatctcggtatctttgattgtccgtttatcatgcgtcagcacaatgtcaatttggtcaaagccttcgacataataaacatgtactgaaccaagtgtgtaaagctcaaagtatttaaccggtttgcgactatagagataacgcatggtattcggtagcattttatgcaggctggcgttaagtcgaatcggattttgaactagtttcatatcaaccgctccctttgctaatgtgagcgcgagaaattcattatacggaccccacgcattgcttgactgtcgctatcctggcaactttaaaatgataaccaagatgacttatttattttattttaccaaggaaagccggtcaatgcctattattgcgcttaatgcctctcagttgccatctttatttgttaatcatggtcatcttgtttcacgcctcaatgaccgtcagaattacccgaatctgttccttatgtacaacaaaacaccagcccggttggggactggtgttttttgcagccttaaacgccgaggcgaaattacatcataccgcccatgccagctgctgggtttgcgccggcagcggcagcgttgttatcttttggttcaggcttgtcagccacaactgcttctgttgtcagcaacagtgctgcaactgaggcagcgttttgcaatgcggagcgggtaaccttggttgggtcgataatacctgacttagccatgtcttcccattcgccggttgcagcgttatagccgatgccttgcttttctttcttcaacttttcaacaatgacagagccttctttgccggcgttttcggcaatctgacgaactggttcttccagtgcacgttgaacaatgttgatcccggtctgaacatcgccgtcttctttcaaagcagcaacagcaggcaatacgtctaccaaggcagtaccaccaccagcaacatagccttcttcaaccgcagcacgggtcgcgttcaaagcgtcttcgatccgatacttacgttctttcagctcggtttccgttgcggcaccaaccttgacaacagcaacgccgccagctaacttagctaagcgttcttgcagtttttcacggtcgaagtcgctggtcgtatcggcaatctgcttcttgatgatgttaacccgttcagcaatggcatccttggaaccagcgccatcaacaatggtggtgtcatccttggtaaccgtaaccttgcctgcacggcctaattgttcaatcttggtatccttcagatccaagccaagatcggagctgataacagtaccacctgtcaaggtcgcaatatcttcaagttgagccttgcgccgatcgccaaagccaggtgctttaacggcaacaacattgaaggtgccacgaatcttgttcagaaccaaggtcggcagtgcttcaccggcaacatcgtcagcaatgatcaacagtgccttaccttgttgcacgatttcttgcaagagtggcagaatatcttgaatattggagatcttcttgtcggtaatcaggatatatggatcatccagatcagcttccatcttgtcgttgtcagtaaccatgtactggctcagatagccgcgatcaaattgcatcccttcaacaacagagagttcagtatcaatccctttgctttcttcaatggtaatcacaccatcatggccaactttttccatcgcgtcagcaatcaggttgccgacttcttcattagaagaggaaacggaagcaacttgggcaatttccttcttgccgttaaccttgtggctgatcttgtgcaattcgtcaactgcagccttggttgccttttcgatcccggtccgaatgccgactgggttagcaccggcagtgacgttcttcataccttcacgaataatgctttgtgccaaaaccgttgcggtggtcgtaccatcaccggcaatatcattagtcttggaagcaacttctgcgactaacttggctcccatattttcatagtgatcttccaagtcaattgactttgcgatcgtgacaccatcattggtaatttccggtgcaccatagctcttgtccaaaacaacattgcggccttttggtcctaacgttgtcttaactgtgtttgctaactgatccacgccacgcagcattgcggcacgtgcatcctcagagaatttaatttcttttgccattgtttttattcacctcaaaattgatcgattattttttacgcaattgccataatgtctttttcgtgcagtacgaggtagtcttgaccttcatacttcacttcagagccggcgtatttgtcgtataatacagtatcgccaactttaacggccattggcagacgcttgccttccggtgtcaaagcgccttcacctacagcaacaactttgccggtttgcggtttctgttttgcattgttggctaaaacgatgccgccaacggtttgttcctcttcttcaacgacctcgacaatcacgcgatctcctaatggttttaacaaggcaatccctccacattacattttttgatttagcactcgttgtgtctaagtgctaactacaaaagtaactataacgagttttgcgggtgaatgcaacccccaaactccggaatgttatactaatttcagacattttttaaaaggagtcgtttatgtcacttcaaaaacatgctttttctattattggcgcctacttggttgccttcatcgctaacctccttatttttcaggtattgccagttgggcgccttagccttggtattgttaccttaatcagtatggtcgcactcattatcgcgattttgagcgagcgtaacttagtgattgccaacgcgattgaagcacctggcgttcttgccccgcagcaacgcgtcttctggggcgtgatgggcattgccggtgttttggcagcgcaactggttggttcgtggcttgaaaccattttattcaaaatgccgcaaaccagcagtcaaattcatcaacagctttccagtatgacgactaatccttggtactttttgaccattggcttagcattgccgatcttggaagagttggcttttcgtaaagttctgttcggcaatctcgtcaatgtcaccggtatctttggcggcgcgctcatcgccagcctcctatttgccgtgacccaacccggtggccactggcttagtgcaactctggtcgggttggtacttgcttacgattatcgccacaccggcgccatcagcacgccgatcatcgcccatgtcggtgccttatggatggtttggctttattacattgcccatgccctataaacgtaaccgaatattaatcgcacccatcaccacaatctcctataatggaaaataatgcttttacgaaggagttaaattatggagacccgctcaaatcaccgtcagcgtcaaaaaccccgccgatttcactggggaagactcatcggtttaatccttgtcgtcggcctgtttacagtcggagcttatgcgttgcgcttatacagtcaggcaaaatatgcgattgacaatacataccatgccaccaaacacgtcagcacggatattgcccaaaagaaaccatttgctgttttgctactgggggttgacacgggggcagacggacggattgaaaaaggtaactcggatacgatgattgttgccgtcattaatcccaagactaaaaaaaccaccatggtcagcattccgcgggataccgctgctgaactgattggtaccaaagaattcaatatgcaaaaaatcaatgccgcttataacgtcggcggttcggacatggccatcaatactgtctccaagctggtcaatgtcccgatttcttactacttaaccattaacatgggcgcacttgaaaaggtagtcaatgcagtcggcgggattgacgtcaacgtcccattttcattccaagacccgtataccggcaaccagaagttcactaaaggcaacatgcacctaaacggcaacatggccctcgcctattcccgaatgcgtcattcagacccagaaggcgattacgggcgccaaaaacgccagcaacaagtgatcaaagctattttgaaaaaagccatatcagtgggatcactcggtaatttcaccaaacttatggacacggtttccaagaacatcgccactaatatgagtttcgcagatatgcaaagtatcttcttgaattatcgcgatgccgccaagaccatctcaaccgatcatttgcagggcgtcaatgcctgggtcggggacggcgcctatcagattgcctccgatgtggaaatgcagcgagtctcaaataaactccgcacagctctcggcttacaaaccgaaacgattagcaatgaagaaaccaaacaaaacgcgaagaactcgcaatttgactttgaagccacaacggatcaaaactacattatttataccccttatgatcgttaatggccgttaactgtctggccgaacaatcatcaaaatcaatcagaacccacaaaaaagtcggctccggcgctgcattttcatgcgtgctggagccgacttttttacgccataaaggcatgtttgcataaacttcatgacttaaagccagtttcaaactgttttggttttcaacgatgtttgcgatcctacatgttctcgccgctgccaccatacgcctaacccaatcaccatgccaattgagacaacatatgatattaagcgattttgtaagatccaatcatcaaacgtatacggaatcaccacgagtgcatatgcgagaattaaccatcgcagcttcggcaacaataggacatcgcctgaatgttctaaggaaatccgatcaaacaaccaccttatcaggaaataaccgccgacactcgccagtatcgccccgataaatagtaaccaaaaaagttggttgccactgggaatcagcgtatgccaaaagctctttttgactgggccgtaaaatctaatcgaatttataaaccgttctattgcgctcatgccaaaccacgtaccaaacaagccaaaaacgcccatccaaaatagcgaggcaaagatcgtgccaaccccaatgccgactgtaaacataaaactgttgacggcgagattgattaataatgcacccacaatattagccccgcttagaccaacatacatcgcaggtacggcggcataaaaacctaaaagcgtgatcccaataccgattgttgttgcccctaataaatacgcaagaccatagccatagcgaactgaaaacagttgtcggcgccgaaaccggctcgtaaacagtgccgcattgagaccactggcttgatcaacgccggccatcgctattccgacaagcaaaggaatagcatacgaaacaattgtcatgaccagtcccgtgaaggatggtgcatacaatttctgcttgtcttgcggagcgattaaatacttttgttgttcttgatattggctataagacatgttggcaaacgtgtcatcatgatgctttgctgcctgccttttagtagcggtaaattcgctaggactcagcatgtactcctgacgattctggtagccttgtatcgttccgccaagattgagaaatgccagtaaaataacaaacacaaacacaacgcgcaacagaactttgtgccgtgattgaaccagcttcagtaactgatggtcatacattatttcacccccgaatgatgtggtcgaaattcaactttgaacaaatctgacaacgacagcggcaaactttcattcagtaccggttgctccgctgccaatgctgcttgaatctcctgattgaagtccgggaaaaccgcctcaatcacccgcccgcgaatattcaggattcggccatactgcttgactactgccggaattttattggttttaaacaccaactgtaacttcaccgcttgctgccgaacatcttcaagggtcaaatcgcgactgatgcgtccccctttaacaaacaaaacccgatcggataagccgtccaactcaatcagattatgcgaggcaatcagaaacgtacgctggccatccgcaaccgcatccacaaccagattgacgattttttcccgaatcaaaacatccaagccatcgaatggttcatccaagaaaacataaggtgcctgactcgctaaggccaacgcgaccatgaccagtgcctgataacctttagataggctctggaaacgggcggccccatttagcccaaacttttcaatcaagtgcagaaacgcggcttggtcaaagtcggtatacagcaatgcgtagttggcggcaattttaaccagtgaatatttgcggaaaaacaaatgctgctggtccaaataaaaaatggcttctcgctgggccggttcggttgccaaatcatgatcgtcaaccttcaccgttccgccatccgcaatatactgatgggtgatggtgcgaaaaatggtggttttgccaataccgttgggaccgactagaccgacgacctgaccgcgatctaacgaaaatgtaacggcttctagcaccggttgctgatcaatctttttttgcaaattcgtgatggtgagactcatgcaggttcctccttttcatttagccaggtatgcagcgtggcaagactgataccgagactctgcgcctcaaccaccaacgcatcaaatttagggcgaaaggttgccactgctgctgcgttggcatgtttcaacggttcggcaataaacgagccacgtcccggttcaacaaagataaccccgtcagcttcaagctgcttgtacgccttcgcgaccgtattaggatttagctgttcctgcttcgccatttcccgtacggacggtaatttgtcacctggctgcatgatgccttgaacgactctggctttaatttggagcaccagtcgttcatagtaagccaagtgagcataagactcagtcgccatgaccgcgcctcccttcgtattatgtgtactattatacgcagtacactgaaaagtgcaacataaaaacgccgcttgcctgctaaaggtaaacgacgccattacggtcttattcaggcttctggttcgttgagcgttggcccataatgttccaggaagtaaatcaatgtttgcagctcggtggctaaatccacattctgcacgcgaacataactcggtaccgaaatccgaatcggggtaaaattcatgatccctttgatacctgctttaaccaaatcatcggtaatgtgctgagcagcatcaattggcaccgtcaagatcacaatttcaatttgctgatctttaatctgtttaatcatttcatccatcgggtaaatcggaacaccgctttgaatcgttccagcgagcttaggattaatgtcaaaaccggcgctgattcggatgttgtttgcctgtcgaaaattataattcaacaacgcatgccccaggttgccgaccccgactaaaccgacattggtaagtcgatcctgattcagaatctttttgaagaaattgagcaaatccttcacatcataaccataaccgcgtttgccgagtgcaccgaaataggaaaaatcacgtcgaatcgtcgccgagtcaacctttaccgcgtccgacagttcagttgaactgatcttggttgtcccggaattagccaagaaattcaagtatcggtagtacacgggtaggcgtttcgccgttgctttggggatgatcgtttccgccatgtaagcaagcctcctgtagaagtattcccatgcagaacatgtgaactgtccaacatagtatcttctgcttatattagctggtttatggcctgaacgcaagcggatacatcttcacaagcagattttgccagctaaatgtatcagcggggaatgcgcgcccatgaacgaaactatgttatattaggtcttaacgattaattgtgaaagaaggtattcctgtgatcattttgcaggcacaacaagttggccgcagcttcaacggcaatgaattatttgccaacgtgaacctggagatccaagacggcgcccgcatcggccttgttggtcccaatggcattggcaaaacaacgctgctggaaatcctgaccggcattgctcccccggacgccggtcaggtcaccaccatgaagaatctatcaattgggtatttagctcaaaactccgggcttgattccgacaaaacgattttcaaagaaatgctgaccgtctttgctccgcttcaagcgatggcgcgtcaaatccatgatttagaggccaaacttggcgatcctaagctgattgccgatcaagctgcttttgcggccactatgaaacaatacgatcaactgcagcatgactttaatgaacaaaacggttatggctacgaggccgaaatccgttcggttctacacggctttcagtttggtgaagacacctatgataaacccgtggggaccttgtccggtggtgaacgctcacggctagcattggccaaactgctgctggaaaaacatgacttgattatccttgatgagcccacgaatcatctcgacatcgaaacgctgagctggcttgaaggttatctcaaaacataccccggtgcgatcttaacggtcagtcatgatcaatattttcttgaccacgttgtcacggaaatctatgaactggatcatcaccacgcaacccattataaaaccaattacagcggctatctcaagcaaaaagccgagcgccaggcccaagcgtggaaagcctataacaagcaacaagaagaaatcgccaaactacaggattttgtcgataaaaacattgtccgcgccagcaccaccaaacaggcacaggcacgccgaaaacaattggaaaaaatggacgtgctggaaaaaccgaccggcgatgataaaaccgtccattttaatttcacgcctaatcgaccaagcggtaatgaggtcctcaaggttaatcaggcaacagtcggttatgaagccgatcagccaatggcaggtcccatcgattttcaggttaacaaatacgatcgcatcgccattatcggtccgaatggggtcggcaaatcaactttacttaagagcatcttgggaaaaataccgttcttagccggcactgccaagtttggcgccaatgtcgatgttggttattacgatcaggaaattcaacaactcaatcccaaaaataccgtcattgacgagatctgggatgatcatccgatgatgccggaaaaggatgtacgcgctgtccttgctgccttcttattcggtgccgatgatattcaaaaaccagtgagcgcgttatccggcgggcaaaaagcgcggctggaattaaccaagttagcgctgaaacacgataattttctcgttctggatgaaccgacgaaccacttggatattaacagcaaagaagtgcttgagcaggcattaaaagacttcaacggtacggtcttgtttgtttcccatgaccgttacttcatcaatgaactagcaaccaacgttatcgccatcgcccctaccggcagtaccacgtatcttggcaactgggactactaccaggaaaagctggccgaaaccaaagctcaggccgaagcagcagcggctgagtccccaatgaccaaatcggaaacgactggtgccacttcttatcagcagtccaaagaagatgctcgagcagcacgcaaattgcagcgtgaagtcgcggatctggaaaccaaattgcaaacattggaacaacaagcaaccgccattcaaaagcaaatgaccgcgccagatgttttaaccgattatgttaaaatgcaaaaattgcaaaccaaacttgatgcggttcaacaggaaaccaaaacgaccgaggatgcatgggaagaaaaaagcattcaacttgaaacgatgcaaaatgagtctaactaacccttttcgttttgataaaagtttgccgttgactgtcagatgaaaagaatataaaagaactggttccaacaacaaattctgctgttagaaccagttctttttttgcacgctaattggtgggatgtttaaaccttttgatcaagtagtcccaatgcctggcgtaaaactttttcgccatccatcatcccataggctttcatgtcgattaccgccattggaatctttttctcgtcagccttggctttaaactggctttccataaaccggacttgcgggccgagcatgaggaccgaaactggctctgaggcgagcttgttgtccgcatcggcagctgcagttgcaaaaacatcgacgtcaataccatctgccgccgccgcttttttcattcgttgtaccagcatcgaggttgacataccagcggagcaaactaacatgatcgttttttgagccatgggaatcatcctttcgttaacaaccttatcaataagttaagtctaaccaaaacagttagacaacgtcaataaaattgctgtcgcgggtgacgattactttacgcgtgggcaaaactcaggccgggatcggcatttaaatcttcagaagcgagatgccgttttgccagttcaatatgagctgcagccccaatcatggcaccattgtcaccggtcaggcgcaatggcggcacaatgacatcgacatcgggaaaatgaacggccaaggtctcattcatcgcttctttcagcccttgattagcggcaacgcccccggcaatcacgagctgtttaaccggatattcggttagcgctttttgggttttgtgaaccaacacgtccaccactgccgcttgaaaactcgcagccagatcttcacggctgagtgtttccccaatttgatcggcatgatgtaccgtattaatgacagctgacttcaaaccgctgaaactaaaatcgagattgtcttctttatccatggctcgcggaaaatgaaaggtatcatgaccaagatgggccaatcgatcgacttcttttccggctgggtaagggatacccaatatccggccgactttgtcatacgcttcaccggcagcatcatcacgggtatcaccgatgatttcaaattcaccggcagcgcgcatatagaccagttccgtgtgcccgccggaaaccgctaatgccaacaatggatagaccaatggcttaacaaatctagctgcataaatatggcctgccatatgattgaccggaataagcggtaagtgatgggcatatgcaatggttttggcagccgttaccccgatcaacaaggcacctaccagtcccggtccatacgttacggcaactgcggtcaggtcagtataagtcacacctgcttcttttaatgccgcatcggtcaccaacgtaatctgttccacatggtgacgactggcaacttccggtacaacgccgccaaaccgctgatgactcttgatttgcgtggcgataatgttcgataggattttggtcccattttcgacaacggccacgctggtttcatcgcagctgctttcgaatgctaaaattaattctcttgctgccacattattctcccctacaatcacgatgatcgccgaaattacggcaattcccgatacatatccagcgcatcatcatggttgctgacataataaccttttttaattcttccatcttgaaaacctaacgagcggtataaccgtttggcaatctcgttattggttctaacctcgagtgtgatcttttgactgccgtaatcaattgcacggccaatcataaattgcattaaaaagcgacccagccccatatgctggtaagctggatcaacagcaatattcgtcacgtgcgcctcgttcatggtaaaccatgtaccaattaacgccaccatctgaccggcatcttcaacggcgaggtacaacgaatgccgtaccttgcgcagttcagagaagaaagcataacgatcccacggcgtatcatgataaattcgacgctcgatggccagtgctgcgtcaacgtccgcttccgtcattcggcgcaacagatattctttattgcgaacattgatcgtccgcggtttaaattgcaattcatcaggcgtcgtgcgttcaaaccacgacctaaactttctcaacataaacatcatgtcctttgccgggatgcgccttaagccagttgttttcggcttctgttaagcgtaaatagcgcggtacaaagtcataaaccgaaaccggtggcaagtctttgccaagctgtcctagtcgcaatgcttggggcaaattcagccaatccggggcaaaatgtgccaatccgccaagtgcctcaataatctggctccgaaacatggcagcatctacgccaacaaaaatgactggctggtgcaaggtcgataactccgtgagcagcagcgtcaatggaacatgtcgatccgtcaccacattcagcagtttacctttgtcccactgataaacccccgtgaacacattattccggcgcgcattcataatcggcacaatcatcgctttagtggcactgatgtttgacgctaaaacggccaagctggaaacaccaaccaacgcaatgtttagcgtatacgccagtgttttgccagtagtgaccgcaattcgaataccggtataggatcccggaccatcagcaacgataattttatctaaatcttcaggttgtaagccacttgcagcaaccaattcgtcaatggtcggcagcaattgttcgctgtgcgttcgcttgtgattaatcgttgtttgcgccaataatcgatcattatccaacactgcaaccgacatcgcctcatttgaggtatcaagtgctaataatcgcatatttaaacctccctccggcgatacaatcatggcaatagtttatcacaaatagcctcgaagcgtgagcatgtatatgcagagcttagaatataggtgtgtacttatactgctatgattgagcaaccaattgacagcaaaaccatcactttttgaaagagtagcagggttagattaaatcaacattaaatccacgcttgaccaggatcaggcaaagcaccgtttaaagccgccagcaaaagaagcacgctgccgacaataagcagcacctgtaacaagatcttaagccacagacgttgatgaatcacaccttctggagtccaatacaagtcggttgcactttgaatcccagtagcttcattctccgctaacaagcgatcgtgtaaccattttgccaaccaaatccaggccaagccggcaactataacactgatcatcacgacccacaaagcaagatcacgcgttgtcaaataattcgtagccatcacataaagacggctaataaacggcaaatggcgcaactcggtataaaattgatttccaagtgccacggcaaacgccagcccgctgatccaactaccaatcaacccaactcgacgaaccagacgcgcactcgcatcttcacgatacaagttacgaatataagtcttccgcccgctacgcacctgattcggatacatcattttatgcgttgtcaattgcatcgccataatctgccgttccaactgcaaggcccataaaccgactccagccaaagccagtgcagtcaaacctatcaacaaaagatacataaccggcaccctttctgtatggtgagcgcgagccggcgcgtttagaaaccggagtgtaagtggcctcaggcgtgatggcccgctcttggccattgcgactgaggtccttacacgcaggtttctgcgccggggagcgcgttatggtgagctgagcgcgagccagcgcgtttagaagtcggagtgtaagtggccttgcgcgtgatggccgggctttggccattgcgaccaaggtccttacacgcagacttctgcgctggcgaacgcgttatagtgagctgagcgtgagcaggagcgcttagcaatcggagtgtaagcggccttgcgcgtgatggccgggctttggccattgcgaccaaggtccttacacgcaaccttctgcgccgagtaaatcctccgcctaaacctttgattgtctattctaacaattaacggccccactgaccagtcaaccgctcagccacctgcttaacatcaaaaaagcactgaccctctgccatcaaatcatggccagaaaatcagtgctgtttttagccggtttcaacaatcaacaatgtcaattaaagatgtggtcgaatccgttcaacactttttagcgttgcgtaggacagcgccgtttgaattggcaacatgaccacgtttttaatcgtgcgcggccagataataccttgccatggcgtgcccatcatgtttagccacagtgtcgtcaaaataatattactaatcaacaacactaagccaaccccaagcaatgtccgaataaccgaaaccttcttaccgtggaagaacatcccgtaaatcatggctgcaatcgctgcactaagcgtaaacccaggaaagttagcgccaggattaaagatcatgatcgacagctgatcattcaatgctgctgcggctgctgccatccatggtccgaaataataccccatcaaaatagtggcaaaaaaagcaggactaatcttcaaccacggggtgccaaaagaaaaacggctcaaaacaatctgcatagccatcatcatggcgagatacacaatgtttcgagtggaaagcttgggactactaaacgataaaacttgcattagctgcaatctccttttttgcggagacgcctaaacatcaggcgaatgcggaacctgcaccgcgacatctgtcttcgtctgccgttcacattccgttccggcagcacttaacgcacaggttcctactcctagatttttgtaacgagtcttatcgtacaccgaaaattatctaaagggaaccccttaaatgttcgcattgccgttcaaaaaagccgtggtgaaatttatctcacaactttcacggtattttctagcgtgataccaacgatgctgccagactcttttgctaaaatattgactcgtaatcacatctttctggttgctctcattccctcatgtagggattcccttaacacttcactatcgaagtgtttttttaatcttttattttattaatcacttttcaaacacccttggcatcgctcatcatcagctgcgccacagtatttacagccaaacgggaaaaagtccagacttatttagcagcatttcaaaaccgcttaccagtggttttgacacgtgaccatcttaacagtcacgcctgggaaaaaagccgtataatgaatctcgataacgtgtgaaaggaagatccaatcgtgaccaaacacattcttgttttacatactgggggcaccatctctatgaccgaaactcgagatggcgatattatgccaagtcagcataaccctttgcttggtgccgacagctttgttcctgccggtgttgaactgacaaatgaagagatttttaacttgccttcaccgcatatgacgcctgaacggatgctgaccttggttaagcgtatccgccgcgccgaaaaggaaggggcagatggtgtggttgtcacacacggtacggacacactggaagaaacagcctatttccttgatctcacccttgattcggcaatgcccgttgttgtgacgggtgccatgcgctcgagtaacgaaattggcagtgatggcctggagaatctccagagtgcgattaaaacagctgccagcgatgaatcacggaacaaaggaactttagtggtcatgaacgatgagatccacaccgcgcgtttcgtgaccaaaacccacactaccaacgtcgccaccttccgcaccccgacatttggaccagtgggattggtgactaaagatggtgtgcgcttcttccaggaattaatcaatcaagaagtctgtgcgatagatcatcttgttgatcgggttttcttaatcaaggcctatgccggaatggacggcactttatttgacgccttaccggataatatcaacggtcttgccatcgaagcgcttggtgccggtaatcttcctcccacaacgctgccagccattcagcggctgctagaccgccacgttccgattgtgctagtttcccgttgtttcaatggcgtcgctcaagccgtttacaattacgaaggcggcggggttcagcttaaaaaaatggggattatcttctgccaaggtctcaatggacaaaaggcacgcattaagctgcaagtgggcctaagcgacggcaaacgcgggcaggcattggctgactttgtggataatgttgtgagttaagtttgggtaattaaaaaagcagttctaagtgatgaaaattgcttagaactgctttttattttcaaacaaaaacttttccctacgatgtttaagcactgaagtcatcccagatcatctgtgcctcggcattcacctggtcattggttacaacccgatgcaaggtgcgcgtcgggtcatcagggtcacgttgaaattgcgcggtcggcgtggtgccatatgcgacttcacgttcatatcgaatatctgcgccccgtaaagtatgcgtgctcaagaagtcataccccaggctgttttccatccattccagataatgagcgttattcacatgaccattgctatcaatgtcaaaataacgaacatgaaaagcttcttcaccatccggatcggtcacctttttaaaccgtggaaatcgattaatttttcggtttgaaaccgccccgacacgttcaaccagttcagggatcacatcaacgattttacgggtgcgcaaatccataatcacccaattgctgctcactgaaaccaaccgattgccttgcgcatcatcgatccagtaatcgcggtaagtaaaatacttattgtaggtggtggcttccgttccgacgcgtaaccgttcttcaatctttggcatgcggtggatatccatgtgatactgggtgatcacccacccggcatgaaactcactgatcgcatcaataccggcatgcaactgttccaattggcgttccgacacttccaacatgacattcatcatattggccaatccagcgcggccaaatcgatctcctagaaaacccggaattcgataatcttcttcataaactgctcccatgaaaaccccttctctttcaagctcggttttgtctcagtcctcagattctaaaaatacattcgtttacttatccaattcatgataagcatcataaaccacttgcttagccacgccattttgcttggcaaccaacttgattgcagcattgggcttggcaccggttgccacaatcgctgccacctgtgctctaagcggcaattgactgttgacagccggtttgtccgtcgcgccggctaccatgatgacaaattcgccttttaattcgttagcagcataggtttgtaattccgttaacgatccacggataaaggtttcaaactttttagtcaactcccgcgccaaaaccgcctgccgatcgccaaacaccgctaccatcgccgcaagcgttttgcccactcgatggggactttcatagaatagcaaggtcgccggttcgtttgatagcttttctaacacgcgctgcttttctcccgttttgcgcggtaaaaagccgtaaaataaaaacggctgcggtggcaaccctgacgcaatcaatgcggtagtggccgcattagcacccggcagtggaacaaccggtatgccggcttcaatcgccgcgtgtaccaattctttaccggggtccgaaatagacggcataccggcatcactcacttgggcaatagtaacaccgttttgcagttttgcgagcagttcgggaatgcgcatttgggtattatgctcatggaatgaaatcgttttggtagcaatttcaaaatggttcaacaacatctgggtatgccgggtatcttcagccgcaataagatcaactgttttcaaaagctcaactgcgcgaatcgtcatgtcagctaaattgccaatcggcgtcgggactaaatataacgtaccggttgtatgggtaccaaagcttcgttgctgctccaaatcaattctccccataaataatatcaagacaaaacgcacatggctcgtcattgacccggcgctggccataaaacattgggcaaacatggaagccttcattatagaggctttctaggttttgctttgattttgataattcaacgccgccgtcactggttttgttgtcgtctttttccagttcagccaagtgttgacgcagatgcttattctcgatttcaagttccgcattgcgttcaagcgtctccgccatatcatctttcatcgccgcaatttccttgagcatctgctgggcgtgtttctcaaggactaggaaaccatcgtacagttctttcttttccacaagatcacccttctaagagtttaagcattaactgttctgttgccgattgaaacgtcacattctgcgttaaccgcacctgagctgtcaaaatagcttgcaaggaagcagttaactggcggcttgataacttagccaaaatgccaattgcaggaatgtccagctgctgcagggcattcacttgaaaatggcgatttaaggcatccgcgtaagccagcccgatcaatgccaagacttgtcgctgtgcctcggcatccttggcaaccggcagtaactgggtttgcacgcgcacgaaactttccggatcatgatcagctaatcggtctaataactgaaaaacccgattaacccgatcctgaaaatcatctgacgccaatagttcctgtgcttcactgacattaccggttaagcgccctgccactcgcgccagctgcgaattggctccgccttcttccagcttggtaatcacagcgttacgatccggactctgaaaagtaatcacctgtgcccgcgataaaattgtcggcaataactgattcttagccgtcgccgttaaaatcaccgtcatccccggaaccggttcttcaaaaaattttagcagtgaattggccgctcctgccgtcattttatcagcatcttccacaataaacacgcgctgattgccttcaaccccggttttgctcatttcctgtttcaagttgcgaatgtcatccaccttgatactttgcgtactggttttgagcatcatcacatccggatgattatggtttaagatgcgctcgcactcaggacactcgccacaaggagcaccgtcttggacatgctggcaaaataggcgcagcgcaatccactcagccagcgctaacttccctgctccttttggccccacaaacaaataggactgggccaattggtgccgatcaatgacgcgggcaaattgggcaacaagcttaggctgcagcgtgttaatcagaaaatcagccattagaagcgatgaaaggcttcaatcggcagcacgaagacggtagccccaccgacttgaacctcaaccggatacgcaatcgaactatctgatgtcgcatcaagattaactggcggcgtcataaattgttgccgcgtctgggaagtctctttaataatcttaagcacttcatcaacccgttcgtcagcgacaccgataataaaagtggtgttgccggcttttaaaaatccaccagtcgtcgataacttggtcgcttgaatattagcatcaataaattggctgcttaacaggttactatctttgtcttgaacaattgcaagaatcagcttcataatatcctccctgcactagttagcattgtcgcacacgacctagcgcattccattccttacttcgcaaataactccgggaaccgctctgtaatcgtcataaacgccgcagtgacaaccgccgcaagtggctgagtcgcatcaacggtgacgattcgcttaggattatcggcaaccagtttcatgtacgcagcatgaacccgctcgtgaaaggccagactttcctgatcaaggcgatcatattgacgttcgccttgatgagccatgatccgatccaagcccacctgtacaggcacatccaaataaaccgtcaaatccggttccagccccgcggtcgcaaattggttcatttgtaacaccgcttgcgtaccgatttgccgaccgccaccttgataagcaacggaactgtcgacaaatcggtcacaaacaacgatgtccccgtgagcaagcgccggctgaatcacttcaaccaagtgctggcgccgtgacgctgcgtatagcaatgcttccgtgcgtgcatccatggccgtattcttgggatcaagaatcacatcccgaatcgtctcggaaattttcgcgcccccgggttcacgggtaagatgcacagaagtaaccgaacacgcctttaatttaggaattaatgtattcaagacgctggttttccctgcgccatcgggaccttcgaaggtgataaaagtgcctgtcacgatatgccgctccttttttggaattaagtccattttacttgaaatgtttcacaattaaaaacttatctttaaatccgtttcataaaagtcatgcaccaagatttgcagcgacataaaaacggtaaatgcttagatctgaaaaagagatcatcgccatttaccgttaatgtaaaatattgcgtgcttctaacatcaccgcgaagcacttttcccgactaaagggaagccggttcgagcacctgactgttactgatcccggaactccgcaatttgttcagccgcaactttggctacaatttcacccttgattttgcgggtgcgcgcctcacgatagagaaaatcgaataaagctgcctgtagcgcgacttgtgattttgtctggtcatcaacttcacggaaagttgccacgagcttccgttgtgccgccatctgatcacgaactcgataaacaagcatcatgagttcttcgtctttttcttctttgaccttgatctgcttgcgtccgaacattacagctcagtccttccttcaaccgccttcattaaggtcatttcatcggcatactcaatatcgctgccaaccgaaaggccatgagctaaacgcgtcactttaatcccagccggcttgataaggcgcgcaaggtattgggctgttgcttccccttctggcgttgcattggtcgcaataatgacttccttgacggcggtattctttttcagccgcttcaaaaggctttcaatgttaaggtcttccgggccgcgaccctcgattggcgatagcaccccatgcaacacatgataaaggccatggtagtcttgagcccgatcaatactcatgacgtctttgggctgttcgacgaccaagatggtgctttgatcgcgatttttgtcacgacaaattgcacacggatcttcatcggtaatattgccgcagatcgaacaataatgcagatcttctttagccgcgaccagacttttagcaaatgccgtaacatcgtctttgttcatatcaatggtataaaaagccagtctagtagctgttttagcgccaatgccgggtaagcgcatataactatcaattaacttactgatcggttccggatattgcatagtaacccctcttgctaaaatcgtgatcgctatcgtgctaaatgacgaacagctttaccatctacatgattcgactaaccgctattaaccgcggcgtcttcgcttacagaatccgcttgatggtgggttacatcggaagtccgcgtgtatacttgccaagtttatcctgcgtttgcttgtcaatgtcggccattgcctgattgactgcttcaatgatcaaatcctgcaacatatccggatcatccggatcaattgcttccggtttgatctgaatatctttcatgactttctcaccgctgaatttaacggtcaccatgtcagaagcagatttaccttcgaattctgtcgcgtatagttctttttgcgcagcctgcatctctttttgcattttctgcatctgccgcatcatactttgcatattacccattccacgcatatttgatcatcctttactagtcatttttgattgtcacattaggtgcatctttgccaaaaagttcagtcagtttactgacaaccgggggcgtctgtggcttagtctctttcgtttctgccttagctgccggtgccttgagttcctgaatatattccttgcgaatggtcggccagacatcgctttgtaccaaaacaatcttgggctgcttgccggtcaacttctgcaatccggtttctagttctgtcattaaggccgcatcgttcatggcccgttcaactaaaatatcatagtcgaagctgacaatcacgccatccggactggctgctaccggctcactgaccttcatcatcgcacgtttggtaatactcagcattcccaaaaggtcaggccagacatcttttaaattggttaaatcctgcttggttgccgcgccaagaatcggataaattgccttacgattaacatgattggctttttgttttttgactcggcgggtacgcggtggcggtgcaatcgtaccaccatttgcttctacccgcttaagttgatcgctcaactgtttgactttggccgatagctgctcaagttgcggcgtcacggcaggctcaggcgcagcttcgacaaccggtttagcggtctcgcttagccgaaccgtggcaacttccagataaatttccgggtgattggtcatccgcaattgttgctgcgtcgtatttaacacgtcaatcatatggtaaatctgcgtcggtttgaagttttcgctcaaaatcttgaattgatcgtctagcaggcttttttctaactcgcctaataacgcaggtgcttgttgattgaccaataaatcacgcagatactcaatcaggtcttcaatgaggcggccggcatctttaccggctgccagcaaatcctcgaccattttcaaagcctgcgcatgatccttagccaacaccgccgccagatatttgcctaaaacggctgtggtgacgccaccggtgacatcaagcgcatcctcagtcgtcacgtgattatcgccaaaactcaacacctgatccaggattgacaaggcatcacgcatgccgccttcagctgctttggcaatgaccttgagtgctgcatcatcataggtgatctgcttgtcatcaaggataaaacgcatccgcttcacaatatcttctggcgtaatccggcgaaaatcaaaccgctgcgtccgcgaaataatcgttgccggaattttatgcggctcggtggttgcgagaatgaaaaccacatgtgctggcggttcttctaacgtttttaataacgcattgaacgcaccggttgataacatgtgtacttcatcaatgatatacaccttaacgcgtgctcgtgtcggcgcatacttggccttgtcacgaatgtcccgaatttcatcgacgccattattggatgccgcatcgatttcaatcacatcggtcagactgccatcgttaatcgcctgacaaatttcacaaatattgtccggttcaccatcttcaaggtggagacaatttaacgctttggccaaaatttttgcgaccgatgttttcccggttccccgggggccagtaaaaagataggcgtgactcgtttgtccggtgatcaacgcattcttcagcgtcttggtaatcgcatcctgcccaataacatccttaaattgctgcgggcgccagacccgatacaacgcttgataactcaccttttcgccccctcatgaatggcttaacatttcaatcgtttagcataaagcctcgttctagtttaccatagccaagccagaagatgccttgtattctgacaacaaaaacggccgctttataacaaagcgaccggtcaatttctcaataacaaaaggcacatgacgaacctaccttagtgctgcttccttccggacctgacacaattcggaaagccatcattgccttaaggccttgcggcaaaaaccattatacctgatttcgatccgtttgaccagcctgtttggccgcttttcgttttgcccgaatcgcacggaaaaaatcttgcaataaggcagcacttgcaatggcttgaatcccggggacaacagcaacttggtgattgaatcgggtatcttccagcaaattataaaaagtacccgctacccctgctttcggatcagtcgcaccaaaataacaggtagcaattcgtgcattaatcattgtccctgcgcacatgggacaaggttctaatgtcacaaacaaactgcaatcttctaaacgccaggtgccaagttgacggcaggctgcctgaatcgccaagatttccgcatgctgggttgcatcctgcgttgtctcgcgcaagttatacccacgacctatgatttgctggtcatgcacaacgacggctccaattggcacctcgccgatagccgctgctttttttgcttcggccagtgccgcgatcatatattgattgatttccgaatccgtcattgccatcgtgaaaaagcagcctccattttagtgtgattgtcagcacaagcctccagcggtttcatataccgccaaactcgcctcataccgattcttcttattgtaaccatttaaaagaaccgcccacaaggaaattttcccatggccggttctttttagatgattgattctttaaaactgtttcaaacgctcaacgactcaatgctgctttcaagcgatcaaatgcggccagcccttgttcgcgggctgatccggcatactcactggcgctgtctttgaggctgcgcaacttatcactgacccggagcagattggccacgtcatcatcgcttaatttgtccaaaatgctttgaacccgatcattgtcaccaaaaatcttcttgacgaagccttcaacctgtttccgctgatgcctgcgttcaaaatattccgttaaattcttggcacaaacaaatgcgccggttgcaatgacagcagcggcaacggcacctgctgctaggtacttcgaatttgccatctaaatctgctcctttctatcctagtatgagtgtaccacgtcacgtattaaaactgttatttactcgctttgagaatgtaataaccgtgctctttcttaataacttccgcgttagcataagtggctttcattaactttaatgcagaaggcgcaccttgctttttttgaatgaccgcatacagctggccgcctggcaaaagatgcgcggctgctccggaaagaatgccggaaacaatggctttacccgcacgaatcggcggattggtcacgacgaccgcaaactgatcatcaatgctgtcgtacatagaactttcgatgatcgaaacattggtgatgccattatcagccgcgttttgctttgccaaggcaagtgcccgttcattgacatcactcatcgtcacttgccggttcggaaaatgctttgccagtgccaacccaattggcccatagccagcgccaacatcaagaatcggcccatcaggcaaggtttcggccaagaccgttgcaatcagaacccggctgccgaaatccacggtatgctttgaaaaaacaccgttgtctgtggtgaaacgcaaccgatgaccgccaagttcgaaatcaaaagtgcgttcatcgtgggcaagatcaggatcgttcgtataataatgctgcataaaagcctccttgaacatgagcatgcgtgcaactcggcacaggtagatccgagcaaacaatcgcgtttagatttactttaacgactattttacactttgtccgcaagcatgcgtagctcactagcccgcatctaccgccaactgtttatttgtcaattccctggccaagccggcttacccaagccaaacgcttaggccaccacttaacgggcgatgcaatggtcactttttgattaaccaccatcataatctgcaacaacgtgaatagtaaagatgtccgcttgcgataagcgacatatttaggaacccactctgttacgtatttgtttttatatgagcgtaatccttggaagccataaaaccgatagccgtattcataaaccaagtgggcaatcttttcctcgatgaaagaatagtcagacgttcccacattggcaagtggcgccatgcccatattgaaatacttaaaaccgcgctgcttggctaattggaacaggttgataaacacctcatccataattcctgacggcgcatcagcacttgaacgcatcaagtcaatactggtaacttcctgattaccacttggcatatcagaagcaaacgcaacgatcttaccttccgggccgcgaacaaccgcaatcggtgcctgattgagataatggcgatcgaaaaagccgagactaaaccctttttcactacgcccagccaaccacgaatcggataccgctttgagttcctgcattaacgcatcgtcaaacggtggttgcagtaattcaaccgtatacccttcccgttcgaatttatgcattaatgcgcgttcgcctttgcgttttgatcccgccaaggtaaaggtcgtgacatccacataaccttcctcaccaaacttcataaaatcaaaaccaaactcgtgcaacttcatcgttaggctttcattgatttcataaaacaccagtgatagatcctgcttatcggcctttttcatgaaatcaccaattgccgcagccatttgggtttcatccccgatcggttcgcccatgataatcagtttgtccgctttctttttgaataagaagaaaacccgatcctcaccgtctacttggtaaaagtgcagcgacttatcacgcatcaaagccaaatgactgacttcattgccgccatatttttcaaccactgcctttaagcgctcctcatcataaggatccgccaatggtttggaaggcgccgacaagtaacggaaaattaagtacactgttaacgccgccagcatgaccccgattaaagtcgtgaaaaacatgcgctcggacgggaataagaagacgtccggcacatgacgatggtgaatcgccggggcattataaaacgcggcgaatgcataaaagatgaatgtcagcccaaaaaccgccccatcaatcagcttattgccccacgataaggccagccgttcacgagtcagttcccgccgcgtcaaaatcaaggccaggacaaccaataccaaaaaaacgataaaacgcaggtgattgtcctcgcgcaatgacgcaatcatggcgacgatcaagacgatgacagtcggccaataagcgcgtttgacccgactggcaataccacgcccaaaccccagaatcaggaatgccacaaccacattcgtcacccgatccaaaaataggaatgtatacggatatagtcgttgataaagcgtattccgaaacgccaagtccggtgctaccccgcgcaacagcaacatgatcccggaaaagtacaggaaaataaccaaaaagccgaacgcgactttacgaatcagctgaaccggcaagccttcaagataagcattcaaacgtttccctgcatcttgagcaaacagaccggcaccaatcagaaatggaatcacatagtaaaacaatcgataaaacaacagccatacaacagcaacattgctatccagtcccaactgtccgagttcaaagatcatgaacacatcaaatgaacccagcccacctggcaccattgaaataactccgatcacattggctaccataaatagcggcaacactgacatcaacggaatccggacctcaagaaaataaccaatgagcaagaagaaagctgcacacccaccccactccagaaacgagcctaatgttaagcgcaactgccgctttaatggcatatccgcgaagaactcactgtcgcgcacgtgggaaactaacatcaacaatggaaagtatgcagccccaccaactagccaaatccaataattggaaaattcagcgccaatcccgaaaacaaagataatcacaatcccaatcatcgaccacagcgacaagccagccaacaagaacatggcgatcttagaaatagcaaatagaacctgcttttgcgttgccttttcatgatagaaattggcccgcaaactggctcctaacaaaccaccaaaaccggcaatgttcgtaaacgtattaacaatccaaccggacttaataacataccggcgtggatagtcgcccggcagtaattcggtaataacaaaatcatacgtcagcatcggcgtcacagcaatcaagcccacgattagcaaaatgatcagtgacccgggactttgcgtggctagactcgctcgcatctgttcgccgctgagatcttgactaatgcggcctacctcgaaaatcacaaacacaaggactgccagcacaaatagcacctttaacgttgtgagatgttttttaaaaaacgttccgacttttcgaaaaagtctcttcattattttgcgccctccgtgtttgtattcccatccattatatggaaaacacgacccgcccgcactcattctgacttttttgtaagacactgtaagtttgcagaaccttaacgcgttcactgagtcagagatctgcgtgtgaggaccttggtcgcgagggtcaaagtgcgatcatcacgcccaaggccgcctacactccgctccctaagcgcgccggttttcgcgctccatataaaaaaggaaaatttttagtgtgaaagcgcttgacctgtaacgcgttacacaaattacactgtgtttgcagttaggaaatggttttgttggttgttagagaagacaggttaacgaaatttggttgcgcttatcatcacgcgctccccagcgcagcagtctgcgtgtaaggacctcgaacgcgatggccaaagcccggccatcacgcctgaggccacttacactccgattgctaagcgctcctgctcacgctcactttcattaggaggctattttcatgttaatgcaaacacatttttactctgaacttcccttttatcaccctacacaaattggggctttgaaggcgattgcgttaaagctgaccactgactatgactttgattatcaagaagttctcagttcactgttagcaagcgccgcagaggagacacaactgctcagtgatcggattgttttgacttacggacacgttagcaagctatccgcgccaatggtgatcggattcgactttgggtcccaattaccgtgggcggctggacagcagatcagcggtgcagtcgtgctgctagtgccagtctcaactgctgatcaaaccatccatgattggcttgatgcgattgcaacgaacagccgcgataatcaagatttagaagctgtaactcaaacggcaactgctgctattgcttaaagtccgcagtcgcgtatccaagccgatatgcgtgcacgttaaacgcgctgcatgccatatcggctttttcgactgggtgaatcgactggtatactgtgtgtggaggtactttcatggcgaatattcacgacattgcacgcctatctggttactcaacagcaacggtctcgcgcgtgattaatggccatcgttatgtttcggctgctgcccgcgctagaattctgactgttatgaaacagcttgattatgtgccgagtacgatggcccagaatctaagcgctgggaagacccggacaatcggtgtcactttacctcataccgatcatccctattttgaacaattggtaacgggaatcttaaacgccgctatgatcggcaactaccacgccgttattttaccctcgcgttacgatcaggaacttgagcgcacttatctggaagcactgcgcagacaagcctatgatggactgatcttcacatcccacggacttagtttaagcaccattgccggttaccaaagatatggtccgattgttgtttgcgaagatccgggccaggttaaacttgccgctgcttacgctgaccgcactcccgcttatcaagcggcatttagctggatgaagcggcaaggccacactagaatcggtctcttgctgagtcgaccttacgcgcaaagtgccacaagcaaactcacgattaatagttatgtggatgtctttggtcaccgtcccgagcaatctttggtggtttatcaaatgcgtacttttcaagatggttatcgcgctggaaagatgcttgcggcgaaacagcctgattttattttgggtaatggtgacgatattacggcaggattgcggcaatattttgttgatcagcatctccctattccgccattaatgggtcaggaaaatcaactttccagtcggctactaaacatgagcacgattgatcatcatgtaaccgccattggtgccgcagctttaaaactggccttgcgtgcagaagttgctcagactgtgattcagtccgatttaattcttcgtgattgatttttgtctattttaaccaaaagaaaaaccggcattcagcatggcgtttacacaccatatctgtatgtcggattttttaaaccatagattcataaccgagcgttacaacgcttgaccggtagtcgatacttgtaacgaatcgttttaaagatagtgattagctttgcttgcgtttacgcttgatgccaagaagacctagaccacccatgactaaagctcctaagaaagcaagtgccggccgtggcgattcatttgtacttggcagcgtatctttagtggaagcttgactgctggcaccattactattggcgttttcggtccctgttggttgtgccggcgtttcttgcgtctgtttcttgtcgtcgccgccctttggattggttgatggtgtggcttttggttgatttcccttgtcagttccagagcctttaccggcatctgaaccgcttccggtgtcagagcctttaccagcttcggaaccacttccagtgccggaacctttacctgcttcagaaccgcttccggtgccggaacctttacctgcctcagagccgcttccgctaccagatcccttacctgcttcggaaccacttccagcgccggaacctttgcctgcctcagagccgcttccgctaccagatcccttaccagtatcagagccacttccggatccgcctccaggttgctgtggtgtcttggcagctgcctcaaccgctgcggcaattttagtcttcaaaccaaacaaaccttgcaattgtgcaatcttttcagtatccgttttagctgctgtacctgcagcaatgacagcatcaacatcaccgtaccaggttttaccggtagtggtatctttggcattaccaactttgacaggcgttgccgctttaattgtttttgccaattgattcaatgcagcatctaataccttgttgaagttggtttcaatttgatcggcggtgctagttcctgctgtcgtttgcgcagcgacagcgtccagttcggcatttagcgttttaccggtgcttggatcggtttggccacctaaatcagttccaaacgcctctttggcagattgtatcttgtttagtaatgcagcttgttggtctgctggcagcttatcaaccaactgattcactgcggtggtcagctgcgttgttgccattgtgagtgtttcaatcgtcgcatcagctttatctaaagcagtctgcgccgatccgatagcggtattcaaagcatcagttgtggcgtcagtatattgagcgctcgttgcttttgcctttgcttgagtaagcaaatcctgcagcgttgttttggccttttgtaactgtgccgggtcatccgtcttaatattcttaaccgcgtaatctactgccggcgattcgttaccgtataaatcaacagccttaaatttaaagtctgcgtttgccgatacactcagtcccgttgtaggtaaatcttggtaagtcttgccgccatcagtactgtattgaacggtctcacctgctgccgccttggctgtcaacgtcacttctttagctggatcagtcgtatttggcgtaattgttggcgctgcgagtgtcttcttaggctcataataaaccgtaatctttttagttgtgacattactgccgctatctgttgccgcaacggttaagacgttcttgccctctaatagtttaaccgtctgatcaattgccatatgacccggctgcccgctgtttaagttaatgtcttcatattgactggcaacctgactaccgttaattgccagttccaaataattaacgttatctgtcgctgttccggtgatacggaaattcggatcattcgtatagacaggtttgtccgttgagctatcgagtgacagtgtcggggcaacagcatctaaaataaaggtcaagctgtcttgaaccgttttatcttgcgtggtatcaccgattacaacgccaaacggtttctgaccggctgtccccagattcaacttaaaactaaaggttagatcatctttaatcggtacttgtttgccatctacttgcaaagtcgtcgtcggatgcttgactttgccggtaatcgttgcaatcccggtcttagggtcatagtacttagcatctttaactttcagttgatttgctccgaaagtgacgccttggtcgaaggtcaccgcattttttagaacatcggcatcataagttgagtttaccttctgctgcttggtaacggtattgccatcttcatcttctgccgtcaccgtaatggtattatccccatagttaacgggtacatcgccactaaagtgatgtttggcatccaaagtaaccggtgttgtcgtgccaccgttagtaaccgttaccttcttagtgtcggcactagctgttccggttactttaacggtactttcggacgtttgatcttgattatcattaacccgcaagtcactaaaagtaggtgccgccaaccggacattcgtatcaaaatgcttaactaactgggtatgtgcttggtcagtataaagatcaaccttcgtcgcatagtcgctagcgtcaagtgccatagtggctttgaaactattggcatcagcgtcataagtggtcgtcaaatcatgctgctttccttgcgcatcggtataggtaccataaacagcagctggatacgtcccggtaaaggtgtaagtgccaccttgcttccctgcttgatagttagccgtttgactcgtgattttatctggtaaaccaccaccattaataatcagatcataagcagttgatccgggcttttgtgcggaagctgattgatccgtggcgtttgaggcgttatcggtcaaataaagttcaacattattatcgccttgacccaacgcttgtgcctgcttatccgtcagtggcgtttcgagttttgtgtagccatcagcagttgtccctgtcgtcgtaaaggtgccatcaagattggtgacttgattaaccgatgtttttgcactcttagtggcatccaaaccgcttcgatcgtcttttgcttcagcggtgagatagtaagtggttttgcctttttcctgtctagacgttaaagcgacatgacgaaccgttggcgccttagagtccagtgtgaatgctacatcgtatgtctgccgcttgtcgccgccttcaggaacacctgaaatacgatacgtgtaattgccatccgcggctgttttgatgttgccatctcgttgatcataatacgtgccatcccaggccggtgcgcggtaataagtatagttgcgaccagttgaatcataataagtcttagtctggttattcgagctgctgagtgttgttactttgttgccgtgattatccagcacatcgacttgcacgtcgctaatattgcgtaacaggtagtattgcatgctgatgtcgttataaagtgcgttcttatcgctcgaaaaggccactgctttatcatcaaccgtttgcttgccactggcatccgtgactaagccgccgtaatattgactgccggttttcttattggtgagcatcggaacagtcccataattgccaccagttggatcgtaagtcacaccattcagactatccacgatcttcccgtcattccaatcaccaaagaagcccatatatggcaagttgagactcgagccatcatttcccttgaagttcaagaacccttcaacaaactgttgctgatcaaaagtcttaggcagtgaaagcgtgaacggtacctgcagggattttccagctggtaccacaatatcggtatccggcttgactgccgcatcagtaattttcttgtcatagagcacgcctgaattcggatcggtagccgaagtataaaccgcattggtatcttcattgctagtcatttgatacgtcagctgatgtttggtgcggttggtaaacgtcaacttaaacgttttggtagtgcttgtgaaatctttcaattcaacagcaggatagccgttttccgaaacaaccgttgatggattcttctccaaagcatcaatcgcggctttgacatccaccaaccctgctccctgtcggcgtggagagacgatgacattatcatagttaatatcattaatcggctttgcagtattcatttcaactgttttgagaaaatcggttaatgctgtgcctttaagttgcttataatcggcatagaattcattgtctttattatttagcgcttgttttagaagtgcctgagagccggcgataaatggagatgccattgaggtccccgacatattcgtataaccattgttgttttgcgttgaccaaatattaccacccggcgctgtaatatcaggcttaaaggaaagatcagatacagggccatatgaagtgaaacttgacatccgatctgctttataattttgatttggcaacaacgccaaggcaatttttacgcccagactgtcatttggatgcgcagttacccagtcaaccagtttttgaccagtcgtattggaaagaccaaaagtaggaaaagtagccgttagagaaatcgaagtcaaaggtgtggatgtgccatcattattaacaatgattaagcctgctgccccagcggcctcggcatatttctgcttgtcagtgaaagtcagactgccacgtttgacaatcgcaattttccctttggcatccgccgtatagtcgccagcatcacctgtactcaacttaccgcttgcgtctttgacaacgtagaatttcttctgatcaaaactgtcaacaaagtcattgcttgaaagctgtacggtttcaggcccgagttttaacccactgccgtcagtaatcgtaacagcttggttgatgacatctgtattctcggccgatgcgacagttgttgccccgcgtgatgtccccggtgtgccaaccgtctcattatcctgcaggccataataatctttgttgacgccttctgtacctgacccggatgtaccggaattccctgctgaaataaccgctgcggtcccggattcattggcgttttgaacggccgcaatttcaggatcctccaatgtttgattgccggaaacagacccaagggacatattcaaaacatccgcgcccagtttggctgaatcttcaatcgcagaaacaagcgttgacgaaccagtcgtcgctgatgtgtctgaattggtaaacaccttcatcgctaataattgtgattctggtgctacaccgacaactgacttggttggatcatcacctgtaccgttagccccgatgatcccggaaacatgcatcccatgctgttcatcaaccgtgtcgtcggtaatcgtgtcattgttatctgcgtaattaaagccatacggaaccttagccgtgaaataacgcccgtgtttagcagtactggtgaatttttcaacgtctgttcgggtcaatttggcctttttagtatcactaagccgcatgtccttatggttggggtcaatcccagtatcaatgaccgagacaaccgtgccttcccctttatacttgtaattagaccaaaccgcctgcacatttgccattgaattggccttagcatcggttgggtaataaaccttggctaaagtaacggttttaacgccggggatttgtttcaaccgcggaatatcagcgactttgactttggtggtaaagccattaacaacgtaaccatagctttctccagctgtctgatgcgtcacttgttcaacggctgatttaacactggcttgagccgcgatgacctgatctgttgcctgctgaatttcggcagtactggagtaatcgggtttcagcgtgccattttcggaagccggtgccgcgctcatctgcacaataacatcgacataagtatcctgttgctgaactttatttaacttgttgtaatcaatgccttttgcggctaattgggttgcaatggcttgattggtcaccgcactggtcgtgtctttggcagtttgtccagctgaggcagtcttggctttcgctaaatttgttcctttagtttgttgcgagattgccgctttagcttgaacttcaccaattggcaaaacagaaagtgctcctaaagcaactgtgctggctaagagaattgatagccctttcctttttgtttgcatcctataccctccgattcccagtaatttcaaaactattcaaaccttggcttgatatagttaagattatatacagacactcaggagtttcaacataatttttaatcttttattaattttcttatttgtaaaaagcctctcatggctgagatactaggcgattcaggtatgtcgaggaacgaaaatgtttaaattatgtgattatgaggaatgtgttgagttttttaatatccaacgttagaatgtagccacgatctattccgcaatctgtaaaaggagattgatttcatgaagaaaaaactgcgcgttccattcttagccgcaatgatggcatcttcaatcatgctattgagcggctgccaatccaaacaagccgatagtacaacggttgctacatactccggtggtcaggtcacacaagccagtttttataaagagctcaaacaatccccgaccaccaaaaccgttctcgctaacctgcttatctatcgcgcgctcaacaaagcgtatggaaaatccgtcagcaccaaatcagtggacaatacttataacagctataaaaatgaatatggtgaaaacttcacttcttttttgagtcaaaacgggtttagtaagagcagttttcgccaaagcattcgaaccaacctcttaagcgaagtggcactaaaaaagttaaagaaagtcaccaacagtcaacttaaaaccgcttggaaaacctaccaacccaaagtgaccgttcagcatattctaactagcgatgaaagcacagctaaacaagtcatcagtgatttagcagctggcaaagacttcacgacgttggcaaaaacttattcaatcgatacctcaactaaagataaaggtggcaaagtaagctttgaatcgagcagtaaaagtctcgattcgacttttaaagatgccgcctacaagcttaaaaacggcgaatatacacaatcaccggttaaagtcacaaatgggtatgaggtcattaaaatgatcgagcacccggctaaaggaacattttcagacagtaagaaagccttaactgctagtgtctattcaaaatggtcgcgtaattcaagtgtgatgcaacgtgtcattagtcaggtgctgaaagatcaacacgtcaccatcaaagataaagatctagcggatgcgcttgacagctataaacaaagtgtcgcagccaattagtccttagtttgcgcatatgcaatgagtttcttcctatttaaataacaattttgtcattgatgttgttatttaaatcaatgacggcatcatgagtttgagttgttatcttcggcagccgtttaactttatacaaaaagcacctcgcctttcgcggtattaccacgattaagcgaggtgcttttatttgaaaatgagactagattatttcaaagttacggttgcgccgacttcttcaagctgttccttgatcttgttagcgtcgtcttcggacaagccttccttgataaccttaggagcggcatcaacgagacccttagcatccttcagaccttggccagtgatttcacgaactgccttgataaccttaaccttttcttggccagcttcggtcaattcaacgtcataggtatccttggtagcagcagcatcgccaccagcagcgccgccagcagcaacaggagcagctgctttaacaccgaattcatcttcgatcgacttaactaagtcgtttagttccaaaatggaagcatctttaagttgtgcaatgatgccatctacatctaaagccatgtttgtttcctccgttttttaaatagtttgtaacgtaaaattatgcagcaggttcttcgtctttggattctgcaattgccttgacaaccaatgcaaagtcgcggacaggtgcctgcaagacagaagcaagttgcgacagcagaccttcgcgatctggcatcttggacatttccataatggtgtccaatgaagcaaccttgttttcgatgatgccacccttgatcttcaatgcatcaaattggtcagcgtacttggccatgatacgggcaggggcaacaggatcgtcattggagaaggcaacggctgtagggcccttgaaaacatcatccaatgcttcgtaaccgttggcatcagcggcccgacgcaggtaggtgttcttcaagacttccatcttgacaccagcctcgcgcagttccttacgtaatgcggttacttgctcaactgttaagcccagatagtcgacaacgacagcactggtagcattcttgaattgttcagaaatcgtcttaacgagttcagctttttttgcgatagcttgttcactcatgtttttcacctccattagtttggttgaagtttttagcaataaaaaaactccatgtctaccaagacatagaggtatctactgtttccgataccacctcggcaggatgattaaggcttgcgccccctgagtcttaggcagagtgactaatcacaacgagtagaataccatggtcggaggttgatgtcaaagtgtttctgcaaaaatatattttgtgcgaatgccgagacttcaacaatcgtaaactgacacgttgaattgtaagcactcacagattgcgttatattagttaggtaactaattttttgaaaggaagttggcgatcttgccaagtaaacttaaaagtctcgagccatggcagcaaaatttggctgtcttatggcttggcaccttcatcgccggcatgggttttagtgaggtttcgccgtttatctcactctatgtcgaccagctcggcgattttaccaaaggccaactcagtatctactccggtattacgtttggagtcacctttatggtagttgcgattgtcagtccgctttggggccgactggcggatcgtcgcggccgtaaactgatgctgctgcgctccagtttcggcatggcaatcattattggtgcgtgcgggtttgtgcataatgtttatgcgctcattgcattacgctttttacaaggattggcagctggttacattcctaatgccagcgctctgattgccaccgaaacgccgaaagcaaaaagcggaactgccattggaattctgacaactggctatgtttccggtaatctgatcggaccgattctaggcggatttttggcccagacgttttcaattcggctgactttcattattaccggagccttactcatgattgtctttgtgctcagcttaaccatggtgcatgaacactatacgcctgatccgcgcttgctgaacaagcaaaagcgtcccggattgctcactcaagtcggcaatcccaaggccatcatggtgttgttgatttcaactgccatcattcagctcggaaacatgtctatttacccaatcatcagtctttatgtcaaggaattgatgcataatgtcgggccgatcacagttgtcgctggtatcattgccgcattaccaggtatttcaaatctgatggctgcaccacgcttggggcagctgggcgatcggatcggatccggaaaaattctggtcagcggattgatttttgccgtgatcatgtacatccctcaaggtattgtcggcagtatttgggcattaggctttcttcgcctcatgatcggggtttcagacggtgccttattcccaacgattcagacgttactttcgaaaatgacaccggtgagctataccggcaccgtgtttagttggaatcagagtgctcaggcgttcggctcaatggcaggttcactggccggtggttttatttccaacatttttgactacaatggcgtctttatttttactgcattatgcctagcgcttgaccttgcaatggtttggatcttcatccctcatatctggtcaagccggccacgacaacaggaatagcgataaggtcgcatttcatcaagatataactgcacatcggtatcactaaaagcgggtctagcacttaaactagagccgctttttgcatgcgatttgtgccaattaatcaagtttcatttgccaggtcatcagcggatgcggatccggtactgccagctgctgataaacggcccacgcgaatgaatcagtatcatcaaattcaccgttcaccaccgagaatgctgcctgaagccgcggtagaactgcgcgcatcagccgaagcgtatcagcaagccctgttccaccgagccaagcactcgtgagttcacctggctcgtcttcaaaccagaagacataagccaaaatggtgccgccttcaaccaaaaagctcggctggttcggatcggcttctcgcaacgattgttcaaattgcgtctgtgtcatcgtggccggattagcggtatgcgcgtccacataattttgataacttaaccgaaccacggcttgccactgagcttcggatagctgtgaccgtgccaccacggtatcattagaagtcgctgctgcaattttccggtagtgactcatcgctgtgtgtcggataagctcaaaccctgtccgttgcaatcgctgcgtcaacggcgatgctgcagtataagtgctaaattgcagccgatcctgctcgtccgtcattttcttgagtttggtgagcaataaaggaagccatgagctttgaccgatgacattaaaatatagtgcatgatgatgataagcgttttgccatacagctgccgcaaactgtatcggaccggtttttgggaaacccagcaaagtcgccgctgagttggcaaaaagtcctttcgtccagtcatcggctgtttccagcagcggccggatgtcagctaaagtaacctcgcggcagcccgcgtgattcaaattagtcatgatgatcggtatccttttcctgctcctgattgccgtgcaagtgcatatacccataagcaaagcgagccacaccataaatcaccggaaccacaaccccgatccaaaaatggtttgtcagataatactgcggcaatggattcatatcgagcgcggcttcgtaagccatttcgattgcaaaaataatcacggccagcaacagtgctgataaaaccccgcgcgcaaccgcaaaccaaacatattggcgataggcttccggtgtgtccgcttcaattacctgcaaacgatagtagtacaaacttgtcacgttcagtaacgcaattgccaccgtcactaacagtaaaatccacgtactggcagtaattagcttaaggctattggcgtcgataaaaacagcaatgacacttgcgataactaacataagctcggcggttagcatattgcggcccataatggcgtcataagtgcgctgtttgaaccgatccttaagtgaaataccataataccattccatgattttcttcatcaattattgccttcctcactttttacaatgtcgttttatcttaccatgcctcacgattgctttttccttgaatcctccaagctttgaaaattatttggcttttcactcgctactttttgttaacgccacgatcccttcttcacctcagacgtgcttactatgaaaattttcattgacagacccgcctttttttggtgaaataagtaacatgttttagggtgtcaagacacctaattaatgttggatttctcaagggggataacgatgtcaaagaaagcacctagccatacgcggttaattatcggaatcggcattgcctggctgtttgatgccatggatgtcggcatgctgagttttgtgattgccgctttacataaggaatggcagttgagtacagttgaaatgggttggatcggaagtgttagttcaatcggaatggcagttggcgccatcttgtttggcatgatggcagatcgtttcgggcgcaaagccattctcatccttacattattagtcttttcgattggcagtggcatatctgcttttgccacgggttatggtatttttcttgtactaagatttattattggcgctggtcttggcggcgaactacctgttgcttcaacgttggtttccgaaagcgtcccggttgaaaagcgcgggcgcagcgtcgtcttgcttgaaagcttctgggctgcggggtggctactggcagcgatcatttcatactttgtcatgccactctggggctggcgggtcgccatttttgccactggactagccgggttgtacgcattttacttccgtgaaggcatccatgaatcgcgcgcgttcaaaaaagtggcgcggccggggttaatcaaaaccctgacaaccctctggcggccaccatatgttcgttcaacactcatgttgtggattgtttggttcatggtggtcttttcttattatggcatgttcctgtggttgccaagtgtcatggtgctcaaagggttcagcctcatcaatagcttcggttatgtgctgatcatgacccttgcacagttaccgggttactttgtggctgcctggttgatcgaaaaatggggtcgaaaaactgttttaagcctttttcttctcggcactgctggtagcgcgctaggctttggcatggcaaccagcttaccgatgcttttgactgccggcatgctactttccttctttaacctcggtgcgtggggcgcgttgtatgcctattcgccagaacaatacccaaccattgttcgtagcagcggctctggcatggctgcaggtatcggccgaatcggcggcattgtcggtccgttattagtcggtcacctactaggcgctaattggtccgtcacgggtattttcggaatcttcacggcgtctatcctcattgccattgttgcgattattttccttggtaaagaaactatgggcgttaagttagctgacaccattgaaacttctgcagcgaaacagtagctgtcattgaaagctcattttctttataggaaaacggtagagtatactaagatggtttttcactcagtcgtcaagatagttagttagagacagtttataataatcataaagaaaggcgtactaaaaacagtacgcctttctttgtggccatggattatttcttaaagtggctagattacccgcaaaaccaatttaaccacatcaatttcaaacatttgtcacacagaatccataaaaaaacgtgcttaacaaaaaagtggtgcaagagaataatcatctcttacaccactagctatttccatcagattttggtttatcaccagtgtatgggcgacattagtgatccaatattactttgatggcttattgtccttctgatgtctggttcccgcaagaccaaacaatcccatcagactaacaatcagcaaacccaaaacagaagtaccgctttcagcatcatcaccggtctgcggtagcatatgcctccctgcatgatccgtttgcggtaatgaacctgtctgggttgtttgaccggcttgtgttggcttcgtttgtgttggcttcgtctgtgttggcttcgtctgtgttggcgtctgacccgatggtatactacctgtcgtctctccaccagtacttggcaaaatatgggagccagcggttgaccctgtggcactctgatcagccaaggatgtggcggaactaatggcagcagttgtagcgctggatgctacatcggcggcgctacttgccttagcatcgtcagacaaagcggcactggcagcgctagaagctaccgaatcatcagaagcagcagcactggcggcactgcttgcttgactttcagcgctcttagcactgcttgcagctgcacttgctgcatgagagtatatacccgcagcactactgttaccagcctttgcagcactggatgcggcactggccgcgctggacgcgacactcgcagcactgcttgatacaacatcctcactggaagcaatacttgcttgttcactagcatgacttgcagccgacgatgccgtcgaagcctcactttgtgcggcactagcggcactggatgcagtacttgctgcactggacgcaatacttacatctgactggatcccactatcacttgggtacctggacgcagcactggatgcggcacttgcttgacttgtagcactacttgcatggccagtcgcttcactggcactggagcctgcctgatgagcatatgaaccggcttcactggcactcgaacttgcagcactagcatacgcagatgttgcggttgatgcttgacccgcttcgctggcactggagcttgcgccacctcgtgtgccttgagctgccgctgaactagcagccgcgctcgcggcacttgaagctgcgccttccgcagcgctggcagctttgtcaaagcctgcagccgcactggcggcactagaagctaccgagtcatcggatgccgcggcactcgccgcttcgctggcaactgcttctgcacccttggcactgcttgctgcagcactcgctgcactcgagaatcctgctgcggctttgctatcaccagccttggtcgcactggctgcggcactcgcattactgttggccgtgctggccgcactgcttgccaccacatcggcacttgcagccgtcttcgcctgttcacttgcatcactggcagcactggaaccaaccgcagcagcactggttgcggcactcgcgttactgcttgcctttgctgcctcgcttgcagcctgactggcaagtgactgaatcccactatccttcggatagctggatgccgcactcgcagcggtgctggcatgttgggctgcactgccggactgaccgacagcgtcactggcgctggagcctgcctgatgagcatatgaaccggcttcactggcactcgaacttgcagcactagcatacgcagatgttgcggttgatgcttgacccgcttcgctggcactggagcttgcgccacctcgtgtgccttgagctgccgctgaactagcagccgcgctcgcggcacttgaagctgcgccttccgcagcgctggcagctttgtcaaagcctgcagccgcactggcggcactggaagctaccgagtcatcggatgccgcggcactcgccgcttcgctggcaactgcttctgcacccttggcactgcttgctgcggcactcgccgcactcgagaatcctgctgcggctttgctatcaccagccttggtcgcactggctgcggcactcgcattactgttggccgtgctggccgcactgcttgccaccacatcggcacttgcagccgtcttcgcctgttcacttgcatcactggcagcactggaaccaacggccgcggcgctggttgcggcactcgcgttactgcttgcctttgctgcctcgcttgcagcctgactggctagtgactgaatcccactatccttcggatagctggatgccgcactcgcagcggtgctggcatgttgggctgcactgccggactgaccggcagcgtcactggcgctggagcctgcctgatgagcatatgaaccggcttcactggcactcgaacttgcagcactagcatacgcagatgttgcggtcgatgctcgacccgcttcgctggcactggaacttgcgccacctcgtgtgccttgagctgccgctgaactggctgccgcgctcgcggcacttgaagctgcgccttccgcagcgctggcagctttgtcaaagcctgcagccgcactggcggcactggaagctaccgagtcatcggatgccgcggcactcgccgcttcgctggcaactgcttctgcacccttggcactgcttgctgcagcactcgctgcactcgagaatcctgctgcggctttgctatcaccagccttggtcgcactggctgcggcactcgcattactgttagccgtgctggccgcactgcttgccaccacatcggcacttgcagccgtcttcgcctgttcacttgcatcactggcagcactgaaaccaacggccgcggcgctggttgcggcactcgcgttactgcttgcctttgctgcctcgcttgcagcctgactggctagtgactgaatcccactatccttcggatagctggatgccgcactcgcagcggtgctggcatgttgggctgcactgccggactgaccgacagcgtcactggcgctggagcctgcctgatgagcatatgaaccggcttcactggcactcgaacttgcagcactagcatacgcagatgttgcagtcgatgcttgacccgcttcgctggcactggagcttgcgccacttgcgtaatcagttagagacttgatcttattcaaatcatcaagtgcttgacttcttgctgtagctgcagtcgcttgtttattcttggagtcgctttgagctgcactagcaacagcagctgcactacccgctgctgctgcatcactcactgcaaccttggcagcaacttgcgctgtcgataacgctgcgctcatggcagccgcagcggaacttgctgcagatgatgcagtggcatatcccgaactatcattagcagcagaagcggcactggcctcagaagcgtaggaatcataagcagcggctgcagagtttgctgatgcatcagcgttacttacggcagcagctgcagatgacgcttcactagccgcgctacttgccacgattgctgcggacgctgccgcactggaactagccgcagcagacttgctagctgccaaagcaatttgcgattgcttctcagcatcactggcgagagacttgatttccatattatcagcatgactgccagcaatcgattgcgcttcacttgcataactcgccgcatcactagcagcagcacttgtagcctttgcctgtgaagctgtgacatcagcagcactattggcgttgattaagctgccagctgcactggatgcctgctttggcgtttcggcatcgttgatcactaccgtcgctgttttcacaatgaatccagcactcgaaataacttcaaatgaagcattggcaggtaacgaaaccccagtcggcagttcgtaactccaattaccgtccttgtccgcctgtaccaaatattttgtactatcataggaattcgcagttaagctgccttctggaatcccctttaaacctgaaatcgttacataggctccggcagtggttttacctgtaagcgttgtggtttcatcagtaactggatttaccttaataaaattatcactggcactgacgaactccaagcttttgtcagtcgcaaacgtgtcggcaagtgctttcccggattgttcatcttctgctgtctcaccttcaaccgtagcggtatctgaagaagagccattcccttttagtgtatagatagcggacttatatggcccataggcattcccgtcatccggaatgattttcacatattgacctgttagcgtgccggtaccactgactttaaataaactgctgtctgcgtcatcgttatcggtaatcttaaaaagaacggatttcggcatatagatgttaatgttggcatcgtcaccgactttcaacaaatgcgcttcgcccgtgccaccgtcaatggttaagttggccgtagcatcctgtgcaaaactcagttgaccgtcatttgctacattaattgcattgacactctttgtccctgtacccgttacattaagatccaaagtgctgccacttgcaacgaagaagcctccggtacctttaatattgataaagccatagccaagtttaggcgcaccattttgagtgatcgtcatgtgcgatccttcgttgaggttgacagttccggtaccgtcaattcttaccgggatgtttccagttgcaccggtaatggataccgttgcattcttatcaacggttagattaccaccgtcttcaatatagattggtgcaaagccatctttcacaagtgcatttttattaaggataacggttgatccatccttaaactcaacgttacctccctgtgtatcaatcaatgcattcgtaccacgttcattcgatttgcttgcatccgtgcgttgtaagttaacggttgctcccttgtcaacaataaatgaaccgccatcatatacttcaacgttagtcccaccagtagttgtccccgtgtaagtagcgccaggcaaaacctctaaataactaatttgaaagttttgctggttgcctaagccttgggttgtctgggttgatccgtccagcggggaaacataactgcccactgactgaatctttgtattccccttaataaaggcttttgtataaatgccatacatcagttgtgcacctgtgtatgtgacattattgaacactaccgaatgatcgatgccgtctttcggcttactgcccttgatagtaaccgggccccaccaactgtaaccgtacatatttaaatcgttgatggtaaatgattcattctgactacttgtaggatcagcttcgaaatacttcttttgaaaatcaattgtgtggttattgccattaataattaggtttggccgataagcatacgattggcgatcaccactaacatccataacaaagtcggactgtacgttgatgacacttaccgttgaatcggccatggctgcatcaaactctgacgcggtgctgacatcggcgctagaagcatcgtttgataccgcttcattaactggagtttgaccttcagatgtatttgttgcagaggcactattggcgcttgcacttgttacactggcggcgctgttgccttcatttgcctgactcgtagtatctgaactaccacttgacgtgccgccaacaccctgactcgcacgaccatcgctggcatcaactgcactactgcttagagcgctggtcgctttttcgccgttactgccagcactggctaaactagtgcttttgatctggccactactttcaacgctagcactactttaagacgcactggctgcgttggcactactttgactgccgccaattttactattagtggtcgttgccacattagccgtgctcgctttggcttgaccatcgctcgcactgctgctggctgtagctacacttgcacttgctgatttcaggctatttgttccattttgaccactactggctcccgatgaaggcgcttcggtaaactctgaactgttgggcgcttgagcatcagctttaaccaaattcgtctgataggcggtccccaaaccgatgccgatgaagaataatggagcaattaaccatttcttctttgccttaaacatcttgaaacgctttttctccaccaaaacatttgctctatttatctttttcatacccaagatcctctcaataaataatgagcaacccacttgattttttacttgtatttaaaaatccggcttagaactgtttaaatagtttctcgtggtgcgatcatcccctttcctgagtacttgcaagcaaaagcgaaccgggagtcatctcaaaagaacgctgataatactgacttccatgcaccgatgaaatcagcttctgaatgttgttttgcagtacttaaagcaccagcttgtaatttgtgataaagccgattatcttgcaacacgaccaaaatcgccttgcctaactcgctaggcgtcatattaacaaccgccaccccattttgtctgttcactaacaggttatgcttcaagaagtggcatccgtatgcaaccactggtatgccatacgacattgcctcaagactattcataccgaaagcttctgacttcgccgcagaaacaaacagcgtcgtcttgtccaaaatatcctgattgtcattgctataggcaaccagatgaatcgcatcatcaagttttttcttgtggattctatcgcggatctcccggcgataggcctcgtctgaaaaataacctttgaggaacagttcagcatccggacgttctcggtgtacacgttcaaacgcatcaaccaaatccgtaatctgtttatctggaaaaagacgcccgatatacgccaatcgtggatgatcgggttgtattttcttggctttcggcgtctgtgcataagtatccggggcagccgcaatggttaagtgcggatattgagtctcaatcgctttaacttgatcatgcgtaggaaaaataacggtactaaacggatgctgctcgcttagtacctcgttgtaaatgacattaggtacgcgcttcttcccttctcctttcaagaacaggtcaccttcatgaataaaagcgagcttagcagttgcatggttaacttgcttgacggcagcatcaagcgttctgcgatctgaaatcatgattcccggattgcctttactaatttcattcaggaaaaaacggaacaggtcatcttcggaatcaaatacataatcatgtccttgataatgaaccaacttccacattgtcggtgcaagctgaccatttttattcatgtggataatctccaaaaccacatggcctttctgatccaaaaacttctgtgcagccacggttccatcgggattataattttgttccatagacttaaacccgcgccaatcccagaattcggttaactctttgtgatcaaagcgatcataataatcaatacttccaactaatccgaccgtctctggcatgacagtaatctttgcaagcgttcgacctaacagatcgatagttgtcgtattattgtcaatcccaacgacatgatatttcgtcaggggaatcgattcgagtaagcgtaacttctgttctttacgctcaaccccgacaacaccctgaaaataatcgtacatgttgatatatgcatctttgttaactcctgcacgcttggcatcccgatacaagaagcgattatagttccggagtagcagtttagattcaatgccattttgattgaaggctttcaggcgttgcagctgcgagaactcagtgccggaattaaatgtgaaaacattttcaccaaccatgtaaatcatttcgtcaccttcccctcactcttttgtgcatccattaaaactttgtgccatttcttccaaacattttcttcagaatatctgttagcagattcgtatgcattcgtactcatctgctgcatcttgtcacgatcggatagcaataactgaatcttctccgctaaggcatgaatatcgccatacggagtgacatacccattgatgccgtcttgcacgatttcgtttggaccgtagttaacgtcataggtcacgccgacaacaccatgcgaaatcgcctccagtaatgagagatcaaaaccttccatgatagaagttaagccaaaaatctgggcagtatcatacgcactttccagattttccgtgtagcctttaaaagtcacaaccccttccaatgaaagttcttggattgttttttcgatttttcgtttttcagcataatgattcgttgcatccgggtaatcatacaaatccagcgtcacttgcggtatttgtttgtggacgatggcaatggctcgaaccagatcattcagatttttttccggtgcaatcctagcaaccgcgatgactttgccgaatattcgattttccgacagaattcgctggcggtgaagcacgtcatccgataccacgccaacaggaacatggaaggactttttgatgtaagggaagcgtctttgaacatcagctgcctgctttttagttgcagaaacaaatgctgaatacttcgcaccattaactaatgcaaattcataattgttattcataatcgaatccattggccgttgcgcatcgccagcatgtgaattatgtaggtgcataatcgtgtaagcgggtttctctagatgaataagcgcttcatccgccaataaagaccgatcaaggataaagacattctggccagtttcattcatgtcattaataaaatgttcaaaaaacgcatcaatcgtgtcaaactgaaaaattttacctttgcgatctgtcagaatccacccagtctgcttaagcttgccatcttcatttttcttgttaaatgctctgattaccggacggccatccaccgttagccattcctcgttgccaaccttattgtctggggtataccactgaaccaatgatttaaatccgcgaacatcataaaattcaacttggtatagattctcaactccgtcaaacaattcgacagaaaccacctgtctagtgccgcgaacatagttgatccgcgcagccaatcgcccatcagctcgtgaaaccaacatacgattgtgctcgtaatcatcggaatattgaagatctttaagtcccaggtctacctgctccggtaacaaccggaccgcgtcaacatggcaggcgtgctgatagtaatcaaacatgttaacgaggtgatcatccgtaattcctgcattggcagtgttagtatgtagatcccgttcccaatcccgtagaagaaatacgtaaggttcaccatgcttatcaaataggcgcttgcgctttatctgcgcatgctcaatacccgatttgctggcaggcataccgaaattgatgaaatagttcactagcaatcactcctagactcaaaaataaacttatcgagaaaaattgtgttagttatgaaacgaattctgactattaattaaccttgtcccccggaagcgttatctatccaatataggtgctaacacgtcggccactcagaaccgtcactggctagaatttaactcataccctacactaatttctgactacttatacaatactagcattaaaaaatttgttaatatataaatacaatgaaatcgattccacttttgaattttcctcgagcatattgcaccatccccctttataatcagcgccatatcagccatccacaggttaaaaaaaattttcgaaaattattttccaaaaaccgattcatcaccaaaaaagcatgccaccataagctgttccttggtctacaaattttttcgcgccaaattccagttattgactcatgcttctgaccattaaaaaagactttatcacgccaaatgcgcaacaaagtcttttcaaagtttcgttatgatacaaaggcggtttttcacttgaaactcgtgcgggctagatcactgacgcagcgcccgggtcaccgtttgctcattgacaaacgtatacaggcctaaatcgccaagttcacgaccatacccggagttcttgaccccgccaaatggaagctcagcattgtaactttgactctgattggcaccgaccataccggtttcaatctgcgcagcgacttctgccgcatgattggtatcaccggcaaagactgctccgccaaggccataaggaacatcattagccaacgcaatcgcttcttcttcgctatgcaccttataaacgcaggcaaccgggccgaataattctgtccgatacgccggattgtccttgtcaatatccgttaaaatagtcggccggaagaaggcaccaggcaaatcaaccggtgtattgccgtaaacaactttggctccgtgttcaatggcagtatcaacctgaccttgcagcttatcttttgccttttgactgttcaacggacccacattgactgatggatcactcggatcgccaattttgacgtttttaaaacctttcttcaagccggcaacaaagtcatcgtagtatttatccaacacaataaaccgtttggagctggtgcaaacctgtccgcaattcatgaggcgagttttaatggcttctggaatcacgtgctcaagatcagccccgtccaagaccagaaaagcatccataccgcctaattccatcagcgacttcttcaaatacttacctgccaacgccgccacatgcgaacccgcaccttctgaacccgtcaagcagacaccggcaacgcgcggatctttaataaaggtctcggtatcatcatgcccgataagtgcgatttggaaagcacccttgtcagcgccgccagccagaactgctttttcaaattcaaggccgctagccggaacattgctggcaggtttaatgatcaccgcattccccaccataaagtttggtgcgaaaacacgcattaactggtagtaagggaagttccacggttcaacgccaaacacaataccactggcaacgtgattgaccaccgcagcccctgcagtactgttaagcggttgcggctgcaacaatgccggagcccgatcagcgtacatatccgcaatttcagcgcaaagttcaacttcgcctaacgcttcttcggtccgcttacccatttctttggtaataatagccgccatttcatcggcattgtcgcggaaataagcagcaaccgcatgcaatgttgcactacgcgtttcagggtcaagattacgctgctgcttgtaaaaagcatgccccgccgtcaacatctcactaatttgtgccgatgttgtgttcgcataagttttctccaacgtgttcgtgttcggatcaacggtttgataagccatttttgtaaacgctcccttcgtgtccttacttaatcatagcttattcagagggtagatgccaaccggataaattccaagacagcggatgaaccttcgacgacagattgcctggcaaattatcgtatcaacaagcaccgaataatccgctatcaacaagtcgtcgggctcaaatacccgttgcagcagctaactgaatatggtaaatggcaagcggttcagtgttttgtccgggcaaaatttcctgtaaaacgccgccactggcctcaatcgtcttgcggctcgcccaattagccgattttgccgtcacaatgacataaggttcccggcgttgctgataatagcctaacgcaaatttgagcaagtttttcgcataaccgtggccgcgctgagacggagccacatgatagccaaaatgcccaccggttctggctagcatcggtgtcatttcagtccggcagcgaacccgccccaagatgacgttttccgagttaaacatgaaaaaagcaaactgcggcactagctcgggtttttcgggattctgatcggcggttagtactgccaaccttgtcgtaaagtcggttgcaggcgtcaattcgcgaacaatattttgactgtaaggattttgctgatcgaaatttaaaacatcgcgccgaaactcattaaatgcatcctcatcattgggtcgaagcgaacggatcgtgaacgattccatagtaagacctcttttcgtaacttgacggttcagacttaatttaccgcaaaagaaaaagacccgctagtcatagcgagtcttaaaatattcaatgaatgttttagaagtctgttgggttaaccttgatgccaggtgccatcgttgaggtcaacgtcaaactcttgatgtaaatacctttggtgcttgctgggcgagccttcagcacaatatcattcattgctttgaagttttcaagcaacttgtcagcatcgaagctcttcttaccgattggggcatggatgataccagccttgtcaacacgataagcaacttgaccagccttgatgtcattaacagccttggccgtgtccatcgtaacagtaccggtcttcgggtttggcattaagcctttcgggccaagaatccgacctaaacgtccaacttgggccatcattggtggtgtcgcaacggcaacatcaaagtccaaccagccgtcctggatcttttgcacaagatcttcggcgccaacaatatcagcacctgcatcttcagcagccttagcctgatcgccttgggcaaaaacaataaccttcgacgttttaccagttccgtttggtagcacaacagcgccacggatctgctggtcagcctgctttggatcaacattcaatcgatatgcaacttcaacggtttcgtcgaactttgcaaagtcgattttcttaagcagattaactgcttcttcaggggtatactgcttggtcgcatcaacggccttagcagcctctaaatactttttaccttttttagccattctgggttttcctccttgcaaatgtggtcactgggagcattttactcccttccacctgattgcctcagttttcactgagaatccgaacagtgcggcctagtcttcgacttcgaagcccatggagcgagctgttccttcaaccatgcgcattgccgcttcaacatcggcagcgttaaggtcttgcatctttgtttcggcgatttccttaacctgagctttggttaccttagcaaccttcttcgtgttcggttcgccggaaccatgttcaacaccagcagctttcttcagtagaatagcagccggcggggtcttggttacgaaatcaaatgaacgatcttcataaaccgtgataacaaccgggataatcatgccagcctgatcagctgtccgtgcattgaaatccttggtgaaccccataatgttgataccggcttgcccaagtgcagggccaaccggaggagctggggttgctttcccagcaggaatttggagtttgacaatgtttgctacttttttagccacgagacatacctccttaagtccgtgatgtggttatgatggccagaatttttgacctcccacgcgtatgctgaaaacatactcgaatagattaccatgttggacgataaaaggcaagaagaaccggcacatccctgcgttttatctgttcccaaaaaccttcataaccacggtcgtccgcgctttaggtaaattcttttaacagtttcaaccaatatcaaatagacaagaataatgacggcagctccgggccagtaagtgactggtaaaataccgaaatcaaatgcctgatggaatggcgatagaatgatgaaaaggccaactaacaaagccatcatggttgacaagatgacaatagctgaggctggtgaccgccaaaatggtgtgtgacgagtacgtaacacatgaaccaccagcgactgcgtaaacaatccaaccacaaaccaacccgcttgaaatagatgctgcgccgacacactggcggcgtgagttccaacgccaagcccgaaccatagaaataggaaagtcgtgatatcaaaaatcgaacttagcggtccaaaagtcaatgtgtagcgcaataatcccttggctcgccatggtgtcggttgcgctaaggttgcttcatccacattgtcccatggaatcgtcatttgcgaggtatcataaatcagattttgaaccagcaattgaatggccagcatcggtaggaaaggtaaaaagatactcgccaccaacaccgaaaaagcattaccgaaattagacgcaatggtcattttaatgtacttcatagcgttagcataaacgcgacggccttctagaatcccatcttccaacaccagcaagcttttttctaacaaaataatgccgcttgcatctttggtaatatcggcagctgtatccacgctgatgctgacatccgcttcacgcaacgctgcagtatcattgatgccatcacccatgtatccgactgtgtgaccggccgcacgcatggttttaatgattctggctttttgcatcggacttagtttcacaaacaaatccgtggtctcaactgcctgtcgcaacgcgctatcatccatggcgtcaacgtcattaccggttgcaacaagctgattggcaattcctacttcctcagcaacatgctgcgtaataatggcgttatcgccggtcagaaccttaacccggacaccatgcgcgcctaacaacccaattgcttcttttgcatcgggtttggccggatcaagaaaacccagaaaaccagccaaaaccatatgctgttcatccgacggcgtataaatttcctgttgatggacgtcttgacgatatgccacgacaatcatgcgcataccttgaccactcatggccgcgttagtttgtttaagttttcggatccgctcaggtgtcagcggcagcacatcaccattgagttgcactcggtcacaaaccgccagcatttcttcaaaggcgccttttgtgatcatccattgatgcgcatcgttagcaacgacaaccgtcagtcggcggcgttcaaaatcaaacggaatctcatcaattttggtcagcccgcttggtaaatcggttaaaagatgctgatgctcacgggcataatccaccactgcagtatccatcaagttgtgccacccggtttgataattagcattcatatatgccatccgcaacactgccggatcggtttcgcccgtagcatcaacatagcgcatcacaacgacccggtcctcagtgatggtcccggttttgtccgtgaaaagcgtatcaattgcgccaagattttgaatggcgtgcagtcgtttcacaatgactttccgcttcgacatcgccaacgccccttttgccaggttactgttgacaatcatcggcagcatttccggtgtcagtccgaccgccaccgcgatggcaaaaaagaatgcctgggaccaatcgtgcttggtaataccgttaatgacaaagaccaccggcaccagcaccaacatcatgctaattaaaacccggctaatggcgcgcatcccttgctcaaaactggtcggcgccggcttatcgctaatttgactcgccatgtcgccaaaataagtcgcgtctcccgtttttagaataacggccgtccccgatccggaaattacatcagttcccataaaaacgagattaggagcatcaaacaagctttgttcatcgcttaaattcgccgcgcctgctttcttctctaccggcatcgcttcaccagtaaacgacgactgattgacaaataaatcatgagtcgcaactaaataggcatcagccgggatcatatcaccggtcgccagctgaacaatgtcaccaggcaccacttcatccatggggtgctctttggtttcaccggcacgtgtgatcgccgtggtattggcaatcaaggccgccaatgcatgactttccttttgagaacggtattcctgccaaaaatgaatggacaccgataagataatcatcaagcccatcattctggcgccgtcataatccgcagtcatggttgagactgcacacaacaatagcaatacccagacaaagggttcattgaatgcagcgaataaaattaaataccacgggcgcggatgttgggtaacaaccgtgttggggccgtcctgttcaagccgttctgctgcctcttgtgaagacaaacccgcttcttgcgtcttcaaagctgcaaaaatggcttgtggttcttgctggctgtaccgtgtcagtgcagcagttttctcctgagtcgaagcatcgcgcctcgatatggttttattgaacatcattatttgttatataaactgtggaagcatgccgctatgacacgaattaaagctttatatcgttcctcctcataaatttgacgtatgcatgtcgtctctagcaagcatccgcgagacacttactggtttcatcatacttggcaaggtttcagagcccatgttgcttaataacagctcatcaatacatttcgccattgagtttgttttgaccacatgagcaccttccacttaatgattgcactcatgtctgcgtgggtgccgcgtcgctattatccataaactgccattgtttcctcactccctcgttttcatgccttagccgaaaaaatataacggtctaaaacaattagctttactcaaagcttaacttgacggtaagatggttgtcaaaggtaactaaaaataactgctgtcagggaaacaaaaggcgcttgttggcatgaggtctaaccgcgccggctcgcgcttcgaccataacgcgctcaccagcccagaaacctgcgtgtaaggacctcgaacgcgacggccaagcccgggccatcacgcccgaggccgcttacactccggtttctaaccgggctggttcacgctcactttctataacgcgctccccggcgcagaagtctgcgtgtaaggaccttggtcgcaatggccaaagcccggccatcacgcccaaggccacttacactccgacttctaaccgcgccggctcgcgctcactatctttttggaggctaaacatgatttcttcagcattagctcaagccgcggctgttcgtgcaggtaccgtgacgagtggtgacttgattgacatgactgcaaaaaaattaaccacgcgcaatctgcaactgaatgcggtaacgtggacgaggtttgatgcggcaaagcatgaagccgcggcactcacggatactggtcagccttttttcggggtccctttgtttttgaagggactcggtcaaagcctcgcctgcgctccagaaacgggcggcagtcgcctttttaaaaatgccaaggcaacccgtacgaataactttgttcaggccttgcaaagactgggtttcatcattgtcggtcaaagtaatgtgccggaattcggatttaaaaacattaccgatgctgcactttacggaccggcgcgaaatccttggaatctggcctactcaccgggtggctcttccggcggtgctgcagcgttggttgccgcaggaattagcccgctcgcagccggttctgacggtggcggctctatccgcatccccgcttcattttctggactgatcgggttaaaaccaacgcgcggccgtgttcccaccggtcccgatgaatggcgcggctggcaaggcgcctccattaattttgccttgacccggacgatggcagataccgaagcgctcttacgcggtttagccactactcaattagccgcaccgtttattgccccaccactgcggcttgatcaagtcaacgacacgcgaccgttaagaatcgcttacacaacgcaatctcccgtgggcacaccggtcagcagcaccgccataactgccgtcgaaaaagctgtcgatgcgttgcgcgctgcagggcatacggtgaccgaagccgctccggatgtagacggtgttgcgctcatgcaggcttattatctgatgaatggtggcgaaacggctgccatgttccaagcctacaccgatcaaaccggtcggacggttacgcctaacgatatcgagttaatcacttgggccatttaccaagcagggttgcacaccaccgccgctgattacagccggtcattaggcatctgggatcgggccgctgaagcttacagtcgatttcatgaaacttacgacttgctgttaaccccgaccaccgccaaaaccgccccgcgcattgatgccgcgttacaatcaccagcgatcattgaaaaaatgcaccacgcagccgagcttgacccaagcgaacaacaaacgctgatctgggatttattcgaacccagtctcacctattcaccattcacgcaacaagcgaacttaaccggcgccccagccatcagcttgccgaccgctatttcagatgaaggcctgccactagggatccaatttaccgccgccaagggtcgtgaagatcaacttctacggatcggctattggtttgaacaacaccatcttttgaaaatgttgccagtagcggaataaggtcgccagccgcaagccaatcttcgcaagcgacaggatagcttttagttaaaaatacgttccactatcacagtatgcaaaaagccttggtccaatttttcggatcaaggctttttacttgccggtcttttcaaactaacgatcacgctaaccttgtttacttacttttcacctcagcaacgcctgctttgaagttgacatagcgtgccaacgcaaaaagatagtcagatagccggttgctatattgcaatgtgacggcgctcaaagtgtcatctttagtagctaattgatccaatgaccgttctgcgcgccgggccactgttctgccgtattgtaacgcggctgctagcggatgtccgcctggcaaaacaaacgctgtgatatggggaacggcggccatcatttgatcaatcgcatcttctagtgctttcacatgtgcttctgtgatcgtttggtgccgcggaaccgcaatatccgccagcagctcatataattcccgctgccgtgtttccaatgcctccgtaagccagttaaatcctggcattgcctgcgcttgagcagcaacatagccgagccacgaatcgagttcatcaagttcgcctagtgccacaatctgcggatcgtattttggcaccttcttaccgttaatctgtttggtcgcaccgtgatccccgacttttgtgtatagcttcatgactgcctcctgtcttcaaccctgatgagaaaagcgtttcaatccctgttgcaaaaccagcaccactatcggataaaacacgagatttccaatggcgtgataagtatcaaacaataaaccacttaaataataagcccaaaagccaagaccattcaaactaccaatgaccgccattcctaaactaacgatgaacccgtataagtagccaagcagaccggctatcccaatctgaagccaaagtgtgcgccgaatcagtggtatcaacgttacgataacttgaaccacgactaggcacatcgcataagcaacaatctgtggcaacgtccacaagccaaatcctaaaatcagatttgaaaccaccaaggtactcatggtcaaagcaatgccccaccgaattcccagtagcagcgttgtcaccatcaaaatatccgtgacgggctgaacattaggaatcggtactttaataatgcgcaaaaccgtacacaaggcggttaataaaccaagcaaagccaccgcccggacaggcgatggctttttggctgctactggcaacttcatttagtcacactcaagtcaaacacaactttatcatggttcttaaccggttgctgcgaggcaccttttttagccatcttgccattgatggtgtacagccagtatgttttcttggcaacattttgcttcttgccagcgatctcggtgatgaagcccttggaagccttgactttccagcccttcttcaaaccggtcataacaacagattttttaggttgcgtaattttcttattcgcaaatgccttaccgttttccttcagttgatacgtgaccacaatctgattgggtttgctgctgcttttggccgtactgctagcactgctgctgcacccggtaagaaccaacatcgcagtgaagaagacaaccagtgaccgtaaaactttctttaacatgaacctacatcctccgtatcgtttatttaatcgggcaagcaccgccagcacaatcggtttgatccactaattcgagatctttttgatcatgatcggcattttgagccgcaaaaaccgctgcaaccgaaccgtgaatctgttggcatttctgcttgtaagtctggacgtcaattggctcttttggtgcttgtttaaagcctgcgccaacgtatggcagcattgacgtggacttgatgacatgccgatattgtgataataagtcagcaatctggtcagcttcttcaggctggaaggtcacggtgcaactcaccgcattatcagaccagtacgtttgcaagaacgcttgggtggcaatttgttcggcaatcgaaaccgtgcctgccgaagcaaatgccggatcatccgcatgcgctgcacgaatcggaaattcaacgaccatcgtatttttagtgtaaacatccggttcaatgtgatagccgcatgccttcagtgccggcaatagcggatcattggcctggaaccgaatccgttgaatcaaataaccggcataatggaaatgcatgccttcggaaacacccgccaatttagccacagttccggatggtttaacggttgtgtgcttgcgcgacggttcgcatcccaaggcttcagaataagctttatccgcgttgaccaccgtacgataaagcccatcaaccgcttgtttaatttccggatcataaaccggtttctcaaccattttacccgtatgcggatcaacaaccggttcaaatccggaaacaactcgatgaccgaaatcatccaggaaccagtcttgaatcccggacatcgaaatgccgattcgccggttcttcttgataatatcgcgtgaaacctgccagtcgtagttgctaaaggtgacccgtttagcataacgcgcagctaacgtgaaggcctgttttagcttccaaccttgctgcacggccacaaccgggaatacttcaaataaattgcagggctcaccgttggccaaagaaatttcgccgcaaggatttgtcccttcgacatccggatcattggcggcattttcgccatcgacaatgcgtccatagcgccgggacaagtcgagattgacaatgcctggttcgccatttttggcaatcgccgtcgcaatcggtgcataggcttcaaactgggtatcaatcgcaacactgttattcgatgcccaacgatgatgatacagttgcttttgatcctgcttcatggtgataaacgcatcatcatcagctgaacctaacgacatttcggcagaacggcgaacattacctgcgacaacggttttaccaatcagattaccaatatcggttgcatcaaccgccgtcaaatgcttaccaactcgcgcattaagcacgttattgatatcctgcaacatttcaactaacggcatgggccctgaagccgtaccgccaaagccatgaatgcgcgcgccttttggtcgaatattggtaatgtctaataccaatttcgtttggccactaggattagttgcggcaaaatggtgatcaatcaccttggcattggccaaaacccagccttcgcgcgtatccggcaaaacataccgatcgttgcgttcggttgcatgggcttgttcccatgcttgtcgatcaaccgcgcccatcttaagtgaagcttcataactggcgctgcgccgatcaatgacaatcgtcaaatcaaccgcactggctactggtggcaacttggcgatattgtctttggtgacggaaaaaccaacaccgccgcctttcatcaattcatcaaacatgaaggaatatggcatcgaaacagcaggctgatcagcagaaaaatcggctggtacaatgtgtgaatcgccatatggttggggacgaatcgcaataaaccagcaattattcaatgcatcgccattacgcttttgataatccgttccggaaatccaaaggttacggccagatggcgtgcctgccaacccataaataagtttgaaaagattgcgcgcctctttttgcaaggccgttactactttaggatccggatccgcagtatgtaaacgcggatcaaggttaatattgccttcaacaacgcgcttgacggtttcatcccaattttcggttcgctcttcattcggcagccaccgcgcataggtccgcttgtaggttacccagccaagctccccccagtgcggcttaatttctttcttaacctcggcaatgaattcaggcgccaaggtgatcggtttcatcataacttgcatatccgtccctcccgtatacaagatatggtatagccaaacgaatctaatatcaagatatagattaatcaataacaattcgttaatgctggcgatgaccggtcaaacagagaatggcgggcttttaaaaaattcaggatgacattaaaaaagccagcgtcacatcacgctagcaagttatcagttatcaccataacgcgctccgatgcagaaacctgcgtgtaaggatcttggtcgcaatggtcaaagcccgaccatcacaaccaaggccacttacactccggtttctaagcagccctgttcacgctcactaaaacaccggtcccacataaggacgaacgagcacatgatctaaatccagtgttttcagctcggcaatatctgttacaaaacaagtaatggagccggcgagcatcaggttcattttcatgtccgtcagttgtagcgccacaattggcatgtggtgcgcatacgcatagccgatttcaaaggcggttcccggatcagggtcttcgccaatataatccaaaatcgcgaccatcaccgttgcttggtgcaagccgcgaatatcttcaccaaaaacctgtcgctgccaagctggtgaattttccgtcaaacctgctttgttagtatcatcgcgtggtgaaaaaataccgctaacggactcattttcatttaaggccgctaatacctgattcaaccgctttgtctgagcggggtcaaaaaaaggagcggcaagatagacttgggccatattttcctcctagcaagcattgcggcaactctattgtcgccaatgccttatttccggtgacagcaacttgcgggtaaaacataaggaaccttggccatcatggtcaaggttcctaagcaatgccaaaaataatgtgccgttgcttatcgcgcaaccgatatcttctgacaatagctaaaaatcgcgttgctgctgccataaatattcaacaatatcatgatcaacgaggcgattctcatggagcaaactgtgggctgcccgtggtccgcgaatgacgacctccgtatagtccttgatccgatccttcaccagataacgcaccgcaaagctgctgttaatcgcaacctcaccgtcatggcgacctccaagcatcaagtctccggcaatatttagccatcgcagatcagcaggaagattgtcaatggttcgctgaaattgctgataaataggggctgtgtgttccggtccctggcgcgtcaatgaccagtttagaatcggtgagcgctgagcaacttctaagtcattcataggcgcagcaatagtgactaggttggcgactggcacagctggtttgcttaataaatacaacactgccgtcacaccgcccattgagtgtccaatcagattaagctgactgaaagcttgttgcgcctgtaaagccgtaatcacgtgatttaatccgcgtaattgcgcagctgggcgtacggttttatcggtgaatagcacttgcaccgcagcatgatgattcaagttcaaccgaccacgcaaacgcaccctgccatcaggggcaacaatcgcgacaacatctttactcaagccataacgacgctgcatacgccacaacatatggccgaatgaataccgcgtacctaaatggccggggatgaacaaagtcggcgttgcatccatgactaatggcaccggcgcatatccgggacgacccagtaatataaagtctgctaaaccgcccgcaatcacaacagtgccaactgcaatcacgagccaaaaccagctgctcatgagccttgcctacagtttgtcgacttgatcaaaatccagttcagcagtgacttcgcggtcaaacatttcggtcacgactttgagcttcatcttgtctttatcaacagcggttactttaccatgcatcccggtaaaggccccatcgataatcgtaacgggttcgcccacatcaaactcaacatcctgatgccgtgtgctcatgcccattgaatgcaagacacttgcaacttcttcaggcaacaatggcgccggctttgaacctgcaccatgggaacccacgaaaccggtaacgccaggcgtgttccgcactacgaaccatgattgatccgtcatgaccatttcgactaacacgtaccccgggaaggtcttcttcatttcgatcttctctttgccgttcttttgctcgtgttcttcttcttccggaacaactacccggaaaatataatcatccatattcatactgctggtccgttgttcaaggtttgtcttcaccttattttcataaccagaataagtgtgcaagacataccaacgtttctctgctgatgtaactgtttcagccataatgttctccttttagtgttttgagtcaaaataaaaaaccgtcatcgaaggcggttttgcgctgctcatagtatagcaaaaataaagcagtttgtcaggtcttaatataagaaggcttggaagactgcattgataacccagtccacacccgcaaaatagatcgcaaaaataatggaagtcatgatgacggtaaacgtatcacgccgcgtctgctgggcagttggccaagtgacagctttcatttccgcgaaaacacttttgataaatttcatcattgcgctccttccattattacttggtttcttgatggaccgtcacgcggccacaatgtttacaaaacttttttaacgttaaccgttctgttcgttttgggttttcgggaacaaaataattccgttgcccacaaaccgaacaagctaaagcaactttctttactgacatcttgttccctccagtcacgtccaatatcttaccaagattacaaacagatagcaagcagaggttcgcgccggtaagtgtcaactttttctcggttctactctaattaagtgatttccgttactccgagctggctccgcggtggcgagggctggcgaccgcgcagctagagtggtgggcacgactgagcccgccaccgctccgccagctcttgctttctatcttaatattctaacaaggtggacccatcgcactgctaccaactaccatgatcgagtctgatattttggacccacaccatcagaagaaaataccaagccacaaggtcaacagcaaagcaccgccaacgatcattaaagattgaatcgtaaaaataaaagttttgtctttgcttggtgcttcagtgtaccgacgcgtgttttttttcaccaccggccaagtcaacataacgagtaaactccaccatggcaaactgcgggtcaaaacacctagcagtaacgcaacaaaggtacagaagggtatcaaccggtaccaacgtaaagctcgggttcggccaaggtaatatggcaatgtaaagcgctgatttttgatatcctgctccatatcagcaatgttatcggcaaacatgacagcagcattcaaaatgatcaccggtaaaacagcgatcaacagttgtaacagccagcctagattaagtgcaaatgtaaacgtgcggcggtcaagcgttaagtcaaggggtcccggtggtgtcatattgataaacaccgcgatcacgaaagtcccataaccttccacaaacccggccaacacctctcccagcggcaatcgtgatagaggaaccggcccgaatgtatataaaatggccacgccgacgccgaccacgccaatcactaacaagctcaggttggtacgcatgacaagaatgatgcctaaaaccacgctgatgagcaaaataaagatggtaagtgccaacatgccccaaggtgacaaatgctcgcggccgataatattttgcgactgctgataactgcgatctttggccttaaaataatcctgaacattgttgaatcctgtcacaaataaggcaatagccaattgagccgcagcgtatatgagactattgatccaagaaaactgatgaaatgcccaagcagcgtaactgattcccaacaccagcggcaacatactggcagccttagccggtaaccgaataaattctaaaaatagcggccacgtcagccgatgataagactgggtcatagcaccacccccattcccaaacccaaaaccagcaaaccgttttccaaaaccaggttgatcaccgcggtatgaaacgttcgctgtttgctgggatcacgaatgaaccgatgcacattgcgaatcaccaacggccaggctaactccaccaccaatgtccatatcggtagcgcgccaaaaatgacgcccaagatcaccgctaagaagccggcataagctaacaatgcgtaaacccgtggcgaccaccattgacccaaatacatcggcagcgtgtggcgatgattgcgctgatcttcctcaatatcagacatattattagccagcataatattggcaatggttgccatcggggtgatgcaggctaaccctaatgcaatgatggcgataaagtcaccacgtaaaacaaccgttggccactccaaatccaaggcaagcaagcgtcccggggcaatattgacataggttgcaataaccggaatgcctaatcccatgacaatcccggaaaaaatttcaccaagcggcaaacgagaaagcggtaatggcccccaagtatacaaaataccaatggcaaaacaagccatccccattaacagcaacagccaatccgtccgcacgaccaacacaacgcccagcaacgaagcaaccacaagcattaccagaatcaacttggcaaccattcccggatcaagctgagcccgaccaatgacattcacttcctgctgataatgagcatctttggctttttgataatccatcaaattattaagcgcagttgtcatcatatcgaaaatcaacattgcaataaaaaataaaagcgtattgagccaatcaaaggcgtgaaaataagtcactgcaaacaaagtgccaatcgcaaatggcaaaacacttgccagtttggtgcgaatttcaaccagttctaaaaatatcggtaacgacatctactctccccttttgtagtgagcgcgagccagcgcggttagaagtcggtcaagcttttattgtgaacccttaaccaacttactttaacttcgccagcgtataccccgagtccttcaacaacttaaacttatctttcaaccccgagctcacgtaaacttttttatctttggtaacaaaaatagcatcagcataattcaacttttcaatataggccatcccatcaactagccccttatcaaaagtcgcggttgacaaagcatccccatccacactctttttggtaataatcgaaacacccattaattcattatcaaatggatagccggttttgggattcatcaggtgcatataaaccttaccatcaactttaagatagcgttcatagatacccgaggtcacgatggttttattgctggcaggtaaggtcccgatggccgtcccacgaggcttcttaggatcctgaataccgacactccaatcctttttagaacttttaggacttttgcccatgacaaaaatattgccgcctaagtcaataatagcagtcgttacatgctgtttcttcaacgttttcacgacttcatcggtaataaagcctttagcaataccacctagatcaattgccatgccctttttcttaagatataccgtctgttgtttcttattgagaacaacatcttgatagtgaaccaatggcagcttggcatcaatttcactttgcgccggtttgcgcgcatcggcaaagccaatatgccacaaactcgtaatcggcccaattgccaagtcaaacgaaccattcgaattttcactataatgcttggccgcttcaatcacccgataaacacttggggtcacgtgtacgggtttcatccctgcatttttattcacggcatcgacttcggagcctttttggttaaccgtcagttcatcggccaactgctgaacgcgggaaaaagcagcatctagtgctccctgtttccccttgtcataaatcttaatcgtaacaaccgtccccatcagaaactgagtatccgaataaggatcgcccgaaaccaattcccgtttagctgtcgtctgactcgaacagcccgtcgccaccagtgccaaaagcatcaggataacgacaatcaatcgctttttcatgtacaacctgctatataaaatgtggaagaatgtctctttgacaccaataaaggttctatatatttcctttcttgattgacattcagcatctcatttagtcccgttaacagcggtattcccactctgaaataattcatcatgacagtgaccgcctcttgaacttttagggtatagcctacccatgtacttttgatttcgcataatcgatcaggttatcaactgcattttcatcacgtcgcatcttggctccgcattggtagcaaatgtaatcatcatgtccggtgtggtatttgacattaccgtgcaaagtaagtttctcttcaccggttttgatataaccacatctagaacaccgttgcgtactcggaaacattggatcggcaagaattaaagtactgccgtgccaatccgctttgtattgcatcatgattttgaatttaccaaacattgaacgatgcaggtttttagcaagacgacgattcatgcgcatgtgctgattatccaagtcttctatcccaattagatcgtgatcaacaactagcttggtcgtaaatttgtttaacaaatccatttgtatccgttcaacgcgttgatagtttcgcttcaacttggttctcgttgcgcgataggccgccgaattaaagtgctttggatttgttgttcgcttacgggcaagctgtttttggtagtgagtgatacgagcgtaaagtgctggtagcgaagcaggtagtgttggctgaatggcataacctgatggggtcttgtagtcgaacttgcctacattgacgtcaacggcagtaacccgttgagtgggtcgcttttcaaccaggactgcaacttcaatagacaacgctgcatagtaaccatctgcgtcttgaacgatgcaaacctgcttgatttcaccctgccatcgtggctgttcagccattttaatgtcataccagagtttggtgccacgtggctgatccaaacgaagcttgccattgactatctgagcacgatccgttttaaaagttttacgtgagcgctttttcgacttccacttaggcttgtcatgattgggcattttaggattcaaatagtttgcccacgccttacttaaatcattcacggcaagctgtaaaacgcgcgccgatcgttcaaactgccaatctgctttgttcgcaaccagttcatcacgaacttttcgctcattaggccgtatcgacttatccatcatgactaaagaggcgtcatacatgtcattccagatttccagcccttggttccaaacgaaacggcgataatcaaacaatttttctaattctttacgcatcgttgcattgggataaagtttgatcttatgcgttttaatcaaaagtgttcacctcccttcaagttaactaaaggacttacttcaaaaatggatcgtcttcaagctttccttgtattgacgtaagccggataaccgacgcgaaaatacgtgaatcatactaattaagtcttcagttagctctccctgaggtgatagaccaggatgattcaaccccacaagctgtgtggttgaatctttggggtttggcgctcaaaccaatcatagccaaaacgcacgcaactcgtcgatgtttctttaattcatcagcatgaccgatataagccaagtattgatgctcggtataataacatcaattaggtggtgttctgcgagctttgagctttccagacttatcccactgttgcagttgcaccgagacatttagccatttcgtttggtctgagcatatgagcatcttccacttaattatcgtgctcataacataccatgttacgctacattgttacatatatttgtctgctgttaatcacctccaaaaagtgtgagcgcgagccggcgcgcttagaaaccggagcataagtggccttggacgtgatgaccgggctttggtcattgcgtccaaggtccttatgtgcaggtttctgcgccggggagcgcgttatagtgagctgagcgtgagccagcgcgcttagagatcggagtgtaagtggccttggacgtgatggccgggctttggccattgcgtccaaggcccttacacgcagatctctgcgctggcgaacgctttatgcaccggtgagcatcttgaaccgaaagcaagccgacacactagccaagtgccacatcgtttactgactaaaacggttacagcaccattataccgggcattatgagcataagaaaagaactcgctcagaaaaattattccaaacaagttcttgcttagttaacccgcgctaataacgcacattaacttcttttcaagatcacgccattacttgtaaacaatattgtcgacttcgatcttgttggtattaccattttgagcagcgttaactaactgatcagcatacaagatgaaggtatcggaactgtgggttgcaccggaaaccacatcaaccttggctggtgactgcttagcaaccagtgacttgttcagttctgggatgtattccttcgggccaaccttgttcactttcttcatgttagcttcgtatttcgtatcctgagtcttggacttaccgtctttattgacgttgtcgtagttgctttcggtaatcttaccgtctttaaccgtgatggagaaggttacccgatagccgttgaagtagttcttttcttcaagcgtgtaagtaccatctttcatcttgccagtgttattgacttcaattggcttggtgtccccagcctgagccgcctgaactaattgttgggcgtaattcttaaaggtcatactggaatcggtcgcaccggaaataacatcgatagcgccgacattggttccattcttcttaaaggacttgtttaattcaggaatgtattcctttggtccaaccttgaccttagccttcatggccttttcatagctggcgtctttggtcttggatttgccattcttatcaacgtaatcatacttagtagaagtaatcttcccgtctttgaccgtcatcgccatttcaaccttatagccatggtcatagccggtttcattcagcttgtaagtaccatccttcaacgggccacctgcaacctgcttttgggttgatgacttcttgaccactttactgctggaagccttgctgctggatgaatttttgctgcttgaactactgctgcatgcacttaaaaccaaagtggacagtgcaacaacggctgtccccgtcacaactttacttaacttcatgacatttaccccttttgcagttcataactgcgatattgtgttttcaatcacatatttagtttagctagtcaaatcaaaaaaatcaaccaaacacgggtattataagcgctttctcattttttaatcgtcctttacgaagcgtatttttgtgtcattttacacaaaaatgtacggctttagaaaaagagagcgcgaacgttagacattacgtaattttaaaggctataatggcttagatacatactttgtaagagtatgggtaaagcaaatggtaaggagtgttatgcatggcgaaaaccaatatcgtcgtggttggcgcggggtttgccggggtctatgcgacaaagcacctggccaagcactacaaacgtaacaaagacgtgacgatcacgctgatcgatcgccactcgtacttcacttatgtcaccgaactgcacgaaatcgccgcggatcgtgtcccagaagacgcaatccaatacgatttacagcggttgttcaatcgacgtaagaatgtcaagctggtcaccgataatgtgactgggattgaccgcgacaagaaggaagttgtcactgaaaacggacgcttcccttatgattatgtgatcttgggaattggatcacaaccgaacgactttgggacgcctggcgttgccgaacacggtttcaccttgggtaagtgggaagacgcgattcggctaaagcgccacattgaagacgttgttcggcgcggttccgaagagcacgatccggctaaacgcaaagcccttttgtctatcgtcattgtcggttctggcttcactggtaccgaaacgattggtgaattacgtgactggcgcgataccttagccaaacagtacaagctagatccgaacgaaattcaatttagcttgatggaaatggcgccaacgatcatgaatatgctagatcgttcagacgcgaacaaagccgaacgttacatggaaaaacgcggcatcaaggtcatgaagaataccggcgttgtcggcgttcacgcagatcacgttgatctaaaagacggctccacgttcccaacatgcaccttagtctggacggccggggttaaagcaactgaccaagcgaaagatttcggcttgaaacaaggacgtgccggccgaatcttagtcaaaaacaacatggaatcgcaagacgatccaagcatctatgttgtcggcgatgtatcgttagttgatcaagacggcaccggcaagggccagccgcaaatcgttcaaggcgctgaggcaactgcccacaccgcgttgacgaacattgaagccaagttggaaaataaggaacaggttgaatataaagccaactattccggatttatggtcagcttgggttcaaaatatggtgttgccaatatcatgggctggctgcacctttccggtttctttgcgatgttgatgaaacatttagtcaacatgctctacttcgttcagatctattccggttattatttattcgagtacttcatgcacgaatttttccggacccgcaatggccgcaacatgttccgcggacatctttcccgtcaaggcaatgttttatggacactgcctgcccgtctcacattaggcgctatgtggttgattgattgctggccgaagattcaaggtaaagagtcatggttcattgacaagctccggttgccatttagctggttacaaccggctgctaccagtggtgcctctgctgctggcgctgatgcaaccagtgctgcttccggggccgctgccggtgctgccaaagcaaccaagaccgtcttctccctttcatatcagtatggtaatgatccgatgatggtctttgacaagatgccaaactggtactacagcattaccaagaccttgattcctaatcagcaagttgccttcttcatgcaaaaggccatgacgattatggaaattctgattgggcttgcgcttgttgccggtttattcacctggttgacctctgctgctacgatcgcttttgtcggcgtcttctgcctcagtggtatgttctactgggttaacatttggatgatcccgatggcctttgcctgcatgaacggttccggccgcgcatttgggctcgataaatgggttgtcccttatctccagaaagtctttggcaaatggcgctatggaacaccgcgatctctttacggtaccgatgcactcaaataattgtctacacaaaaggctctgggtggacttacctagagtcttttttcaagagcgggaagctgctgcggtctcttttatcggccacgactgctccccgtccttcgtgttcacatcatcgttttgaagtcatgaacttgaacgcgattcaatttcactagattggaggctcacaatgaaacggccaaatacctttaaacgttatcttaagatgattcgcccatttgactggatcattgttggcggcctgtttatcgcagcgttcattccgtatcttattttcggcattcatgagaatcagcagcaagcaaccgcctcgcaacaggtattaacagccgtggtgacccatgacggccatgaagtttatcgcaagcgactaaccggtcatactgggaccagccacttcacctatcgtgataaagacggtgactggaataagattgaagtcaaaggcgcgggaatcgcgattacggaagctaactgtcaggatcaggtctgcgttcgccgcggtcggattacgaaacccggtcaaacaattgtctgcctgccgcataagctactcattgcgattaagtcaaataaaggcgatagcaacacgggaggtatggtgaccgaatgagtgtttataaagccgaccgtacccggcagtatatctatattgccttactctgcgctcaaggcgtcattatcggcctactcgagcgtatgatcccgtttccctttgcctttgcgcctggtgccaaattgggcctggccaatttaatcacgatcatttcattgttcacgatgtcaattcccgacagctttattctgatgtgcttgcgactgctgctcaccacactacttggcggcaccttgtcaacctttctttacagtggtgctggtgcggttttatcgtggtttggcatgttactcattaaacaattaggtgaaaaacgtgtcagtatgatcggtatttctgcagcaggtggcattttgcataatgtcggccagctcttgatggcatccttcatcgcccaaagctggaccgtcatgctctatttaccgattctcgcgtttatgggcattctggcgggcattgcggttgggattgctgctaattttctttttgaacacatcgatatcttacgacgactccgctatgatcgcaccaagcgtcgtaaaaaaggagctacacatgaaaattcatcccatgtggcatgaatacccgacgttggcgccggagcttgcttcagcgctaacgttgattgaaaaacagatcacaaccaacaatacacctgtggccaaggcgatcatggaaatgattaatggcggtggcaaattgttacggccggcgtactgtctgcttttctcccggtttcaagacacggatcgcgagaaaatgattgcactggcggccgccattgagacgcttcataccgccactttgatccacgacgacattatcgataaatctccaacccgccgcaatcaggtgacgattcaaaaacaattcggcccggacacagcagtttatgctggcgattatctctttgttgtctgcttcaagctgttggcacattacgcctcaagcctccgcagcattcaacaagacagcggcagcatggagaaaatcttaaaaggcgaactggatcagatggccacacgctaccaaacccaaatcaccattaatgactatctcaagcaggtttccggaaaaaccggccagctctttgcgttaagctgttttgtcggtgcctacgaaagcggcggaacaacgaactttgccaaaacggccgaaaaaatcggcatgaacattggcatcgccttccaattgctagacgacattctcgattacactagcgatggcgaaactttgggcaaaccggtttacgaagatgtgcgcagcggcgtctactcagcaccactcattttggccatgcagcgcgatcgccaagcctttttgccgctgttagcgaaaaaagaacacattagcgataccgagatgattcaactgcgcgatcttgtcatcaagtatgaaggtgtcaagcaggcctacactatggcgcaacaacgtactgaactggcgactgccggtttgcagaagttgcctgccggcgctgcacgagacgatttaatccgtttgacggagagccttttgaagcgcaaatcttaattcgtattaaccggatcttaagcaaccagcagaaattgagctggttgcttttttgttaatgcagatgtacaacaaatcctctaactcctagatcgctatcaggttcgatttttcttactctcgattaatgaccattaacttttcatttttgatctgtttatctgcccatggtctttacggcgtcttgtcgatatgtagcccattttgatgaaaaatctcttcgcttcatgagaaaattccacgactttttcgctttcacaattgttggaatttgttatttaaagtcgaacttccatctgtgaaaaatcacctaaataatcaagttagtacaaaagtctcattcgataaatccgctttcaatgggaacgaaaacagcttactataggttcacaattttaaatcctggaagtcagtagtctattttttaatagtgggtaatcgttatggaaaataaagctaaactctttaattccggcaagataattgtcagtcatatcgttttccccttggttctagctattgcggttggcatcaccacttctggatcatttgtttaccaagccgttaatcatgaagaacccgttgtcgtccaggctgcttcatatcccactcctgcaaagcgcggtatcaccccatatggattgggtaatgatacggtttacgtttactactcagcctcacaaatggctgcagttaaagcggcttcaaacacccatgcaaatgctagactagcttttgcggctgcttttggcgccataaatcaatacgcagggcttctggcaacggccgcattgattcgaacaaacacccaattcaataactttagagaggcgatcaattcggctatttctaaaaagaaaggcttgcagcttcagtacaaaacaactttcgatgatggtaataacagcgctacctggggagcatcatttgttgttaagtaattagcatttcccttaaatcgaccccatgcaatgtacattgctgaattgaaggaacaatcagctcatctgctggttgtttttttgcgttccacgaagcatagttatccatagagcgttcaaccattctcaacccaggaaagtgtgagtgacatgaccaccattgccgttttttcagatatccatggcaacttagcagcgttagaagccgtgtatgcagatgcgattcaacatggcgctgaaacttattggttcttaggtgatctttttgggcccggaccagacgttcagccattgtgggaagaattacaaaccatcaatccgacaatcaaaatccggggcaactgggaagacttcttgatcaccacatggtcaggtagagatcgtctatctcccatgcaaaagaaaattgaagcttatattttgaaccacctgcatgatccggccaaaatttgcgccacccttgccagttggccgcttcaccaagaagtgacggttaatggggtgcaaattgggctctcacaccatcttcccgccaataacagcggggatatgctctcagtccgtgctgaaggttccgcattatcggcattattcagtggaccccgtagtacccttgacttggctatctatgcccacattcaccatcccacaatgcggtatgtcgacttaagcatgccgacccaaatcgctgatgcctttgattatgccaaagccgatgaacgccttgttttgaaccttggctcagtcggtttacctttcgacaaaccaactcgtcggtatcaagagtggcgcgctgagtatctcttattggaagtgactgacgacggcgcaatcaatccgcagtttcgccgaatttcttatgatctgcagcgagaattcaagcaggcgcaggcaatggacatgccgtttgctgagaattatcggcataatttttatatttaagcgggggaggtttgctgtgcatatttttctgcttttgttaggattttagtcggcccaacatttaaaagattcagtatactgatatacattgtaactggatggcatagagactgtttacaagcaaaaaaagtcccataaaattgggactttctgtacttcaaacactcctattaaattgttaaggctgatgctattagttgatttatcgcatatctggagaaaatatcctgttaatatcgtatggaagccttcactactctgacctatctttaaaataaacgctccctatgagtacagcaatcattagataaccagttaatttaaaatattgcgtccaataaagctcacccagaaaaagaagatcataaccaatattaaagagcatcaacgccaaccatagtaaaaatcctccaagatatgtcttggctttattcttaacgtttaccaccccagaccgcattgtacggcataccatgccaatacggttgccataacagctgcattacgtttaataccctgagctgctactttagcaacgatagcctttgctgcttccaaccagagctttttgtcaatataagccacgatagtattgacattgaccatgcttcggatttcctcaccgagttttcccagcatgcaatttccaatatcggctagatcgcgttgaacaattcgatgctccgttggaaaaatacgagattcattctcagagataccgataaacctttctgtagcctgaatttcatcttttccatatttggcaatgagataatcaatgttaagattttcaatatcgccatctacaaacatcttttctagttccttggcgatggcttgctcttttggcgttgccgagtttacagtaatctcgtctgctttagttgctgcattgaccggtttggctccggttagcattagactaacaaacaatgtcgttgtgaatatcgctagcaatgcaagaaatttaggtgttcttttccacttcgactgaaattccatgtgaatccccccatctgttaagcgagttactcgctttttttgtcaacatccgccataatttatccaggaacaataataacgtcatcacccaccggataagtgtcattcaggatctctgtcaaatccggcacacggatttccccctttctcctccaacctccttcgacatttacactgataatttaatcaaacttcagctaaaaaaattcaaaagtcgagtattttctacatgagaggtgaagaaatgtttgctgatcaatttacttgtggtaacttatttcgccaaattcgtgaacgtcgtcatcttaaaatcgccgatgtacaaggacccttacacaagacttcagtttctttctttgagactaaagatgccaacatccgtctttttagcctgatggagatcttgaagccaacaatgacagaaccccaggaattctttgagttaattgatcaaacgcatagccaattgcgtcgcttttttagagagctcagtaccttatatgaaagtctggatttagagggcttacaaatgctcttgaccgactatcatgaaattaaacgatctgaaacaccacagtatatgctcaagctaatcgttatgtcttgtattgctaaaattaaggaacaaagcccagttttctcggctgaggatgaagagtgcatccagcagtttttgttaacagaagggcgttggttccattttgagtatctggtatatgccaatttgtgccactcactctccaatcgcatcaatgaccgcttacttcgccatatggtcaccaaatatcaagaatttcacctatctcggtacgatgaggcttttgttggtgctttttataatatttccgcgaggtacttaaaagatgccgattatgaccgtgccttatcaatgctagatatagttgccgactttcctgtcaaaaatacagccctgtatctgcggcatcatgtggcattcatccggctagctgtgccgatcttaaagtaccaagatcaggacgccaaaaagaaactagctgccttactgatggccacagagatcattgacccgaagttatataagacgaatatggcgtggatgaagtctctgaatttagatcccgaggcaatcttaaataacatcacctgaagaagtgctgggtccccatggaagaggagaacgattaacctagtattctaaggtggaatatttgatgttagcctaggattaaacagtttgcaaaaagcagcaagtccacccgtcttagcacagacggggcgaacttgctgctttgttaatttcatttattcaaggttgcacatcccaaacaaagtcaaaaaatgtatagcgctaaatctcattgattcactaaggttccaacataccaagttgtccaaataagcaacaaagacagtacgccgaccaggacaaatcgtttcaaactaaactttttatcaggaaccagccgtccgtaccctatataaccggccatggcaagcgttaatacgattaacactcgatgcaaaccttcaagaaatgtcataattttttatgattaatctatgcctctgccctttgtcaaactcaactagactaattcactcgcatttttaatctttaacaataccgaatccaagccggctttacacgattatccgtttcacattcaacaaatctttatgatcgtaaatcacactcacgctttttgaaatatcagcctaaactcatccgccaacgaaagcggcgcaacactatatggcacgtcatgagtcacaagtcctaaaacaagtttttcacgtgttgcctcatccaattttgccaaatcaataagcacctgatcacgatcaatatctaatatcgcatccgcactaacatcggttaacagctgaggtgtctgccgcattttcaaaaagtttggttggctctcatgcatattgatttgtttgacaatcttgcccgcccgcagaaaaagaatgcgatcagccaagctttgcaggttgtccagtaaatgcgagaccatgatgacgagcttgccattttctcgcagttgctgaatttgacccgagatcagcgcaacattttccgggtcaaggccgttcatggcttcatccagtaacatgatcggcgtatccgaagccacgaccattgcaaaacataatcgctgtttcattccgagcgaataggtgctgactttttgggtgatataactgcgcattttcaaaccatcgactaaggcatcgagcgtgatctgactctgccacatgtttcggtacaatttcaaatgttcatagccatttaactcaccaaaaagctcgctttctaaagggaatgcacaaattttttgatgaatcgccttaatcgcttgattgctttcgtaacgcagcccgtccacctctacatagccacggtcaggctttagattattcatgatgacattcaaaagcgtggttttacctgtgccattcggagccacaagaccgacaatttctttctgatttaaagtgagcgtgatgtcatctaagacctgctttttgttggcaaaggacaatccaatatcatttagctttagcatgatgccacctctctctttttcgggtgccgtttgtgagccaggcaaaatataatgacttcaagtacaattatcacgctcagaatcatgatcaacccgaacacgaaggtcatttgtgtcgtctcatacctgaagttttgaaagcccaccaccaaccggccgatattgaagtaactcggcagcaagtataacgagttgtgattaatggcgactaagccgggtagaaaataaagactttcgctaactagcaacaggattgtcaccgccaaactggcaaactcacttttcaagattaactgtaagacaacctgcagacgaatgatcagccatacgcttaacagtaaaagaacaagggcttccccgataaactggcctagcgaaattgtgctgaaagtgagcccttcatacaccggtatcggtaaggacagactgccaattccgaacttgatcatgttaaacggtaataagatggccaaaaagccaagtaacaagccgccactcattagtaacgctgacaaagatttgtcattgagcatggcccaagttgttaacgggaagtttttcaaaatcgattgtttcttgcgatctcttgtcactaaatccgtactgatcatcgccgtcaaaagcaataacgacaacgccagtccataaaagaacgcgcgttgcagctgctgtaaggctgtttgttgattaatcaccgctgccgtgacgttattgtttgccatatttgcatattgacgcaaccgagtccgcgcctctaaattccaataatggccattacggttctgattgcctgaacctgcatcgcggaccacattcggatcactataatattgcagcggataactaagccacggctgcccttgtagcactaagcgatcagtaagcgctaattcgtcagccattgatgctgctacccgattgtatttgccttgcccagccgctttcaactgcgcgcgttcagctttcataaactgaggaacataggtaccagcgttggcaatggtcggatagttaggaaatgccggattgaaggatttcatgaattttgcatttttctggtacttagcggtcacctcctggcgtgaaaagttttccaaagtgctatttgcaggtaagtattgatagcagagccaaaaactccatagcaaaaaaattaagcacgcgccccaatttttcttactgaggagattttgtttgatttgaaaggctatgtatgaacgattacgactcattttttgcacgcccccaccttgaaatcacgaataaaatacccgtcagccagattaacatcatccccaaacctgtcacccaaccgatgggcagatgatcgtttattagaaaatggcctgaatacacattagcaatgcttaaataaggtagcggtgttaaatagaacactgctggcagcgatggactgaatgtcacgatgattattacggtaatcaaagcaaggagcgttgcatagaaatttccgatcagtcgattcaaccaaatggctacgaccgacatcaatactgtgagcacaactgcatagaccgcaatcagtaaaccggcaagccaactgggaaccgtggtgatcttgtttatcaaggtaaaagcggttggatagttccagtccccgaaaccgataacgattcctaaaagtattaatcccacaactggcagaaccaaaaacaatccgatactcaattgaaagtttgctttgacgtgggccgccattttaccaagaaaatgaaccggcatgttcctcaaaatactttggtgctcaagttctactaaccatgaatctccgactaaataggcgattaaaaaaggtgcgcacactgcgatgacctgaaataataaggcgccatagtcactggcagtcttgatggcaacccgcggcgaaccttgaacttgttgtaactttctggcaaccgcgatcttcccggtcacggcttctttggttgggattaatagtccactagcaccggcaaaatcaagtgaataacttttaagttgtgcctgtgccaattcgacctgcccattaagaatcatgccggcatcatggacgagtaagccactatcaatcttgccggttcctgaaagttgctcattcagcgcctgcaccatttttccttgtttgctggttttcgaatagctttgggcatcatagcgtaaataactcgattgcaccgactgttgaatcctaaatgtctcaatcttcaaatcggcaatctgctgaaatttagcaacccaaaacaagccaatcactagaaaaaccataaatagttcgcctaccagatttttctgattcagcatcacttgcttttgaaagaaggcgcttagctgtttcatcttaaatgcctctctgttcacccatttttgctttctctggtcaaaactttactcaaagtgaaattctgtgagttgctttaacatactgaatcaataggtccacatattttgagtatattgataaaatatgagcccagcaaaaaccagctatttctttactagttcataccttctatcctctttatccattgattagtacatgatgagttttacattacattaaaatgaggccgccatcaagtaagagctcaaattaatcgtgcagcacgtccgccataatgtgctgcacggcgaggaagtctgcgtgtaaagaccttggacgcgtgttttcttttatgcccataacgcgctccccggcgcagggatctgcatgtaaggacctcaggcgcaatggccaagaccgggccatcacgcctgaggccacttacactccgatccctaaccgcgccggctcgcgcttaccaaaaaagccaaagcaccgcagccttcaaaaagactgggtaccttggcttattaaacctgcatcaatgagtgtgaacttttgcagcgatttgtttgccaaaatctgtttgatcaaaatgatcgataatgtccttaagctcagcataccgcagactagcgccgaacaacggacttcccggttcggtcataataccgtctgctaatcgattgtggacaacagtgtcaaagcccattcgatcaacaaaagccgctacttgatcaacagccgcgggatcatcgccggtcacaaacagcgccttgcgttttgaattccctttaggccgcgcttcttcttgcaggttatgatagcccatatgattgaaggttttgacaattttggcacctttaaaataggcttgaacctgttcactcgaagtggtcgttggatctaacacttcttcgcgaataccgtctgtttcccaccagtaattcatcgcgtcaatgaccaaatgacctttgagtaagtctgcatcaatatttttataccggcttaacgggattgctaaaatgatcaagtcactgttagccaccacctcggcattttcggaagcaatcgcgccggggacgagggttttgatggttaaggcgatttttttgactgtgcctgagccggaaattcggacagtataaccggcatctaaggccaaacccgcaagaacgatgccgactttaccagcaccaagaatgcctatacgttgaatcgccattatttcaccgccgccttttctgctagaatttctttaacccgcgggatgactttcgtgccatacaactcaatcatgcgttcacgctgagccgcagtttggttgccggcaccgtaaacaaggtcaaagcggcccaaatccagcagatcgattgtttctgccatgcgccgcgccacggtttccggattgccgacataaaaagagcccactttagtttcaccatcgaactgttcgcgactcatcggtgcccagccgcgagttaagccgatgcggtcaaaattggctttgatattcttgaaggcgacttcaattgcttcatcttcgtcatctgcaataaagccatgagagtggacggcgattggaaattcaggtttgccgagttcctttgcggcagcatggtacagctgaatatatggcttaaaccgactcgcctgaccgccaataatcgcgatgatcactttatagccgaagttaaccgctcgaatgacagattccggtgagccgccgataccaatgtatgtctccagtttgccgttttctgttttgggataaacttcctgattcttcaaagcagcgcggaattttcctgaccaggtcactgctttttcattgcgcaaggcatcgtacaagccaagtttttcgttgaacaagtcgtcatagtcggtcaaatcgtagccaaataacgggaaggattcggtgaatgatccgcggcctaacattacttgcgcgcgcccgtcagacaacgcatctaaagttgcaaagcgctcataaacccggaccggatcatcggaactgagcaccgtgaccgccgtagcaagcttaatttgcttggtcactgtcgaaatcgctgccaaaaccgtttccggacttgaaacgctataatccgggcgatgatgttcgcccactccgaaaacctgaatgcctaattcgtcagccagttgaccttcccgcacaatctgtcgaatcgaggccgccgccgtttgtaaactgccatcttcattcgccacaatgtcaccaaacgtctccagaccaaactgtaaatgctcaatgtctaccatcaaaaaagcctcccaaacgataatacttactttttgtaagttgataatcgtatcatagccttttttctggcgggtggcaagctttcacacagatattcatacgagaatacgccaattcatttatccagagacgcaaaaaagtccgatcatcgtgcgacggtcataagccaatattgacaatgacccgctgcgtaaccggactttttaaatgaagtcacatctgaagacttattcttttggtttcggccgacgttccaagtggcgccgcattttatcgagcaagaagagttgatcattattccatgggctattacggcgagctagatgcgcggcgtaactagacgtatcatggttaaattcacgttccgagcgttgcacttccttgagaaagtcgcgcgaactgatgcgtagagcgccgcgggaaaaaaccgtccactgctctgcttgatcactggtgaccacgaccagctgcaccagcggcgagttcatctcctgagccagtcgttcgatatagctgtcggcagtttcgtcttctttcgtgaaaaccacttgcaagtcccacttggcataacttttaccgattcccggaacatacatggcatcgaaaaccacaatcattttcgcattttcatgactgcggtattcagccagaatatccagtaagcgatcacgggcgacatcgaaatgatcttctgctttcaacttggcgagttcaggccagttaccgatgacgttatagccatccacaatcataatatgttcgcgcatttacttaccctcatggcgactggcaaaagcttgatacatcaagatgcccgccgcaacactcgcgttaaggctctgcacgtgaccggccatgggaatggcaatggtggcatccatcaatttggcaattcccggcgaaatgcctttgccttcattgccgatgactaacgccgtgctgccttttgcgtcccactggcgataatcctgcccatccatggcggtgccaaaaatccacatgccgcgatctttcaagattttgatggtttgcgctaggttcgtgacccgcgcaaccggcacatattcgatcgccccagtgctgactttggccacggcactggtcaaaccgactgcccgatgctttgggataataatgccatgcaccccgctcgcatcagccgttcgcaaaatcgagccgagattgtgcggatcttccaagttatccagcaataagaagaacggatcttcccctttatctgccgcgtgcttaaacagatcgtccaatgttgcgtaagcatatggcgtcatcgccaagagaaccccttgatgattgccgtggtcactcatgagatcaagtttttgctttggagccgtggcgactaagatcttcttcttttgcgccatgccgacaagatgctgaatcggttcgctttttagatcggtctggacaaacagcttgttaatggtggctgcggttccggccttgagcgcggcttcaactgcatggcggccgaagacgaattcatctggctcatgttcattatttggtgcttgcggctgttttgccatgacccgtcttcccttcttcaacgtattggatacaccatgcggctagctcggcaacgcgatcatcgcggccttcaagatgcaagtaaccaaacagtgcttcaaatcctgtcgagatgcgatacgtgaccacatccgtatgtttggcatgggtgtaacttttggcattgcgcccatgcttgaaaacttctgtctcttcggcacttaacaaatccgccgtctgcatcccggcaatcaacgccgcttgtgccttggcggaaacaaaatccttggctgcgcgttgcaaggctgccgggcgcaccagtccgcgtttgagtaagtgttcccgaatatagacttcataaactgcatcgcctagataggccagtgcaatcccgttcaattgttttggatcaaatgtcattttctacgccaccgtgtcccttgaggagtgtcttccaaaataatcccttgtgctgccagctgatcgcgaatctcatcgctcttggcaaaatctttcgccgcgcgcgccacatcccgagccttcaccaaggcgtcaatattcgcatccagattggtcgggtcggtgaaaacaaccccgaaaatctgcagccaagcatcatactgattcaggagatcattgacactttcctgtttgacggtatcttcattggcatattcattcaacaatttggcaagatcaaatagcacagtcaggccattttgcacgttcacatcatcgtccattgcagcaatgaaacggtcttttaaggttttaagctcagcagtgatctgtgcatcaacgccggcaacagcattggcacggcgatagaccaagttttcccgggcaattttcaaacgatttaagctattagcagcattctttaaattcgcctctgaataccgaatcggcatccgatattgcgtccctgccatgaagaaacgcaaaacctggggatcgaccgttttgagaatgtcgtggaccgtaataaaattacccagcgacttgctcattttctggtcatcttcgccaatggtcacaaacccgttgtgcatccagtaacgcacaaactgcttgccggttttggcttcactttgggcaatttcgttttcgtggtgcggaaattccagatcctgaccgccgccgtgaatatcaaacgtatccccaagcagttgggtactcataaccgagcattcgatgtgccaacctggccgccctttaccccatggtgagtcccaactgatttcaccgggtttagcagctttccacaaggcaaaatcgattggatcttctttcttgtccagctcttcctgtgtgatatgctgactggcaccttcttcgagttcatcaacattttgatgggataactcgccgtaatgtttgaatttacgggcgcgataataaacatccccatcaaccgcatatgcatagccttttgcaattaaatcctggacgaaatcgacaatgtccggaatcatctgactggcacgcggatgcgccgtcgccggttcgatgccaagcgcagtggtatcctccatgaacgcatcaataaaacgttgcgccagatcaaggggagcttccccggttttgtgtgcagcggtgataattttatcatcgacatcagtgaaattcgaaacataggtgaccttaaatccgcgatattcaaaataacggcggattgtatcaaacgcaatggcactgcgcgcgttaccgatgtggatgtaattatagacagtcgggccgcagacatacattcggatttctccgggatgcaagggtttaaacggctctttttgtcgcgacatcgtattatatagcgttaacatcggctcatttccttcctgtagcgtcttacctgcattttacaggaaacagcagcgtttataaaggaacgtgacgcggttggcggtaataattcttccgcctttcaaaaaggaaaccttcaaattatctgtaaatgccaagattctcaccgatgagaaaattcttcctcccattttttaccaaaggcggggcttatgatagtcagaacatgtataagttgctccaattcgtcctgatcgctgttacaattcttaagcttaacctggcatcgccttcgcaaaagctcagcttgtatccgaatgtaaaagtgatcatccggtagtccgtgcatttgtagttgcgttaatgttatcaaggctctttcatagtcgctttgatagtaaaacattgcagccgtattatatagtgcctgaaaaaaaagatcctgctgaccatttttttgctttaaagcgaaatgaatggtcagcagcttttcaaatagcttttcaaagtatttagactctagaaaaggaatgcagtctatgtacaaaatatattccaatgaataccaagaagttcgtttcatcaagtaattcataacagtttctgagtcttgtttagaaaaacattctgcgccatcttcaatatcgagcttgaccgcagtaaccataatagaacgtaacttaaaaagtatgttatgcgtctttgagaattcttgaatcagttcttgcttcagttgatatagttggccaatatttttttgcaaagataactgcaataacttctggttaaaatcctgttgcgataaatcaacatcagaagttttaaactgattctttttctcaaagagttcaaagaattccgctggctcaacacacacattgtgcaaaagcgtaaaaagattctccgcagaaatctctgttcgaccgttttcaaacttagaaaccgtacttatgtttaggggcctagctatatcggaaatacggagtccccgatcagtacgaatttctttaaagagttggcctaaactatatcgctccaattttctcacttcctgttgatgagatgaattttaattttattataatcaaatgttctttgttgtacatgaaaaattttaatttaagcaattagtctgagtccatttccagatcctgttaatatcaacaaataaggaaggaaaatatgtttcaaagtactcccgcaattgttagttgacaatatgttaagcttcaatcagcttcaagttggtctatcagtaacggctatagcgtttcaaatgcgatagaatggctgaatgcccacgtatcaaaatgagtgaagggtgatgtaccactaatgattaatgcctactttttacaaaaacttctgtggggtgttaatgttgtatcactgattgtaatgttatgttttttattgccgggatatactgatcagtactggctaatttttatatgcctacaactcgttgttaacatccttgatcgaggacttttacgtcagcatctaccagaaaaatattccgactcaaatattggtggaagcatcaggtaccttattctggcggttggactaccacttttctacccggtagtttcccacaatcgttacttgtggttaatggtagtcattggaagtataaacgttatattcactctggcttctgatgcatcaaaacgaaccaaatataagaagtcttgaaaaaatatattgcagtcaccaagaactttctcgaaacataaaagcaacgcaaactcatgagtagcatgggtttgcgttgcttttgcactttcattttttagtgctgtaaaagtgaaccttaacagctaaaagtttccttaaccagctgatgcgccgaggttgcttggcagttttcgactaaatcggacttaaaatgatgcgatcttggcattaatctccccaccacgatgatgtggtaatagaaaaagctatcaaaactgactcataaaccatcaagccctaaatcttcaaaaaagttcatcaagacctgtcttaagccctttgcttttaatcaatcttccgctttagattcaaaatgtttaacgggtcgaacaagtctttgattcgatgttgtaactcatcaacagcaaagccgagttcttcgttgttccattgattcttgctcatccccacagcatgttcgccggaaattgttccgcctagtgcaagagctttgcgaaacatcatgcgaattgcctgcagcgcttcttttggcggttcaacttgatcggctggccaaatgacggttgggtgaacattgccatcgcctgcgtgtccggcggtgtaaatttcaacgtttaactctttggcaactgccgcaatataatccatcatttccggaagcttggaaagtggcacagccatgtcttccatgatgtgttgaccgtttgcaaacacagcaggcaacatgtcctggcgcagtttgataatcgcggctgattcagcgggatcactggtcacctgaatgtttttagcatggtcagcggttaatattttctcggcaattttcaagctcgcctcgccaccggtatccaagcggaaaatgagcatggcttcggcgccttctgcataatgcgtgccttcataacgatccagtgccgccactgttaaaccatccagtgcctccagtgtcaccggataaataccggacaaaatcctcaaccccttttgctaaagcggtcatattgtcaaaatacgccacgccgacaaccggagtgccaaccggaatcggatttaacttgacggtaatttccgtgatgatccccagcgttccttcagatccgacaaagagatgggttaaatcataactgaaggcatgtttataagtacgcccgccaagcttgatttcacgcccatctgcaagcaccacttttagtcctagcacgttgtcagtggtagcgccatatttcaccgtgctcatgccacctgcattcgttgcaacattcccgccaatgcttgaaatcggcttggaacccgggtcaggcgcataaaataggccttgttttcgggcggcttgatccagatcgccattgatcacgccaggttccacaacggccaataagtcgcctttactgatctctttgatccgcttcattcgcgctgtggacaaaatgatgctcccgtccagtccgtcagcaccaatcaccgtgctggtatcagctccttgaggcacgaccggaatgtgatattgccgcgccacctttaaaacgccttgaatatcaggcacgtcccccactgcaatgtaggccaaaatatgcccagctatctcctgttgggcattgccattagcgctatgttcgcgggcaactttatcatctgtgtgaatctccgcatgcggcgcggcatcctgcaatgcggttaaaatctctgcatgatcgtaagctgtaaaaattgccatgatccagaccccctgtcctgaccgtctatcgtcaaattttgctgatatgaatcgttcacttttattatggcccaattcacaaaagatggtcatgatttagtcttagcggtcgatctgggtttgattaggccaagcgattggtatcatcaagatcgcgatacgacagtttaggatggacggtaatcaccgcttctcccaaccacgttaaatctcgggccattcttttcgtctgcaatggccgccgcggatagccaagaccggtcactttcgtttgcgaggccacacaaatggtcaagacatccgtgtcggcgcaggaatctggctcatgccgaaaccgcaatgcattgaaaacttccccgggcgctatttgcaagggtgccgccatttgcggataagcaacgcgcaccacatgccgaccgtgagtatcaaaaccggtcaaaaccgcgacttcaggctgccccagcaagccaaaatgacgatcaaatccgtcaaaccggctaaagcgcggcagaatataataaaaagtcggcatcattaatttcagcatctgttgaccggttagcattagcccagcctttccagcaaaacaaccggccgcggcagaaccgggaatatagcgcaacgcaaaggcaggatattttgaggaagtggtaaccgaatttttcggggatgggggctggcgggaagacaacatcaacattcactcctatcgcatcattagactataaataaaataatactcggttaactgctgaaaacgcacgcgataacccttcgccatgccatcaaccctaaccttataaaaaacaggccgggcttcagctgccgaatccgacgctgtcccccctgcctgtcatctgaaacctaccccaaaaaccaacatcacctagcttgttcgaaacgcacccgatcaagtccgcctcgttcgcacagctagatcatgccgcaatatccatcacctttccgttcatcacgaaaagagccacccacttaacagacgaaaaagccctgccgtaaccaaccctgtcacaatgcccgccaaaaaatagccgactttggacatacttcgtttacgtttcattttcgcttcacctcagatgatgttaccgcttacccttaccaacaactttcattttaccctatcgagatgcatttgtgggttttcacaaataaacgtcggaaaatcaccgattaacgttgtgctgagtcgtcaagagttggatttagcgtccaagtaacgggtgaaaaaatgttttttctataacgcgccggctcgcgctcacacacaaaaacccgcggcaaacgtatgcgcgcgggtttttaaatttgcttaaagttgcgacgtaacaatctcaacattcttcaagacttgatcgcgtcccattaattcgatagtttccgctagttgtggaccatgcatccgtaatgttgcggcaattcggattggcatgtaaagcttgcgtcccttaacttgcgtctcctgcttgacctcgttaacgatgtgcccaatggaataagcatcaaacgtatcgagtgctcgaatctttttggcaaaagcttcgatcactggcttcgcgttatcatccgccagttccttgcgctcatcatcagtcaaatcagtggccttatcaaagaaaatatccgccaatttactaatctgagccgtataactcatttgatcagtgtaaaggctgatcagctgccgggcccattcaatcgtcttgggatccggatcgctttgaatcttgccatcttcaattaggttagccaatgacaggctcattaactcatttggattggtcttttgcttagccttgatgtactggttattgacccattccagtttcttttgatcaaaccgtgccggactcttggacaaacgcttaggatcaaactgcttgatgaattccttcttggtaaagatttcgtcttcgccaaccggagaccatcctaacagggtgataaagttgaacattgcgtctggcaggtagcccaattcacgatattgttcgatgaattgcaaaaccgtttcatcgcgtttggacaacttcttaccggttgcgccattgataatcaaagtcatgtggccgaagatcggtggttcccagccgaacgcgtcataaatcgctaactgctttggcgtgttggcaatgtggtcatccccacgtagcacatgactaatttccatcaaatggtcatcgacaaccaccgcaaagttatacgtcggcatgccatcacgtttttgaatgacaaaatcgccgccaagcgtgttggcatcaattgaaattttgcccttaacaatgtcattccactcataagttttatcagtcggaatgtggaaccgaatgactggctgtaatcccttggccttggctgcagcaattgcatccgctttttctgcttcactcatgccttcatattcgtactcgtaatgtggcatttcgtgacgggccttttgggcttcgcgatcggctttcagttcctcttcggtccgatatgattcgtaagcaaaacccttatccacaagctgcttgatcaacttgtcataaatgtctttacgttcagactgacggtatgggccaaagtcgccacctttatcagggccttcatcccaatcaataccaagccagtgaaggttgtccatctgactcttttcaccgtctgcaacgttgcgtttcgtatcggtgtcttcaatccgcagcaccaacgtccctttgttgtgccgtgcgaataaataattgaacagcgccgtccgtgcattgccaatatgcaaatgcccagtcggacttggtgcataacgcacccgaattggtcgatctgccaatgtcttagcctccattttctgtaaacatgcactgctagtgtaccacagaagggcaaacgatggatgggtccgagtgcaattgacacttacttaatttgctaattcgttgaccgccaacgcgaaaatctttagactgttatcaggctcagaaaaaggagtaattacccttgttctttgtttagcggattggatggcacacacccctcaacattctttgaacgcggaggtgatagccatgccaaaatcaggagacgaaaggggttcgccgcattggacgtggcgtcgattatcgtcgcgcttgccatactggttaccagaatggccaaagcttacgcgataatcaaaaaagctaaccgtaaaggctagcttttacccacagtcatctgaaccgcgtcgaggtcatcgggatgccgcctgatggcctcttttcaacgccattattataccttggatgtcgacaaatcgtcaagaacgaccagaccgttccttattagacgtcagcttatcaaattgaagccaattaaaacgctcactaacccaccgcttgactttagtcactaacttgtcggttgcgcatcgtccgttgccatagccagtaaacaagtaccacaattagcacggattgcccaactaaaatgaattcttcaaccgtcaaactgagtgctcctacttgcgccagtgccgcaggaaagtcgatgaaagcatgtaacccgatcggtaccaataaccagaaccattgcttccgtttaacgataagcaaccaaaccacaacggaaagggcaatctgtacggctaatgccatgatccgttccagcaacgacagcgaaactgtccacgcactcatacccgttagctgcttcactaccgcggtgattgccgacctcgagctagcaggtgtttgattgatcaccttttcaatctccccgctatttattatgaacgcaaacgcataattactaagtactgtcacgctgccaatcaaaatcatctccaagccgccatgtcccaagccatacaggaatggcgtctcaggatcgttaattttagcgggaatacgcttttggataaacttgaagcccaaaaaccggccaacttcttcaaagacaccggccaaaagcgcgccataaagtgcataagcccaaggtgtgtgctgaaactgccgggcaattccgcgaaacgggccttctagtacaccggcaaataagaagaagattcccatcccgatgaagaagattttagtcgcccctttttggggatgacttcgccgcttaataacccaaactgccagcccaatcggcaacgctaagcagatgagcatttgaatcaacatcatggtcacggctgattggctgaccatttgattattcacaactttttccattcgcttttacctctcaatcaaaccagaatgctaagagcacaataccaaggatcaataccagcgttagtcccattaaaacccaactgatcggccgagccatattcaacgtaaacccaatgccgatgcgcttctcgacaaaaatggctgggtcgccgggattgtagtaaaaaataccaccaatccaatgctgattgtcgttcagcaccttgccttttgcatccagtttacgcgtgccagcaatataagccatgggcagtaacataaccgagaccagcgtcagggttgcggtgagaatcacgttaagccactgccaatcgctagacattgccggtaacatcagctgtaagaccagcaagctttgtgagaggaagccaattaaaagcagatagtacaaaatagcgttacgcacgcgcccggatcgcggttcggcatccggattaccacgaaccgtaccacgtgctcgacgggtcaaataaaaagcggttaataagatcagcgtttcgatgcccaacgccattaagagcacgatggtatctgcggaaggctggcggaaacccagaaaaatagccagcaagcattgtggcaacagaaccagacccgctgcggccgggaccagtgtttgcggctttaggtttgccaagtcaattgtcacttgatggttagtcaacgcctgatctgcatgtagttgctgcatcaattgtttacttttccggtgaccatcgatgattaatacaccattaaggctcactgttgctaaagtagcggcaatttgaatccaggcaagggtcactgacgacaatgcccaaatagccacggccccgcctgccaaaacagcaatcaccactgcgcctaacaacgaagcaactagataacgccgtcgcaacgtcactgcttcaggacgttgccaaattgatgtgcgtgcataaacaacgccaaagagaacattgcggcgcgacagccacggcagcatcgcctgaatggcaacaagcacaagccaggttatgacaaggatcaaaatttctgctttcatctaccttcactccccgttagttggtcgtacagctgatcaatcattttatgcaccgtgcttcggtcaaggttccgcgccaccgcttcggcaacgactttttcaagtgctggccgtaaaacgttctcgacagcttgttcaggggcgccgcgtgattggaccaccgcaccgcgtcctcgttgtatgactacgaaaccttcttgttgcaacgcttgataggctttgttcactgtgtgcaagttgacacccagctcatttcccagtgcgcgaatagaaggcaacacggttccatttgcgagcgtgccagtcgcgataccattcacaatagcatcgcgaatttgttgataaagcggtactttagaagccaaatcaatcgtcaaacgcacaaacccgccttctttccgttacacttgttctacaccatgtataacacttgtgtgaaaaaaggtcaacgaattttggctaaattaccgccgctcgactttttttattataagtaccttaaaagacgccttttttaccgcattgaaatcggcgtaccaatttgtgcgagttgatcatcatgcgtaatcgcaatcaccaaccgcgtttttgccagctcctgcagcaagtgaatcacatccgctttgatttccggataaatattggcggtaggttcatctaaaacataggtcgtggcatgttccttgctcaaggcctttagaagtcgaaccagttgcaactcgccgcttgaaagaatatcgacttttttatctagtaaattgaatatgttgaaattaggcgaatggaacacttgagcaaaatgcttcggttcttcatttaaaaatgccgccacattgcgacagtcatcggctaagtattcgccaactgtcagatgcgggctaggtacatcttgaaataaaaacccaatttgctcgcgccgcacttttgccaaatcgacttgtgccgcattaagcccatttatcagcacatcgcccgtcatttcaggttggtaaattccggtaatggttcgaacaaaagtcgtttttccaatcccattgtcgccggaaataacataaagtccgggcgttcgaaatgaaacattcatgttcttggcataaaacatctcatcgttacttggctgctgggaaaaccttctgacattgaatcctttgacctcaatagtgtgaatctcgttcacttgtccggtccctttttcatcaggcgcaatgcttagaatttgtcgcatgcgtgcaagcgaagcccggtatgcttccgtgcccattgctaccgtcagcagctggtcaaccgaatttaacaattgactgaaatattgcaaaataatcgagaaaaagccaatggtaatctgtccattgagcactgcaaatccgccgactaagaagaaacaggtttgaaagatcaactgaatactgatttgcgaagcagacatcgtaaaccgaatccagaaatctctgatataagtctggaatagccctgcttcaacccgattcaagcgctttgcttcgttctgaaaactgccagcacctttaatttcaatataacggccgataaaatcattgcgcgccgtgaagtattcgttttgcttgttcttaactcgcaagctgatcgcgtagattttctggtggaagacaacgtaaatcacaaaataaatcgggacaaagattgccatcatgccaaaaattttagcatctgctttcatcacataaagggcaatagtcaatgttgacacgataatgccgatgagccgcaccacggtatccgcaaagaagccgacaatttcgttgacgtcatcgtttatgcgggaactcaaggtagtcggactccaggtcaggattgcgagggtcttcttagtaaacaagcacgccaaaatactgcgattcatcgccaggattgttcgccgtcgcgtcaggatctgaatacgattctgaaaataggaaacgatcagccgcgacagcccgattcctagaatgattagcagcaaggtgacaaataaggtacgatcgtgactgtacacaaggctatctaacagtttaccttctaaataagtcccgccagtgattaaactggtcccggtcactgccagtaaaattaatgcgatgaagggagccgtccgttttttcagaacatgtttaatgatgggtggcataggcgtacctctgtttcgcgtttgacgtgtttcgactggttctgcaaaaagtccggattctgtccggaaaaaacatagcattgttacatcgtcctgccattctcgctgcatagacaactatttaccgaaacagaactagcttgtcaggataatttgtttgtacctgtcttcatgtgattcgtcaacgatttgcttaacactaatgccattatcaaatatttctttaattttgcaacttaatcttttgcttagtaactgaggcagcaatttttgtgatcgtgttctttttacgtttgccaatcaattatgaatcctaaccagttgtttctttttgcttgttaaccaggctaatattctcatagccgaattttagaatatgtaaagtcgttttctcatttcaattgtcagccttttcgccaccaaaaaaatcggtcccaaataccgagaaccgattttgcttaatcttcatgtagctgatttagatttactttcatccactactggcgcttcgccttacgaaacagcagtgtcgaaccaaggcccataagtgataacaacgctaaccccactgctgcaataccgtactcgtgcttttcgttggtattaggcagccgccgctgagcacttggcgttatgacttcagttgtggcagactggctgctggttgatggtaccgttgatgtttccggcgttgttggcgtaactggaatagccggtttcgtatagacaaagctgacaaccaatccggtatctttaggaaaagttcctgatgctgcagcactatcagctgccaggcgcacataccggtaaccgttaatcgtgatcggaccggtcgtataagccgatccactctgacctgccaacactctgttaggggctaattcgttaccattttcgtcaacataacgaaccgtgaccgatccttgtgtggctggcacttgcttgtaaacaaaggtaacgatcacattgccgttgataaaggtattaccagccggcgcactgccttgggccacacgggaaaaggcatagtcgctaatctcaatgggccgggcttcatataaatcaccaacttgacccgtcagcgtcttatcaggggcaatgcgcttgccagcctcatccacaaatctttccgtcacgcttccttgcgctgccggtttctctgtataaacaaaagtcaccgtctgcggattagcagtaaagctgcctttttcaggcgcactgtttgcagccagatgcgcatattcataatttttgacatttgctggcacggcagtatacgaaccaccgactgtccctgtcagggttgtggcaggcgcgatttcattgccatgttcatcaacatacttcacattcaccgttctttgagttacaggaactttggtataaaccaaggtaactgtcaaagtacccttgctaaaggtcccgttaattggcgcactgccattagccaactttgcatattgataattggcaatcgtcgctggtttaattgtgtacggtttcccaacttcaccttgaagaacagtgtctttaacaagcgtgttcccagcatcatcaacacacttcaccacaacttcattgctgctcgtcggcgaatcagcgtttattgtttgctgattatttaaattcaattcttgcccaagcgttgccggttgcacggccaatgtggctgtcctagtcgccaccgagctcgccttaacgtgactaggttgatgaccgatagccaacgcaaagacaccaattaaagctaccagccatagctttcctgatttatataacctataacgagtcttctcttctccaaataaacgcaatggtcttgcccctctttcgtgatccagtcgaaaacttttcaactgaaaacaacaaaaataactgctcatacattcacttgtattgtagcattaattagtttttaaagagttatcagctacaccttagcatgccaataaagccgctacgtcagcgtttcataaactttatcaataaaatatcggagttccaattttctttttgaatccacactgatatggtattcagcgtttattcatgcttctagacggttgacactgctttttgataccgttgttctgataattaatttgaatttcgttttttaaattggatcaatcacaggcttctgataccaaccccgtaattctgtctcagagaagattcgcacaagttttgcgacagttggggttggaacaagatgttgatggtttgaagcagtttcgttcacaattcaccaaacagttcaaaagtacccacaaaaagctctataagcttagggaaattatcgtttcgtgcatcatcatggataccgaagatagacacagtttgctttcgccagaggactccaaattcgtcagtgactatctttttgaaagaaacatctggtatacccttgaatatgttttatatagcgattgtgtgcctttcttacagccagcggactttgaaaaactatacaataagttcttaacgattcacttttcatttcggcaacgcggtgactacatggatttgttctttcaatctttctacaataccgctgttgcactctactatcgccaagcatactcgccggcaattcaaacattggataggctaaaagaacagcagattcccgacagtttattttcgattcgactgcatttgcgcttgttacgccgcttgtgccaatacaagctcaccaacagtaccgaaacggccgctgaattatcagagctcgtaaaagtaattttcaaaatcagtcccgcattcgggcgtcgctggaaagcagaatttcaatttcacgaacctgtaagtgaccatacttaatcaatataagccaacaaaaaaggacagttccggtattcccgcgctttctagagaaataccgaaactgcccttttattttttcttaatccaattacctttccttgtcgcgaatagccttttgctgatgagccggcttggcaaagatcatgcgccctgccgctgtttgtaaagcactggtgacaattacttccagcggtttgttcatgtagaatttaccgtcttccaccacgaccatggtgccgtcgtctagataggctacaccttgctgtcgttcggagccggatttaatcacggtcacggtcatgttttcgccggggatgacgtctggtttgagtgcgtttgccaaggcgttgatgttgagcaccgggacattttgaaattgggcgactttgttgagattaaagtcattggtcatgacaatcccatccagtagttttgccagtttaagcagcttgctgtcgacttcggtcatatcgtcaaaatcgccttcgtacatctcaatatgaatgtccttgtctttttgcatggcatttagaatgtctaagccgcggcggccgcgcattcttttcattgagtcagccgagtccgagatcagttgcagttcatgcaagacaaaattcggcactaacatggttccttcgatgaagccggttttggcaatggcttgaacccggccatcgataatcacactggtgtctagcaatttgtatttgcgaaaatgatcgccaactttgcgctcgagcacctgatcattttccgtttccgtattccgccggttgcgaaagctcagaagccgacgccattcttcgctgcgtgtcgtacccacccgaaaacccaagtaaccgaataatagcatgatgatgagtggtaggaagatattcagcggcgcgatgaagccataaaacggaatggaaataatggcggccagaatcaacccgataatcgtcgacaaactgccaaacagcagatagcttggcgatttggtgtttaacgttttttccagtaccttcaagcgcttaagaatccagttcacactgagactcgccaagagcaagaagataatggcaccgattaagccgtcaatgagcaagttatttaagaagtgattggcactccaaccaataagatcccaaagtgacggtaatgcgcccatgccgacgccgatcccaatgagaccaaagatcaaataaataattcgtttcttcatgatatacctcctttctaagtttaattaaaaaccttatgcagcgcttcggcaatgcttgtgacgccaataacctgaatatctttaggcgcacgccagccttgcaggttattgcgcggcacaaaaattcgtttaaaccctaacttagccgcctctttcacccggtcttcaatgcgattcacccgccgcacttcaccggttaagccaatttcaccgacaaaacaatcagtcggcgggatttccttgtcgcggtatgacgaggcaattgccactgccattgccaagtcaatcgccggttcatccagcttgacgccccctgttgctttcaagtaagcgtcctgattttgcaacatcaaattggcacgtttttccagcacggccataatcaggctgacgcggttgtgatccaagccgctgctcgtacgtttggcattgccatacatggtcgggctgataagtgcctgaatttcaaccagaatcgggcgagtgccttccatcgaaaccaccaccgccgatccggttgcaccagccagccgttcttccaggaagatttccgagggattggcgacttcctgtaaaccattttgatgcatttcaaaaattccaatttcgttagtagagccgaaccgattcttgaccgaccttaagatgcgataggtatgatgcatatcgccttcaaaataaagcacggtgtccaccatatgctcaagaatcttgggcccggcaatagcgccttccttcgtcacgtgaccaacgataaaaatcgtcacaccttttgacttggcaattcgcatcaattcggcggtgacttcccgaatctgagcaaccgagccgactgccgaattcatgtccggtacattcatggtttgaaccgagtcaatcaccacataatccggttgcatctggtcaatcacgttttcgatacttggcatgtcggtttcgggatacaaatacatgccggagttggcaacccctagccgccctgcccgcattttaatctggctggcgctttcttcacctgaaacgtacaacaccgtaccacctgtgctagctagctggccagacacctgcagcagcaaggttgatttgccaatcccgggatcgccgccaatcagaaccaacgagcccggaaccacaccgccaccaagcacgcgattcaactcggccaagcctgttttaacccgggtttctttggtcaccgtgacctcatccatgcgtgtgggcttaaccttgctgccggtgcgcgtttgccgcggcgccgatttagttgaactgatagtttcttcaacgagcgtattccagccgccgcagtttggacaacggcctaaataagtcgccgaaatataaccgcaattttgacatacatattgtgtttttgctttcgccatattatcccttcaatatctgctagtggtcggttgagccaaaaccgctttgtcgttgcgccaagccgccttggtcaccgtctgccaatagaaatggcataaaaatcccctgaccgatgcgatcaccttttttgatcatcacatcccgcgggaagaaattcaggagctgaatatagatttcgccttcatttgccggattgttatagtagtcggcatcaataaccccaataccgttgggcagcgtcaggccatgcttaagcggactgctggaacgattggccaaaatcaacacttcattaggctgcatataggctttaatgccagtgggaaccaagtaaggctttaaaatcttcttcgcccgttcaaagtccttattcgtcaacggatgctcatttttaatcaaccgaaaaagccgaatgaagtcataacgccaaatactccgcaacagaaaatcttcgcgcgcataaaaatcatacccagccgcctgcttagtctggcgggtcggcaaggttaagttgtcatcttgatactttgaaacaatttcaaatccgcgggtcttcatgaaaatagcctccaaaaaaagtgtgagcgtgaaccagcccggttagaaaccggagtgtaagtggccttgggcgtgatggccgggtttgggccattgcgaccaaggtccttacacgcaggtttctgggctggtgaacgcgttatggtgagcgcgacccggcgcgcttagaagtcggagtgtaagtggccttgggcgtgatggccgctctttggccattgcgaccaaggtccttacacgcaggtttctgggctggtgaacgcgttatggtgagcgcgagccggcgcgtttagaagtcggagtgtaagtggccacagacgtgatggccgggctttggccattgcggctgtggtccttacacgcagacttctgcgccggtgaacgcgttatgacaagcgcaaaccagcttgtgcaccagaaagcacgccaacatgtccaaagtatcataccacgcggagacaatcgaaggccacggtgtaagggcttcccttcttgtaattataccgttttcctgataaatttggcttataaaagtcattcatgaattgggttaacgacggatgggtcatcagacgaactgtgccagttacgcgccttgattcttaataggatgaccatcattcaatttgccaaggaggctgctatggaatttcaacgtgaaccaggacgaatttttaatacggattgggacggccgactgatggctgaagtcactttccaatcaatcgatgacggcaaagcgtgggcagtggatcacacctttgtcgatgaaagccttcgcggtcaaggcattgccgctcagctcattgaagccgtggtcgcagcagcgcgcaaagaaggcaaaaccatcgagccgctatgttcctatgccgtgcatgcattccataatcatccggaatatgcagacgttttgcgaccagttaaagatcagtgaaaaaatccttctcgaagctgccgaaccttggcagcttttttggtatgagcgtgagccagcccggttagaagtcggagtgtaagtggcctgaggtgtgatggtcgggcttcgaccattgcgcctcaggtccttacacgcagacttctgggctggcgagcgcgttatggttttatcgtctcggctccccttttcaacaaaacactaacttttacccaaaagcttctcagtttcatctttaaatctaaattaaattggggtaaggtttctttaatgcaatttaaaaaggaggatgttatgtcagaaattacatttgatcaaattaaagcctttcaagatcagcttgatcagcatccggcatcgggtgcacttggccgagctgtccaaaatgtcgggccacaagccgcaagccgtgaaaccatggacggcgaagatatgaagccggttttttcaattgacctagacaccggcagcgttgccaaccagaaaaaaagcggccggtgctggctctttgcgacattgaatacagtccgccacgggattgcggatgaatttggcatcaaggatttcgaattctcacaaaactacaatgccttctttgatcgcttggaaaaagccaatttattttatgaaaatattctggcaaccgcggacaaacccctggatgaccgagaagtcgccacttacttaagcggtccagatgaagatggtggccactacgatcaatcggccgccttaattgaaaagtacggtttggtgcctaagtcggtcatgccggaaacttataacagcgacaaaaccgctgaactcaacagtgtgttgaacgagaaattgcgtaaggatgctaaggtgttgcggaccctcaagcaagataacgccagcgaagaagccatcgccaagcaaaagcgcgaatttctcagtgttgtttatcgcattttggcttacacctttggcaatccgccgacaacgtttgatttcgagtaccgtgatgacaagaagcaataccatcgcgataccaacttgaccccgcagtcattcttcaaaaagtacgtcaaatggcattttgacgattacgtggtgattgccggtgatcccgaaccaaccaaaaagtatcagcaattgtataccatcaattcagccaacacagttgttgaaggccatccgctgacaattttaaatctccctccggaacgtttgaagcagctggcattagcgcaactgcaagcaggtgaagctgtctggtttggcaatgatgtactagccgacatggatcgcaaatccggcacgcttaaaggcggattgttcaattacagtgatttgtttggtgtcgatttccatgtgaacaaaaccgaccgtatcgtgaccaccgaagcggaaatgtcccacgccatgaccctaaccggcgccgatgtcgttgatggcacggtcaccaaatggaaagtcgaaaattcatggggcaaggaaaatggccatgatggttactttgtggccgatgccaactggtttgaccagtacgtttatgaagtcgtggttcgcaaggatcttttaactgacgcggaacaagcgcttcttcaaaccgagccgatcaacttgcctgtatgggattttctaaattaagattaactgatatgctaaactaagcgagtcacaaaacggtgccggcttatgacgaaatcttcgccgccttttcgaacgaccatgattttcattaccagccgcatggtgactcagcttatgcacataaaaaggagtgtttatttaatgtctgcagaaattacttcaggcgatttggatcagttcaaacaggatcttcaagccacacctggcgccaacgccttacaaaaagcggtcatgaacaatggtattaatgcaactgccgagaataccgatagcaaagttgccatgacaccaacgttctcaattgaacttgataccggtgctgtgtcaaaccaaaagcaaagcggtcgttgctggatgttcgccgccttgaatactatgcgtcatggcattcaggcacagtttaagatcaaggattttgaactgtcccaaaactacaccttcttctgggacaagtttgaaaagtccaactatttttatgaaaatgtcttaaaaaccgccgatcaaccactcgacagccgtaaagttgcctttcttttggctaccccgcaacaagatggcggccaatgggatatgctgtcagccttaatcgaaaagtatggcatcgtgccaaagtcagtgatgcctgaaacctacagttctagcaagagtaacgaattaaatggtttgctcaacttgaaactgcgtaaagatgcggtcaccctacgcaagttagttgctgacaaagctagtgatgccgacattgaagcagccaagcaaaaaatgctggctgaagactatcgcatcttggcatacacgttaggcaacccgccaaccaaatttgactttgagtaccgcgatgatgataagaattatcacattgatcgcgaactgacgccgcaaaccttctttaagaagtacgttggctggaatcttgatgattatcaaagtatcatcaacgccccaaccgctgacaagccgtacaagcacctttacaccgttgaaatgctgggcaatgtcgtaggtggtcgtgaagttcgccacttgaatcttgacattgataccttcaaagacttggcaatcaagcaactcaaggccggcgaatcagtttggttcggttccgatgttggtcaaagctccgatcgtcaacttggcattttggacaccaacatttacaagaaagatgacctgttcaacaccgacttcaccatgaccaaagctgaacgccttgactatggcgaaagcttgatgactcacgcaatggtcttgaccggcgttgaccttgtagacggcaagccaaccaagtggaaggttgaaaactcttggggcgaaaaagtcggcgaaaaaggttactttgtcgccagcgatgcgtggtttgaccaattcgtctaccaagttgttatttccaagaagtatctcccagctgaactacaggatgtcatcaagaacgaatacgacaagccaaccgttcttgcaccttgggatccaatgggtgctttggcatcaagataagcttgatctgaaaacactaggataactggaaaagtctcgtaattttgatctaaagttacgaggctttttgtataccgccgtaagcgattcgaaccaatgcggctgactgcgtgacttaacgctcataacgcgttttccagcgcagaagtctttgagtctgataaaattgtggtattctggttgcaactggattaaatcaaatgaggggatcgggccatggggacacaattagcttttgattggcgccaaatcattcattcacgcaaaaacattgccttattggggttgttctttgcggcattcatcatcgcattcttcgcattagtctggacgcaccgccttgatattcaacagacttccgaggccactgccaatgccgccgtggctaactatgcggaatataacttggacacactgagcaaaacccaaaagccgctattggcgaatctagatgaccaaaattcggcgactggtgttatcgacttgggcatccagcttgatcaacccgatacgacccgtaacgggctgcttagtttacgcactgctcaacttgaaatgcggcaacggcattataaagcgcttaataccatgccgctgccgccgctgcaccaacttaaaggtgacgttctggcgcttaccacgttaaaaaagcagcaaaaacctgccgtcacgacggtttccactagcgcggcgtatctcgtcaccatcctgccttatctcagctggttaaccggcgcggctgccgtgctgctagcctgtgatagctgggttgaacgacgccgccaccaaacgctgattagcgcgcgtcctttatctgtcggcgttgccggcagcagtcgcttgctcactttaattggtttttacatattgatccttgttgcaggtagcatggctgcaatcggcttacctgcgctattaaaaggcttgggtgacttcgactaccccatggccatcatgggacaaacattactgccattgtgggaatatttacttattttcgtgggtctgacattactggccggcatttggatcattagctttagtatgctgattaacacgtggataaccaatgcttacctcacgacctttattgtgaccgccactgctttattgccgcttatattgccgcaacttttccgctttgtgtggtttctgccattctcctatcttgacgttgccgcaatgatgcgtggaacattgattgatcgactgaatcagcccttagccagtatttggatcggtacaggcgctttattcatctggtcggtgcttaatctgggactctttggttatcgggtcagaaaggaggcagcatgatgcgatattttcgattccaactccatcaactgcttaccaatcgtaaaaacttagctgtcattggcatcgcactcgttgccttgatttgccagttcgtctttttcccgccaaatcaggtgccacctgaacttccgacaagtacggtgttgacgcgtgatcgcgataaaaatgtggcgtttgtcaatgagccgcatggaccgcataccgcgatgtgggtcccttccacccgtcaactcgtcaaaattgaaaatcgcatgttaacggcgcaaaaacagcagcattcgcaggcctatgtgcaggcaactttggattatctggcttttgtacgaaaaaatgccgccaatcctgaggctcaaagtagcccattccactatccgctaacatattattttgaaaatcggcaataccctgatgccgatgctgcttttgccaatatcaccctgacgcgcgcgctgatgactttagccgatcagcgcgatcccgacatgactgcggttcatcagcaaactttctggcagacgcttttccgtggcgcgttaggcgggtggctcactgcgctactgctgatcacgatcttatttgctaatgatttgctgacgagcgaacaacgccatcgcagcatcgttcggtcatcgcctctaagtccctggcatgccatcaacaccaaaaccttgaccgtgctaacagccttagccggtgtacttctgctatcagcgcttgttgttgccggcttcgtcatccctactcacggagtaggatcgctaacaactgcgatcgcctactttgccaaagatgggatgacagttaccgttgatccgatcgcgctcagcattgctctccccatcatcctcggcttgacaatcctattgatgtggctctttattcggttaaatctactgtgtcagttactttttcacaacgaactggttggactggtactcagtgcactcttgctattcggcgagccactctacttcatgcatgggttggctttttccgtcccgcaaaccgcatactacctgcccgggtacatgaatccggcggcgattgtcagcgggttgcaaaactttcgctatgataccagccgcatgagtccgctcgctgctttgattgtggtcggcagtgtgattatcgtgcttgaagtgatcctattcatcatcacacatcgacgccgggcagcaatcgttaaataaaggaggccccatgatggaattacaattacaaaatctcgttttgggtttcaaaaataaacccaatgtcattcatgatatcagcctaacgatgacgagcggctcaattgtcggcattgtggcgcccaatggtactggtaaaacaaccttgctgcgattgattcttaatgatctcaaaccacaatccggcaaagtggtattagatggacaaacatacggcagccaaaagcataccctcgccatgcatcggcaaatgtgccttttcccggttcaagatgatctttatcctgacttatcgggcaaggcgcacctggcatattacgcccgactttggcataaccaaacgaaaagtgttaagcaaattatcagcgcactcgacatgcaggattatgtcaatcagccggtgcgaacttattcaatgggcatgaagcagcgtctttgctttggcatggtgatggcggccaacaccccgattatgctattagatgaattcatgaacggtttggacacgatcaacgttgcgcgcatgtcgcagattctgcgcggattgcgggcagaaggcaaattgattattacagtgtcgcatctattgaataatctgcaaggatatgctgatttcatctacttcatgcgcgatggcaaaatcatcaaaacgattgatcagcatgaacaacaacctttgtatattcaagtggcagccgaagaagccaaccggttaccgcgcatgccttggcagcactatcccaatggcatgttggtattgccaattaacaacctccccggcgaacattttaaccagttgctgctaggactggctgcgcatcacattgcgtttaaattagcaccactggatcttgaaacttacttcaatgaattttatgatgccgattaatcaccaagaccactcaaagtcgcttgaacagcggctttttatgcaagtttttctggatgcaagatattgggcaaaataaattaagagccttcccttacaatgacactcggttctgctacaatgacgttattacttttcaggaggcacaaatatggcgtcaggcttgactgctaataaaaaactgcggcataagattaccgcggcggctttactcgtaacccttggtgttgtctatggcgatatcgggacatcaccactttacgttatgaagtcaattatcgctggaaatggcgggatgggacatttcgataccaattttctagtcgggtcggtgtcgctgatcttctggacgttgctgattatcacgaccctcaaatatgttctcattgcgttgcgagccgataacaacggtgaaggtggaatctttgcactttacaccttggttcggcagcgggcgcggtggcttgtactgccagcgatgattggcggtgcggcgttattagctgacgggatgttgacgccagccgtgacggtcacaaccgcgattgaaggtttaaaaggggtccatattaacggcaacattttgatcgacaatcaacaacaggttatttgggtcacgattttgatcattaccttcctgttcttcatccagcgttttgggaccgacctgattggcaaggcgtttgggccgatcatgtttgtgtggtttaccttcttaggcgttgccggctttattgctttatcaaaagactggtccatgttgcgtgctttgaacccttactatgcattgcgtttgctggtcagtccggataacaaaatgggtctgtttattctagggagtattttcctggcaacgactggggcggaagcgttgtattcggatatgggccatgtgggacgtggcaatatttacgtcagctggccatacgttaacctatgcttagtgttgaattattttggtcaggcagtctggcttgatcgccatgctaatgtgagtgcttataatcagattagcgatttcaacccattcttccaaatgttaccggaaagcattcgcctaggcgcaattattctagcaacattggctgcgattattgcctcgcaggcgttgatctctggttcttacacgctggtttctgaagcaattaaactgcgctttttgccgcggctgcacattgtctatccgacacggcttaaaggacagctctacatccccatggtgaacacgattttgtggctcgcctgcttgactattattgcttacttcaaaaccagtgccgaaatggaaggtgcttacggtctagccattaccatcacgatgttaatgacgaccttgttgctttatcaatatctgcgcgctcgccacgccccaaccttgatcgccttgggtaccttgatcttctttagcgcgatcgaaaccgtcttcttcatttccagcgccgttaagttcctccatggtggctatgttacggctatgatcgcgttcgtcattctggctattatgtatgtttggcaatatggcggccggattcgcgatgataacacctaccgcgctgaaatggcctcactgtttgcgtataaaaagcagctatccgaacttcgcagtgatccggaatatccaacctacaccaccaacttggtttatatgacgcagattgccgatgatcactacattaaaaaagaaatcctgtactccatcttggataaacgaccaaagcgcgcccgtgtctactggtttgtcaccgttaacgtcacggatgagccatacacggcgcaatatacaactgatacgtatggcactgattatatggtcaacgtccagctgtatctgggctttcggatggagcagcaggtcaatgttttcctccgccagattgtgaatgacatgatgcgcgaaggtgaattgccaacgcaaccgcaaaaatacaccaccattccggatcgacaggttggggattggacgtttgtcttgctgcatgaagaattgtcaccgcaaactcagatcaaaggttttcagaagacgattatccaggcgcggctatggcttcagcgcgtgacagttacacctgctcaatggttcggtttggaatatgctgacaccttggacgaaactgtcccgcttgtacttggtaagattccgatcaccaagttaacccgcctaagccgatcgcaagtcgacgcgcaagctgaggatgaagacgactagctattttagtcagatcacaacacattcgctagcttaagcgatggcgcacacatcatgcgctccccggtgccggctcacgcttacagaaaaaagtgtcccaaaagtcatgactactgacttttgaggacactttttaaatacaaattatagtggcaaatacaaagtcataccgcttcagtgctcaaaccagcctgtctgtctacaatctacgcgccggctttaacttttttcatggcgcgcaaagctgcttgggccgctgcgagtcgggcaactggcactcgataaggtgagcaggagacgtagctgacgccgatttgatcaaagaacgccactgaatccggatcgccgccaacttcgccacagactccgatcggcagttgcggctttgtttgacgaccgtttgtaattgccatggccatcaacgcgccaacgccttccgtatcaaccgtttggaaaggatcatccggaagaattttctgctccagatatgcgggtaagaaggatcccacatcgtcacgcgaatagccaaaagttaactgggtgagatcgttcgtcccaaaactgaaaaagtcggcggtgtgagcaattttgtccgcggtgacgcaagcgcgcggggtttcgatcatagtaccaacttcatagctcacctgcatcccttttgcggcggccagctgttcaatttgccgaacaaccaattgccgcacccaacgcaactcggtttccgaattggtcaaaggaatcatgatgtgcggtgttacctgcataccttcatcggctaaccggaaaaccgcatgcatcagcgcccgcacttgcatggcgtaaatatccggataggtcacggctaggcgatccccgcgatggcctagcatcggattgacttctttcaacgctgccatccgttcgcgtaactgattttgctccaaccccagctcatgcgcgacttgcccgatttcacgctggtcatgcggcaaaaattcatgcagcggtggatcaagcagacgaatcgtgacggttttaccagctgccaagcgatatagctcgtaaaagtcctgttcctgcattttctctagtgcggccaagggtaccttgcgtccggctgcatcttttgcgagaatcaaccgccgcatttgtaacaatcgttctggttggaaaaacatgtgctcggtgcgcgttaggccgatgccatcagcgccaaaagccaaggcctgctgcaaatccttaggtgtatcagcattcgtaaacacgcccatgcggctggcttcttttgcccatgctaacagtgtcgccagactatccttgaccaaggcggcagtggtcgggatttggccgcgatacaaattaccggttgtcccatcaacggatacccaatcgccttcatgcagcaccgtatcgccaacagtcgcggctttggcatgctcatcaacggttaaggcatgcatccccacgacaccggttgcccccatgccgcgcgcgaccacagctgcatgtgacgtcatcccgccgcgtgcggtcacaatggcctgactaacaatcatcccttctatgtcttccggtgaagtatcctggcgcatcaaaatcacttgatggcccgcttcatgagctgctttggcttctgctgccgtaaaataaacctccccagttgccgcccctggtgatgccggtaaaccggttgccaaaatcgtatgtgcctgtaacgcttcaggatcaaactccggatgcaacatgtcactcaatgattgcggttcaatacgcaacaacgcggtctggcgatcaatcaagccttcgttaaccaaatctatcgcaattttaacagcggccgccggtgtccgtttaccattacgcgcttgtaggagataaagttggccatgttcaattgtgaattcaagatcctgcatgtcgcgataatgctgctccaacgtggtcgcgatcgctgccagctgattataaacttcaggcatttgatcgtgtaaaaccgcgactggctgaggcgtccgcactcctgacaccacatcttcaccttgggcattcaaaagatattcaccaaacagcgcgcgttccccagtcgccggatcacgggtgaaggccacgccggttccggaatcagcgccagcattaccaaaaaccatcgtctgaacgttcaccgcggttcccaagtcttcgggaatgcgattttcgcgccgataaaccacagcacggcgattattccatgattcaaataccgctgtcactgccgccagcatttgcgctttgggcgattgtggaaatgacttgcctgcctcaatataaagctgcttaaatgccagaatgatttgctgcaggtcagcggttgtcaacgccaaatcagagtcataccctttttggcgtttcacggtggttaaaatgtcatcgaatcctttttccgataagccgtaaaccacattaccaaacatcgccagtaagcggcgataactgtcatacgcaaaccgaggatcggcagtttcccgggcgagtgcctgaacggtttgatcatttaagccgatgttcaaaatggtgtccatcatgcctggcattgaaatcggtgcaccggaacgaaccgacaccagtaatggcgcaaccggatcatcgaatcgtttcccggtcgctttttctaacgcctgtatgtgttgatccagctcggttaacaacgcttctgaaagcccgtgatgctgttgataatcgtggcacgcagctgttgtgagcgtaaaacccggaggcaccggcaggccaagattggtcatttcggccaaattggcacctttgccacctaataatgcccgcatctccatattaccttccgcaaacgcatagatttgtttcatgataaagccttcccttcactaaatatgacgttatatatattcgctatataatgtattatttagcaggcaaaaatgcaagcgtttacacttagaaattggtctaattcggaaaaagtttaatttcataacgccatctaatacgcaaaaatctgtttgcaagcgcggcgatgcgcggttaatataacatcccatttcacaacaagaaacttgcctataaggaatgtaaaaagtgtcctatttctcgccaaaatcgagaaataggacacctttaatttgaagctgcaaatgaaagcccaacctcatgctgcaagtgtttcaattaaatatttaaagatccggtttttggtgatcttgccaatcacatgagtgtccccatgtttttggatcacaggaagtgaatcgacattgtgtttcaacaacaacttgctggccgccataatggttgtatccgccgtcactgtcacaacattgggcatccgcgtcatgacaatactggccggtaaagtggtgtcacgatccgtaaagctggcacgcaataagtcctttcgcgagatgaggccgaccaaggcgccatcatcatctaacacgtataaggagccgacatccgccaagaacagcttggttaccgcttcttccatcgaggttgtcagcttaatttcagtcggcggcaataatattttggcaatcggggtattaaacagcgcatcgttgtctgctgataaaacactcgctccttggtaggcgtatcccacttttggccgggcatctaaaattccaaccgttgtcagcaagcgtaagtctgcgcgaatcgtggccaaactaatctttaattgtgtcgccagcatttccccagtcatcggactttttgcttttagtaactgaacaattttttgttgacgtttagtaagttgcgtaagcgctcctcctcatgattgctaatcaacagtataacattttcagggaaatatgacgtgatatttaatcgttaatcacaacttaatcccaaatcttggtaaaataaatccggcatgtagctaaactactttgccggaaagttttcacagtgtttgtttattgagaatggttaaatgctgatcaagcgtgtagacgattggttgggcattgccaatttcaactttgttaataccagcatcgctaatagcttccatgtacttgactaacgcccgtaatgttgagccatgcgccacgataagctgattcttgccggccatcaaccgcggcgccaattcagcgctccaatacggcaacaggcgctcactcgcatcggcaagactttcaccgcgcggaataatcgtcgccgggtacgcgtgatagcgccgtgaacgactgggatgggccaacaacggcggatgcgcataaaagcttcgccgccagctggcaacttgatccgggccaaaaagtttccgggtcagatctttgttaattccgcgtaaggcgccataatgccgttcgttcagacgccaacttttagtgatcggcaggtaattctggccgattgcgtcctgaacgatgtaggcagtcataatggcccgcgataacacgctggtatgcacatgctcaaataagatcccggtcgccgcaatctttttgccggcagctgctgcttgagctttcccttgcgccgttaatccgacatcggaccagccagtataagtattttgttgattagcaatgctttcgccatgccttaaaaggactaatttgaccacatcacggcctccttaacccaactagtataacaatctcaacgggtttagggtagtctgctcggcaggtcttttttgccgccaaggcgtgaaaatgataggctactattattgaactaagcaaggcgcactgccttagcttatagaaagaaggatgctcatggccaagtcgcatcaatctgtcaccatggtcgagcttttctatgatttgatttttgcctatgccgttgggcgaatggcgcagagtctggcagtgccggtgcatgggatgatcgcgccacaagtgctggttgaatttctattgatgctgctggttttctggaccatctggacttttcagacagtcttaatcgatcgtttttcacatcatgaagtgacccacaacctgtttacgttgttcaacatgttttgggtgattgtcttaagcaccgcgattaaccctgattttgctaaaaccaagtggccatttcaattaagcgctgcgattctcttcttgagtcttgcgagccaatacggtctgctttggcggcgaaaacactcgcaactcgccaaaacatttggcatcacactggcagcttgcagttttgtgattttaatttcgctatttataaaaccatacaccctttcatttgcggtcttctttggcggtgtgctagccgctgggttgatgccattgcttttgcggcacgtactcaaaaccacgccagccgacttaggcaatctcagcacccgttattctctgttggttttactgatatttggcgaatcgatcattggtgtggcagaaaccatttatgccggtctatctttgcaagcaggtcttttcttcttggtagtcatcttattgtttattgcctaccaacttgtttatgacaacggccttgatcgccggcaaaaaaccgcgggcttggctgttatctatttacaacttccattactggcggccattctcagtctcagtacgttcattcactcgtggctggccgggctgcttgatcctcaatggtttgcgcttgccatcacggtgacattggcagtttattattttagcctaatcggatatcttagcgcctatcctgtcaagcacattgacatcggcttcaaacgctggttttaccttggtttttccgtgttgatttttggtatttttagcttcatgacaaccattatgccattacccttcatgttcggactcaccgcttatctattagccaatacgctttatctttggcaatttattctccatcccaatgacgcgatgtataataaacttggttaaatgaaaggggagctccacatgacaacttatgatgtcacattcaacactgtcgatggcaagtcactcatcaagcgcaacgtccaaagcgatcacgaaaatgctcgggtttgggaggacgcggttgaacgttttgatgccgaccacctttacatcaaaatgaatgacaaaacaatggtcagccttttacggcgtgccgttgttcgcattgatatgaccgaactgccaagcgatgttgaaaaacgggcaaatcgccgcgatgagttccgcaatgccatgtacacgctgagccagattggcctgtagcaatcctgttacgggtatcaaaatggatcagcacatttagtccatcagcctctaacccacgtcatcaaaatcctatcgattcatacatatcgtagtttcttgatgccgatccggtcatgctgatgtacagaatctatgtatcaaaaaagaatcccttcagccttaaaaactgatagggattcttttttcggtcgaatcatgtgtctgtacaacaaacaccaagtttaattcatcaatgcttcaaattagtcagcgtagttaaaatgggttaacggtgcatgcttaacatcttcaatcgtcttagtgccggccagctgcatgataatttccaactcgtgatcaatctgttcgaacacgctttgaacaccttgtgcaccacctaaagccaagccatagataaccgggcggccaaacgcaaccaaatctgcaccggacgccaaagctttgaagacatgactgccacgacgaatgccggagtcaaagatgatcggaacctgcttgttaacggccttagcaatggcaggcaaaacatcaaatgatgctgggccaccgtttaactgacggccaccatggttagaaacatagattgccgcagcaccggcgccaattgcccgcaatgcatcttcaggagactgaatacctttaacaataaccggcaagtcggtatattcagcaatccggcgaacgtcatcttcattaatcttttgagcagcagaagcataaatttcgccgatgcctttacccttgccatcgccttcagaatacttttccaggttcggcattggaatcgggaattggaagttgttgataatatcttcttctcgataaccatcaacagtggcatcaacggtcagaataatccccttgacgccagcctttttagcttcgtcaagcaagctcttattgaagtcccaatccttgctcatgtacagctggaacaattgcggtgctccgttgccggccgcagcagtatccgcgattgaggttgagctatacgtgctctgcgccatcaaaccaccgactgctgccaagccgcgagcggtatccttttcaccttggctgtgagccaatccctgagccgcagtttgcgccatcataaccggcgtcttcagatcaatgcccaaaaagttggtcgacaagtctggagaatcaatgttcgacaacgccttgggaacaatctgtgcgtggttaaacgccttggtattctcggcaagcgtccattcatcttcggatccgccaacgatataaccaaatccacctgttggaataatcttcttggattcaccttctaatgacggcaagttcaaaatatccaatttcttctctgcatcgctttgttcgtaaccattaacaactgtcatgtgtcaaaagcctcctgaattgcttacttattagaacacttataagtgtagcacttataaatagtaagtaaaggcattttgctaattttttgtaagcaaaaaggagaacctgcaaaacgaggccctcctttgttagccaaacaccgaatcaacattggcggtttagcgttctttcttctccttggacttgtcaaccacgtcattgaacttctccgcgattttgtccttggcatcactgagcttttctttagcattgccgaccatctgttcagccttgccttttgcttcggtcgattcatcgccggtgagtttgcctgcgccttcttttaccttgccactgaccttatccttagttgcatcaaaatctgccatacgatcatgcctccttatttttgcttaacttaaggataccaagttgacggtttgccctgctattttaatgctcataaaaatataaatcattttgttttggcgtgctcagtcacttaataaagtcgaataaaaaaaccagaccttgatgtcaaaaacaaagtccctccgacatccgtgcctgattttataaaaagcctaacgaagtaatactacaatctgagtaacatcctttatccgttggcgaaagttaaatttgctgaaaactgatccttatatttaggatctcaacagatcagtgtcctaaagtaacctaagaaattgtcacttagaatcctttgaagctttgtcggtcgaagatgtaacccctagtttggcgaaaagcatcacaaccaacaaaatagaaaacactttgacaaataccttaagcgcgaaaaggtcaaggccaaagcagtacagaatgaccctgtttaaaatgtcgccaaggccaaggccgccgaggaaaacacagatactgccccaaaaaggaacttcgtcaagccatgttcgtatcgtttttaagatgttcctagcgtcccccgttccatccctttttaaaacctttaaagatctgatcggtatgtgcccacgcatccgccaataggaaagtagccaaagcaccgccgtaagctgctaaagggacgattcctcccgaaactgacgaaagatctcgctccgacagtggcaaaccagggttaatttcttttaatgtcttcatactatctccccctatcctttgatggctctagctacccctaccgaaccacaaaatggaaacggaaggagccaaccggtcttaacctgacagttagcggcagcgccaacagcataaccaaatttttcccagattaagtcgttagacccggcagcaatcttgcttaaatccaaatcatttaattctttataagcctttgttaagttgttcatgtttttcctccattctttctgcttacactattaacatcgttgtcatcctcaatgttcaacttagctggatgcacaatcggtagttggtatctgcgcattgagctgtgaatcggtaattagtgtgttatatctgaattcagctcacttgaatgaactgtattcccacccgtaactagtttgagctttcatacagtgatcttctttggcgccgtatcttttaaaaccactgcctaaacatcctcctttcgttctttaagagtgatcatctctcactaccaatataaaacattaaagtatgcctgtgggaaagtacttattaacgtcgtattttccccgaaaatcgtcacgtggaattcaaatttaacgtttatcgcaaattttgctacgtttatttttcattttcaaatttgccattgagctgtgttagacaattaggacgaattctgtgttgctattagctaaaagccgctcatagtccttaacattgacgattatttccttctatcgctcaaccccccataacgatagaccatcgccaagaaataccgaaagcagattcattttatgactgagcattaaattttgaaccagctgttgtcaatgtggtttacccacgattgccaactgacgccatttttttctggtcaatgatcaatcaaacgtgctgaccaatatgatcactgtcacggttaactaaaagtagcatgaggactagtgattccaaaagtttttcatctcttatgtatcaaaacaaaaagaccctccaactaacggagagtcttgtaaaaacgcctttagtgccgtgcaccgggacgtttttcctcaggcgctggcggaataaccgctttgccgccttttttaatatgcttgtagttcacaactgtcttattcttcatatcttcaaccattgacgcatcttcgggtgaaaaactgtcaatcgtcaacatggctgcattggcataaagcttttcgaccgtgcctttgaagctcaatggcacatctttggtctttcgtaccgagaccttatcgcctacaacgatttcttgtgacacacaaaaacctccttcaacgcatcttccgccacatttccgtcaccatcgtaacacgagccgtcatcatcggaaaatgaaggcgcgttatgacaattattgaaacggaatcgtgacgcactgcatttcgactgggatagacgcactatctttgcgctgttgccaacgccattttcatcaatagttaagagcttacttggcgacctggactttaaccttaatcggtgcattcaggtcaaccgaatcactgtaatgttgcaacaaataccgctgcatcgcatcacgcgcttctttcttggtcatctggtgacagacccgcgaagaatcgtgccggtgtccccacttatccgtatattgaccaacgacttcataatcacgaagatgtgctgcaaataacatgattcctcttaaccacctttactaattgtaccatgacttggcacttgtttttgtatcacaagaagcatttatacacccttatcggtcccgtttcaaccacatgagcaaaaaaaggctttcagagcttcccagatcccggcatatcaacgctaaagctttctcaccgtttcaacacctatcattgatatgttagccaacatccctttgcattggctgatcaaagtcagactaaagccggtcacggttactctgcttcatccgcttaaacgcaatcaccgtccggcccaccaagtcctgaacattaaacttatctcgggggtcataatccaaaatcgtcaccaaagctgaattctcgtaacatttctcgatccggccaataaaatcatattccatattgccattagcctggcacaaaacagtcattcctgattttgcatgtttcataaccaaaacctccttgtatagtgagcgtgagcagggccgcttagaaaccggagtgtaagtggcctcaggcgtgatggcccgggtttggccattgcgactgaggtccttacacgcaggtttctggccctgcgaatgcgttatggagcgcgagccggcgcggttagaagtcggagtgtacgtggccttaagcgtaatggcccgagtttgaccattgcaccaaggtccttacacacaggtttctcgccctgtgaacgcgtcacggaaagcgcaacccagcacaaccaatattccacctgctcctgctgggttgatattagattatcaaggtgaatattttatcgtcaacataaacgatcaattatacaaatttcctaatattttgttcataatgcccactcctgcaagctcgttcgttccctgtctccagactaaaaattgcgccaacccaaacgccatttatactttctatgattttaagaattcctagtcattaatatttctattgacatcattctaagaaagactaacgcttaagaagcatttaagtctcaaggcaaggtgatgatcaaatgaaccgacacgttttcgcagcaaccttttcttcgctgcgttcaaagaactttcgccgattttggacgggccaatgtatttccgttatgggaacctggattcagcgaacaacgcaaacttggcttgtctatcaaatgacaaaatccgcttttctagttggtttgctagcggcggcacagtttgttccgatcatggcgctgactttggtcgccggaacattgattgatcgctaccccaagcgacaaattcttttgtttacccaattcggctttttactgttgggtgctacgatgacgttgattacctatttgaagatcgtccagtattggcagattctcgcgattgccttgggctatggcatccttcagagtttcgatacgccaacgcggcaatcatatgttattgaacttgtaggcaaaaaagatttaattaatggcatttcgctaaactcatccattttcaatttggctaaaattgccggtccgtcactggcaggtatcttaatggtgacgctgggcgtggcaccgtgttttctgattgatacgcttagttatgtggcgattattgccggtttgttaatgattcaccaagatcatcctattgccagtcatcgttcacgccacatcttattagatatccgggaaggcttaagttatatcttgcatcatgcagacgtgaaactcagtgctgaattgatgctggtcatctgtacattaaacttcaacaataacgtcatcatcccgatctatgccgaggaggttttgcaccgcggcgctcaaggttatgctagccttttgtctgctactggtgtcggttcactggtagcagcttttctcatgagttatcttgccagcttcggcctgcgccgggatctttatttggccgtagcagtcggcacggccttgattcagtcgtccatgctgttcattcatgtctactggcttgccatgctgctcatggttctcatcggcttttgtaacatggttttcctgaaccagtccaacgcctcgtttcaatttggcattcccaatcaactgcgcgggcggattatgagtgtttacgttttgctcaatcaaggatcaaccccgattggtagtctatacgccggcagtgtcatggatgctgctggcggtttatggggatttcctgcatgtggcgtgttagccctcatgttaacgatggtcatcttcggttttcaccagtctacgataaaaaagtgggtatcccggtaacaccaaaaaacgcaggtaagcacgttgaaaagaccttgtgcttgcctgcgttttcgcttaattgttgaactaaccttcgcgtacctgtccgttacccagcacctgatacttaatcgtcgtcaacgccgctaaccccatcggtccgcgtgcgtgtaatttttgcgtactaataccgatctctgcgccgaaaccgaactcgaagccgtctgtaaaccgagttgaggcattcacatagacaacagccgcatctacctgttggaggaattgctgactattttggtagttatccgtaatgatggcctcgctgtgcttcgtgttgtgtgcgttgatatgcgcaatcgcttcttcctcggaatccaccaccttgaccgccataattaagtcattgtattcggtatcccagtcttcttccgtggcgacctgcatgttcggcacaatcgcccgcgcccgttcatcaccgcgcaattcgacaccatgcgcttgcagtgccgcagcaattaaaggcagttgcgcgtttgcaacatcagcgtggattaaaagtttctcggccgcattgcaaacagacggccgctgaactttggcgttgacaacaatgtcgattgccatctgggcttgcgcatacgcatcaacataaatgtgacaattgcccgccccggtttcaatgaccggtacggtagcctgttcaacgactgctttaattaacccccggccaccacgcggaatcagtacatcaatatagccattcaggtgcatcatctgattcgcgacttctcgcttcgggtccgtgattaattgaatcgcgtcttttggcaatccttgtgcggtcaatgcagcctgtaaaacagtcgccaaggccaaattgctgtgcagcgcctctttaccgccacggagaatgaccgcattgccacttttaaaagttaacgcagcagcatcaacggttacatttggccgggcctcataaatcatccccaccacccctaaaggcacccgtttttgcgcaatattcagtcctgcatgattcacccaggccttatccgtctgggcggttggatcgggtaaggcggcaacttggcgaacccctgctgccatgtcaacaattcgctcggcggtcagcaccagtcgatccgtgaacttagccggcaagcttgctgccgcttttagatcttcatgattagctgccaaaattgtttccgtatgcgtttcaagcgccgtagccatggccaacaacccggcatttttttgtgcggttgtcaactggctcaaaacagtcgccgcggcctttgctgctcggcccatttgttccagatcgatcgtggtgacatccatttttaatcgtcctccttgtaccctgacaggcgcaaccgttcatttattaaagactgttcgttcagcaacctctttaaacatcagttagtcgcatgaatttcagatggcacaggctcaagttctgccccgaaccatgtccccactgactcgcctgcaacgactcgcaaaataatgcgtgggtcacgaccactcgttaaaaccatgtgcttccctgctcgcatcatcacttgtgccgccttaagcttcgtcaccattcccccggttccaaaccgggttgaactgcctcctgcaccagccaaaactttagcagacacatgggtaatcgccgggatcaaggcggcgtttgcatggcgattagggtcacgatcgtaaagcccgtcaatatcggaaagcaccaccagtaagtctgctccgatttgcttcgcgaccaaggcggaaagttggtcattgtcgccaaaggtcgtgcgatgatccagttcatcaaccgcaacgctgtcattttcattaatgattggcatcacctgccgcttcagcaaagcatcgatggtatccaaaacatgctgccgagtttgcggataatcaaaaacgtcatgtgttaacaacaactgaccaattttagcgccataatcgctaaacctttgcgtatacaacgtcattaactctgattggccaatcgccgccaacgcctgctgctgagcaatttcggcaggccgcaccgtcacaccaagtttggccatccccaccccaatcgcaccagacgtgactaaaaccagctcatagccttgattcgtcaaagccgccaacgtatacgccagccgatctatggtctgcaaattaaccttgccattttgatgaatcaaactactcgtccctattttgacaactaaccgtttacaatgcagcatccgtttcaccatcgctacctccacttaccgccgattaccagaatattaaaaaagcaccgccttgatcgagacacccgttaaggcggtaccattctcgttcaaagccgtgctttgcgcttttttactatttaatttcgtcaatcttcagttcaagcttggattcgcgagccattcagaactttcagcaaacgtcctgatctctgtgagccgctactatgacttgatgaagtgattgtatgcggggtgtcgggaaaagtcaagcgggttattcggttctgataacatctatacagggtgtatttttaaacaagtctgcccattcatcagatgttggcaatgcgcggagaacaatggcatcatcaacaacttttacaaagagctctctcgtttcctcaaggttaagttgtctacgcattttaattggtatgacaagccgatgtttaattactgactcttaactttaagcagcgtgcttatgtttacgctttgctttgcgtgtgacgaacaaccattctccgaggaaggagccacagacaccgccaacgtaaatccaccacttaaaaggaatgttcgataacttggcaaggataaatcccacactcattgctcctgcaagagcggttgcgaagttacggtgttgtttcatgtcgcttcaacttctttcaatatttagtctttgttgaacccataatttgaatagatgtcattagtctttctactggttaaccaaatagctttccaaagaagctacaatgatgcctattccaagctgcctacgcggtgcttaccttgccacgtgaccaccaacaacagttcttgaacaattatcgttgcacgttttatagcagccggtatatcatcatcgcgtccccagacttcaagactgcatcaattgttagcctaaaaaagatacgcttctcgaatacggctttgctccgcgtttatcaattgttttataaaacgctatctaagcctttgttgatgcagattatacatgaatcgcattttgtgtcaaaaagcatgcacggaatttttgccaaatacagattacataacgtttgacatataacaaaaataagaacctggactcattcatcaaaacaaacagtgagaaaaatagaacgcccgtaaggaatcagaacgttttttcaatttctgatatatttagcaatctaaaatgcgttgagctgctttccctcgtatattccgctcaacaaataccttattgccgctccaccgccacccgtaaggcatagattcgcggcaaagttctgtttttacccacaggttgaccgttaacagtaacgtgtccctgattgacatgaactttaaccggcagcggcaatttgactgcgtatcgttctggcagacgcagccgttcactgtaaaaatgcccatttgtcagctttcccgtcacgccaacaacacccagatgatcggcttgagcaaggtaaacgcccttagttgtcaatggattattaataagccgccactgaccattttttagccgatattgtttccgtccccgaatgtcaaaacggtaaaaagcaaaagcgccgccagtaagtgggcgttggctgccatccggaaagacggccatttgttgaaataatgcaatggtcttttgtgccgcgtgtgtttgcattgtttgccgagctgaaagcgacatcgtttttggcttaacctgacctcttggcagtcccactactgctgtcatcgcaagactcgcaatcagaatcttcataatcagttgttttacccgcatccccatgcctccaaatattactttttaaatatcgtcacaataagtttatcatttcaactaagatgactgctaacaatacacatgttattaaaatggaaacaataagttgtttgcaagctctgccaacctgatacataccccctgctcgaaacacaaaaaagcccgccgtccacagacctatccctgcacaacggcgaactttcttactttctaacattctctttccagattacgcccgcggtcggcgaagatagcgccgagccagatagaaactcagcaatgccaatcccagcactccgacgacaaccgcgatacttaaccacaagcgccagcgatcagcagactcggcggcgtgctcaagtgattcggtataaggtacccgtttgccggtcactaacaggcggtgggagttgatcatatacggggtacaggtcattaatgtggccaaatcgcgtcccggttcaatgcgcaagctctgggtttcatccggccgcacggttttgatccgaaagacctgatacgccatctttttgccgttgacttggagaaagaacttctgccctcgtttcaacttgctcagatcggtgaaaaagcgtttggtgggcaagccgccgtgtgccgaaacaactgtatgcgtgttcttgcctccccgcggatagctagtacctggtaacaccactgccccttgatctaacagcgtgttgttggtggtgtcaaaaaggggcagatcaaccgctaatttcgggataaccactcgcccgatcagatgccgtttcacataggcttggttaaatttctgcctactttgaaacggatcctgtcccggacgcaaaccagtctgggcaagtgcacggttctccgctgcccgttgctcatcttgggcggcggcattttgcttggcttcttgctgtgctgctgctcggcgactggttagtagcaattcattaatagccgttgccgcgaacggatagcagaaacacgcggctcccgcagtaaaaagtaagatgacgaaccagcgtaacagccgacttgtccccgacgctttttttgtcataggccattagactttcttgctggtctttttcttcattaggtgaccgccacccattaagatggccccgatcatcaggaaggcgaagagtccgattccgcctgtcatcggcaataattgattcaccggcgtgttggcgatgcgaatcgttttcgtaccccaagtaccggcaatgacttcaaaatctgttgtcggatcaaggatttcatagccttctggtgccgcggtttcaaccaaggtatatcgccctggcaacagcccttgaatggttaagttggctgtctcggctccactggttttgagtctcgttgccgcgtcttgattcgttgtccaggtaatcttggtcggttggtaggttccggccataccgttaacgccttcaagaactgcatattcgcgcacattgccgttcattcgctgtaagatgaaagtcgcgttggccaaacttttggaagatccggcttcgtgtttgaagaaccgaatcccgccagtctggatttccggaccattgacggtaatcttgctgtcaggatcaaagctcacttcagccgtgttaccgactttttggtctgggatcattttctcattgacgattccggtgtaggcaacggtcacgcgtttgccggcatattgggtcaacaggtttcgtaccgcatcgggatcggtcccgcctagaaagtccagttcaaacccgaatggatagttgtgtgtttgttgccaagctgcgtcattagaactcatgaaggccatttttccggttaatgcctttaaaatgtcctgaccgtcaaccgtgattgccgtcaatgccttaaaagtaaggccttccttggtcatataatccagcactttaaattggttgtacttaaaagtgtcttgactgtgatcagccagcgcgccaatatcatgcggaatctggaactgaacctgatacgtgagcacatcgccaaccgcgacatcatggagatcttttgttgccaccgcttgttcattgatttccgtcagatttttggtaacaagactgtctttaggataaagatgaatgttggtcagatccgatccatcgtcttgccgcactggcagactcacgatcatatctgctgctttttgatacggttgcggggtcacggcttcgtgaaatgcgtacacgctatgccggccattggttttggcggctaatcctttgaatgccgccaagccgtctgcatcagtcgtgacagttgctgcattaggatcctggagattcacatactgacccaggttttgcgatatcatgctcgcagcggttgtcttatcatgattttccagtaattggtaaaaggcgtccgtcacgttgaaaattttaaattgagcgccttgcaccggtttacgcccggtcagtccaaggtcgtggccggtattttgaatctgttcgtcactggtttgttcgattttgtgcagcgtgaaatccacagtcgttgtcgcggcatgtacgggtttgcccgcactaagcagtggtagaaggaagctcatgagcatcagcgctgccaagagactgtgcccgatctttttaaacgttacttgcatgcgtggtgcctcgctttcttatttttaatgaagaagtaagtggccagtagtagtaacagactccctaaaaggacaaagcgtaaattgcgccaatcggacatggccggcaaataaccggattgacgcttaggtgtacgcgttccggtgccgttcgtatcctgcccgtgattgccaagctgggtcgttgatggccccgcggtttgatcaccggttgtcgacgcctgcttatcggcatagttataaactcgcgggtagccgctactgatcatttccggtgtcaccaccccgccaaagttttcctgcatcggctggccgtcaattaacacaaagcgccggttgccatcttcgtcttcccaagaatcaggaatctcgattttgatcgcgcggcttttagcatccacttcatagccgggaacgccttgcaattcttcaaagaaatattctccggcgggcaaaaagcgttcacctgtattaactagcccatcttgatcggaaacaaatttgttcacgcggtcatcatgcaacggatcagtagtgctcacccatttgttgcgcaagtcggttactggcgacatatcgagataaagcttcttaccattctcaattcggtaaatagcaaagatcgcaccggctaaccgtttactcgtaccatcagggtgcacgccgaacttgaagaaatacggatcgcggacataaccgacatttttcggatacagatggatggtctgtaacgggttgccactgataggatccgtgactggaaaaacaactaacatcggcgaacttttgcgctctaagtccacattgagttcggttgaaggatccggtgccacctcgatcatcagataagctttagtcggtgcctgttgatcgacagaaacggttattcggctgatcccatcttcaccgagtgttggatcgttttttgtattcatcagcccgatacctttgttcccttgaccggctaatttcaggttggcccgcgcaaatttcagtgcttgcttacgcgtcatattctgataacgatcaactaaagcccgaattgcttcaggcgtcatattcggtttcaataaggagctggcatcatagacctcaaagttagcaccattcagcccgctggttttgcttaataatttgtagccatctttatccgggttattcgggtcaatccgatgaccgtcattttcataccaaacgtcttccggttggcgaatatcccgataaattcgcttatggatcacaatctcggcagtttgatcagccgcgtgaacccaatgtggtgtgttgccaagcacgataccaatcaatagaagcaacgggacaagccaccaataaaatcgtcgcatcttaacgggcctcctttcgcttcagatacaggtaaagcagccagccgccgccacacgcactgattgcgaccatgagaaacagcaagataccgctaccaccagttttcggtaggagtgtttccaacgaatggttcgtcagtgtgaagcgaatccgattcaacttatcctctgcatcagggataaattcaaacccatactcatcactgcttaaatcgctgccactatacgcaagatctaccattgtgccatgcgcgttaatcttgaaggtaaacgatccgttcagccgatcaaatccggcaggcgctttggtttccgttaagcgataagttcccggggtcaactgatgtgtgaatcgcaactggccattttcatcagtcgttccttgagcaacaggggtggtttgatcgccacggtataaggcaaaacttgcattggcgagtttgtttttacctttttcaattttgatcaactcaagttcggtgggtttcagttggttgatcaccgtggtgtctggccaaatctcgccgttgcggccgactgtcacagtaccgtcagctgccacttttaaatcaaattcagcctgcaactcgtgaccggcagcggcaatttcgcttacctgatagtcgccgggttttagcgttccaaatgagactttaccctgcgaatcggcagttgctgtttgcagttgagtgtctccttgcttcaagacaaaccgactacccggcagcactgcgccatactggtttttcttggtaaattcagctggaaatctgcctgccggatcaagatgaacctgcactgcgttggtttccttactgtaacgttcctcagtgtcgaaaaatttaacggtcgctttattgaccagcgtaagtcgttttgtcagggtgtccggatcctttgttggccgcaccttcaatcgaagtgagaaaaagccgctatgaaaatgaattttctgcacatcttcacgtccgattgtcagcgtgattcgctgccgatcgccttcttgcgtcacgacaaaatccgacacgtcctcagtcagcgtcattttccgatcttggccaaccgcatccggatcagttgcattaaagagctggaacgctttttgataagtcgggggactgttgttattgtccggaatcaactcgacatgctccggtagcaggtccgtcacaacaattttggtcggcttcaccacgtaatcgcccatactgtatacttcctggttgatgtagtagtaaaatggctcgccgttgtaatgctgattgaccacctgatcgtctaaatcatttgcggtccagatggtgccggttttatcttcctcggctccgccaccggcttcggcatttgcgctcacgcttttgttgttggtgacatttgggtcaatcaactcgatttgtccactcccattggcaacccaagtaccgccgccgttggaataagtgccgcgtctaaaggtatgactggtaccgtttaaagtaaacgcaacggcaccacgcccaaatgttggcgcacctagtcgatcttcccattccgtcatattctcgtgatcaattggatcgacccagtttccccaggtctgtgaggtgtacccacgttgttccttcccgcgagcgcccagtttttcggtttcgaatgtcgctttatctgaggtaatccaggttccttcctcaaattgccaatccgtgataaaccgatcgtcataagtgggcgtcatccccgcctgctccgtccagacaaactcaccgggattcaacgaagtaaacgtcagggtcgaattttgattggcttcactttgcggaataaagttcaatcgctgtctcgttgccttgtcataaaaaatcacgcgccagtcatagtacaaaacattggcaaatgacatcccggaaaagaagttgttggaaaaatcaatgccgacatcctgaggggtagtgccccattcgactggacggacgcgaatacctgttagttcaacataagcaccaatctcaaaacggtttccatcaagatcacttgctgagccaacatgatcaatatccactttgatcttggcatctagcaggttagaaggaccactgggattttgaaccgcatctttaaaaataatggcggtggcatcagaacgcgacacataatctgatgaaacgccattctccatcgcccaacgtgatccgtattttgaacgggtactactatttggtttgcgataaatttgcgcctcttcatccgaaagtgcggcgccatcagctttagttgcgtgaattttaatcgtcccaagtgcagacggcggtaaaatcagactgtgcgcatctttgctgagtgcagccggttcctgcacatcatcgttagccaggcgcgcaggcagctgcaagtcaacatcaagcgctaatacctgagcagcgtcattaaatccatccagactgagtttcacactagctgcttgctgctttgtatcaggcagctttttggttaaaaggtattcacctttttctgccgttttctctgcaagccggcgcgttatttcaccgttagtatgtgcaggctgggacgtgaatccttgggcattagcgaacttgacgacttgctgccccgtttgatcctgtggcttggctaaaatcaacttaacctgaatttcagaccgctgaatgtcaacgttgtaagttaacgtatgaccatcgccgtgccaagacttccctgcttctagcttgatgtgctgccgagcttttgaagtagtttgcttggcggccgcgctggttgatggcgcactagccgctgcttccagatcaaactcagcagcttcggatgcggcaggacgagtgctcggctgcactgacgcatcccggacatcgtgctttggattagtctgagcgcttttggctaccgggaccgcggcactgccaatttgcgtgaccagcatcagcagtaacatcagcatatgaatccatttcctaggcaatcgggtgcctcctttcatgttacatttttcacttgttgctgaattaagcgtaacaagatgaactgcgtaaacggaactataataattgttattttataaataaagttttcttcggtatattacttcttaaattataattagcagcgaatatatgaatgatcattccagtatttataagttttaggatttggcgcacaaaaaatcccgacctgactaagctggaaacgctcagacggatcgggaacaacctacgttattaaattatattttgctactaagcgcggacaattttacccacggcaattggcagtgtgacgtgtgcatcatagttcatgacggttcctttaaccgtatctggaagttccaaactgtccggaacaccatgaatgtaaacaacccgtttatctaattgcaaatcttcactaccaaatgctgccttgaacgccttctgcagctcttttaaatccacgagcttgtcataagcatagtgcccgtcagcatcggctactggatagctgtcattgggtacgtgcattttagcaggctcggcatcaaacgggaccatcgttgtaccggaaaccggttccgtttcaggtaaatcaacaaagccgtcaccattagcatcttgggccgcggtggctatctcagctggcttgccatccggaaaaccatggaagtgttcccaatgctggacgtttgcaggtgtatcaaacatctcaatatgaatacgcaactgcgccccgtcaacagtgaactcggcagtaccatgggccttagtaccgatcttctctgcattcaatggcacaatttctgctgtatacttttcagccatgtcaaccactcctgttttaagatttgaaccacctttagaataacgtaaagtctttaattgctcaattagtttaataattatttttatagccttttctacgttctcctagcgatggcgtcaacggtttcattcagtatttaagcagttacatatctctccgaagcgactttattctcttcctaaatcatgcgcttgaagtagtcgctgccgtaacgccggatctgcagcatataaatacaagccatacttagcccgtttcagcaaaatattaatagcattcatgacaatcgcaattttagcggcttgcgtatccgctaaatcagggcgttttttgaatgcttctttgtcctgatattgactcaggttgaccgtcagacgatccttctctgcatcgtagccaagactcggccctaaaataactccggcatagttcaaatcgaacccttgaatcgtgtaaatcgagccaacttcatgtaaggtttccggtcgttgtgcccatggccgatcggtaaaattaattttatcccacggcaaccgcaatgaaccagccgtgacataccaggtcttcttatccagaaccgtaaacggataatcagctgttgcaatcaatcgtgacaggccaacttccgcatcgcgttgctggattaggcgatacatcggctgaccatcggcaaaaacccgaaaatcaaacttcttcggatgtggcagcggggtgatacgcccgcgaacaaactgatcaatccaattattgaccgcagcatcccccacccgcatttgttcagtcagttgaaaatgcgccactggatagccgctggtggttcgcttcagcaaaggcggcgtccaaaagcttttaagtttaactagttgatgaaaatcaaacaccagcacaaccaatcgcgccaattgtaaaatgtcagtcaattgattagtatcccgaaaattgttatacgggtctggcgctgtcagcaacaaatgtccttcgtcaataaaaacaacatcggcgcgcttgccggcttttcgataggcattaataaagggtgtcggcttcataaagtcctttttgcgaaaataggacttggcttcggctatttctttgtaaatcttcaacatttcattatggttcacgagcagtttattatcagtgcctgccagcggtccgacttctgcacgcgcggcttgttgcagttgcgcaaaggccgcgtccaacaccacgcttttcccggaaccggcatcacctgaaacgatgagcaaatgcgttttgtcggcttgataattagccatgataaaattatgaattttttgcttcaatgctgcttgtgcggtggtcaatgtcgcgtcttgcggcaaaatgaatgttgactgagctagatctggcatgtcgacacctccgtcatcaatatagcatgatcaaagctagtgaccatacgcagcttagttagttaactataacaactttaaaaataaccttaaaaaaactaaagtcaatgcaaattacatacgttattcacgtaaaccggttacacttaggatagtgactaaaaatgttattcaagaactaggagtatcgtcatgccttcaattgctgattacccgcaacgcctcaatttagcgccttttcaacagacacgattaactgagttggatgccggtctttttgcacagcttggttatttgaattttaactacctcatcggccaaccttacgcgcgttttgctgatctgaatgatagcaggcgtctgaataaggccactttaacgacttgggcaattccgacgcatcaagcaatgttacaagcgatgcggcaaagtgcacggtttgcgcgggtgacttggaccaattggcttgagacctgcagtcaccgtaatgaagaagactttggtgccatcaccttcaccttggcaccacatgtttactgcgtgagttttcgcgggaccaccaacaagttagtcggctggaaggaagatcttaacatgagcttcatgcccactatccctgcccagcgccgtgctctgagctacttgacccggcaaattagccgccatctcggtacctattatttgacgggacattctaaaggcggcagtctcgccatttacgcttttgacaacttgccgcaaccgcttgctgatcaagtcgcgcatgtgtacagcttcgatgggccaagtggcgtcccactcgatcccaaccaccgtgatcgcgtcaccaagctcgttccgcaaagttcactcattggggtcagtctcgatccggcaactaactttgaagtggttaaaagtcacgtcaaacttttcggccagcatgacgtcctcacctggaatatcgctgaccatactttcgcccggctgccaacgaccacttggatatcgcgctattttcagaaaacttttgcgctatggttggcgggtttggacaccaaagcgaccgccatcaccgttgacgccttatacaccatgcttcgaagcggcaacgccatcaccttagacgatttagccaaaaccaaaaaccactggcgccactatctacatgcctttcatgaattagacaagcatcatcgccagcagctaggcaaatcgttccgctgtttgctcggcgcaatggcaggatcgttggtaaaaacgcattaaaatttccatgtcaacttgggcctgttagcaataaacttcaaaatgtctcttttaactcgaagcgagaacggcaaaaacctgccgaactcacttcgagttttttgcactactgtgacaaaaagttcaaactaacctacatgccgtcagttcgcggcccacaaaaagacaaactagcatccgcccagaaccccgtcatatctacaactctacgaatcttagagtctccctaagcaaaaaatccttgtacctttttagatctgctttaacaatgagaacaggtggtgaagagaaaatgcaatttagtgacaaactgaaacaggctcgccagcaacatcatttaacccagatgcaggttggtacgcaattacatgtttcagccaaaaccatttccagctgggagaatgggcgtagttttcctgatattagcaccttggttagtatcagtgatttatatcaaattccgttggatcaattacttagggaggatcaagatatcgtgcaacattatgagaccatcagcaaacaagctcagcgttaccaaaagtatttccaaattacatactttttgaatatcttactgattttggccatctgggcagtacagatcacttcgagcaattctaaacatatactcgcgtggctatttttggcactactggttaatttagtggtaatggccacccactatcctgattaccatacttggatcaacggtaccgcacaccggctgctgttgatcctgttagcggttggattaagcgcggttttactcgtcttgagtttcaatggcgcagcgtcactaaacgacgccaaaacagcctctgaccaaactgcttatttaatcggcttttatacagggctgctcacaaaaccgctaattgaggcgtcaagcattatcttttccatctttggttttgccgaactaaaagaacagccgtaagctcttttttctcatcttcccgctaagtcagccatttgcgctggcttttttaaaatctgataacttgctttacaaggtacaggctgctgggtatactatgcttaacaaggtatcaaaaggaggccagtgcatgcaaccttcatcccaaatgctcaagggcatcctcgaaggcgccattttacggatcattcagcaaggtgacatttacggctacggcttgcatgaaaagttgggcacattgggctttggcaatatcccggaaggcaccatctacccgttattgcttaaactacaaaaaaacaagctcatcgttggcgttcgccgtcctaccggcaatggtcccgatcgcaaatattatcacctcactgatgccggtcaagacgccttggctgactttcagcaacagtggcaacaacttgcccaagcaatggcacagcttaaccaaggaggcaccgaatcatgaaaaaactaaatcggctgcgaacggcaaacgatcagctgctgaaaaatattcacggcactgattacacctacacggaaacggttatccaatatttacgcggtgctttgttcaaggatccatacgccattgaacacgccattagtgacttacttgcaaccctaatcgatgcacaacaggccggcaatcgcgttgccagcttcttcagtgacgatccccaaacagcagcggataacatcttagccgagttgccacgcgtctcttggtggtacttgtttgatcaatactggccgatcctcatgttccttttttcctccagtatttttacgatgttagtcagtcaagacaaccagttatctttaagtaataccattgcgccgcttactgttgtcttcgcctttttagggttgccatttgcacgcggcgtctcatttaataagctctcggccaaaacaatctttggtctgctgctggttgtcacccttcttgttatcgtccctttaatactgggttacttaaccgtcagccattctgaatttgccttttcgcatacgacccttaccatcatttgcggcagttgtgccgtgctcaacttggcggtggctttgggttttcggcaaatcgctaaactattcttaggctggtcaacgatttggctactggcacttgccggactacttttgccaatttcagcattcacggtcggcattgccatcgccggcgttgtcctcacagcactcttattgttctatcatcccgaaccccgctccggattaatcgcctaaggccgcgattgatcacaaatcatacacaggagaagcattcgccatgaaaaagttaatgaaactgcgcgccgctaatgatcaactgcttaagcaaatccacggtctcgatcataactacacggaaacggttgttcaatatttacgcggtgctttgtccaaagacccttacgcagttgaacatgccatcagcgatctgctgacaacgctcattgatgcctaccaagctggtcatcgcgtttctagtttcttcagcgacgatccccaaactgctgcagataacattttaaaagaactaccacgcgcttcgataagttatcatttcgccattttctggccgttgatcatgttcctgttgattgaaagtatttttctcatgtttatcagccaagatcgtcagcttacggccggcaacattgcgttagccggcgcgaatgtctttattatgattcctatttcttacgggcgtggcatcttctttaacaagataacacgcaaaaccgttttaacttgggtcgcagccttgttcgtcatcttctttgcgcctgcgctaatcgattatttttcacacggtctgctagacttggctatctctcgtccatcacttctgggattcagcctcgtcttaggtgccttcaatctagggatggcgctgtggtttcggtatgctgcccttgtgtatctagcatggaccggcatctggctgatagccgcactcggactttccctccccgtctctcagataacggtcatccttggcatcatcggattcgtgggtgccgttgcatcgtcggtttttcgtttcgagccacctgaagtatgacgccaaagatgacgctgctgtgttgctttatttaaacagctgaccaaagaatgttgcttccccaaaataacgatcgccggttgccccaatcgttgtaaacaattggcttaacgcggcaggtgactgtaagtgattgagtaacacataccgggaaatggtccgtctgagtttgagggccaccatttgataaggcgtatcacggtttaagtctttggccgcctctaaaagctgttgccgaatttctggatgctccgccatttccggatcgttataagcgacatcactcgcctgaaataattgttgcgttttcttactcatctcttcacctcgtccatcttgctactagctggtatatactcaactcagtcattattatcaacgtagaaagtaactaacacgagtcgttcgaacactgacacgctttttgtgctgtgctagactattcatgcagtataccgatcttgtgctcaccctaatatccatgaaccgggagccaaagatcaattttccgtttgcagcttatcatgtcacttatgaaaggatctttcaattgaaatatcgtttattaggcaaaaccggctacaaagtcagtgaagtttcgcttggcacctggcaactaggcggcaagtggggtgcgccattcgatgcaaaagtcgcccgcgaaactttggacgaagcttacgatcgtggcgttaacttctttgataccgctgatggctatcaaggcggtgaaagcgaaaagatggtaggggcattcgttaaagaacatcccgaagtgcatttcaccactaagattggccgtaaagaagaaccgctgaccgccgagcattttgatccggatcatattcgccgctatgttgacaaatcgcgccaaaacatgggcttagacagtctcgatgttgtcttgttgcactgcccgcccatgcaagtctattatcagcctgaaactttctttacactggatgccttgcaaaaagccggtaagattcgacattatggcgtcagcatcgaacgggccgaagaaggcattaaagcgctcgactatgacactgcggttgttgaagtcatcttcaatatgttccgcctgcgcccggccgacaccttcttcccgctggctaaacaacacaatgtcggcattctcgcgcgggtacccttggcaagcggcctcctgaccggaaagttcgatgaaaagacccaatttgcccccacagatcagcgcgccaacaaccgccatggtgagcacttcagcaaaggcgaaactttctccggcgttgactatttaaccggcgtcaaagcagcccgcgaactaaaggagcggttaggatctgacaatctggccgcaacggcactgcggtttattctaatgtacgatgctgtttcagcggtcattcccggcgccagcaacccgacccagatcgaacgtaacaccgacgcagccgaaatgcctgccttaacccctgaccagatggcagtcgttaaagatgtttacgagcgcatgatcaagaatccggttggttacgagtggtagtcaactaatgatcggtgagcggttgtcaaatgaacctcctcaccgatttatctaagtgtaagctgactgtacaagccatctgagtgtgatgacgatcacgcttgccaagttggtttgatgcttgcgctaactcgttgctgccggcagctttcttctgcaacagcgctgttgtgctacataacaacttaacgagttcaccgaaaagcacccacacttccaattgacgattcaagtcataaccatcacaaaaccccactccgatttgaagtggggttatttgtgttgctaaaaagttatactgatcaatcgctttgccgccagcgagaatccataatcaagcgagcggtaaacaagcccaacggtaaaaacataatgataagtgcggcacgcgtcatccattcggcaccgacgccaatattattcaatccaatattgtaaactgcccgatagatatacaagccaggtaccatgatgacgattgatggcactgttagcgaaatccgcggatagccatcaacgcgattaatcgccgatgcaatcagcccagccaccagtgcgccgataaatgccgccgcagcagggggaatcgtgttgagatccaccaactcaagccgtaacgtattcgccactgctccaatcaacccggcctgaattgccattcggcggggactgttaaacatcaccgagaatccgaagaccccacaaaagctggcaatgaggcgataaaccaaaagaaggaccggactcaagcctaagtcgacaaagttttccgggcgtaaatggacaaccatcgcgaccagccaaccaaccagcgaagccacaatggtaatcatcaacgcatacagtagtcgttccattcccgagcgcatatcctgcttcgaaatatccagcatactggtgataaacgggaagcccggaatcacaaacaacatggcgccgatataccccgcttcatgccgcgctgcaattcccagtcccatttccagtccgcgaaaagcgataaaataaaccaaacaggcaaccgccacactgacaccgatacaagccagcaacgtccagttacgtcgaatcatgatttcacgcagccaattaccgatccctgcaccaacaaaacaacagatcatttcgataggaccgccgcctaacaaaaagacgaaagcgcaacacgccaaagcagctgctaatccggcgcgcaacggatcgtaattgccagacattttttgaatttgatcaagtcgatggtgaatatcccgaacggtttgagtcgcatactctttgtcaaaatgacgcacaaaacgttccaacgcatccaacttgtcagtattcacaccactttttggcagtgaaagcacctcagaataggcatggttattgctaaagcaggtatacgataaggaaattaggccaatatctgctgagcacgacatccgcaatgctcgagcaaccgtgttcatcgcctcacgcacgcgccatgccccggtgccacacgccagcaacatgatcccgactcggccgacgagtgacgcgcgctcttcaagggtggcatgatccgcttgccgctcttcgctgacaatcacgtcataccacggaatttgcatatgatgtttttctgaaagcggttggtctccccgatccgcttggttatcttttgccttcataactcgtgctaatccttcttatagggattgtctttttcaaaaaaattgaaaataaacattcactattctagcacaattcataacagggtgtatttttgactttttgaaactaacggatttgaccgcgttattcatgacaagcacgcacaaactagcaatcatttctcggtctcaacttattgcatatgatgttggaatcgctgcgccagaaaatgccggattcgcaaaaagcgacgaggatcttccttcttctgtccattggcaatccgtcgtagttcgtcaattgcatcgcgtccttcttgactcaaccgtacactttcagtcgtgagtataaaatcaattcttagtatcatccgaaaaacatgccgtcgtaattcatagccatggaaaccatcgcggataatctcttccttggttctttccacaacttcttcaatattcgtttggcggatgagctgcggttgttcatgtaattcatgcaacaggcagtcgatatagccttttgtttctaattcttcctcgtaatccatacgccgatcaccgcctttcatttgattaacttgatccgtatcgttttttatggtcattttcttaaagaatgggcatcgcattttcgctactaaacggcaaaagtggtaaataccgatttatcgatggttaaacatcttatctgcaaagtaatcccaataagtctttgtgccagtgataacagatgcttggccggctaatccataataaagcgactgccgctgtgatttagataatttcacccgcgccttgaccgtaaagaagttaccaactttcggatcgcgtgtcggggcaacgtcaatcgcataaacccggccatctaatatggtaggggtcggcacattctcagcaattcgcaggcgcactttctgcccacgcttgatgctcatgatctctgtcggcaaaacgcctaattttatgtcagcggccgtttgttccgttaaatccggcagaattcgtgccaacacgcttcctgaagggacatattgattccccgctaaagcagtttctaaatgcaaaaccccactggcacttgctttgacatgatagttttgagtttcatcattcagggtggctaacttagcctcgtctgcttggatctgctgctgaaccttcgtctgttccgcaacggctgtttgctgcaaccgactttgtaatgcggttagattagcctgagtctctcccgctttttgagccgatacatctgcttgtttttggccagcccgctgctgctctaaagacgtcaaattggtttgttcctcatccaactgtgtctgtaactgagcgaggtactggcgtttaaggttcgcctgtgcctccgcgtcggtattttttatctcactttcatattgttgataaaaatagtgataggcgtggcgactgggcaagggtttgttcgcctgaatcgccgcttttgccccggagatagcggccattttcgcttggctcgtttggatactggcgcttagtaaccgatcaatctctttgtttttttcactagcgacggtttgggttgcctgctcagcctctgctgtcagagtcagcactcggcgttggctcagataatcttgcacctgttgttgatagccgaatcggtctgcctttgaaaaaagatctttgttttcggtaacactttgtttcaaaacatccaattgctgctgttgctcttttagcgttgccagttgctgcttgagtaatttaatttgtgttggattggcgacatcgtggtaaacaagtaaggtctcgcctttcttcacgcgcttgccttctttcatgcggttcgagacgatccgattggcggccgtcgcctgaactgtcacggctgcctttaccggttcaatttcggcagctgtcagcacagttacctcgcgccgagcaaagatcagaaacaatagcaagcctaagaaaagaatcgtactaggcataataatcattgttgaaaaattgcgaaagcggtgctggtaatattcggtcgttgcaagttttttgggatccatcatctaaagctcacctcactcatgaaccaggcgcgcgtaataaccgtcttgggctaacaacgttgcatggtcaccttgttccacaattttgccatgatccatcaccacaatttgttcggttttagccgcaatagttaagcgatgggcaacaaaaataatggtccgatccgtcattgccagcaagcgatcgacaatttttcgctctgtaatggtatccagactgctagtcgattcgtcaaaaatcagtacttttgccggcgataacaaggcccgtgcaatcgccagccgctgcttctgaccgcctgataaaatgctgccgctttctgacaatttggtctgccactgctgcggtaagtttgcgatgtctgcggcaatttccgcagccaaacacgcctgcgtcaagtcttgttccgaaacatccgaacggctacctaacgtcaaattctccaacaccgtgcccgaaaaaataaatggatcctgaggtacatattcaatatattgccgtaatgttgtgagattaatgtctttgaccggaatgccattaaacgtgatggttcccttatcggtatcaactgggtaaaagccaactaataattttgctaatgtcgacttaccagaaccactcatgccaacaatggtatatttagcattttccggcacttcaaggttgatgtttttcaacacatcttggccaaaaccatatttaaacgaaacatcccgaacacgtaacggaccttcgattaaatgccgctccgtcaagtgccgcggttctttgaattccgattcaaccagataaacctcattcaaacgattgttagcaacccgcgccatttgtaactttggctgtaggttgatgatgctttcaagcggattcgtaaagtatgacagcagcgcattaaaggtcagcatctgccccaaactcattcgattggcaatcaccaaacttgccccaatccacaacaccacaacgttcaacgccagcttcaacaggcctttaatcgcttgctgtaactgatctgccttggtgtaactaaacgacctcttcaaataggttagaaattcccgatcaacccgttcatagctaactcgttcgccggtcaaggacttgatggtttcaatgccattcaaatcttcaataatcgatgaactcaagattgcattactttccatcgtctcttgattcaaccgatcaaacggccgctgaaatgcaaaaacaatcaccaagtaacacggcacggcaatcaatgacactaaaaacaaagtcccattttggatccctagaacaatgcctaatattaggacaatccagacatccaaaaacaacgtcataatcgtattcgccagcgcatcaataattttattggcatccgcaaaccgcgacacaatctctccggtccgccgagttgaaaaaaacgacatcggcaattcatataaatggcgcacataccctaaaatgacatcaatcgcaagccgctgccccaacaccgccatcaaaaaattctggccataagtcaacacagcttgcagcaagtaagccaccaaaaggccactagcaatcatccccatcgtcgtccgcatggcattcggtatatacgtatcaataatagactgcaaaaaatacgacccaacgatactaatgaccgtaatcaataccgcggccagaataatgttcgcgataatacctttttgcttagccagcatgggtacaaacgcaaacaaactgcctttgtcctccttacgcggctgatactgcggcgccggtgcaataaagatggccacacccgaccattctttttcaaacacctctcgcgaaagccaggtcatgcgcactgacgggtcaggatcgccaatcagaatactcgtgcgcgttgctttaaaaacaacatagtaatgaagcaattcaccgcgcttcagcacatgggcaataaacggataaggcacatcctcaagatcaaacaactgcatattcgcctgcaccggtttcgtctcaaacgctagtgcttcagcggcccgaacaattcccaaagccgtcgtgccatcctgatttgtcttcgctaactcgcgcaagtgggctaacgaatagtccgacccattgtatttaagcagcatgtttaacgcagccacaccacagtcacgctcgtcaacttgtgcggtgtagaagcgtttgtagtaggtgatctggcctagtttgggggtgtgtttaaacatgtaattatctccactttaaaaattgaattgccaattgacatcagcctctccagaacaaaaaataagtaaaagcactatattgactaggtaaattgtgctatcatgcattttatcgagggccatagcagttatattaatataaaaattataaatatatgcaaatttaataatttttatattgtgtagctcgcaatacgagattatttgtaacctcttttacgagtgctcttctcccacacgtaagaaaactagccaaagatactcgttagccagttcttaaacttgttaaacgtaaaaccttcatctcggagcattccgccaacaaaacttgaaagttcaagatctgtcatcattggcatttcctcatctttaaattttttcattacctttttctcccttcgttttgtctttcgttcaaagtgatcgtaccagatctttaaaaattttggttaggcaaaaaataaacgtagctttttcgccatttaacgcagattttcgagcaccttggcaatttttaggaagttaaccgcctacaaacagaaaggtaaagattatagcatgattatttctacagacttgtattacttcttgtttcacttaccgatctttttgattgatcttactttcctttcgtatatttactttaacgacttcaaactcaggcatattttcttatggtcactcgccgcaggaacgctctccacatttctttcatcagttggtgaaataacatttggtattttatatgcaacaaatatttcaaaaaaatatcagcgttttgatatcttctgggttttcttatttctagaacttaacttaattgttattaaccttcaattactagtcactaaaatcgtatttctgtttctatctgtccaatcatccactatctcaaatagcatcaagctgatcattgatgtcatatttgcagttgtcatgtctcaggtgttaatgaaaaagaagctattcattaattctatccgtgaacaaatccaaaaaaaaatagctatttggagaccggcagttatttatttaatagtgacctgcgtttcgctttactgtttagagtttgctttttcatttcttgaaatcaccaatatcctaacacttcttattttgttaaccttaattctttttatggttatcaacgtattctcgttattcttcatcgtaaaatcatatcagtattctttggagttgttagttatcaagcacgcggaagcttcaaaacgcgcgtactattcagcccttgagcagcaacgtatcaataccagtaggattcttcatgattacaaaaacttacttgcaacgttacagcttagcttgcagaaatcatcaccacaccactcatcagacgttcgaacgattgtcactcaagcacaggatgcacttcaaaaagctgagataggcaaagatgccttagctttgatcgaaagtgatccgctcaggagtttgctgtatctcaaatggtccgaatctgcaaaccgtggcataacaatgtacatgcataccaaagatacagtccgatccctggaaagtgatgtcggatttgcaattatcagaatcttgggcattttaattgataatgctattgacgaaactgccacacttaaacttaagtctttcagagttctcttattacccgcccgcgatcacttagaaattgttgttgcaaacccgattcctgacggctttgatttaactcgacttaaccaaaaaggatttacaacaaagggctcaggccacgggcaaggcatgtccattatcaatgacctaatccaacaaaatcccaatatcagcatgcgtaaagcaattatcaacaatgatcaattaaagatcactctatttataggaggaaaagcccatgcctaaaaacaaaacaatcctaaacatttacattctcgaagacaaccctgactatctaacctttatccaagaaactgtgcagcagtaccttctgattgaagaactacccgccaagatccggctggcaacaacgtcagcaactgaactgcttgcagctgtcgattggtcagccatcaatgatagtatcttcctccttgatatcgagctgggagattcagcgacaagcggcgtagatgtagccacagccattcggagaaagtcatattatgtcgatatcctcttcatcaccagccatgtagatgaagctttaaggattttagagcacaaaatcgcaccgttggacatgatcaacaagaactcaccttcgaagacagaaaagaaaattcgaaataacattctttatgcaataaaacgtttaaaggcgcgtcaggtcgcatctcccagattgtttaactacagcatcaactccagcattttttcacttgaaatggatgaggtcatctatattcaaactgctcccggcgtctcaggaacactggagcttcatgcagaaaatgaaatcacaacctttcccggcaaccttaaggaactagcgaccaaatataccaacttatgtcgatgccataagagtatcctgattaatcccgcacatgttttgcgtctggacatcacaaaccgattcgtttatatggacaatcaagataaacttgaggtcagtattcggagaatgggcgagttgcgccaggctcttacagcaagctctgaagcacctacaagtagtgactgaaaatgccattgtttttcccgtgtgcaaagttggctaatccagcctctagttttagattaagtgacaacttttaactttgccaaggcagccatctaatactgttattagcacttagcactataagtatcgccactttcggccatcaaaatgttagtcaagtgccaagtactctggtgtgtactatcctgaaaccaagaaacctctgaaactaatgtggtgagctcacttaccacactggtttcagaggtttaattcttggcaatagggtacctttccgaacattccggaaaaattgatcaacaacattaatacaatccttagtccctgacaagcatgacttcattgattgactacatcattttcacctcaaccaaacaggactcgtctttcgatgacacttgagctatttaaagagttacactatagcatcaataaacgttgattttcaccaataaacgttgatttttaaattgcattgacgttttttgccaaaatagcgacgttaaaaaataattgaactaaaattctttccgctaagctatagtagagccaagcggtgatcacctacaaaataataggaggtgctaagttaaagtctgcagcagatcatcttcgaagttcggatcatctaatagaaaagcttcgttatctgccgtaataactcaggggcttttaagaaggcacatgttaataaattatcttttaagcttcaaatgagtggagattcagaaaaaacatcaaaggcagcgatattggcgatcttatcggatgtgttcttggaacagccgattctgctggacttggtttcctaggcagagttcgagccggtacagttacggttattggaactgtatccggtggcgcacttggagactggtctggtggagacgctggagccgctagcttttgcaagggagtgtgattcatctgcctctttctctagcttttctcttatggttagcaatgataaatgtctttaccacacgtaatgtttggctctggatcgtcaacctaataggtttgctaggattatgctttctggcaactaggctgtataagaagaacagttgagaaagacatttttcagacgacactaacattatttaagagttagggtctaaagagtgaaggttgaacatccgtagaagccccgagaatcggggcttttttgggatcaaggaagactcgtgagtccacgttttatgtaacctgagcttctaacagcgcctgcaaacaccaagatcccccctctatgcttgtcctatcaactatagcggggggatctttatatctcaaaccagccatgtactccccgttcagattgttatcagcaaagttgccaaaaagataagccatgttgcgtaataaagattcacagtgctactccttcatcagctctacttcaaccaacgtgctatcgactgacccgtttccagcgtcataaatcccctttaaaattcccggtgaaaagtaccaaaacgccattattaaaaccccaatggcgacaagcaacgacactttctgttggaatgataatcttgcaaattgatcgattacgctcacctcgtttacaaacagacttatttttacttctttcagcaatccattagtaacctgttctttatgttctcccaccttctaagaaaaaggcaatatactaatggccaactgcatcaattgggaacatttctcccaaaaagatgttcgcgcatgaagccgatgtcttaagaggtctatcatctgccagctgatcgcagttacaaatacgaatgtgaagaaaaatgccagaatcaaaagcatagaatataacacaactgtcataagcaaagctccttgagttttcttttaaacttacattgaagcggcaaattagcgagcacaggttcggagataccatacgttctgctaaggtcggtcatacaagcaagaaatcacaaaaatgacaccattttagctatttaatgctatttccgaaaggccttttgctgtcaggaagaagaaacaatcgttggttttgaaagctcatcttattagcatctgttctgccgtactcacgcgcaagatctcctgatttgtatttttgtttcaatacaaatcaggagacttttgcgtttttggctaatagaacataaggtaacaagattctgacactaaaagcagtttccaaatatcagtagagtcacctaaaatttcatttaccgtcatgaacagccgatattgcattattctggcctggcagatagctgtgtcacaatagttactgtctccttgagctgacaggcttcctactgacaatgacgctgccaccttaccaatacttcgaaatcaaacaaggaaaatttgttatttagagcgtttatggtctttaacctttgaagatgcgacacttattttggagaaaagaatcaaaacaatgaagattgaaagcatctcaatgaacgcccggacgatgaaaaaatcaaaacccaagcaatcgacaatcagcttgtttaagctatcactgagcgagaacccgccgaaaaagatacaaacgataatccagaaagaagcttcattaagccatgtgtgcatagttttaagaatcgtcatcgtacctccgctttgctcatcactaaatcatttatcgaccgatcagttttggctctgtctttttaagttagaccgttatattcgaaactagtttgcctaagtcgccgttataaattggacaaccttttaggcatcatccattgacaacaagcccataccaaccagcatcgcaatcggagtttgatctgcaccaaatgaatcagtgaacctaaccataatcaagcgcgctcaccgttttagtagtggcttctagtacccatatctgatattcgccagcgaagaaagctgctcgaatttatcagattgttgctcggttaacaaaatattgttttgcaacagggcattagagatttctagattcatgcggcttaaaataaatggaacagctgcttgcttgtgaattaaggcctctctattgttccttagcactgtccgtaagcgatcactatgggaagaactgtcatctaagtcgcgaagcaattcatcgataagctgtatcgcttgttcagcccgtgcattcccaccagaaaaccatttcaatttcttcatctttcactccaaaaaagttgcgctagtgcaccttcacttgtaacacgtttggcgccgtgcattgccagatctgccgtagcaatgacggtaagaacatactcgcctacagataaaggcttgttctgggcagagatacttttacaacggcgacaacgctaaaaatcaacgcaccgttattacgatcgttcccatccttgcttgaccccagctaccagctcatcagcatggttccacgcatctgttgccaggaatccaagaatagcagcgacagggattgcgagcggtccgataccgccggaaatcttactcaattcagcttcattcaacttagtcattaaaattacctccttgtatttgtaagaaactactcgccagttgatccaaaagtctttgttatggatattgtggcgaaaaaatgctcatctaccgcacaactttttgcaaatacaaccatggcgtcatcagcggcatgcctggattaaagccgcttgacctttaccatcgaaattcgactaatgggtttgtatggcagcattacagcgtacggcttaggcattgaaatgagcactcaaagtttaagcgtaggtaataaaccagatagcattcaaaatataagcacgtttaaaggctatctgatgctcactgtcgagatatttatcatcccaaacgcgatagtgaccatcttttttacagcacgtatataccaaaacacctaatagatataccaagataaacgtagctaacattaaaagatttatcttattcatacgttcgcccgttcgagtgcctattcatcccggatactaattgccgttaagtttgtcaacaatctctttggcaggcccaatggctggtgcaaacatggcgccttcagcccaagcacgcgcggttgaaccaatggccttcccgataaaggtccacagattaccattatcgccaccagaaatgcttgctaagtcagctgtgtttaaagtttttaaatgatccatgttcttcctccttttttctttatgagcctgtcaatgtattaatcagcctaagttattgcttaagtcgccaccttaattggatgaacaatcggcagtttatacttaaatgccgattcgtaagctggcggatggcgttcgtttggtgaatccacactgcaattaaataaaggaacattcccgccggtcgtcaattcaagcatttttcccgagatttccttcaaagctagtcctgttcgcatggtcatcccattttcctcctttccctttgttagaaggacttcccttcttccccatcaatataaagtagacagccaagtttgtgggaatagattttttaacgtcgctttttgcaagaaaaccgtcgtaaaaaaccgaattttgacgtttattgttgaaaagccgacgattatttggatattaccgttttctcttcaaaactcaagcaactgcaactgtatttacttttacccatgtctttttcgccactgtgagcatccagtcttaagccaacttagaaaggcgatcaggctcgcggccagcatgtgcatccattcgccggggaagtgatgacaaactgcacacatataaccgacagtaaatgttaataagcagcgccaaaatcttttttgattcacgctttcttctgcttttcctcccgctcactcaacagcattaataacgtcatcaaaatcagcattggcgtcacaaaactgccatgattggtccatccaattgccgatgtgaccgtataaatggcgaaaataatggtagcgattatcaacccataatcgactagtttagtcagtcgcgtaggcatcgtttttctccttaaactcgttctatcataattgatacagacagccgcgctacgaatgcgataaccgtgccagaaactcttcattgttttggccacggcgaaaaagtcgcagtgcaatcgctaggtaaatcccggcaataaggaatgcgtgaacaatcgtcatcgtcatagcgttgggatcactaggcgcttctttcggatacggtccactaaccaaagtgataacaaaatcaatcaaaaaatggatcaatattggcataagcaacgatccatagcgaatataaagtgctgcaaaaatagcccccatgccaaatgcctggatcacttgggcaattgttatcacaagcccttgagcaggcaaattactcaggtgagccaatgaaaaaacaagactgcttaaccctatgcaaaataagagttggtatttggcatggcgatgatgggcaacataaaacgcccgaatcaaaccgccaagcatgacgccacgaaacaaatactcttctggaacagcggcaatggtaccaatcacagctgcttgcaagacgtcaatcggtgttcgacttgtaaccgtgaaccaaccgataagcatcaagatcagtccccagatgacaaccggcttcaatcgtggccgcctaagtgtcactttcaagacgatagcttgtttcagcagcagccagttaagtgcgatcatcaccagtaaaatgatggctttaaataagatattcccagcccagaagtccaatttaagcatgtaaactgctggaattaaaagcagctcgctgattagcacaaccaaaagcaagatatataaaacgcaaaatcctggcgacaacagcaaatgacgttttctttccatttatccaccttcactcgcatgtttcaatgcaacgcagcttcgatatcgctatccacaatataccgaggctgcgcatgttacggatcattaacttttaaacgtcgggttttcgccgataatcgttgtattttgaaacttgacaacgcgttaatcgtccccatttccgaaaaggtttgccaatggaagcgcacttgctgactatttactgactgccccacagttgcacgatcctgaaaatgccgtaagcaaaatcgcctcatccaataccaacgcgccaacgttagtcttgaatgaggcgatgaaaagttagagttcgatatttacgcttctgcggcttcagccaaatcagcaatgctcgtctgctttagcacttgcaccatagcatcttcggcttggtttaaaacattggtgcttgccgctaaccagctcgtgacgcgctcgccgttgacaaacgcagctggatcgatttcctgatgaagcttaaataacggtgccgtcccttcaatagccgttaagatttcgtaaactgtaatcgtttgcggcgttttggctaatcgcaaaccgccattgagaccggttttcgacgttaaaataccactttttttaagtgtagacgaattttttttaatgctaggaaccggaatgtttagcatttcggaaatcttttgaattgataaatagtcttcgtgttgtgcttgggactttgcgttgacgtaggccgtgatttcaagtgcttgcgagaatgcgacagaaaaagccatcgaatatacctcctattagacgattgtgtatattctattataccaatgataccgttacttggcggctttttctgccggaataatgaacgtgacgacaagtatcaagccaacaatggtcatgccgacgccaatcaacattgcctgtccgaatacatccgcaatcttagttaagctgctagttgaagccgcaaagattgccagtcctaaagcgccgccaaattgtcgggcggtgttgtagacgcctgatgcagctcccgaaatttccggccgaattctagccaaacctgaagtagcgagtgtggcaaatgccagcgcgaatcctaccgcaaatccgagtgtcccaagtaacaaaaaccagtaattggcaaaccgtgatgccactgccagttcagccaatgaaagtagcaccgtgacaaatccgaagatcatgacccttgaattacgccaccgatcaacgaaggtccgggccttgactgccacaatgaagagtaagatggccattggcaccatgcctaatgcagtcataaatggcgttaatcctaagacgccttgcataaactgaggtgtgtagaaccaaaagccgattgcagcggcactaaacaacaaagaactgacataagaagccatccgttccctatccgtaaagatttccagtggcattgtcgggtgagcaacgcgaccttgactagcaatgaacgcaatccaaagaactgctgaaatcagtaatgtggggattggccacggactgccatccaacccatatgagattgaagtcatcgctaatactgacaagatcgtaccaatccagtcaatctttccggtttggcgttttgcactaggtaaatatctagccgcaataccaaccatgattaatgcgatcggaccattcatgtagaaaccgacccgccatgacgcaaacgttgcaaagaagccgccaatgactaaaccaaccgctgcaccggctccaatgacggaagcatagtagccgattgcccgctgtcgtgcttttccttgaaaggtgtctgttaacaaagccaaacagttcggtgcaagaatggccgcgcccacgccttgaacagcgcgaaagctaatcatgacaagcgcattggtagctgccccgactgccagactgccaactccgaaaatagctaaactcgcaatgaacaatggtttgcgtccgtaaatatcgcctaatttaccgcctactagcatcagcccagcataagttagcgcataggccacctgcacccaagacaacgcgccagcattcaaatgcaattgtgccgccattttaacggtacccgtgtaaacaatcgatgtgtcaagcacacctagaaaagccccaatcagtgccagacctaaaataatgacttgagtcgctgacatgcgctgcgattgggtgattgccgcatctgtttcctcaatgacggtgtcgtcagccaggccatcattgattaattccttgtcttcttctttgctcatatgagatgcccctttctatggttcacttagtatattccgtttatactaatatggcaaatcttttttgagcaaaaaaaaccacgtgttccttaattctgtggaaacacgcggctacaagcgaattcttttcgggccggttactggaatcagaccatggcttgggcaacaactgtctaaataataaagtgcggcccgcctacctgactcaactcgccatgaatgtcattttccataaaatcttttaccgcctgccaccactgattggcctccgctgaaagtttcattccttgcaagccgattaatcgcgtaaaccgtgcgtatagtcgcgacaaggcgtaatctgcggctcgattcttgagcacattaggccgctttaaaatagctaaggcctcatccacaacttcctgtgcttctgtctccatcagaccaccactagccgcttttttcagactcaggtttaacccagtcaaaataaacagaatctgatttcgttgcaccatattcatgagcgatcctccatgtctggtcgataagtatttgcgttgagatagcgttttcttgaattgctaactgcaatataccaaatctatcaagcttcagggcaaactttcgataaacgtagccttttcgccgattaacgttattggggacataaatcgcccggtccaaagcgcatagaaaaagccgtggtgcattaaccacgactaatcggaagcgcgtatttcagcatagtcgtaaaaaggctgaaatgacacagttcatcagcatcgaacaagctcatattccatccggctacttaatgtccgccaccccagacaattggaaaagcgactagcccagcagccagcgcctgatcgcgataacgcttggcattgacctgatctgccggcacatccgccttgatcgcattgaaaatggcgatcatctcggctggaatcgcgtgatgaatgagataatacttggaaatatcatgcgatagctgggtcacgactgcgacataggctgttttgtcctctgcatcttccagttgtttcgcgttggattcgattatttgctttaatttggcatcagctttcacggccggactactatatgctttactcaacatttcgaataacgcttgtttcttgtctgacatgacatttgcctcctaaaacgatagaccctgctaccattgtacagttgcatcaaggaatttttccagagtatgcacctggacgagccaaaaatcaagcgccatctactgcaacctgattaaagccgtaacgaaaaagaggcacctacatgaaaagtgcctcttttgtcttgaccattacggcaaatcgttgccagccgcgaagtaaatgtcataccattcctgccgcgtcaaggtaatatcggcaccttctgcactttctttgatgtgttcaggattcattgaaccgagaataacctgaacgcccaccggatgccgcagtaaccacgcaacagcgatcgcatttttattcgtgtgataatgatcggcgactttttgcagctcgtcatttaatgctttgaacttgggactgtcaatgaaggtaccttcaaacatcccgtactggaacggcgaccatgcctgcaaggtcatatgtttgcgttgcagatatggcagcaagctcccatcatgatcaacagaccggtcatcggccatgttggtatgcatgcccgcatcaaccatgccagtgtgggccactgagaactgaacttgatcaatcaaaagttgttgatgcagattctcctgcaacagcgcaatttgttcgggattgaagttagaaaccccaaaatgccgcaccttaccgctttgctgcaattcatcaaacgcagccgccacatcatcaacttccatcaatggatccggacgatgcagtaaaaccgaatccagatagtcgatttgcaagcgctgcagaatgttatcaaccgctgacaacaggtgttctttggaaaagtcatagcgtttgccgaaaaccaagctgccgtgtgaacgttttggatctaccacaatcccgattttagactgaatatacaactgatcgcggttaactttagcttgtttcaaagcttcgccaaaaacctcttccgacttgccttgaccataaatgtccgccgaatcgatgaaattaattccatcgtcataagcgctatccaaaaccgaagccgctttttccggagacaaaacattcatccgcataattcccagtgcaacactggaagctttccaattagaaccacctaattgcacttgtttcatgacagcaaaactcctttcttagtaagcgtgagccagcgcgcttaggggccggagtgtaagcggacttgggcgtgatggccgggctttggccattgcgaccaaggtccttacacgcaggcccctgcgctggcgaacgagttatagcgtgagcgcgagccggcgcgcttaggggctggagtgtaagtggccttgggcgtgatggccggctttttggccattgcgaccaaggtccttacacgcaagcccctgcgccggggagcgcgttatggtgagcgtgcgccggccacaacccccagcgccaccgtccgcccacaatccaatgacacctcaattctatcccctaaagtccacttaaggtcaagctaatatgagaatttcaataaaacgacttgtcagcatctttttggcgcgttaatttaaaggtgataacacttatttttaattagcagaaactatcaggagggttcaaaatgactgttaaagataaagtcgtcgtgattaccggcgcgtcaagcggtattggcgctgcaaccacgcaggtattggcacaagccggtgcaaagttagtgattggcgcgcggcgtgaggatcgccttgccaagttggcggaaccttttggaaacgatcagattcgttaccaagcaaccgacgtcacgaatcaagaccaagtcaaatccctagtcgacttagccattaagacatttggacacgttgacgttttgttcaataatgccggtcttatgccgctttcagaaatggctgagttgaaagttaatgaatgggaacggatggttgatgtcaatatcaagggcgtcctttatggcatcgccgctgttttaccgcatatgatcgaacagcacagtggccaaatcattacgactgattctgtggccggtcatatcgtgcatcccggaactgctgtttattccggcactaagtgggcaattcaggcaattatggacggtttgcgtcaggaacaggccgccaaccacattaaaacaaccatgatttccccgggcgctgtgaatactgagttgttcagtaccatcagtgatccgaagcgccgcgcagcagtagaagccgatgagaaaaataacggactcaccgctaccgatgtcgccaacgcggttttgtacgccattgatcaaccagacaatgtagcggttaacgaagtgctgttgcgtccggtcactcagcagcgttaaacgcgttgaatcttttcaaaggagtttatatgtctgattatacttttctaaaaccttttacattcaaaaatcagcccatcaccctgaagaaccgcattgtcattccgccgatgacgactcggctttcttttgaagatggtacggtcacgcaagacgaaattgaatattatcaaaagcgcgctggaggcgttggccttttcattaccggaaccgccaatgttaatccgcttgggaaggggtttgaaggcgagttaagtgtggccgatgatcggttcattcccggcctaagtcgtctggcaactgcgatgaaaacaggcggctctaaagcggttttgcagatttttagtgctggtcgtatgagcaatagcaagattttgcgcgggcagcaacccgtcagtgccagtgcggttgccgcgcctcgttctggttatgaaacgccgcgagccctcacaactgaagaaattgaagcgaccatccacgatttcggtcaggcggtgcgtcgggcaatcgaagccggttttgacggcgtggaattgcacggcgctaacacctacctgattcagcaattctactccccgcattctaaccggcgaaccgacgaatggggcggcacgcgagaaaaacggatgcgtttccccttagccgtggtgcatgaagcggaaaaagtcattgccgaaactgccgaccgtcccttcctgttgggctaccgcatttcaccggaagagttagagcagcccgggatcactttagacgacacattagcgctcattgatgctttaaaagccaccaaaatcgactacctgcacgtctcccagtctgacgtatggcggacatcgttgcgtgatccggataatcctgccatcatcaatgacgttattcgcgatcatgtcgccggcgcctttccgatcattgtggttggcggtatcaagacccctgaagaagccgaaaaagccgcggcagcatttgatctggttgctatcggccatgaaatgattcgcgagccacattgggtgcaaaaaatacttgcccacgacgaaaaggcgatccgctatcagatcgcccctgaagaccttgacgagttgggaattgcgccaactttcctcgattttatcgaaagtatttccggcggtgctaaaggcgttccgttaactaccgcaaccaatgacgaacattaaacccttaagttattggccaccgttttaaaatttaagttcttcatgtgagtcgagccgtaacagctcggcttttttgtgattgtaatcttcctgcgtgatggctccggtatctaacagatctttgtatgcctttagcctggcaatagtcgcctgctccgctgcttgggcttgggtcgttttggctgcctgggctgcaatggcttgttggcgccgatagtagtacaaataagccgcaccgccaaggacaaggactgcgacaaagatataccaatattgtaccaacatggcaatgataaagatgatgatcaaaaacccgaagaatcccattttttgatttttcatgttgctcgctccaatcgtgactttcgctattgatcagtggtgtctggctttaaattccagtcattttagccgggtcaacccaagcatcaaactccgcctcagtcacgtaaccggtttgaattgccgcatccttgagatccgttcccgtgcgttcagctagctgagcgatggccgcacttttttcatagccgatatgcggcgtaagggcagtcaccgtcattaaggaatgcgcaacgagtgcctgcatgcgcggggcattgacggtcaaatctgctacaagtttttgcgtgaagctggtgatcgtctgtgtcagtaacgtcgtcgattcaagaaacgtactgatgatcactggtttatagacattcagctcaaagttaccttgggaggcggcaaccgtgatcgtggtatcattacccatcactcgcaccgcagccatggtaagtgcctctgcttgcgttgggttcaccttcccaggcatgatcgagcttcccggttcattggctggaatccgcaattcaccgtaacctgctcgtggaccacttgccagaaaccgaatatcattggcaattttcaacagatcggcggctaatgtcttaatacccccgtgaacattgctgatttcagaatgggctgccaatgccgcaaatttatttgtttgggcggtcagtggcaagtgatagacatcactcaaacgcccggccacaatccgcccaaagtttggcgctgcgtttaatccggtaccaaccgccgtaccgccaatggccaaacgaaaaagtgccggtttcaactgttcaatcgccgttcgatcgtgcgctaacatcgcaatccaaccgctgacttcctggccaaaagttaacggtgtggcatcctgcaaatgtgtccgcccaattttaacggtatggtcatattgcttggctttcgtttggaatgccgcgatcaagccatcaacagcagccatcaagtgattgacagcaatcgcagccgtaatgttcatcgccgtcggaaacgtatcgtttgaactttgactatggttaacatcgtcattaggtaaaatgggtaagtcaggattgagcttggctgcctgatgactgacaacctcattcacattcatgtttgtttgggtgccggatcctgtttggtaaacatgcagcggaaaatcagcttgtaatttttcatcaggcaaagccaataacgtgtctacagcctgcgtgatcagttggcctttgggagcaggcaaaacgtcagctgccacattcgcccgcgctgccgcttttttgatttgcagcagcgctttgatgagcggcaacggcataagcggtccggcttgaaaattatgacggctgcgttcagtctgcggtccccataaagccgtttccggaatttcaaccggtcccaaagtgtctgattcaatccgtgtattcgtcgtcatcgctacctccatcttaatcacatgtgctgcgattgcttgttaatgatagtcctattttacacgatcacactgccaagcaacccaaaagcataaaaaaacagccttagcacctaatgatcgctaaggccgataccccaacaccacaccttgtcgatgcagtcttgagatcaaagttcagtgaagcactgccgcaaccagccgtgccgcgtctttttgaaattgaagcgatgaagatgataaagccgctaaatattggtgaatcggatcggcttgcggggtgggtaggccagcgtgcagccaaccgctaatcaatgccggatcaattgaccaagcctgaacgttaaccagtcgctgacgggtgtctggtaccgttgttttcatccttgcttcggcttcagtcaaccggtgataagttgctggcgaaacagcatacatcaagggttgttcactaccaaaagtatcagtttgcagcataactgccccttccgtattcaatgggaaatttttacgagcaagactgctgcgctttaatagctcgctaaaggatttaacatcgtaggttcgactcacttgaaccggcgaggccatcatcccgttgaattgtttaaaaatctgccatggcgtctgcgttaattgataggacttatcccctggttgcgcacaatccaaggcgccgttcagttcaagctcccgccgtgcttttttcaatttaccccgatgctctacccctgcaatttgtccatagcgctcaaaaaatggtcgaccaccacggaatattttccgcttcttggtgttactctcagaatccagccgatccgcatacatgagtccgatcagtaaatcagtcgcatgctgcgataatccggtcgctgtttcagttggtacagcttgagtcataacctcacttaaatgtgccatctcatccccactttcatcgctgatgaccgtcacgcgtttgctggagcagaagtctgcgtgtaaggaccttaagcgcaatggccaaagcccagccatcacgcttaaggccgcttatgttctggcttatgcccataacgcactccccggcgcagaagtctgcgtgtaaggaccttaagcgcaatggccaagtgcgggccatcacgcttaaggccacttatgttctggcttatgcccataacgcgctccccggcgcagggatctgcgtgtaaggacctcaggcgcaatggccaaagaccggccattgcgcctgaggccacttacactccgatccctaaccgcgccggctcgcgcttacaaaaaagtcgccttgatcatgttgagctgatcaaagcggcttttttaacatatacaacaatggccaacaattatcttacttgttttggtgtaccttagattgctcattttccaatccaagaattgcgaataaccacggatcgtagccttctgactcctcgatcccatcgcaactcatcaccaaagacgcgacaagactattgtacgtcatcatttgctttcgcctcttcttcatcggctacagcttcaagatgagcttcataacgcttattacctttatacagatcccaaattgtccatgccaagagggccaaaacagctgcaatcagaacgtaagcgatcatattagcaatgttggtttgtgcggccgttggattatcaccgaagaatccggcgattgaatctggcagacctttcaggttcagataagttaaaccgataacggaaacccaaccgagcactttaacccagccagtgttcttgaaccgatcgcccatttcaaccttactattcgtaaacattagcagcggtaacattgagaatggcaacgcgaaggccaagaagacctgtgagttgttcattaatgtattgagcgcctcatgttgctgaatcggcgtttcccgagcagtcaacataacgcagacgataaccgggataacggagataacacgagtaaccaagcgccgagcccacagtggcatcttcatatgaatgaagccttccatgataacctgccctgttaacgtaccggtaatggttgagttttgacctgatgccaacaacgcaaccgcaaacaggatagataaaataccggacttggcaaccgcaatcaaaacaccgttactcagtgtggaagaatcagacaatgcctggaacaaaccgaagaaggaaggatctttaacagcaccgctcttgaagaccgcaacccccataacaagcagcaagcagttaacaacaaaggcaaaagtcaactgaatgttggagtcccatgctgaaaacttaacggcttgagcaacatcttccggatctttatgatcaattttacgagtttgagaaatcgcactatgcagatacaggttatgtggcataaccgtcgccccgatgattcccaaagccccttgaattggactcataccgttgactgacggtgaacttgcaaatgtttcgccagttggaatgaagcctttaagcaaagcccccatattaggatccgacaaagcaacttgataaacgaagaccagtaaaatgacaagaataagagcaacaacaatagcttcgatttttcggaacccaatcttggtcaacaacagtaataccagaacatcgaggaccgtgaccagtaccgcaataacaagtggaatatggaacagaagataaagcgcaatagcggcaccgataacttcggcaatatcagtcgccataatcgctaactcagtcaaaatccacaagacaatcccaagcttcttcgacgttcttgcacgaatcgcttgggcaagatccatttgactcacaatgccaagtttagctgccatgtactgcaacagcatcgcaatcaaacttgacattagaataacggaaatcagtaagtactggaagttttgaccaccggtgatggacgtggaccaattccctggatccatgtaaccaacggcaaccaatgctcctggtccggaataagcaaatagcgttcgccaaaagcctttcccgtgtggcacctcaactgtaccgttaatttcttccaatgacggcccgttcgcgtattgaatgagcttcatggaatgtttcttcttgtgatcatcactcacaatatgtctcccctttcatcttgaaaaaagttaagtccctggggaacaaggtcttttaggtctccctaacttaatcctttcttaggatatgccttgaagctgatatcgtcaactattttatgaaaattaattgtattttcagtgactaatttgtaaagtgtccattgtttcaaaatgcctaagcagtgcccgattcacggcaatagctaatcacgcttacagccgattgctttcagaaaaccgtttcaaagcattaggtcatcataatcccgatataaaagataaacgcttttttagctcgcattaaattgaaatcgcaaattgattgcaaccggtttaggcataccatatgataaaggtagtaccaaaaaatttatatcacgaaatgaggaatcacttatggaagaagttcccgactcgcaaccgccagcaacagcgcacagtatcaaggatctgcagcaaatgttgcaggtcccgtcccttgaccacggtctctctaaaacagaggccgctaaacgcttagaagccaatggcccgaatgccatcgaatcgcatccaacgccaaagtggctgatctttctgcggcagttcaacaatttaatcatttatatcctgatcattgccgcaatcctaaccactgtcattggcgatgtcactgatacctcggttattgttttggtgattatcgtcaatgcgattattggatactatcaggaaagtaatgccagcgattcacttgaaaaaatcaaaaaaatgctggcccctgaagcaactgtttatcgtgacggcgaacgtcttgatattcccagtgccgatttggttgtcggcgatgttgtttttctggaggccggcgataatgttcccgccgatttacgcctcgttgatattgacaacttaacgattcaagaagctgtcctgaccagggaagcaaattcggtcatcaaaacgactgatatcctgccagcagacacaccacttgccgatcaaagcaatatggcgtttgcctcgacagcggttgcaggcggtagtggtattggcatcgtggttgcaacgggccacgatactgagttcggtaagatttcccaggcggtttcggacgtacgtaaaggccgctcgccgatgatgcgcgaaattgacggtatcggtaaaggaatttcgtacgccattatcgcagcagcggtcttactatttatcttcggcctgatcatcggtaaatacagtctgcctgtcttagcccttgccatcgtcaccatggtcgttggttcaatgccagaaggtctgcccgccaccacatccgttatcctggcaatgggtgtttccaatatggcaaaaaagcaacacgtcattgtcaaaaccttgcctgctgcggaaactttaggctcagtcgatgttatctgtaccgacaaaaccggtacgctaaccaaaaacgagatgaccattaccaccgtcatcacgccacaggccacttatcaggtaagcggctcaggctacacccctaaagggcagttcaccattgccaaaaaagctatcgagccagcaaaccatccggatttaactgcattgctaaccgctggatttgaagccaatgacactgaattgcaccaagaagacggccgctatgtcatcaacggtgaacctactgatggtgctttcctcactgcctactacaaagccttcaaggaagaacccgctaacaccgaacgtgacttgatgccgtttgattccaacaatcgttacatggccaaattagcaaaatgcgcggatggccacacccgtctgtttgtaaaaggttctccggataagttgttaccgcttgttgcggcggctcatcccgactttgatcaatcccactatttaaagttaaccagccaattcagtacggaagggcaacgcgttattgccgttgctcagaaaatcgttccagatgatactagcgaaatcacgccagcattattgaagcaaggactcgattttctaggactgaccgcgattattgatccgccacgcgagtcagtgatttcggcgatcaagcaaatgcggcgcgccggtgtcaaagtcaaaatgatcaccggcgatcaccccgagaccgcgctagccatcgccaaaaaactaggcatggccgattcgcctacagccgtcaccggcacgcaactagcagcactgccggaagaaaagcaacgccagatgatcctcaatgccgatgtctttgcccggaccacgccaaaggacaaactcacgattgtctctgtcttacaggatgccggaaacgtcaccgccatggtcggcgatggggtcaatgacgcgcctgcacttaaaaaatctgacgtcggggttgccatgggtcaatccgggaccgatgttgccaaagatgcggccgacatggtgctcaccgatgaccgctttgcccgcatggaaaccgccatcgctcaaggacgccgcatttaccaaaacatcaagaaaagcattttgttcctattaccgacctcttttgccgaaggactggtgatcgttttcaccattctgactcaacaagcgatgccattacgtgccagtcagctgttgtggattaacatggtcagtgccatcaccattcaatttgccttcatcttcgaacctgccgaagctggcacgatggagcggccaccacgtaagaaaaatgcgtcaatgatgcacaaacatgatgtctttcaaattgcttatgtggccatgatgatcgccggtatcgggttgtgggcgttcgactggttgacagccaaccacttaaccgaccgcgtcaccgcaagcaccatgatggtgaacatgattgtcttaggaaaaatcttctatctctttaacatccgcacaaacacactggctctttcaaaaaatctctttagcaatcccatggcgtttgcgattatcggcatcatgttaggattgcaatgcttcctgacttatgttccttttatgcaggaaatcttccaaactgcttcgatgtcgtggcgtgaatggggcattgctgttctagccggttctgtgattttgatcgtgactgaaatcgacaaaatcatccgcctgcgctggcaacggcttcacggccacgatgcgtttcaatccaccacaaaaatcagtaaataatgtttggacagcctaaactttttcttttcttttggcattaacaatggtaagactataagtaaggtttccctaacaaaccttatgcgtatacaaaaagtccgataaactggttcatcatccaccagtttatcgggctttttgggctttcgaaggcgatctctgaattaatgttccgtgatgctgtgccgattctttcgccttaaaatatttcaggcaatcctaaaatttctcttttaaataagccgacaactggtatactggaagtgaaaagaagaggagctgatcgttttgaaattgtatcaaggtctcacacaagtccaaattaatgaagaatttgccggcgaagcaaatggctataagattaccaccacccttgagaaaccgctgaactacgagccggcaatcttgtatcagtacttggatgccgtcttaaaaccgggcagtcgtcatgaccaaaataatttgcgttatgtcaccgaccccggattcatcggtgaaaattacgattatcaaagtgttcctttcacctcacatatgactgatttcgatgagaaaatggcttttgcacgcaaactggttgccgacctcaaccgtcatttgtcagtcaatgtcaaaccggctgattccgaaattgaactgattttcgttgactgagcaaccgcgttacctcctttcctagtcgcgatgctgctcctctcccgatcagttgcggctaagtcatccagtcaagcagcttagttgcagcaaaacgccgcctatccgaagaaaagataggcggcgttttggtgtcgctggaattactaaaacccctgccgttacactgttgacactatttatttttgggtaatgatgaataatctgatcaaacggtggccttcaatgcttttctggtcttctatgagaatcacttgcaaaatacataaaaagcgagccattgttgtgacgttttcacccaatgacccgttcttttaatgcttttgttcaaccgcttttggcaatgtcaaggccagcaatagcccaactaagcccacgccggcaaagacagcaaaggtaactgcaaagccgccagcgtggctatttaacgtcacctgcatgttgtccaacaatactgtcgcaaacatcacgccggctgagccaaataactgtcgggccgttgtggtaaccgcggttccatcggccaccagttcatttggcaaggcattcgcgccagccgtcacagaaggcatcatcacaaaggcattccctgcttctgttgccatcgctaacacaatcgcacctagcaacggcagatgacgagcaaaaatcgccagtaaaccaaaaccgcctgtaatcagaaccatcccgatcatcgcgaccagccgcggaccaaagcgatcaagcaagcgtccactaaccggattaagtaaactcagtaagacggctgctggcacaagtgacaggccggaaactaacggcgaaagacctagcagggtttgaaaatacaacggcatcagaatcgtcgtaacaatcaaaccgatgtaagaaatgccggttaagaagaccgctttggtgaacataccggttgcaaaaacccgcatttgcagcatcggtggttggcgattcaattgccgaatcacgaagataccgcctgccaaaaccccaacgatcaacaaactaatcaccccgacgcgcaggccttgttttgaccacgcacttaaagcatatagcaagatcggaaagctcgccgacaagataaacgaaacccagtctaaccgggtctgttccagcggcatcaccgaggtaatcgtgacagtcgaaactgccagtacaagcactgaaacaattaggaagaataggaataacgcttgccatggaaaccacgtcaacaagacccctgaaataatcgggcccaccgccagcgccgatcccattaccaagccggctgttcccatcactttaccgcgttcactgtgcggcgtaatcgtcagcagcactgtctggaaactagggaaaataatcccgacggcaaccgcctcaagtaaccgaccaatcatcaaaaccgcaaagcttggcgcccagatacataaagccgtcccaactgcaaaaatcagctcaattgcctgaaaaagccgctgaaacgggacattatgcaacagccacggactcaccggaatcatcagcgtcatgaccagcataaatcccgtcgtcagccacgcgaccgtatccgcgcccaaaccaaatgccttcataaaagccggataggccgtactcaaagaagattgcgaaattgacatcgaaaacgttcctgtcagcaaagttgcgacaaaagcgccgcgatgtttaatcgttgtaccattcataacatcatcgatttctatttgatttttggtgcctcacattttcatacccattttttcatacgactgcataccgcccatccataattcagatggtttgaccccacgttccttcgctaaggctgtcatcagtgtatccatgtccattagtttgtattcctgtttcggcttcgtcggatcaaacgtttcgatttgcgccatcatgccaccatcttcatgttcaataatgtgacagtgatacatgtaaactcccggtaaatcaaagcgcactaacagccgaactgtttcacctggattaacgccaactgtatctttaaatccatgctcatttggataaggcgcatgcccgttacgggacaaaatcaaaaattgcgtgccgtgcacatgaaacggatgaaccatcccgggcgcagcattactgttggtaacatcccaatactgagctttgccaatcggttgagtcgcatcaattcgctgcatggcaaactttttaccgtcaatcgcgacactttcatccattccttgcatcaccacatggcgaactggcaacgcaggatcaactgcaggtgccttcaccgtaaagagcttgtccggcaattgcgtgtgatccggcttgaaagcatgaatccgaaacttcagcaaaggcacattatcggtgtaaagcgtgaccacatcgccttcatgacactgaccaaaatcgacaatgacttctgcccgttcagcacacgtcagcatcaaatgcgtcaaggccaccggttccggcaacaacgaaccatcaccgccgatttgggtaaacggcaaatcatcggaaaaatgcagccgccactccctgcgattagcgccatctaaaaaccgtaaccgaactttctgggtagtcacatcgaaataaggattaatggtgccattaatcatcgcggtcggaccagcaacaccatccggatcataatcagtccgataattccactgattctgctcatggaaccggcgatcctgcaaaatcaccggaatgtcgtcaaccccgtaattgtgtggtaatggcaagctttcttcatgctgatccttaacaatgaccattgctgccaaaccgtgccagacctgctcggcagttgaaggacacgggtgggcatgcagccacaatgttgccgccggttgatccaaggtgaaatcaatttgcttactttcgcccggataaaccggcgcatggcacccaccatccacataagggccacttacattagcaccatgccagtggaaagttgtcagttcaggcaaggtgtttttcagtgtcacatgaacatgctggccgcggcgatagacaatcgtttgcccaagcaagctagcattataaccccatgtttttgtctttgcaccgggaagcaactgtgtctcccccgcttgtgccgtgacggtgtaatacacatcggttgccgtttctttatcaggttttagcaacggcggcacatttaagggtttggctggcgcatcgcttacttcaagtggcacataaccgccatcatgcaagtcaaacgccggctcatcaaagaaatagtcggtataggttttcatcatcgttcccccctcgcttcaaattctagcactttttagggttgccataaacgtaatttggaattaatctaaagtaggtgcttcgtaaaaagaagggaggaagatgaaaatgatgtcaaaatccatgggctggttgatgttggcacttaatgttgtgttgctggtattaattgccaccatgcataacatggctgccatgtggctgatgggcattatcatgtcacttgatgcaatctcgggattggtaaatgcgtatcaagccgaccatgaaacgcatcaccatgccacgcagcattgatctttaagcagacttgatgctgattgtccgtctacctcacctttcttttatgttgacattaacatatgtttggaataccatatgttagcaaataaacaaagagtgaggcagcaagatgaaaccatttgtcatcgccaaaaacgctgatatgacaaccgccattcgagttgaatatttttctactggctggatggcgtttgaatttttgatcggcttctggtcaggatttcaagcagggtcgattctgttaattgcgtttgggctggatagttttctggaaattatttccggtgccactttaatctggcggctgaaaacagaaagtaacggtgcaagtgcttcggcagtcgcccgtgcagaacaacgctcaagtcttgtggtcggctgcgtgctgttactgctgagcttatacgtcatcggggtttcaggtttcaatcttgtgacgcacgcagccgctgaaagtagtatgagcggtatcggtattgccatcgcgtctattattgtgatgccatttttgacacttagaaaacggcatcttggtcacaagcttaattctccagcacttatcgaagacggcatgtgcaatatcacctgtgcctacatggcggctactgttttgatcggtagcttgttaacttggctatttaattggtggtgggccgattcggttgcagcgttgattttagtttattttgttgccagtgaaggctggaaagcactgcaaaccggcttgagccacagcgaaaacgaagaataaatctttccggaaaaatgaccttagagcaaagcgccttgaatgaaaagacgtcttgctttaaggtcatttgtatcactttgattattattcgttcatcaatggaaaagaggaaaccgttaatgactgctacgacgctaaggttggttgaatcggccaagcttgccgaagctgagcgtattttcaaactgctcagtaatccgacccgattgcagatgctgaaattactcgaacaacaagtgctcaacgtcagcaagcttagtgaattattaggcgttgagcaatccgttgtctcccaccagttagcgctcttacgcaagcaccaactcgttagtgcaaaacgtgtcggcaaagctaattattatcaactcgacgacccccacattattgcggtcattgatgccatgctcgcccacgcagatcatgtcgcccgaggtaagcaacacggtcaatgactcattttcgagaaaaaaacaaggtatattcctttacacttcaatgtgtataaggatataccttgtttcttttcatactgatccttaaaactagcctgccaatccatcgtgaatcttatcaaggttccacttcatcatcgtataatacgtatcgccttgagtccccttagctgccagcgagtccgtgaaaatcttcgagtaaatcgacaacccggtctctttggccactttattcatggacttcggtgagaccgaggtttccacgaatagatgtttcacttcggatgcacgaatcttagctaaaaccgtctgcatctgttctggtgttccttgagattcagtgttgatttcccaaatgtatgccggggtcacatgataagccttggaaaagtacttaaaggccccttctgacgtcactaacacgcgttgcttttccggaatatcgaggaagcgtgactgcgcggtttcatgcagtttttgcaacttggcaacgtatcgatcgctattcttctgataataagcagcgtttttggcatctttttgtttgagcaccttggtaatcgtcttaacatactggatgccattagctaagtccagccaagcgtgcggatcctgttctttggtgttggtcgtcaagtgttgcgcggtcacacctttacttgcggcaaaaacatccttatcaaattccttgtgcgacgtcttaaccaacttcttaaaccagccattaccaccggtttcaaggttcaaaccattatgaaacacaacatcggcttcactggttgccgccacatcggttgggcgcggttcatactcatgcggatccgtgccgcgtttaacaatactgtacagcttgatccgctcgccgccgacattttgaaccatatcctccaaaatcgaattggttgtgaccacccgcaacgtttgattcgtgcttgctgaatctttttgagccgtactccgactgttaatgaaccaaaagacaccaccgaccatcacaattaaagcacctacagtaattaaaatcttcttcatcgaataacttcctccgcggtttgagtcgtcgcggctgttttggtccgctgacgcttactgaaactaaagaatgcctgttttggtgaaaagacgaacgagatggcgaacaataccgccgctacgagcacaattgccggaccggatgcccagttaaaggtgaagctgaaatacaacccggtgatagacgaaatgaccccgacgcttgctgccatcacgagcatggtttcaagccgatccgtccataagaaagcagtggcagcaggcgtgatcagcatagcaacgaccaaaatgatccccaccgtctgcaaggccgaaacagttaccaaggttaaaaccagcatcaacgcgtaatgaatcgcagtggtattcaacccataagttttagcaaaggtattatcaaacgatgtgatcaacaattccttatagaacaacaccacgaacaagatgacaatccctaacacaaccgcggtggtcataatatcactatcgctgaccgccaaaatattaccaaacagaatatgatgcaagttcgtagcgctttctgccatcgaaatcaaaatgaatccgagcgcataaaacgcactgaacaccacgccgattgaggtatcggttttgatcttactatttgccgcaacaaaaccgatcaacagcgccgcgataatgccaaacaccgaagccccaatcatgacgttgacacccagcatataagcaacggcaacgcccggaagcaccgcatgggaaattgcatcccccatcaacgacatgccgcgcaaaataatgaagctaccaatcaaaccggacatgatccctaccatgatggcagtaattaacgcactttggaggaaatcatattttcctaacgcggtgaaaaattcagctaatgaactcatacgctcgccccttccttggttgcaaacagcacgttggaaagatcggccgaaaatgcccgttcgatattttgagccgtatacacttcttcgaccggtccttcagcaataatgccgtggttcatcaccacaagttcatcaaaataatttgaaactttatttaaatcgtgatgaacgacaatcagtgtttttccggcatcgcgccactgattcaaaatggccatgatttcctgctcgctcttcatgtcaataccgacaaatggctcgtccaggatcatgatgtcagcctgctgcacaatggcacgcgccacaaacacgcgctgtagctggccgcctgatagctgactgatctggcgtttggtgaaatcctccaacccgacttgttccagcgcttcaagtgccgcctgacgctcttttttaccggggctcttcaacaaccccagacgtccataggtgccagtcagcacaagatctaacacgttaattggaaaagtcagatccaaatccttgcgctgctcgacataagcaatcgcctgttgcacttccttgagggtgcggccggaaaagtcgaccttccctgattgaaccttgatcaaacctagaatagctttgatcaaggtcgatttacctgctccgttaggcccaatgattccggtgatcttacctgcgttaaaatgaacggcaacatcagcaaacaccggtgtgtcagcgtaggcaacggtcaggttcttgactgttaacataagaacctccaattttagggtgacctaattcgctttcaccctaagcttacagaaaagaaggaagactggcaagtgttttttaaggcatacttaaaatttttatacgcggtacatcttggccaccaacgctttatcgtgtccgtctcaagtcatacttataaaccccgataaatcaaaaaatgtaatcgcatgcagttattggaacttatttgagactataaaaagacctatgagtaatttcattaattactcataggcctttgtttatcttcccgttatttaagtcacaaatcagtcgcaactttttaaaaggccggttgttattttttctgcgtacgtattaccaactggctttacgaacaccgggaatctggcctttgtgtgccaactcgcgaaaattaagtcgcgagatgccaaatttacgcatatacgcgtgcggacgaccatctaaagcgtcgcgatgatgtaatcgtactgggctggagtcacgtggcaatttgctgagtccgatataatcgccttttgctttcagttctgcgcgttttgctgcatattgttgaactaacttctcttgccgttttgccttggcaatttttgactttttggccataagcttcctctttctataaaatgtgacgagccatctcattaaccgacctattttccgacaccgacaataggcgtatacgaacgcttatctggatttttgctgcttgcgcttcgcatcgtgtagaatttttaatgctcgtttgcgcgttttaatgttgggactcttcatccggcgccgcgcacttgctaaatccgttttttccaaaatttccctctccctttaaatcgtaatcattacgcttaatgacgaatttaaccgtatcatgcagctgttttgactgtcaataactttttcaggacgaacgcttctttgacccaattcaaaaaaagacttgtcaagccggtttttttgctttagagtttaaatcgtaatgattacgttttggaaggaagcgggtatttatgatgaaacgattacttgcaggtatcagtgtcgcactcttagcagtttttgcagtcgcgtgtggcaataatggtgccgcaaagcaatccagcgctagcaacgataaaattcaggtagtggctagcgtcgatttttatggtgaggttgccaaagcagttggcggtgataaggtcgcagttcagtcggtgattaacaatccagctgttgatccgcatgattatgagccaaccaccaaagtcggcaaagcagttgcaacatccgatttcgtcattgccagtggtatcggctatgacggctggatggacaaagtcgttaaatcggaaaacaaatcgaaaaactacttaagagttgccgatgatctgatgaacaaaaaggaaggcgacaacgaacatatctggtatgatccgcggacaatgccaaaactggcaaatgcgctggcggataaatttgccaaaaaagacccggccaataaagccaagttcaaagccaacgcaaagaaatacatcgcttcattagatgacctcaatgcacttgttaataaactcaaatcaaacgcaaacggtcaacttgttgacgtctcggaaccagtcttcggttatgccttagattacctaggctacaagatcaacgacgcccacttttctaactcaaccgaagaaggtaccgattacagcgccaaggatattcatggtattgaaaccgacatcaaggaaaagaaaatcgcctttttcgttaacaacattcaagcgacatctaaaaccgtttcacgccttgttaaacttgccaagcaaaataacgtgccagttttgaatgtcaccgaaacacttcctaaaggcaaaaactatcgcacatggatgatgagccaataccaacaactcgaaaagatccaaaatcaagcaacaacaagcagtaagtaatcaaactcgtctgaccacaagggtttgttacacttccctttacctcggtatcactcaccctgtaccgaaaaaatccatcaatggtttagcattgatgccccaacaaaccataagttcgagtcaaaagcatcgaacagtctggtcaggaaaagtccgcaaattgcggactttttttagtgagcgcgacccggcgcggttagagaccggagtgtaagtggccccaggcgttttaaatcggaagtgttacactagagtcggcacaagaaaggaagatgagtatggcaaatgtgatgattctaggagcacacggccaaattgcgaccttggtgcgccaccgcttgctaaaagaaactcagcatcatctcaacttgtttttacgccatgccaagcgcatcactgatgttgaccgccaacgagaaacggtttacgacggtgatgtcactgatacggacaaactgacaaaagcaatgagcggtagtgatcttgtttacgccaacttagggaactcagggattgaggatcaagccaagtcggtcgtcaaagcgatggatgccaatcacatcaaacgcttaatttggatttcaacacttggtatttacgatgaagtgccaggtgcatttggtcgctggaaccataagatgttagacggcggttaccttgaaacctatgctgcagcggctaaagtcatcgaaaattccgacttagcctacaccattattcgccctgcttggctatccaataaagccattgtaagttatgaactcacgcaaaaaggggaacccttcaaaggcacagaagtctcccgaagtagtattgctgatctggttgttaacttaatcaatcatccgcatcaacacatcggtgaatcgcttggcgttgaccagccgcatacgcaaggcgataaaccttccttctattaatcttagcgtgaagtttttccaccacaaaaaaatttcatcttcattagcgtgaccgctctacaaaaagcatcaccggcacatgaggatgaaatttttttactagtcaaaccgttttggcagttcgacgctatttactactttcagttgtgacagcttgttgattgttggcaaaattgcgaattgattggggaatttgatcgccaaaatacttttcaccgacactcacggcctgtttgaagaagccttgaccgttagcctgataagttttcgcatcattatttattgcgctggttaagagctcgctgccaagcttattgtaattagtcaaggctttggttaaaccgtcctctgttttattgtttgctaattcgaggcgaatatcatccaattgcccaagcccttttttggctgtcttgctaatttccttactatcactttgcaacgatacttttgtcatcgttttcatgacaatatcagaaatgcgcgtgtaccgcttttgcaggtcgtttttggtatagtgatttgttttaatcatcgttgaccccgcatcctgtgacgatttagacgccttggactgacaaccggtggccccgaccattgtcaaacagattacagtgatcaatagccattttcgcaacacaattccccctcgatcaaactgttcacaaccattcttcattaagttcattcaaccacaggcgtgatacagcgtcaaacaagtcaccgcaaatgacaaatatgattgcagatgcttttggataaaaagttcaccatgacttcatgaccatcaaaaatagtcccagaactaccggcatcatgttttcaatatttttcaatcttatacaaatggatatattatgccagattagcgtttcctacgattagtcatcaatatggcatcttttagcttgcgtcaatatcgccagtacgctacgcttaaacgcgtcatcattacggttaaacgaggagattcagttatgttaaaacggttattaacagtcatcagtctgctactactaacaacagttgctaccgcatgcagtacgaataccaaatcatcaggaaaacatgaaaagatccaagtcgtcgcaaccgttgatttttatggcgaagttgccaaagcggttggcggcaagcaagtacaagtcacgtccattatcgacaatcctgccattgatccgcatgactatgaaccaaccacccaagtcggcaaacaagtggccacagctgatttaatcatcgctaatggcatcggttatgatggctggatggataagctaatcaagtcggaaaacaaatccaaacagtatttacgcgttgctgatgatctgatggctaaacatgaaggcgataatgaacacatctggtatgatccacgcaccatgcctaaacttgccaatgcgttagccagcaaatttgccaaagaaaagccggcaaaaaaggcgatttttaaagccaatgccaagaaatacatcgcctcgcttaactccctcaatgccttaattaccaagctcaagcaaaatgttcatggtcaaaaagtcgatgtgtccgaacccgtctttggctatgccctcaattatctgggctacaaaatcaacaaccgtcattttgcccaggcaactgaagaaggtactgattacagcgccaaagatatccatgcgattgaaaccgacatcaaagaaaagaaaatcgccttcttcgtcaacaatagccaagccagttcaaaaaccatcgatagtttcattaagctagccaaggaaaacaaggtacctgttctgaacgtcaccgagacactgcctaaaggaaaaaactaccgcacttggatgactgatcaatatcgacaactggaaaaaatccaaaatcagacggacactaagtaaccttcttgcccgcaaaacctacgagcagcatacgtttaaaacatgatagtttgtgaagccatgtgacatatgaaacattttcgtaaactttttgaaatgaattcgttttcacaccccttataccaattgaatttttgaccggttgaactacaatagacttgtaaacaggagcaaccaaaggggagatgttttaaatgtcattgttcaaacatacttttaaacgcgttgagcacttgatcgccgcaccacgcgatccccacgaagaagaacaagcacgtttgcaggagaacttgttctatacaaacctcagtagcctccaaccaaaaacaaatgccagattttgattgatggttactataccaaaagccgtctcatctgcaggtgaggcggctttttatgtgtccagaaagcaactgtcttccctaagataatccgatcatcatactgcaaagtacctagcaatttttctgacctttcttcttcactataaatttgggcgagccttccatcattcttgacgttacttttccaaaaaatagccagctcgctaataaaaatgcaaactgactacttaaggccatcgataaacttagttctgtgaccttttttatattttaaatggcgactagacgctgagcaaccactcccacagcgattgaaccctctgtttaggtgttctttcatcgccagtctgcctcacatttggatgataggaataacgagacccccacgatccgttgattcctggtttccttacgactgacctatatgaaagaatccagcacttttttgaagaccataaaactgaaataatatcgtctttcggtctgttcatgctgcgccgatttctccgatgtgtctacccttatctctaactaccaaaaccttgcaatagcactctcacaagcgagagtataaaagccattttttcatcataattgtctcgcctgctaatcatcccacatgtttagcaggctaatatcaattactttgcatgacgcgctttacgaacgccagcgaacccaagaacagcgatgatagcggcaccggcttcggctaaaagaagacccgtttgcccttcacctgtagctggataagcgtgcttgccattcttctgggccatccgactcataggttgtggattggttgactgagtggttcctagtggtgccacggcagcacttgaagttgaggagccggaagtgcttgatgatgctgtggcacctgcacttgaggctgatgaacttgaggcactagaagatgctgaactgcctgtacttgaggccgatgagctggacgcgcttgaggaagcagaactgcctatacttgaggctgacgaactcgaagcgctggaagatgatgagctgcccgcacttgcagcagcttatgtagcagccgctgaacttgaacccgctttggccgtattctgcactgctgccgagctagctaccgtattatccagctcttcctgttgcggttgcccctgcactgactgaggagttgctacttttgatgcccgcgattcattttgctgactttgcagggctacaggtgccttttgacttgcatttccatttttagaaagcgttacattggcaacgcctaaagttgtcctgccaaaaagtacgacaaacgctgaagcaacaacccattgactaccgcgcttgtacattttcttcttgtcattgacgacatgttctttgaagcggttatataaacatatttactcctccaatagcatcaatattgtatctgctaaagctcggtacaaaacttattatatttttgaattaggagtattatgcctatgcaatacggcgcttcttgagatgactcgtcaagcaaagtattttacaacctttttgatagtttcatataagtaatgaaacccttaaccccgctaccatcgccaacacccccagcagcacaatccccaaataatacccaacaaacacgcgccactgccgattacgaatcaaaataaatgcgtctgccataaacgttgaaaaagttgtaaagccaccgcaaaaaccggtcagcaacaacacccgaaaagcagaaaacgcgggcaagccagctaaaaatcccgccaaaaatgccccaagcacattaatcatcattgtggcaaccggttttccgggccacaacatccgccctaacaccgtcagtaaataccgacaaacagctcccacaccagcaccaattccgaccaaaattaccatgagcttttatcctttcgtggtagcctttttgcaacaaagaatccgcctgccgctgccatcagtccgccgataagattcaagcttagcaacagaaacgcatagaccgcatgcgttgccaccaaattaacaaagtccagcataagcgttgaaaaggtcgtaaacccaccgatcacccctgttccaatgcctaacaacagccactctggcaagtcaaatctcatgtctagcccataagtcgtaaacgccagcagaaaactgcccaataagttcacaattgtcgtacccactatggtttgaccgtccatcgtgactgaactaaggccatatcgcatgaccccgccgataaaaccaccgacaaatactgccagcacccaactaaaccttacttgttcccgttgttgcatagattgctcctttcttcatccgcgcgttgccgtacatgtgtccaaaaaaagacacctaccccgttaattacaaggtaggtgtcatcaacttacgtataggcgaacaccatcgccatttaattcattgaaattatatcaaataattgcatgggaaaacagcgtcgggaagtgattgatttttcattgtagacaaacatgacgcagcttaacttatacccagctgaccgaccgccaacccaaaatacttgccacagtaaaaagcccgcgctgcaacaaacagcccggactttttaatttcagtcgaagtcagtgaacgcgcactgactttcggctttaaaatggtacccgcttatcacgggaaagtcattcagtcgaaactaagaaaacatgggagtgttgtcactatcgacatgacttaaaaacgctattttggagaaatgacgtcagcagcattatttgatgttgtcaccatggttagtctaccaagtcgagcgatcgcttggtcacacaatattattgtgcccccagagttggtcgtaaccaaagccagtcagatcttcaacttttgctttgacggcgggatcaacatccgccatcttgccgcctgccttcaagcgatcgatttcatcacgaaggatcttgtgattttcacgatccaacttaaagaagtaggaagtaacaaacgcgagtaacagcattaacgttgtaccaactaacatccagatgattaaaccgtttatcgcagcggcactttgcgtcttggcgccttcattgaatccaaatgctgataaaacaatcccggttaaaaatggtgccagcgcggaagttgtcttccgagcaaaggtcataataccggcaaagataccttcgcgccgttgtttggtgaccatttcgtccacatcaggaatgaacgtgtaaacagtccatggcacatagccggtaccggagtttgaaatgccccaagttacctgaagtgcatataaggtcatgatgccccagctagtcgcagctgcttggccatagtacaaaccggcgtagcaagcaaccgtgaagaacatcattgcatacataatccgcaataacttggaaggtccaagtttgctcatgatctttggccataccaagttacatgggatcccgataatggaaccaaacgtcaaaatattggaagcttcagtcggattgctctgcatggcatagacaatgtaaaacacataggttgccccgacaatatcacgtgctgtaaatgaactcagataaataactaagtgaagtgcaaaggatttaatccggaagaccgaacccatatccttaatcatgttccaaagcgatactaaaggattttcgcctttatgactgctttcttcaataatagctttacgttcttccggcgttccatccgtctcacgttcaaaggttgagaagtacgtcaagccaatggcaagaatgaagatgatagcaagaatgatcccgatggttaagaatgcgtttggattatttttacccataatggcaaagacgcgacctggcagccatgaagcaaggaaggttgctaaagctgaccaaagcatccgcgaactggataaacgtgacttcatatcataatcatctgtcatttcagcggccagcgtctcgtatggaatcataaccaacgctgtgaacgcttccatgagcaggtatgtgaaaagataaaaccagaagcccatatgtgaaatccagataatgacatagataaacatcagcggaatggaaattagcaggaagaatcttctgcggccaaacttccgtcctaatttagttgcaccgaagtgatccgttaagtaacccatcaaagggctaataaaggaatcagccacacgtgcaatcgcaaggatcgtacctccaagcactggagataacccgccaaaggatgtgtagaaaaacaacatccatgtggaggcaacggttagggccccattaccaaataaatctgcggcaccgtaaccaataacattacgccacctgacttttctcttcacgatgaaaacctcccattcaattagcaacaaatagtgattcggttcttttcgtaaacgtttacaaaaatgaggttaacaccactttcgtaaaatcgctatctaaatttgactattttagtaaaaccagcgcgattgctaatgatatgtcccaaaataaggacatatctacaggatcagaattagttttggcctttgaacgctcttcatgttctcgtcgcttatcaataccattatgcaaatcggaatcacctatttgtgcttttgatcgttgcatatgctgttgtagatttttgtgaaatttacagcaaatgaaaaataatatctagaccagtttcgcaaacagtgacgcttttcctttgtatattcaaaatttcgtgatgtccatctgatcgatccagtggtacttttaacgcatctttagtatcaaaatgatttttagggacatcaatctagcaagtttgggacaaatctccatctatgaaaaggcaagattttaagcaataactgatatcacgcatttcataacttcatatcaaaagcgacttttagtaaacgcttaaatgccatattgcattttcaatttttaaaaagtacgctaaaaaaaagaacgttttacttaaaaaggagctaattaggcatgccaaatataacaccatcgttactcgcgccggatcatctgcgcgttaacttgcaacattttgcttataacgtccaaacgcaaccgcatttcagctggtggaaccacagcaatcgcaccggagcatcgcaaagcgcgtatcagcttacggtctttcagcgccttcaggatcgtcaggatcataaatatttgtacgatagtggttgggtaacgagttcgaataataccgcggtgacggctgcaaagttatccgatcaactcgttgctggtcaattgtattattggcaagttcgcatcaaagacaacgccggaaatatcagtgacttctcccagcctgccaaactgatctgtgccgatccgtcgctaccggttaagcatggcatctggcgccaacctcaacccaaaacggcccaagagttggcacacatcggtcaggttgtctttttgcgcagccctcaactcaagatcaatccgagcgaggttgatactgccatcattgttgcggtggcccggggtaatgaaccggtttttgctcaaagtttcgatctttatctcaatggtcattgtctgggggttggctcggctcgccaacaggaacacgatcatggaacagaaaaaacggctatttactataacgtttatgaagctaccgattttttgcaagacggggcgaataccgttgcagccttggccactgcaagttcagataagcaggcattctggtgtcagctgatcctgtataaacatgacggaacgaaagaagttgccacgaccactgacaacacctggcgcgcattagatggcagcagtgcctttggcgattatggcgttaagatcagaactcaatatttcggtatggtcagtgaaaatatcgacatgcgttactatcctcagaactggaccagcagcgcatttgatgatcatgactggccgcttgcatggcagaatcctcaccaaatgattgccgacaatgaagtactggtgccatatcgaagcgaaaataccgagcgagtggaagtgcatgatcgcaataaacgggtggtcactttttccgatcaaaactatctgttggacttgggcaaagagatcattggcgggctaaaggtcaatctgttcagtgccttcgatcagcgtgtcaccgtgatgatgggtgaacaactaaatgacgacggccacgtccggcatgagatggcgtgcggacctgattacatcgaaaactgggcgcttgtaaaaggccagaatcaattcaccactttacaaatgaaaaacttccgctatgttgaactggtaggatttgaaggcgacttgccgcttgatgccattaatggttgggccatgcaacaagcatttccggataatgagagtcggtttgatagtgacagtgagttgttaaatcgtgagtacgagttgtcgaagtatacgatcaaggcgacgaatcaggatgtttttgtcgactcacaagcacgcgaacgccggccgtatgaaggcgatctccttgtgaatgccaatacgagttatagcgtctcctcaaactactcactggctcggcattctctggattatttaattgacaatccaacctggcccgaagattacaaactgttcgcaattgaaatggcttggcttgattatctctataccggtgatgatgatttactgcaaactcgttacactgacttacagtacaagctaaatcgcggtaagtccgcagaaagttttgacggcgcctcgcaaagtttcactggttcgctgaagaacagccaaggtgtcgacaattttgacgctgcagttggcttggtcaccaacgatgggctggtggactggccgatttccgaacgtgacggctttatggaaggtacttacaatacgccatttaacgcgattttccatggtgcttgcgcgacgatggccaaaattgcgcgcgtccttcatcatcccgatgacgctgaccgttaccagaaacgagcggaaatcattaagacgaatctgattgataaattatatgacccgcaaacaggccggttcttcgattcgttaaacgcggatctatctgttaatcgccatgcatcacatcacgcgtctgcttacgcgctttgctatggcgtttatactgatcaggatatggccgatcgattaagtcattttgtcgccaatgatggtcattttgtcggtagtatctactttatctacttcatgctcaaaggactctttgaagccggtcacgcagccgacgccatcacgctgttgaccgaccctgacaaccacaaggatcataagtcatttgcggcgattttagacagcttaaaagcaaccattgccccggaagcttggagtaatgcgtacaagccaaatctcaccttatcccatccgtggggcgccactcccggcttaacgattgttcaaggggtctttggcatcgtgccgctcgcgcctggatttacaaccttcagagtcaaagttcgccctggcaatttgaagcacttagatctcacgacgccatcagtcaagggacttatcaccctgcattatcgtcacgagccaacacaccagacgcttgacgtaaccgtgccaatgaataccaccgcacaagttgaattacctgatgatgcccacgccattgtcgttcacgaccagtacggaaaagactggaccacttcgatcgaacatgaccacgacaccttgtccatccccatgggtcgctatcagattcaatatcaagcttagtgtctaccaatcttaagttttcatgactttggtcaattttacattaaacaaaaaccagctaggcagcaattgactgtcgagctggtttttgtgtggtgagagcgagccggcgcgattagaagtcggagtgtaagcgtccttacacgcagatccctgagctggtgaacgcgttatggttgttgcggaccgaatcatctagctggttttaattggaatcgctgaccagggttgtcttcatatcaaccttcgtcgtgataaccccatcctgataaaacacatcggcaatggcgttttcttctgccacaatgctactgttggcactaatcagcgtcatggaataggtgcgccgttctaccatctttttaatcactttatcggagagattgagggttttactgagcatcgcaatgagttgcgtatgatggctattggcccaagtcatatcgtcatttagttcagtcgtcagtaacttacttaatgatgtatgggtcttggcatagctctgggttgaaatcaggaaatcacggttcttggtcaaaccggtgccgttggtcaacagcttagcaccttgattgacttgggccgttgacgtatatggatcccaggtaacccatgcatcgacactacctttagcaaatgcaaccgaggccgagctttgatccatgttcaccagtttcacatcactggtgctgagtccggctttcttgagcgcctggatgataaggtactgggcggcagtgcctttttgatacgcaatggtcttgccctttaattgctcaagactggtgatgccgctatttttaccaaccaaaataccactaccatattctttggtggccccagcggcaattaacgcaatatccgtgccagttgctttggcagtcacaggcggtgtatccccgacccgcgcatagtcgatggcaccgcttttaagtgccgtcatcaaggctgctccgtcagagaactccttgaactcaacctgatagccttttgctttcaactttttggctaattcgccacgctgccgggcaatgtcgacaggatcggctttttgatagccaatcgtgacggtctcaaggttgctcgatgccgtggcggtttgcgtataaccgtaaaccgccacgctcagccaagcgactaagcccactaacaataaaaccagtcgtaacttacgcttcatatagcttcccgccttgcattagttgtttgcggagtttcggccgtagtaccttaccagtagcattcaccggaaaagctttgacaaaaacgacttcggttgggcattcataagcggctaaatgtcgacgggcaaaattgagtaaatcaagcttggccttttgcgggtcttccgtggcgtcttggcgaatcacaacggctgtgactgcttcaccgtataagttatccggtaagccgataatcgccacttgggcaacccagtctagttcgtttaggacattttcaactttggccggggccactttttcaccgccgcggttaatcatttctttgcgccggcctttgacaaacagatagccgtcttgatccagatatccgaggtcaccagttagaaaccagccattttcaaaagattccgggtgtggctcaagataatcatgaataacgtgatcgccacgcagaacgatttcgccttcaacaaatggctttttggtaaaggtgccatccgctaatttgattcgcaactcagtccccaccggcttaccggctgaaccgattttcggggcatgaatcggattaagcgtactttgactagccgtctcagtcatgccatagccttccagaacctgggtgtgaaaatgcgactgaaaggcaaccagcttatcttctggtaatgcaaaggaagagctgcggacaaagcgtaaatgaatgttgctgttgtaagccgctaacgcctgttgattcatcagcaagattgaaatgatcgtcggaaccaccgagacccacgtgacatgattggtttcaatcgtcggccagaatcccgaggcggaaaacttcggcgcaatcaccagcttaccgcctgacaacctagtagcaagtaccgagatgacctgggcattaatatgaaacatcggcatgaccaccatcgcggtatcatccggcgatagtgcgtgactcttggcatcatgaagcgcagcatttaataacatccggtgcgtcaagccgactcgtttaggtttgcccgtggtcccggaagtgttgaggatcaatgccaagtcgtcctcttgtggccgtgcttgaggggcattaatccgataagccaactgactcgcatcggtcaggattgccaactcggaaatggtatgcaactgtactttctcccaaggaactagcggggcttctaaagctttgcccacggtcggtaacgtgatgaccgcttgatagtggtaagtttcccattccgtcagcaattccggtagtggcgttttggcagcgattggatgggcaacagccccaatttcccagagcgcctgattaagcggtaaaaagaccggcgaattcggtaaagcaattaagacttggtcgccggcgccaattttctgctcagcaaactgatcacgtaatgcggcaacatcttcttccaaatcgcgtccggtgtaccaagtattagcctcaacggatttgactaatgggtaatcacgatgattgatgagattctgagataactgatcggtgagtttgctcatgattcaggactcctttcgtagctaacaacaatgactgcggacggccaatgagccatccaaacggggaaactttgtaacaaaaccaagcgatggcaaaggaaatgccgagaatgctgagataacccagcggcaacagtagcattaacatgagattactaagatgaaccagttccaagacaccgcctaatagcgtgatggcaatggtttggcaaagatagacaccaaacgaaacttgtgcgccatgaccaaccaaacgagcaaaccagtgcgttggctgtttggcgtgccacctggcatacttttgaccaaggatggcgacaaaggcgatcatcaccacgtcatataccaacatatacggctgatgaggtgaaaccgcagcactgtgagtcaggccaagaatctgtttgttgaagccataaagaccaactgttcctaagctgagaaacaaggtgctccagccgatcaggcgctgatgggacattaaccaggttttaatcgcttgggcgtgtaggctgaataaaccaccggcaatgaagaagaattggtaggtcacaacattgacgccatatgctctaaaccaccataaccagtggctcgtgtcgatatgcggcagcccatacttgatgcctgcgacaatgagtaactgtaaagtaaaactagctagcaacaaggcgccgtgatgcttttccgtttttttgaatagccaaagcatcgccggaaataacagatacagttgtaaggttaccaagacgtaatacagataaaattgatcaccatgcaataaggcactgagataatccggccagaagttggcaacggtgaagccgccaatgcccagtagcacggcactgatcattaagatcgtgttccacaagacatagggaacgccaactgtcgtgaaacgttttttgaagaaccgcggccagttacgttgccgggagtagtagaccatcgtcagcaccagccctgtcatgaacatgaagcccatgcgtgtgaagtgaatcatgaggtgggtggcgagcaaagccgtgctggcaaaaccagaagacatttgatgttgaaatgccgtggtggtgtggttcaacaaaacgccggcaatgaagatcagtcgcattaagtcgatctcataaaggtagcgatgcttagttggctttgccgtcgtagcattcgctgttgcctgcacctgtttcatacggtcaccggctctgctagaatggccttcaatacccgcgctgccgtttgggcaataacttctggtgactcaccacgagctcctgctgtttcggtgaccaactgaccatctttaaccacgataatccgatctgccatccgtgccgcttcattaacatcatgcgtgatcaacatcgtactcagcttttgggtagtgaaaatgtgtaagatgagatcttgcatccgttgacgggtcaacgcatccaaggcgcccagtggttcatcaagcaagagcagttggggcttggccaacaatgctcgtgctaaggccagacgttgtttttgaccaccagacagttgtgccggatagccatcacttttatcggccaaaccgactgcttttaacagcgacttagcctccttaaccactgccggatcatgattcttgaacgaaacattatcaagattggttaaccacggtaaaagccgatcattttggaacatcacgcgcattaccaagtcgttttcgcgcgtcagtttgccagcagtcggggcttcaagtccggcgattaagcgcagaatcgtacttttaccgccgccactcatcccgactagtgctaaaaattcgccgggataaagattgagttgaatgtcatgaagaacggttttatcaccatagactttttcaatatgttgaagtttgacaattgggttagtcattttcagtccctccttgccgccaaccgaggaataggcgctccaagctttttgcgatcatatcggagagcttgcccagtaaggcgtaaatcaaaatgcaaagtaacaccgtatccatccgcataaattcctgtgcattggtggccatgtagcctaagccagatgtggcggagatcgtttcggcaacaatcaaggttgtccacatcacccctagcgcataccgcacgcccataagaatattggctaaggcacccgggaaaacaacgcgggtgaacaatgcgcgtcgggataagccataagcacggcccatttccaataactccggatctgcgccgacaatgccttgatacgtgttgatatacatcgggaacataaccccgatggcaaccaacgcaatcttggccggttcgccaatgcccattaagataatcatgagcggaattaaggaaaggtgcgggatattccgcaacatttgaatcggactatcaagcaaagcgcgaatcggtttgactaatccgttgatcaggccgagtgcgaagccgacactaccgccaatcgcaaacccagccgtggctcgataaagactaatggcaatattctttggcaattcaccgctttgccacagcgagatcccgtcttgaatgaccgttgacggtgcgggaatcaaggaactcgtcacccagttaaaactgaccgccgcctgccagctcatcaggaacgcgagcggtaccagccaaggcaggatctttaaccaattcacagacggtttaacccgttttttcggctcctgcgtcagtgtcgtgacttcttgcatcagcgccatctcccttaagttgatgatgttcatactagtagcggtaacttaaagctgacttaagcaagtttgaagagttcgtgacgaaaacggcatgaaaaaacgcccgcttcactgtcaataacagttaaaagcgggcattcccgtggatcagatgtgtttttgaaagagaaaatagacaattgataacaattgacgtcatctaaaaagaagccggtgaagcaaattttctcagcaagatcaattaagcagtttgccttgaccccctaaatatttggttgttaggtcaatcacgcgttgggccgtttggtcaaccaacgcttggcttgtgttttcatttccttggacgatgtaataaagatgggtggtttcaggcgtcactttcgttttttccacttgccgggtttctaagtggcaaatgatttcgttgctgtcatcaacataagcgtactcgcctgctttaaccggttccggctgaccgtctgcaccgatgggaacgaaacgctcggtgccatcagtcagccgtaaattgacattgccatcaatgtgcgcaatgtcgtgggcgccaagagcaaggtgactttgaatcgaaatgaggttgtataagtcaaccactggattaatgggcacaagctccccgcgtttcaaaattagcttcaataatgttgctggcgctggggtgttgttgcgcttaggcagatgaacagcacgatgcaagtcccaaaagccctgaataatcggatcctgcttaatctgatcgcgattcaatgtttccaaaaccgttgcaatctctgtggaaatggcttgttttagagcttgcgggtagtggtgattgtcgatgccggttagctcaacgccgcggattttgacgcctagtgctagtactttgggatcgatgatgaagttcatggctattcctcactttctgggggtgcggtggctgcgttttttaggcgggagggagttctgtttttcggttggttttgggggcgactttgcgttctataacgcgattcctggtgcagaaatttgcgtgtaagggccttagttgcaatggctaaagctcggccattgtgactgaggccgcttatgttccggcttactcccataacgcgctccccggcgcagaagtctgcgtgtaaggaccttagccgcaatggccaaagaccggccattgcgactgaggccgcttatgttccggcttactcccataacgcgccggctcgcgctcactcaaaaacagcatccatccccgttttaccaagggacgaatgctgcaacgcggtaccacccaaattcacattaccttcacaagcaatgcctcaacgacgccgaaattcatgatctttcgaggtccggaaagttaacggctccgaccgactagcctgcgttaacaaactaatgacatggcaaagctcatcttcacagtggttgcagtcatccttttccaccagccggattctctgtggaccgaaaccaccgttactcttctttgcgtctttaacgattttgaattaaccctatgctaattcgagcattaggaaaagtcaatcaacacctgacaatagtagccattaatcaacgtcaaaagttagcgccttatctatccggcagcacatgctcatcaccatacagttcagcttggctctgccataattcgcggaaataggccgagcgttgaagaagctcttctcgcgttccgatatcttcaattcggccagcttttaataaaataatttgattggctaatgtcaccgcgccgatacgatgcgtaatgaatagtgaaggggtttccttagacagccgtttgatttttgtaaataaagccaactcttttaacgggtccatcgccgcagaaggctcgtcgaggatttgataaatgcctcgcttgtactgtgctctagccactgcaagctgttggcgttgcccgccgctgggttgaaaattgccttgctgataacttccgatttcagtggcggcttgttttggcaagtgcgccacccaactgtcaatcccatttgctgccatcacctgtgcaagccgatccttatctggttgagtgctggcggtaatgttttcggcaattgcaaaatcaaaaatggcatagtcttggaataccactttgaatagtcctaagtaagcagccgctgatattttagcaatgtcatgaccgttaaataagattttcccggcagtcggttgatatagtcccagtaacaatttgactaaggtggtcttgccactgccatttacaccaatcaacgcagtcacgccggttaagtcgagagtaaaggaaatatcatgcaagacctcctcgccatccgggtaggcaaacgaaacatggtcaaaaacaatggtattttgccgttgaactggcggggtcttactcgttggcgttgttgtttggttcttagtggtcaatatctcattgacataatccatctgattctcaaagcgcaggaatcgttgccaagtcgctacgatcaaactagcagcactggtcatttgaaccacgctgccaaataaggtattaagctgccccaccggcaacaagccgcgataaattttaaacacaattaatagaaacaaagccatcgtcgcaaacgccgccattaaagcagtgatcatttgcgaaccgctgtcgttaaccaccagcttatgattggcagtcttttcctcagtccacgttgcccgatagcgttgttgaatcggcgtacctaaaccccaaatcttgatagacttaagtccttcataggcgttgacgacattcatcagaaaatagttcatttttctttccaagcccatcaaatccttgaacaacttaaaacttgcgcgcgtcagagattggtagatgtgaatgagcaatgcttcgcccaaaaataatgtaagaactgtcactaaaactaccgcggtaatcacttgactgcgtgtcgtcccagcaaccactagccaactaatcaagcctaaaccgacaattacggtcacaaccccttgaatcaggttttgtaattggctaaagaaaaccggaatcccgcctgagtaacgaaatgacgcctcacttttcatcatcttggcaaaatagcgctgagtctcaagtgtttgaaaatcaacctgctcccaagtttcatacattgccagttttagctgctcattagcctgaagcgttttaacttccaaatagcgctgaatgcatacggccatcaggtaagccccgccagccgtcccataaaaatagccaataagtgtcggtaccgtttctagatgacccgccaaaatagcgttaatgatttgggtattacccagaataatcagaagcggcgcaatggcgttcagtgtgctcatgaatattgccagcacaaaaaggcttttcccaaaccgggcaatcaagcgtcctgttgccaaggcttcttgtagctgggctttaagctgtttcatgatcgccacctccaacgtacattgaacgctgtgcttcccataaagcgcgataatcagcagaattttccaggagccaatgatgcgttcccgccgccaccacggttccgtctttcatcacaaagattttgacattccgaaccgcaagcgcaccaagccgatgagcgacaataatcgtggttttattgacgagtttttcatcgattaaatcgtaaaattgtttctcactcaaaggatcaagcgcggctgtcggttcatcaagaatattgaagtcggcttgacgatacagtacacgggcaaatagcagtttctctttttgcccgcctgacaattgaatcccatcatccgccaattcgttatcgataaaagtctgcacgccttgaggaagcccagcgacaaaagcacctaaccccacttcatcaagcaccgctttaacccgatccaagtcgatcttttcaggtgttgtgcaagcaatgttttctgcaatggtgaagtgaagtatcacgtcatcttgaaactcaacggccaaccgacgctgaatagcagcaggcgtccagtccgaaattgcttggccatccatgacaaccgatccggctgttggcaagtaaagtccgcaaagcaatttgatgagtgtcgacttgccggcaccattttcgcctacaattgcgactaactcgcttggcgcaatggaaagattgacatcgtgcaaaataggcgtcttgttgacttgataatccacatgcgtcacgttgattatgccagtgccactaaaatgttcggcatttttgtgctggtgatggcgataaggaaatgccataaattttcgaaagttatcgacaaacaccagatttttccctaccgccgcgtacgcatctctaagttgaccaaagttactattaagcgtttgaatcgccgtgataaaaaacagcagactggcaacagaaatattccgggttgccagcaaaatcagtaatgacagcgctagaccgccgacattcacgatgcgctgaccgagattcaccattaacgtgatattggcataatgtcgctgccatgccactaagcgctgaattaaatcgctaaagtgctggtggaaaaccccaagcatcgcaaacaagcgaatatctttgccggtcgaacgcttcatcaacgttcgaacaaaataattctgataactggtaatacgattctggctgtctttatgcttgaaataccattgattactcagccgctgaaacaggtactgcaagacattaagtccaaaaaccaccgcggccggccaaaaactcagtgtccccatcatcaccagcaacaccgcaatctgacaacccgtgcgcaccaaaataatggtctgatcgacaatcgccccgataccaacattagccccattataaatagcttcatacgcctgatcgatgaccgtttttcccgccaccgaatcaatcaagcgctgatcccaaccgaaaatatgctccgaaaacaccggtacataatcaaaacggaaatcaaacgtcaatattgacaggcactgctgcaagaacagatccaaaattctgataccatagacaaaaacgccagcaataaagataactaatatcgtcaacccgacactcaactgcttggtttctaacaaaatgactgcgagcggcggcagcaatgaaatcccaaccacataaacgatttcgaccaaacacagcccgcccaataaggctccgaacttgaagcgatatttgccaataaatttagcaagtatgtagcgccagttgctagcttgttccataacggccaccccctgatatcaccaaaggcttacgtttgttaaaagcaaaagtcaccattcacagtgaaaatgagcacccatgtcaagattgttttgtacaagcgcgaggataacttttcatgtgctcacactgtttaagaaatgattaaagtataacttacacctaaaaaaatgcagtcgcaaagtatgccaacctttgtgtagcaagaacagtatcatcatgactaatctagcttccgaataaatcgcatccaaataagcaatgaagacagtgccagcccaaccgcactaaggatcaagacattccaccccaagattggaatcacacggccaaataaaaagtcggccggcgggattaaaagcgcactaaaaataaacaagattgaaaaaacgcgacccagataatcattttcagtgattaactgtagcgcagtgaataccttggcattgaatctcgtaccaaagaagccattgataaacgcggcaaaaagtaacgcgggataaactctaaagatcccgggaatgagaatggacaaagcaagcaaaagtacatctatgtagtaaccattcttcccacttttttggttaaacagtgccaacaacaagcctccgacaatgccgccaatcgcctcgatactgatcactgcgctataccaatcaccatttaaatctaacgaaaccttcaccaaatatggtagtgaaagcgtgtaagcttctgcaaaaaaattaatcgtggcaattaataccagtaaccccaagattgtttctttctttcgcacataggccataccagactttaatttgggcaagatctgcaatttttctttatgactgtttttttcggtataccggatggttgcgattaataaagcggacaaaacaaacgaaaccccattgattaaaataaagccattaatgttactgtgaagcttcaataacaatgcgccaaccaacgggccaaccactttgatcgtacttgacaacgtattttgaaccgaattaaaaggctcgatttggctttcatgaatgacattaggcacaacggcttttgctgacggcgaattaaatgccaacgaaacgttaagcaccgaactcgtcagaatcaatagcagtttgcctgccacaacatcgcgaagcaaaaaggcgcacatgaaacaggtcactccgctcaacagatcagcaaaaatcatcatgtgtttgcgattaaacgagtcaacaatcgggccagcaaaaacattggcaacgataaggactataccgctgataccgttaattaatcccaaaagttctgtttgatgcgtttgctcaactaagaaccagttcatcccgtaaatatagaccatgtcgcccagtaaagagaagccgtatccaagaagcaaaggaagcgcgttttgcattcgcttaatcatgatgtaattcctcgctgttcgagcattcgatggtatttgtatgtaatgcacttatcattttaatgacctcgccagattgaattgtcgtcattgttcgcgatcaatcacgctgacttcagacgcctatcactaaaaggacaccgctagatttctttgaacaaacacatgctttccatcataaaggttaagctaaaatttatcaatcgttaattttgttcttctaatgctaggtgctggatcaaaatgataaattcgcaagtaaaccgcgaaagcttccaaatctcctaaaaatgaagcgtattttggacagcaaaaaaccacccgaacagataactgaagtgcaacaaaaaagttagacagttggaaaattagttacgcagcggtctgattccgatattcaatcggggtcaggccatttttattgagtgaaatacggtcatgattaaaccacgtgacgtaatgatctacgatttgcttcagttcctcaagatccttgattggttgccgattgagccgttctcgtttgagtaggttgaagaagctttccattggtgcgttatcatggcaattacctttacgagacatgctgggaacgatgcccatggcgtgcacctgagactggtattcacgggtttggtattgccacccttggtcagagtgcatgatgggtgtgacgccagcggggagtttcttggccaaatcgtcaagcgttaggtggagttgttctttgttcgcagagttgcgcacaatgactgtaataacctctcgactggcctcgtcaatgatggccgagatatagccccagctgtggtcaagcagtctgacttgcgttacgtcggtgtgcaggacagcgaagggctcctgggcatcgaattgttggtgtaacaggttgtcgttcacggtgcctacttttcccttataggagtgatagccgctagtatggcgagaatacagtgtgacactaagattcaattgccccattaaccgtagaattgtattgggtgagcatttaaagccggcttttcgtgccatcacatgaatacggcgatagccataggtctcatatgagtcatggaaggtcttcttgataaataccttcaaggcggcatatttatccggcttattcttgcggtgcaagcggtcatagaaagtagcccgaggcaactgtgccaatgccaataattccttcaatggatagtcatgccgtaacgcgtcaactactgctgttttttgggcggcagattgttcttcgatacggcccctaatttttttaaaaagtcacgctccattcgcgtatggtataactcgccgcgtaatttcaggatctcttgctggtaagcttccttctcactaagctcaagcttcttaacttgtttgggtttcttatgtttcactgtagaccgccttcctcgcggtttcggacgcaacccagccactccctcagtcttgaagatctttgcccaaacagtcacctgcgaagcgttgatcccgaaatgagcagccaccgatgccacaccttcaccactggtttgataatagtctaccacggccaacttctgttccagagaataaaatgtcttcgtatgctttcgctgaagagattcaagtccatggacttgggcttgcttaacccactctcggactggtttcgttgacgggatactgtatttagtgcaaaggctgttataggaaacccgtccagaaagatactcctgtacaaccttcaccttgaactcacttgaatatttagtcataaaaataccccacaatcattagagtatctgtctaacaattatggggcacttcataactgtccaggtggttccaaagttgatgcatataatatgcaccattttgccggtcgctctcggcgaattaacgcttggagaactgactagctttacgagccttcttcaagccatacttcttccgttccttcatacgagggtcacgggtcagcatgccggccttcttaagcgggccgcggaagtcaggatcaacggtcaacaaggcacgggcaatgccgtgacgagttgcgccagcttggccagagaaaccgccgccattaacgttaacaagcacgtcatagctgccagtagtttcagtgatgccaaatggttggcttaaatcggtgatcaggttttcatatggaaggtagtcgcgaacgtctttaccgttcattgtgatcttgccggtaccaggaaccaaacggacccgggcaacggagttcttgcgacgacctgtacctgcgtattgtacttgtgccacagtaattgcctccttagattaagtttgaaatgtcgagtacttctggcttctgtgccaaatgtgggtgttcctccccagcatagacatgaagcttcaagaattgctgatggccaagagtgttcttggtcgggagcatcttcttaacagagtattcaaccagacgagccgggttgtcccgcaagagatccccagcgatttcatgtttcaaaccacctggatgctgactgtgacgatagtaaatcttgtctgaggcttttttgccagtcaactttaacttagaagcgttgataacgatcacattgtcacctgtatcaacgtttggggtgaattgcggcttgttcttaccacgcaagatcgaagcaacgacagatgataaacggcccaacgcgatatccgttgcgtcgatcacataccatttacgttcgatttcacctggcttagccaaaaatgttgtacgcacgatttgtttcctccataattctgtgcttgtttgaacacgttaagtttccggggcttatcgtggggcaaacaataccagctactagaataccaacgattagcgctcaagtcaatgtaaaattcagtatcctactataaagttgcactcgcagttcgcgtttttatagcttcaaattgttccttgccccaaatgtgcttgtctacctcaaatactgcttaaaatgctgcttccattaataactcgtctgcaacactccactcgatgcttcaatccttgtgtccttccccattggcttcgggccgcaaaacaccggtacaaaacatctgcaaagcacgatcaagcgacaattgattttgaaaagtgttcccgcgactggtaccaacagttggctgcaaataagcggctaaaacggttaaaaaatagagggtcacgtcacgcacgcgatatgtcggcgccagctgttcgtcaaaggtgctaaaaaaccgatctaacggcgacaacaagccaacttgccatgcctgaaaaacatccgcctgtgccttagaacttaaattcccgacatcatgtaagacgagttgcaagttcatcatgttgtcatcggtgagtaaatgcccgaggcgcttgacttttttgccaaaattttgggcatctatttgttcatgggcaattttacttgccatgtcttcacttaccgccatgacaacagcaagatacaaggcctctttggttttaaaatagtgatacagcagcggttggcgaacgtcagccgcttcagcgatcattcgggtggtcaccgctgtgtaaccgtgattcataaataatacctgagcggcggttaagatccgctgcacggtcgctttcttctggtcatttcgttgtgtcatttttccaagcccttttcatttatcatatgataaacaagtgatatactgattgtgcaaaactaaatatggaggtgatcgtgatgttccttgcgtataaagagattattcacaacaaagcccgctatctgctcgtcatggcgacctttgttttaattgcctatctggtcttttttctaaccggtttggctacaggtttagcgcgtaacaatcgcaccgccattgacgcattgccgggtaattacgttctcctgtcgaaatatgccaacaaaaatcttctgagttcgacattgagcgcggatcaaatcaccaaagtcagcaccaagcacaccgccgtcctcggccaagtggcggttgttgcggaaagtaccgcgaatgataagaaagtcaatagtaacgtctttggcatcaacctcaacggcaagctgaagccgactgtcacaagcggacgcctgccaatccatcacaacgaggtactcgcggatgacagtgtgaccatttatggcttgcaccaaggtgatcgcatcactttaaacggcagcagccaaacgtatcggattgtcgggttgacgcatgaccggcgcttttacacggtacctgtattttacacaactttaggcacttttcggcagctaaagttcggacagcgccaagttaaacaggcctccgcggtgatcagtacaaagccgtttaaaaatattccggccaagacccaatccatttccaaagcaaccttagtcgaaaacatccccggctatacagctgaaacgtcgacttttgccttaatgatcggagcaatgattggcattatgctcttaatcattggcatcttcatgtacattttaaccattcaaaaaattgccatgtacggggtcatgcgggcacaaggtattcgcacgcgggcaattattgctgctttgttctggcaaatcctgatgcttgcggtcaccggcgttgctatcggtgccggactgttaggattaacgcaatttattttaccaaaagccatgccattttatgctaatccgccgctttttatcgcgatcgctgccgccttaattttaatgtccctggttggcgggttattctcactacgccggattttgcacattgatcctttagctgcgattggaggtgagtaacatgaccacactggttcaactcaagcaagtcagcaaagtttacggcagtggccatacggcggtagtcgccttgcatcccaccgactttacgctgcatgccggtgaatttgccgccgtcatcgggccatccggttcaggcaaaacgaccttgttaacgattatcggcaatctccagcaacccagtgacggtcagattgtgattaacggtcaggacaccacgcactttaatgaacaccagcggactgatctgcggtttaatacgtttggctttatcttacaagccagcaacctaattccttttttgaccgttaaagatcagctagccttagtcgaccgtttcaatcatcatcgccaacacaaacgctccatgaccgagctctttgacctactcggcattagcgacctgaccgccaattatccgtccgctttatccggtggcgaaaaacagcgggttgcaattgcccgtgcgttatacaacgacccgaagattatcttagccgacgaaccgaccgccagcctcgacaccaaacgcgcactgcaagtcgtggcacttctggctgatattgcccacaaaaccaaacgcggcgtcatcatgatcacccacgacacgcgtttgctggatgacgtggatacgctatatgaaatgcgcgatggtcagctcaagcaactcagagacagagcggccaaaaaagtcacaccgaatccggcgtagatttaatctttttttaatattttaagtttgccgctattccgcatagcagcagcatctaagcgctatcagataggccaaattagcactcttttaaaaacagtgctaaaaatttgcatcatcgcccagcaaaaggcttataatgaatttgtatcaaaaatgagtttatatcatggaggtaatcattatggcaacagtagatcctgaaaagacattgtttctcgatgaaccaatgaacaaggtatttgactggagcaacagcgaagcacctgtacgtgatgcgctgtgggattattacatggaaaagaacagccgtgataccatcaagactgaagaagaaatgaaaccagtcctagacatgtccgacgatgaggtcaaagccctagcagaaaaggttctcaagaagtaagatcacaaaactaaacatcatgaaccgcgcccctgcaaaaagggacgcggttctttttgggtgagcgcgagcaggagcgcttagaagtcggagtgtaagtggcctcagtcgcaatggcctgggtttggccattgcgactgaggtccttacacgtagacttctgcgactgcgagcgcgttatagaaagtatggcaaaaccactaattgcctctaatagaatgttctccgcaagcttccagcctcttctcttggccattgcgcctgatgtccctacacgcagacttttgcaccggtgaccggcttataaaaagtacgaccaggcccgccaattaccccaagagaacgccctccacaacccaccaaccacaaaacctcaaactcactatccaccttccccccttgaccctaaccccacgtcaccgtttaaagttataattgatccaagggaggccagtcaatgacatactcaaccaagcaactcgctgacttagctggtgtgaccatccgcacactacgctactacgacaaaatcggcttactaaagccaacccgcaatcctaacaatgattaccgccaatacacgcaagctgaggtcaaccgcctgcaggtcatccgcttcttacaacttttcgaaatgccactcagccaaatcaaacagctgcttgacggtccaaccgaccaattaaccgccgcgctcatccggcaacggcaacacatcaccgccaaacgcgaccaacttagcttactacttcaaaccttggatcaaactttagaaaaaggggttaacaccatgacagacgacgaaaaatttgctgcttttaagcaacaagccattcagcacaatgaagaacattttggtaaagaagtccgggaccaatacggagaggatgtcgtcgaagccagcaatgagaagtttcgcaaaatgtcccaagcacaagtcgcacagctgaccgcactgcaacagaagattctcgaggaactaaagccactcgttggtacgaccgattacaacaccgctgccgccaagcatcttttcaaactgcacaaacagtttctccaactcacctggccatctgaacaatattccgaaaaagctcaccgcggtctggcagccatgtacgtctccgatccgcgtttcaccaagtactatgaagacggcacaggtaaaaaaggtgcttccaaaactttgaacgccatcattcgccattacacgcgttaacgcaccaagatttcatttcgtgtgcgctgtttaagcattttggcgtgactaaccagctgtcaatttcagcaggatgaattcatttgcaaagaggctctaaagactgacctaccagtccttagagcctcttttggttgcatagtttgtcaactcggtacttcaaaatgcaaaagatcagggaaataccacaaagccaataaaaaagtttgtgtgtgagggtcaataataaacttccttcaagtacaatcccgaagcaggggccgtacctcttgcctgctgcctatccttaacttcaaaaagccgttgaaaatcatgaacatcgcgccggccgttgccaatctccaaagccgttgccactaaaatccgcaccatgttgtacaaaaagccattaccataaaactcaaaaaccaattcattggcagccggatcttcttcaaccgtcgcctcataaattgttcggaccttatctttaatcacaccgccactagctgcaaaactcgtgaagtcatgcgtgccaactagatctttcaacgcaacctcaatccgcttgacatccaacttataaggatagtgtcctgtgtaaaggcgattaaacggattcgtataatagccacgcgccacccgataccgatatcgctttcccttcgctgaatagcgcgcatgaaaatccgccgcgacaatttcagcttttaggatttcaatatccagtggcatcagtgaattcattgcccgcaacatcgactcagccggaatatttcccgggtaatcaaaactaatgacctgtcctagcgcgtgcacgcctgaatctgtccggcctgagccatcaacatgcaccggttgcccttttgccattttcgtcagagctttttgcagaacaccttgaaccgttcgctgcttgggctgaacttgatagccggcaaagttggtgccatcgtaagccagtgtcactttataatgcgtcaatacagtggttcctttctaatacgcgcgcagtaacagcaaaagtccggttaagacaagcataccgcccgcagcaatccagtcacgctgatgataacgtaagatccgatacttggttcgattgtcgccgccttgatacccacgggcttccatcgctgttgctaactcgtcagcggtggtgaagctagaaacaaacaacgggatcagtagcggaacaacagctttcatttgctgaaaaatattaccttcaccaaagtcaacgccacgcgctcgttgggcattcataattttagtggtttgatccatcaatgtcggcacgaatcgcaaggcaatttgcaaaaccaaggccagctcggtcaccggcacgtgaataacccgtaacggttttaacagactctcgaccgcatcagccagtgaaagcggctgggttgttagcgtcagcaaggttgacataaagatgatgagcacaaaacgaacgaaaataaaggccccattaatcagccctagcttcgtgatccataaccaaccccaatgccaataaaccgtaccgccacgaacaaacaatacctgcaaagcgacggtaaacaagatcagccagattaacggccggacgcctcgcaagaagaagccaagtttaataccggacagccaaatcatgaacaaagtcgccacaaacatcattaaatacgtttgccagttgttggctagaaaaacaatcccgatataatagaaactcgccatcaacttggtgcgggggtcaagctcgtgaatccatgaatggccgggaatatagcgtccaagtaatagtttatccacgctggccacctccgatctgtggcagcaattgatccgccaactcggcttcggttaacggctgcggatcaaagtgaaacccttttgcagtcaattgttgtgccatttgagcggttttaggtaaccctagctgattcgccttcaaccaagccgagtcggcaaagatctcccgcggcgttccggttttgatcaaatgtccctttgccatcacccaaaccgtgtcggcataatccgccacatcgtccatctggtgggtcacgagcacaattgtctgcccttcttcacgatgcaggcgttcaaacatttgcatcatttcgtgccgcccagccggatccagaccggctgtcggctcatccagcaccaaaacttccggttgcatggccaacacaccggcaatggccactcttcgcatttgcccgccagacagatcaaatggcgacttttctaatacatcatgcggcagaccgaccatcgtaatcattttatccgccaacgctaaagcatcctgctcgctcacaccaaagttttgcggtccaaaagcaatgtccttagccacggtttgttcaaacagttgattctcggcaaactgaaaaaccataccaactttttgccgcaacggtttcagattcttattactcgtttcattagtgatgaccttatcgccaatcgtgacagttccggaagtcggctttagtaatgcattcaagtgttgcaaaatggtcgacttgcccgaaccggtgtggccgataatcgccgtataactaccatcatgaatggttccggaaacatctttgatcccgtcaccagcgaaaggcgtacctgcctgatacgtaaagctcacatggtcgaatgtaatgtccacaggtagtctaccaacctttcattgtccaaatatgcttctggcattgtgacaccgcgctgaatcaaggcgtcttttaaccgctcggaatacggcacatcaagccctaagcgcaataggtctgtcccatgtgcaaagatctcgctaggcgttccgatttcgttaatcttcccgtcattaagtaaaataatccgatgcgcagatgccgcttcatcaatatcatgggtaattgacaaaacggtgagccccaattcatctttgagttcccgaatcacacccaacacttcctggcgaccggccggatctagcattgatgttgattcatccaggataataatctccgggcgctgggcaataatgccggcaatcgccactcgttgcttctggccgccagacaaccgcgccggctcccggtcagcaaaagccgtcatgccaacgcgtttgagggcttcatccacccggcgaatcatgtcatctcgtgggacaccgcaattttccaatccgaatgccacatcatcggcaaccgtcgcacccacaaactgattgtccggattctggaaaacaatcccaaccttggcgcgaatatcccacacggtttcttcgctaagcgtcatcccggcaacttcaaccgtgcccgattctggcgccagcagtccatttaaatttttcgccagcgtactcttaccgctaccattatggccgataattgccagccactcacctttagccacatcaaacgacacatctgtcagtgcttgacgttttgcttccggataagtgtaattcaagtgttgaacatgaatgacgttgcccacaatgccccttcttcctacgctttgtataccgaacaatgataccatattttaccgaattgttggacgatccctacttcaaatacgagatgtaccgctagtcgtttcagtgaccgccgggactaattagccaattcaatcatcttttcgtaatatccggatcggtacaaagaaacccgaaaaagaccgtaaaaatcaacgcaatcagccctagaagccatgcctgtacttgcaccattccaacatgagacatcacaatcccaaaccgactctggccattgacaaccaattgccgatagaattgactttggataaggaaaatgagccaaaacatgagggctaagcgtccaccttttgccgataaacccacaagtagcgaaatactaccggcaggcatcacccagctaaagttaagaatcacctgtaacaaaaacccatccaatgagtggggatgcgtcagattggcaagcgggtaccactgcgccaaaaccaccacgaggaaccataaaacaataagcggtgtataggccttcattaaagaaaatggtgtcttgcttcgtctaaagcgtgctcccattaaatagccacataaagccgcaaaaagccacagatacgaagaccagtcgatagtcaccgccccattgtccaaccgataaacagtgggaataaacagcccacctatactcatatttgcaggcgtaaatgcgagtatcaaaacgacaaagaagattgaaaggattgtccagccgccaaccaacaataagccaagttgcagcggcgttcgatattgaaaccaagtacgcatattagcatgacctccattatgtcgcagtatacaggaaaaatcggattagtagtgcgcatggagctagaaagtttggcgaattgaggaccaatttaccgcgcgtcatggctggctttgttttaaggctaatgcttttttaactcgaccccagtatttaaaaagaattctcttccgcgtgtcggcgaagagaattctttttagttgatagatttaattacggcaacaagtttggttacgcttgctttcgaggcgctggttcatacttcatcataacgcgctcaccagcccagcaatccacatgtaagagccatgaacaccatggtcaaaacgggtatcacgtccatggtcgcttacatgccgactgctgatcgcaatagtttgcgattgcacaaaaaaatcatttaatgatggagacaccggttgcccggtgctctcaagctagactaagcaggattaaacctgccatcatcgtaacgctccatcgatcaaatgatcaaagttggttgacctcgagggccagcccttttaactgaatttagacgagctcaatgataaccattggtgcaccgtcaccgcgacgtggcgcagtcttcaaaatgcgggtatagccgcctttgcgatctgcgtattttggtgccaagtcactgaacagtttttgtaaagcggacttcacaatcacactgtcttcttgttcttcgacactcgcaatttcgttgcgcacataagctgctgcttggcggcgtgcatgtaaatcgccacgcttgcccaaggtgatcattttttcagcagttgaacgaacttccttagcgcgggcttcggttgtaacgattcgttcgttgatcagcagatccgttgtcaaatcgcgtagcattgccttacgctgtgagctggtccgccctaatttacggtaactcatggattggcctccttttcgaaattagtcttctttacgcaatcctaagccaagatctgccaacttgtttttaacttcttcaagtgacttgcggcctaagttacgaactttcatcatatcggcttctgttttgttggttaactcctggaccgtattaatcccggcacgcttcaagcagttgtaggaacgaaccgacaagtcaagctcttcgatggtcatctcaagcattttttccttgtgcgtttcttctttttcaaccataatttcagcgttcttagcttcatccgtcaaattgacgaaaatatccaggtgttcagtcaggatcttcgctgctaagctgatggcctcacgtggcgagattgagccattagtccaaacatccagcgttaacttgtcgaaatcattccgacggccaacacgggtgctttcaacttgatagttaacccggctgatcggggtgaaaatcgagtcgatcggcaaaacaccgattggcatgtcatcagacttattctggtcagctgccacatacccgcgaccctttttaacggtcatacgtacatggaagtgcccgccgtctgcaacagtacagatatactgttcaggatttaagacctcaacatcaggatcagcgacgatatcagcagcagttaccttagccggaccgttgacatcaatttcgatgttcttatcttcatcagtgttcatcttgagtgccaatttcttgatattcaaaatgatctgagtcacatcttccaatacaccatcaattgtggagaactcatgaagtaccccatcaatttgaatgctgctgacagctgcgcccggtaatgaagaaagaaggatccgccgcaacgagttacctaacgtagtaccgtagccgcgttccaacggttcaaccacaaacttgccatagttggtgctttcgtcaactttggtaatgttcggcttttcgaattcgatcatctagtttgtacccctttcaaaacgagaagtgaagatttgtctgcctgaccgccataacggtcgaagggtaacaattaaacacgacgacgctttggaggacgagaaccgttatgcggaaccggtgtaacatcacggatcgcagtaacttcaagacctgttgcctgaagtgaacggattgcagcttcacgaccagagcctgggcccttaaccgcaacttcaaccgacttcatgccatgttccattgattccttcgccgcagcttcagcagccatctgcgcagcaaacggtgttgacttacgactacctttaaacccgagtgcaccagcagaggaccaagcgatcgcattgccgcgagggtccgtgatcattactaaggtgttgttgaaggttgagtggatatgagccacgccagattcaacgtttttgcggacacggcgcttccgcgtagtttttctacctgccatcgatcaatgacctcctttaattattttttcttacctgccatcgttgcttttttccctttacgggtgcgagcattgttcttggtattttgtccacgaaccggcaagccacgacgatgacggatgccgcgatatgaaccgatttccatcaatcgcttgatgttcaagttcacttcacgacggagatcgccttcaactttgtatgagtccaaagctgcacgaatcttgtcttcttgttctggggttaggtcatcttgacgaacatcttccggaacaccggcagtcttgagaaccttttgagcggttgtcttgccgacaccatagatataagttaaggcaatgacaatttgcttaccacgtggtaagtcgacacctgcgatacgagccatgtacaatgacacctcctattttttaatttatattatccctggcgttgcttatgctttgggtttgcagagcagataatcatgacccgacccttacgacggaccactttgcagtgctcgcacatctttttaacagatggacgtactttcatgagaatttagcctccttgagttggcaactacttgaaacggtatgtgatccggcccttggtcaaatcataaggtgaaagttcaaccgtcaccttgtcacctggtaaaatgcgaatgtagtgcatccgaattttaccggaaacatgggcgaggatctcggcaccattttcaagcttgactttgaacatcgcgttgggtagggtatccgtcacggtgccttggatctcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttactttgccacagcagccaaaatcgtcttgatatctgcaaacaccttatcgatgtcttgatcaccattaacagtgtggagcaaacccttcttttggtagaagtctaataatggcgtattcatctcgatgtttactttaagacggtttttaacggtttccggcttatcatcttcgcgttggaagaattcgtggccgccacagcgatcacatgtgccggcaacctttggcgggttgtagattttgtgataagttgcaccacatgtcttacagataaaccgaccagacaagcggtcaactaactttgcaggcgcaacatcaatattgataacagcatctaacggcttcttaagatcagctgtgatcgtttcgagtgcctctgcttgttggatggtgcgcggaaagccgtcaagcatgtagcccgcatcggtatcggactcagcaaggcgctccttgacaatgccattggtaaccgagtcgggtaccagttgacctttatcaataaagccttttgcttccttacctaatgctgtgccagcagccatcgcggctcggaacatatctccggtggaaatatgtgctatcggataagtatcctcaatccgttctgcctgcgtgcctttccctgcaccgggaagtcccattaaaatgagattcacgttgcatcctcctctaattgtacgcgctggcatgtatttaaaactgctgtgaacagcttctaaacgatttaacgttgaaacttgccagtttgtacgctgcttttaacgcgtcaacctttgaaaatggctgacttctgatatcgtttacttcttatcgttcttaaccaaatcgccgcgaataaatccgacgtactcacgcttcatgagtaagccgtccaattggcgaaccaattcaatagcggtcatgacaacaatcaacaggctcgtaccaccaagtccgattgattgcggcagcccccaaatgttggcagccagttgtggcagtaaggcaaccaaaccaaggaacaaagcacccactgttgataagcgcatgagtagccgtgagatataattctcggtttccttacccggccaaacaccgggaatatagctgccttgtttggttaagttttctgcgaccttctcgggattaacctgaacgaacgcatagaagaacgtgaacagaataatcaaaagcgtatagatcgcagttccggctggcttttgcatattgaagacattagtcatgacttgataccatccgtcagtcccatgattcttctgaaaagccattaaaattgtttgcggcgtcacaataaaggaactcgcaaaaataaccgggataacaccggcaacgttaactttaagcggtaggtaactgttgctgcccgcgctggtaacgcgccgagtgtactgaattggaattttataattagcttgctgcacccaggtgacaaatgtgataaccaggatcacgatgactgccaaagctgctaaaaacgcaattcctttccagatttcagaaccagagtatacctgaacgttatcccgatataactcttggagacctgaaggcaggcgtgccacaatcccagagaagatcaacagcgaaaccccgttaccaaggcctttatcagtaatctgttcacccatccacgtcagcaacattgtgccgcctgtaaggatgataccgattgtgatataggtactaacggacggatttttaaccaagcccatcgaacttaacgtttgaaagccggccgtaatcccaattgcctgaaagaacccaaaagcgatggtcagataacgagtaacttgattcagcttacgccgaccgacttccccttgcttgctccactcgacaaatttcggaacgatatccatctgcagcagctgaaccacaatttgggccgtaatatacggcgaaacccccatcgaaaagatggagtattgtgccaatccgccaccactgacagtatccagcagtgagatcaagcctgtcgagccgattgactgcagcgccttggcattaacaccgggaaccgcaatcagtgtacctaatcgatagaccaataaaaccgctaaagtgaagaggatcttgttacggatgtctttgaccttgagcgcgttttttagggtcctcagcattagatcacctcaatcgaaccgccagctgcttcaacggcagcttttgctgcggttgaagcttttgcaaccttaatggtcaattttttctcaagtttaccgtctgccagcaacttaacaccgttcttttcgttcttaacaatcccggcatcgatcaaggctgctggtgtaacttcagcaccgtcatcgaagcgattaagatcggaaaggttaacgattgcatattctttgcggttaatgttgttgaaaccgcgctttggcatccggcggaataatggcatctggccaccttcgaagccaagacgcgtcttgccgccttgtcgtgccaattgaccttttgtccctttaccagctgtcttaccttgaccgctagaagtaccacggcccagacgcttgcgggcatgacgggagccgacactcggctttaattcgtgcaattgcatactcttgggcacctccttgtcgaaataatgtattaatctttgatttcttcaaccgaaaccaagtgtgaaatctggaaaatcgcaccacgagtggctgcgttgtctggtttaatcaccgagctgttcacccgatttaagcctaattccttcacaattttacgttgcttaggaagacggtgggcagcactacgggtcaaagtaatcttcaattgagccatgtgtttacctcctagtcttcaagcgatgacgcagaaacgccgcgtaattcagcaacttgttcgcgggtgcgcaactgtgtaagtccatccattgttgcccgaatcatattgattggtgtgttacggccaagggatttgctggtgatatcagcgattccggcaagttccataacggaacggatagcgccaccagcagcaaccccagaaccttcttcagcaggcttcagcaaaacttcaccagcgccgaagtggccgattacttcatgaggaatcgtggtgccgacaattggcacttcaatgaggctcttcttagctgcgtcaacagctttacggattgcttcaggtacttcttgggctttgccggttgcgaagccgacgtgaccgttcttatcgccaacgattgcaattgctgcaaaccgtagacggcgaccacctttaacaacctttgtaacccggttgatggcaacgacctggtcttctaagtccaattggtttggatcgataaatgatgccatgtgttggttatcctccttttttctagaattcgaggccattttcacgtgctgcttcagctaaagcggcaacgcgaccatggtacagataaccaccacggtcaaagaccacaactttatgaccatctgcaactgcgcgcttggcgatcaatgcgccaacctgagcagccgcgtcagtcttgttttcaggatctttaatgtccttatcaagagtggaggcacttgctagcgtcacacccgctacgtcatcaattaattgcgcgtagatgtttttattggaacggaaaacgttcaagcgtgggcgctcgctcgtaccagaaatcttgcctcgtacgcgggcgtgacgccgttgccgagtcttattcttatctggctttgaaatcacaatgttcacctcttgttaaatttgttgaaggttacgactacttaccagtcttaccttccttacgacggacatgttcgtcaacataacgaatacctttacccttataaggttcaggtgcacggacggaacgaacaacggctgcgaattgaccaacaacctgttttgagatcccactgatgatgatctgagtggtgcttgggacttcaacagtaacaccttttggcgcggtcatttcaactggatgtgagtaaccgacgttcaaaacaagtttttcgccttgcttctgcgcacggtatccaacaccaaccagcttcatttctttcttatagccttcggtaaccccaacgaccatgttgtttaagttggcacgcatcgtaccatggatggccttgtaggaatcatcgggacgggtgaaattaatttcgtcgccttcctgatgtaattcgatttccggggcaaaatgacgggtcaattcgcctttagggcccttaaccgtaatattgtcaccatctttggtaacagtaacaccggctgggactttgatgactttataaccaatacgactcacttatcggcacctcctttttgatgttatgaattaccaaacgtaagcgagtacttcgccgccaacgtttttggcacgagcttccttatcggtgataacaccttcggaagttgagataattgcaatccctaaaccgtttaaaaccttaggaacagcatcactcttaacgtatgagcgcaaacccggtttggaaatccgcttcaagccggaaataacccgttcattgttcttaccatacttcaagaaaatgcggatcacaccttgcttgtcatcatcgataacttcgtagtcacggatgaacccttcacgtttaagaatctcagaaatgtctttcttcatctttgatgcaggtacgaccaaggattcgtgacgcaccatattagcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgatatacggaatgcggacggccacaccgttggcaccgcgtatattcctggactgcaaattttgcaggccgtttgtttttagcgatcattgacttcttagccaagtagcggacctcccttatttggcgaatggcatcccgacttgcgtgagcaactcgagtgcctcttcatcagtatttgccgttgtaacaatcacaacatccaacccacgaacccgattaaccttatcgtaatcgatttctgggaagatcagttgttctctaacacccaatgtatagttcccgcggccatcgaaggacttaggggaaataccgtggaagtcacgaacacgcggcagggaaacattgatcagcttatctaagaaatcatacatgcgttcgccgcgcaatgttaccttggcgccgattggcataccttcacgtaagcggaaaccggcaatactcttcttggccttggtgatcagcggatgctggccagagattagcgtcaattcttctaccgcttcatccaataacttagcattctgagttgcatcaccaacacccatgttcaaaacgatcttttcaatcttaggtgcctgcatggtgctcttatagttgaacttgcttaccaatgcaggggcgatttctttgctataacgttcttcaagacgattctccatgaaaaagtttgtcctccttccctattatttatcgattgcggtgccagacttcttagcaatccgcactttattgccatctttaacttcagaaccgatgcgagtcggcttgttggtttcaggatccagaagcatcacgtttgaaacgtgaataggtgcctctttgtcgatgataccgccttgcggattcgtattgttcggcttctggtgcttcttgatcatgttgatgccttcaacaacgactttgtcagcgctcttgaggactttcgtgatctggccttctttgccggcatctttgccgcgcatgacccgcactttgtcaccagttttgaacttcatgtatcgcacctcctatttggtcagaatgattaaagcacttcgggcgctaaggagacgatcttcatgaaatcgccgtcacgcaattcacgtgccacaggtccaaagatacgagtcccacgtgggctcttgtcagcattgatgatgacagctgcgttctcatcgaacttgatgtaggaaccgtcagcacggcgagcgcctgacttggtacgaacaatcacagctttaacaacatcagccttcttgacaacgccacctggtgttgcttgttttacagttgcgacaacaacgtccccgatattaccggtcttgcggtatgaaccaccaagtaccttaatgacaaggatttcgcgcgcgcctgagttatctgctactttaagacgactttcttgctgaatcacggatttggtcctcctttcactctaaaaatgattagatgataactgccttttcgacaatattcaataaacggaaacgcttattgcgtgataaaggacgagtttccgcgatttggacaatatcgccaactttagcgctattgtcttcgtcatgcgcataaaacttcttggaatacttaacccgtttgccataaacagggtgtgtgttatatgtgctgacttccacggtgatggtcttgtccattttatccgagaccacgcggccttgataaactttacgagaattacgttctgccaaggtaaatgtctcctttccgattatttattgagttcctgttgccgaaggaccgttttgatccgtgcaatgtttttccgaacttgcttcaagcgagcggtgttttccaattggccagtcgcctgttggaagcgcaagttgaacagttcttctttatattgcttctctttgtcgagcatctcagcagtggttaatgcagtaatttctttagccttcatttgattgcccacctacttcctcgcgtgaaacgatcttggtgcggattgggagtttgttggatgctaaacgcaaagcttcctttgcgactgcctcggacacgccgccgacttcaaacatgatcttttcacgtttaacgactgcaacccatccagttggtgcacctttaccattacccatccggacgccgacacctttactggtgtaggacttgtgagggaaaatgcggatccatactttcccaccacgcttcatataacgggtcattgcaacacgcgctgcttcgatctggcggttggtgatccaatgggattccaatgcttccaaaccatattcgccgaagtcaacgttcttgccgcccttggctgcaccgcgcatcttcccacggaattcacgacgatgcttgacacgcttaggtactaacattgattatttccctcctttcgcattattttgctgtggcttttcaggtaaaatttcaccacgattgatccaggttttgatcccgatccggccataagtcgttgctgcttcttcccatgcatagtcgatatcggcacgcaaggtatgcagcggaaccaaaccttcattgtaatgttcacgacgtgcaatatcagcaccgtttaaacgaccggaggcttgggttttgattcccttagcaccggcacgcatggtacgttgcattgcttgacgcattgcacgacggaatgcgatccgttgttcaagctgacgcgcgatgttttcgccgacaagcttggcatccaaatcaggttttttgatttctacaatattgatgtgaacttggcgaccagtcagcttattgagctgcttacgcaagttttcaacttcagaaccgcctttaccgataaccatacccggtttagcagtatgaacggaaatgttgacgcgctttgcagcacgttcaatttcaatacgtgatactgaagcatcttgcagcttcttattgatgaagtttcggatttcaatgtcttcatgcaagtagtcagcaaagtctttgtctgcataccacttggcatcccagtcacggatgacaccgacacggaaaccggttggattaatcttttgacccacgcgttatccctccttatgcttctttttcggatacaaccacggtaacgtggcttgtccgtttattgatcggtgatgcgctccccttagcacgaggacggaaccgtttgagggtcgggccttcgttgacataagctttgcttacataaaggttttgtgcatctaagtcatagttatgttctgcattagcaatagcagacttgagtaccttttcgatgatcggagaaccggaacgaggtgtgaactcaagaattgccagtgcttcagcaacatcgcgaccacgaatcaagtcgattaccaagcgcgctttgcgagcagcaatccgaaccgtcttggccgttgccgttgcagacgtaatttgatcagccatgaatgttgtgctcctttctagcgtgctgttgtcttcttgtcatcggtgttgtgaccgcggaaggtacgcgtaggaacaaattcgcctaacttgtgaccaaccatgtcttcactcacgaaaaccgggacatgcttgcgaccatcgtaaacggcgatggtgtagccaatgaaacttggaaaaatagtagaacgacgcgaccatgtacgaataacggtcttcttgtcgttatctgcctgcgcttcaatcttcttcaggagatgagcgtcggcaaaaggtccttttttaagactgcgacccattgtgtgacctcctttaatcgatgtaacacttcaatgtgtttacttcgtcttgcggtgacgaacgatgaatttctcggatttagccttgtgatcccgggtcttcttacccaaggtcttcttgccccaaggtgataatggtgacggacgaccgattggtgctttaccttcaccaccaccatgcgggtgatcgttagggttcataactgacccacgaacagtcggacggaagcccaaccagcgcttacggccagctttaccaatgctaatcaattcgtgttgttcgttaccaaccgcaccgatagtcgcacggttctcggctaataccaagcgaacttcgccggaagcaagtttgatggtaacgtacttatcattatccttacccagtaactgagcggaaacgccggcagaacgtgctagttgtgcgcctttgccaggtttgagttcaatgttatggatggtggtaccagctgggatgttctttaacttcaatgtgttgccgactttgatgtcaacatcgtcaccggagtaaaccttatcgccaaccttaagtccctttggtgccaagatgtaggacttaaccccatcttcataatgcaataatgcaatgttagcggtccgatttggatcgtattcgattgctttaaccgttgcggccatattgtctttattgcgtttaaaatcgatcacacgataaaactgtttgtgaccaccgccacgatgacgcacagtgatgtgtccgtgagcattgcgccctgctgtatggctttggctgaccagcaaagtcttttcaggctttgtcttggtgatttcagcaaagtctgagccggacatgttgcgccggccattgcttgttggtttgtacttaataatcgccacgtgtttaacctcctataacaaatttttgttacttgttatcgttatcttcatcagcgaagatcttgatttcttttgaatcggcgctcaaggcaaccaaggccttacgacgacgacgcgtcatgccttcgtaacgaccttggcgcttcttcttgccgcgaacgtttgcaatgttgacattaacaaccttcacgccgaagatttcttcaactgctttgcgaacttggggctttgttgcatgaattgcaacttcgaatgtgtatttacggttgtccatttcagccatcgattgctcggtgacgatcggacgtaaaatgatatcgcgtgcttccattatgcaagcacctcctcaatcttttggagcgcagattgggttaagatcaatttcttgtagttaacagcgtccaagacgttgataccctctgcaggaacaactttcacattcggcaggttacgtgcagctttggcagcaacatcattgccatcttcaagcacaaccagtgccttatcgttgactttgattccgtccaagacatttaaaaatgccttggtctttggagcatcaaagctcaagccatcaacaacgaccagatcgccatcgagaactttttgtgaaagtacggatttaatcgccaagcgccgaaccttcttaggcagcttgtaagcatagctgcgtggtgtcgggccaaagacgatcccaccgccgcgccattgtggactgcggattgaaccttggcgggcacgaccggtacccttttgacgccaaggcttacgaccgccgcctgaaacagcggaacggtttttaacggcgtgagtaccctgacgaagggaagcgcgttgcatcacaactgcgtcaaacacgacgttttcatttggttcgactgcccagattgcatcgttgagttcaaccgtgccgttttctgagccgtcttgcttatataaagtaacgttagccattagttattgtcctcccttcgtattatttagctgctttaacagcagaacggattgtaacaaaggacttgttagcacctgggacattgcctttgatcaacaggacattgtgttctgtatcggcggcaacgacttgcaggttttgcatggtgcgggtatggttacccatccggccaggaagcttcttacccttgaagactttgttgatgatagctccaagtgaacctggacgacgatggtagcgagaaccgtgtgccatagggccgcgggactgaccatctttcttgatattaccttgataaccatgacctttggaagtaccggtgacgtccacaatgtcgcctgctgcgaattcgtcagctttaacttcgctgccgacttcataatcactaagcgctacatcgcggatttcgcgaacgaagcgcttaggggtcgtgtcagcctttttggcgtgaccgacgcttggcttattcgtcaagacttcacgcatatcgccgtagcccaactgaactgcttcgtaaccatcagattcaacggtcttgacttgcattacaacgttgggtgttacgtcaattacagtaacgggaacaagttcgccgttatcggtgaagacctgcgtcatgccaacttttttgcctaagattcctttacgtgccatgggtacacctcctattttctaagaattataatttaatttcgatatcgacgccgcttggcaaatcgagcttcattaaagcatcaactgtcttcggtgttgggttaacaatatcaatcagacgtttgtgcgtccgcatttcgaattgttcacgtgaatccttgtacttatgtggggaacgtaaaaccgtgtaaattgtacgttccgttggcagagggatcggacctgaaattgttgcgcctgtacgctttgcagtgtcaacgatcttgtctgcggattgatcgagaatccggtgttcataagccttaagccggatccgaatcttttgttttgccattgtgtgacctccttcgtctattatcagttagtagactagctccgtgaaaattaccaactcgccaccgtggcaaagcggccgggcgtgtcgcaacctctcacatccacgctactctggttcatctctggaaccaagtgcatagttatcccctttgagaaacagcactcttgatagtatacaaaaactcccccgccattacaaggttttctttcgatttgcacaaaaaagtttgtgcgcttgatgctgagaaaagcaaacttgttttactgatcagctgtatgtgctacattcaaattaaatccagtattcgatttgattaaggagcatgccatgaaattcgatcactataaaaagtttatcaacgtagccttggatcttttgctcggtctgctcgctattgttgtcgtcatcttcatgttacgctacattatcgacattgggagtttaatccttcgaccgttatcggctgacctattcggcaaggtcattcaggaagtcacgagtttctttatgctgtttgaatttgtcattatgctgattcgctacattgaagaggggcaccatattccgattcgttatctcattctcatttcgatgacggccattttacggcagctgttggtcttacacgatcgtggtaccgaaaccttgcttttgacattggcaattctcgttttagcaggcgttttgacggtcttctcctttgttagtggcgatttcaaacactcgcgcggagaacaggatattgatatcgatcagcacttttgactgtggcgatcttgttttgccttagctactgatccaggctctgatgtattcttgttctttagctcgggttatatgacttcacgcaaaaaggaatcgcagctgaccgttgcgattcctttttgcgtgaatatatcctgaccggagcattcacaattagataattccctttaattaaagtttgccaaccaagtcagcacccggcttcaaggttttctcgccaggctgccagttcgctgggcaaacctgatcaccgtgagcggcaacaaattgtgctgcctgaagcgtccgcaaaatttcgtcagcgttacgaccgatgccgaagttgtttacgacataagcttgaatcacgccatcagggtcaataataaaggtgccgcggaacgcttgcccactcgcttcatcccgaacatccagcgccgttgccagtttaccagccggatcggcaagcatcggatactgaattttcttgatcgtcggactcgtctctgcccatgccatatgcacaaattcggtatcctcagaagcggaatagatttcggctcctgcagctttaaaacgatcgtagtgatcctgcaaatcgcctagttctgtgggacaaacaaatgaaaagtcagctgggtagaaacagattactgcccacttaccttgcaaatccttatttgtcaccgtgtgaaaatccccattttgataggcggtcaatgaaaagtccggtaaatgctgtccaataaagctcataatattccctccatttttagaatgattattatttacaacttaacggtaccttttcatgcccgcattttcaagcctaaattgccacgaattacctgtgacagttacacacataaatcaaaaatgttgctggttagcttgccttctttccaaaccgccgattaaaaaaacaccatctgtttcaatagacagtgtgtttaaaagtatgctcttaaggcgttatgtgaacttcctagcgcaaacggttcctttcttcatgccgataatgtgccaaaccttcttctaagccgcgaatgacataatcacgaatatactttggcgcaagcactttgactaaccctgcctgtcctagcaaccacatacgaatgccaaagccatcattaaccggaatggtgatgtggtagaacttttgcgcgtaaggattcttggacgttggctgctcatcgactttttcatcatgaacgatggcatccggaaagcggtcaaggacaaaacgcgggtcatagccatacaggatttccagattaattggcttgcctaagtatggataccatgtgtgtttttgtaaccggccgccgcgaaaacgtgcttcataggcatgttgcggttgacgtccatggtaagtaatatggctcatatcatcaagccgaaagcgcacaaactgaccattgtccggatcatcaggctgctcgtcactaccatcaataatgagataaaaaaataagtcaccaaaatataatccagttggtaggcgccgatcaaaatgacgggttacgccatgataagtatgatcgaagctaatggtctcatgtttcaaaatcgcctgactcaaacgtgccaaccgtgctgtgagtgctacttttggtacccctttatactcgaagatcggatttcgtaccacatcgcttaggcttcgatgctccggcccttcaggcagcaactggtgaagtagcattttcatctcggaagttgccaagccccgacttgcggtcaaaatcagcgtcattgctaataactgcccgtcatctaagggactgtggccagttgatagtacagttgacttgaagcgataatcacccgtggtactttcgacaaatacatccggctcgtccatcacgtcatcgaacatccgtttaatgacactaatatcacgccgaatggaagactcatctttattaaactcgtgcattaaggtttgtttgtttaatacctctcctcgcatgagtcgcagcataatcgttacaattcgttcctggcttgacacgttgcgccacttcctaacgtcacctaataataacagtatcatacgcgttcaaaaaacgtgccgtcaatcatctcaagaaaccttccaagctcatgatgtattgaacagcctagagatcggtcgaattcacattcactttccataacgcgttcgccggcgcagggatctgcgtgtaaggaccttgggcgcaatggtcaaagaccgaccatcacggttaaggccacttatgttctagctcatgcccataacgcgttcgccagcccagaaacctgcgtgtaaggaccttagccgcaatggccaaagcccggccatcacggctaaggccacttacactccggtttctaaccgggctggctcacgctcaataaaaaacggtgctgccttgaacaggcaacaccgtttttgtcgtcggtgatcacgaaagactagtctttcgtagcaacaccgccgccatttttcttgataatttcttcttggatgctctttggcacagcttcgtagtggtcaaaggtcatggtgaaagtaccacggccttgggttgcactacgcaaggtggttgcatagccaaacatttcggccagcggaaccattgagttaaccaattgcgcattaccgcgcgcttccataccttcaacgcgaccgcgacgtgctgtgatctggcccataacatcgccaaggtattcttcaggcgcaacgacttcaacgtgcatgatcggttcaaggatcacggcgccagcattcttcgaggcattacgtaacgccatggaagcagccactttaaaggcagcttcagaagaatcgacttcatggtaagaaccatcatatagtttggccttcacatcaattaatggatagccagccaagacaccgtttgccatggcttctttcagaccttgttcaacagctgggatatattcacgcggaacaaccccaccgacaatggcattttcaaattcaaagcccttgccttcttcgtttggtgtgaactcgatccaaacatcaccatattgacctttaccaccggactgacgaacaaacttaccttgtgcagacgcttctttagtaaaggtctcacgataggcaacttgtggttcaccaactttagcagccactttgaattcacgcttcagacgatcaaccatgatatccaagtgcaattcacccatgccggcaatcaatgtttcaccagtttcagggttggtttcagccttgaatgtcggatcttcttcagagagcttctgcaaaccgatatccagcttgtcttggtcttctttagagtcaggctcgatggaaacctggataaccggatccggaacatccaatgattcaagaatcaatgggtggttaacatccgtcaaagaatcccctgtggtggtattcttcaaaccgatagcagcagcgatatcgccggaaaagacttccggaatttcttcacggtgattactatgcatctgcaacagacggccgacacgttcacggttgtcttttgttgcgttcaacacataggaaccagcttccagtgtgccgctgtatacccgaatataggtcaaacggccaacaaatggatcagtcgcaactttgaaggccaaagcagcaaacggcttgtcatcaccagcggtcagctcaacggcatcgcctgtatcaggatcggttgcatgatacggacgaacatccaatggtgacggcaggtaatcaataaccgcgtccaacagcatctgaacacccttgttcttgaaagctgaaccagccaaaactgggtagaattccaagttaatggttgctttacgaatagcagcctttaattcagcattggaaatctcttcgccttcaagatacttgtccatgatgccatcgtcaacgtcagcaacggcttcgacaagttcgttgtgggctttttcggcagcttccttatattcatcaggaatgtcaaccgtatcccacttcgtcccgagttcatcttcgtcgtacaagtcggccttcatttcgatcaggtcaatgaccccttcgaacttatcttcggcaccgattggcaactgaacggcatgggcatttgcctgtagccgatcatgcaaagttgacaatgaatagtcaaaatccgcaccaatcttatccatcttgttaacgaaaactaaccgcggaaccccgtatgttgtcgcttgacgccaaacgttttcagtctgcggctcaacaccggattgggcatccaaaacggtgatcgcaccatctaacacacgcaaggaacgttcaacttcaatcgtgaagtcaacgtgtcccggggtgtcaatgatgttgacccggtgatccttccagaaagccgtggtagcagcactggtgatggtgatcccacgttcctgttcctgtggcatccagtccatctgtgaagctccttcatgagtttcaccgattttatgaattttaccggtataatacaaaatccgttcagtcgtggtcgttttaccggcatcgatgtgagccatgatcccgatattacgggtacggtctaacggaaattcacgtttgttggccatgtggcgtattgctcctctcttgattcaactggctttatacaaagaatggctactatataccaaaccgcggatataatagccaaaccatcttaccaacgataatgtgcaaatgcccggttagcatcagccatcttgtgggtatcttcacgcttcttcactgcggcgccggtgttgttagcggcgtccatgatttccttagccaagcgttcgtccattgtgtgttcaccgcgttgacgcgaatactgaacaatccaacgcaagcccaaggtggtccggcgatccggacgaacttcaatcggcacctggtagttagaaccaccgatacggcgagctttaacttccaagaccggcataacgttcttcattgcttcttcaaaaacgtctaacggttcgttcccggtttgtttcttaatcatatcaaatgcatcatataaaatagtggatgccttcccgcgcttaccatcaatcatcaagtggttgattaaacgggtaaccagctttgaattgtaaactggatcaggtaaaacatcacgttttgcgacactgcctttacgtggcatgcattttgcctcctcttaaaagtattcgtctgcccaagctgctcacaaaccggctcggctagcaacccaaagcgattcctgagtttcttttaggctgacgcatattctgtctataccgcacaaagcggatctaaaaatttgttgtcatcatcatgcggctaatccgcactgattttgcttacttcttcttaggacgttttgcaccgtacttcgagcgaccttgcatccggccgtcaacaccagcggtatcaagcgcaccacgaacgatgtgataacgaacccctggcaagtccttaacacggccgccacggatcaagacaacactatgttcttgcaagttatggccaatacccggaatataagctgtcacttcgatcaagttggacagacgaacacgagcatatttccgcaaagctgagttaggtttcttaggtgtcatggtaccgacacgagtagcaaccccacgtttttgcggtgctggattactggtaaggctcttcttcttgctgttgtaaccgaagttcaacgcaggagagtctgacttggttgatttggatttacgaccttggcgaactaattgattaatagtaggcattaagcttctccttccttatattgcatcttttttaagtccacacatccaggcggttcattttttgtgataaaaaaacggccaaccgaacggcgacggctcttaacccagtcagcacgtccggacaacccgaataaactggaaaaaagcacctttgatagtgtactatcctatacgcgctggtgtcaaggaaaacaatagaacattcacttgacatttgaaatggtgaacttttaacaaaagcgtatgaacgacaaccttttcacggttatatttctaaataaccggttaacttcaaccatagcaaaaaagttctgtaaagcaaccccgaaaggcagcttcacagaacttttttaaattcgggactttttgaaatctggcatatatattttttgatccactgcggccttttttctccagcgatttagcctgaaaagtttttaaaaatgcaggttttaagagaaatacatttgtcattttacttactttttgttacgaaagcgttgtcgatattgctaaatcgatcatattgcatcgttatcaagcgccatccatttttcagcgaaatttattctatgaagtgaggtggtggctttgattctagctttatttttactaaccgtgatcagcgtaacaaagcgtttaactagcattaatcagtcagttcattgtattttggcgattcttttagggataagcagtacgacctggttaccttttttcctcagtgtcggtttgcttatgtttagcattgctgattggcatgagcgcagcgtttcactcatcaatttttgtggctggtggtttggtatcattgtggtttttccctgcaatttgtttaatttaatgatgttaggttccatggttggcgggttagcactgatgtcgcacggtttaggcagtgctgatgttttactgattgcattattaggtggcgttctgcaactagaagctgccttggttatcacgttaattgcttgtatcagcgctggcggtcactggtttattacccgtttagagacgttgccgatgattagtcatatagcgatcggttacggttgctttagtttggcagctaattgcctaggcattttttgatcgtggtcatttgtgtacaagtcaaaacgtatgccttggcacagagattggtatgtaagcagctcgtgaccgttcctgctcgcgtgcatataaaaaagcggcgcaagtatctttttcaagatacttacgccgcttcttttgtggccagatgcttcagtttgaccaccgacaaggcgattactgtttgtcagtgtcgctttgctggttgtctttttccttcatctgtttttcgatgtctgaaatcgaataaacactgtcggaaaccgtaccgacactcttaggttcctcgtgacgataggtggccatcccggtaccagccggaatgatcttcccgataatgacattttctttcagaccaaccagtggatcgttcttgccgcgaatggatgcatcggttaagacacgcgtggtttcttggaaggaagcagctgataagaagctgttagtttccagagaagccttggtaatccccagcaagaccggacgacccgttgccgggatcccgccactgatgattgcttgcgtgttcttttccttgaagtccgcaatgtcgagcaaggtgcctggcagaatattcgtgtcgcccggatccatgacgcggatcttacgtaacatttgccgtaccattacttcgacgtgcttatcaccgatgtcaaccccttgcatacggtaaactttctgaacttcagaaagcaggtagttttcggttgccatcacatcgcgcaccttgatcaattgcttaggatcaattgaaccaccagttaagcgttcgccacggttaatgtgatccccttctgcaacggccacactagatgcatatggcacactgtaagtccgggtatcggtttcacctttgacggtaatttcacgcgtatgctcggctgggttttcatcaattgccgttacttcaccagtaacttcagtgataaccgcttcacctttaggattccgtgcttcaaagatttcctgaacacgaggcagcccttgcgtgatatcttcgccaccagcaacaccaccggtatggaagttacgcatggtcagctgggtacctggttcaccgattgactgtgccgccacggtcccgacagcttcaccgacttcaacctgttcgccggttgccatgttacggccatagcacttctggcaaacaccatgcttcgtgttgcaggtaaagaccgaacgaatggtaacggcttcaacgccagcatccacaatcttctgagccatgtcttcatccataagcgtattgcgtttaaccagcacatcgccagtctttggatcaagaacgtctttcatcgtgaaccggccaaccaaacgatcatacagcggttcaatcatttcgttaccttcacgaattgcacgaacaaccaatccacgatcagtaccgcagtcttcttcgcgaacaatgacgtcttgggcaacatcaactaaacgacgggtcaggtagcctgagtcagccgtcttcagcgccgtatcggtcatccctttacgtgcaccgtgagttgacatgaacatttccataacggttagaccttcacggaagttcgagataacaggaacttccatcatccctccgttaggcgcagccatcagaccacgcataccggcaagctgagtaaagtttgagatgttaccacgagcaccggaatcagacatcatggaaattgggttgttcgggtcaaaagaatcaaccagtttttgctggatttcatctttagcgtcgttccagatctgaatgacccggtcatgccgttcatcgtcagtgattaaaccacgacggaactgcttagaaaccgttgcaaccttcttatgggctgccgccacaatctctggcttttccttcaggttcgtaatgtcggcaatcccaacggtcaaacctgaattcgttgactgagtatagccgagtgtcttcatgtcatccagcaagtcactggtccgctgaactttataaactttgaagacttgggcaatgatgtcagacaggaatcctttcttgaatggatcgatcaaaggtgcatcttcaaggtaagcatggatatcttcacctttgtcgatgaagtatttgtccggcacaccattgacgatgttgtcctgagtcggttcgttcaaatacgggaagtcttttggcatgatctcgttaaagattgccttgccgacactcgtcaccataatcttttgtttctgctcatcagtaaacggtttgtccgtaaaggagttcgcagcaatcccgacacgactgtgcagatgaacatagccattttgcaacgccatcaacacttcattggtatccttgaagatcatgccttcgccttcgcggcccttctgctccatggtcaggtagtagttacctaacacaacgtcttgagaaggggtaacgattggcttgccgtctttaggtgccaaaatgtggtgggctgccagcatcagcatgcgcgcttctgccattgcttcatcagacagcggtacgtgaatcgccatctggtcaccatcaaagtcagcgttataagcttcgcaaaccagtgggtgcaagcgaatggacttaccatcaaccaagacaggttcaaatgcctgaatacccagtcgatgcaaagtaggcgcacggttcaaaaggactggccgttccttaatcacatcttcgaggacatcccagacatcatcgtcttggcgatcaatcttccggcgagcatttttaatattgcttgccatatcgcgcttaaccagttcgcgcatgacaaatggcttaaagagttccaaggccatttcacgcggaacaccacactgataaaacttcaaccatgggccaacatcaataaccgaacggccagagtaatcgacacgcttacctaacaggttttgacggaatcggccttgcttccctttcaacatgtgggacaaggacttaagcgggcggttaccaggtccggtaaccgggcgtccgcgccgaccgttatcgatcaaggcatcgaccgcttcctgcagcatgcgcttttcgttttgcacgataatacttggtgcattgagatcaagcagacgcttcagacggttgttacggttgatgacccggcgatacaagtcgtttagatcagaggtcgcaaaccggccgccttcaagctgaaccattggccgcaaatccggtggaataacaggaatcgtgtccataaccatccatgccgggtcattaccggactccttgaacgcatccaaaatgtccagacggcgaatcgcacgggtccgtttttgaccctgagctgatttcaggtcttcttttaattcagcaacttctttttcgagatcaacatcctgcaacaattccttgatggcttcagcacccatcttggcattgaaggtctgtccatattcttcccgcttttcgcgatattcgcgttcggttagcagctgctttttctccattggcgtatcgcctggatcaatcacaacataggaagcaaaatagatgatttcttcaagtgaacgcggcgacatgtcgagtaccagacccatccggctaggaattcccttgaagtaccagatgtgcgtcaccggtgcagctaattcaatatgacccatccgttcgcgccgaaccttggaccgggtgacttcaacgccgcagcgatcacaaacgattcccttatagcggattcgcttgtacttaccacaggcacattcccagtctttggtcggtccgaagatacgttcatcgaataagccgtcccgctcaggctttagggtccgatagttgatcgtttcgggctttttgacttccccataagaccagctgcggatcttgtccggcgaggctaagccgatttgcatactttcaaacttattgacatcaatcaaagggctaacctcctatttcttatcgtcggtactattgtcggcagactgaccgtcacttgcttgggttgcggcttcgtgtgccttcttttcttcttgctgagctgcgaacttcgctaatgcatcgacggaaacaacatcgtcttcgtcatcgtccatgtcgcgcaattcgatttcctgcttatcagcacctagaaccttcatatcaagtcccagcgcttgcaattccttgaccagcacacggaatgattccggtacgccaggctttggaatcggatcgcccttaacgatggcttcgtaggtcttaactcggccaacaacgtcatcggacttataagtcaagatttcctgtaaggtatacgctgcaccataagcttcaagggcccagacttccatttcaccaaaccgctggccgccaaactgagctttaccaccaagaggctgttgggtgactaaactgtaaggtccaattgaacgcgcatggatcttatcatcaaccatgtgagacagcttcatgtaatacatgacaccgacagatacccggttttcaaatggttccccggtacggccatcatacaagactgacttcccatcagatggcatgccggcttctttaacggttgcccacaagtctttatcgttggcaccgtcaaagactggcgttgcaacatgaatgcctaagttacgagcagccatgcccagatgcaattccagcacctgcccgatgttcatacgacttggcacacccattggcgacaagcaaatatcgactggggtaccatctggcaagtatggcatgtcttcttcaggcacaacgacggaaaccgtccctttgttcccatgacgaccagccatcttgtcaccaacttgaattttccgcttctgcgtgatataaacccgcaccatcatattgacgccaggagataattcatccccagcttcacgggtgaagattttgacgtcctgaataataccgccgccaccatgcggaacccgcagcgatgtgtcgcgaacttcacgtgctttttcaccaaaaattgcgtgtagcagccgttcttcagcagataattcggtaactcccttaggcgtcactttaccgaccagaatgtcgccatcccgaacttcggcaccgacacgaacaaccccgaattcatcgagatccttgagggcctcttcaccaacgtttggaatctcacgtgtgacttcttcaggtccaagtttggtgtcacgtgcttctgactcatattcttcaatatggatcgacgtgtaaacatcatctttaaccaaccgttcagacagcacaatcgcatcttcgtagttgtacatgttccatgtcatgaaggcgatgatcgggttttggcccaatgccaattcaccattttgcatggctggtccatcagcaatgatttcatcgacatcgacatggtcaccgatcgtaacaatcggacgttggttgtagttcttgccggcgttactacgcttgaatttcatcaatttgtaagtgtccaaggcgccgtcttcacgacgtacccggatttgcttagcatcgacatattcaaccgtaccggcattgttagccaaaaccgcggttcctgagtcatgggcggctttgtattccatcccggtcccgacaagcggggcatgcggattgatcaaaggtaccgcctgacgctgcatgttagcacccatcaacgcacggttagagtcgtcgttttccaagaatggaatgcaggcagttgcgactgcgacaacctgcttaggcgaaacgtccatgtaatcgactttgtctggtgaaatttcaatgttgttatctttatgccgggccaaaaccgtgtcatcaacgaaggatccatcatcgtttagtggcgagtttgcctgcgcaacaatgtagttatcttcttcgtcagctgtcaggtaatcgatcttgtcggtaaccttatgcgtatcccatgaaacccgtcgatatggcgtttcaatgaagccgtatgggttaacgaccgcgtatgaagccaagctgttaatcagcccgatgttcgggccttcgggggtttcaatcggacacatccggccataatgggtgtaatgaacatctcgaacttcataacccgcacgatcacgagtcaagccaccaggtccaagggcagacagacgccgtttatgggttaattcgcccaacggattggtctgatccatgaactgtgacagctgggaactgccaaagaattccttaattgaagccacaactggccgaatattgatcaattgctgcggtgtaacggttgcggtgtcctgaatcgacatccgttcgcgaacaacccgttccatccgcgaaagcccgatccggaactgattttgcaataattcaccaacggaacgaatacgacgattacccaagtggtcaatatcatcaaccgtacctaagccttcctgcaagttcaggaagtagttcatcgatgccaaaacgtcagctggcaaaatatgcttaactttcttgccgatatgcccattgccaattaaattaatttctttatccggggtcacctgtgagtaaactttaatactctgcagctcaatcggatcggtcatcacaccttgatcagaaggttgataagtggccgtcttgaaatcatcccgatccaagtacggtgccagcttatccatcacttggcgatccactttggtccctttttgggcaacgacttcacctgtatccggatcagccagtgtttccgctaaaacctgattcaatagccgggtcttcaggctcagcttcttgttcaccttgtaacgcccaacagaggctaagtcataacgcttcgggtcaaagaagcgggcatacaaaagtgaccgcgatgaatcagcagtcttaggttcgcctggacgtagacgttcataaatatccttcaaggcttcatcagtacgggaatcatccgtatttttatgcacatctttttcaagtgtgagcatcaacgaatcattgtccccgaacatattgataatgtcttgatcggagccaaagcccaatgcgcgaaccaattcggtcagaggaatcttccgcgtgcgatcaatccggacatacgcaatgtccttcgcatcggtttcatattccaaccatgccccacggttaggaatgacagtcgtgccatacgtcacccgtgagttcttatctgtttcactatggaagtaaacgccaggggaacgaaccagctgggaaacgataacccgttctgccccgttgataatgaacgttccttgtttcgtcattaatgggaaatcaccaaaaaagacgtcctggctcttgatttcgccagtttcatgattcgtcaaacgtaaggttacatgcaatggtgcggagtagttcgcatcgtgttggcgtgcttcctcgacagtatatttcggttccagcagttgatagccgacaaattccagtgacagtttcccctgaaagtcatcgatcggcataatatcgtcgaacatttctttaagaccttcatcgaggaaccattggtaagaattcgtttggatctcgatcagattaggaagatccaaaacttccttgatccgggcataagaccggcgtgtccggtgcttaccataattcactaagtgtcctgccaaattattcaccccttgtaagattttccggcttgatgattgtaaaaataatgtaaatattgttaaatttacatgacattgaccatcccgcagacattttgagcaaaaaaaaaccaaaaacagatcgaccttcaaccagcctgctgtttttgcttttttcattagtcagaacggacaatagatcgtcctgacagcctgtccaaaccgaaatgcgattggtttaataatacgcgtgcggagtaacaatgtcaagcacctgcttttcaaagtaatgcaataccagatagcatcaaaatcgcgtcccgccatcactgactgttttggcaaaataaatcggtcccagagataatgcttcacctctaagaccgatctttttaagcgttattagtggaacctgacatatttgggcctgctattgatcatgccttgacaggttctttagaagcgccattttctttatgcttatctttgttttccttgactgtaaacgtcagcttgccttttttagcgccgatttgaatcaagtcgccggttttagcctgacccgtcaacaatagctcactgagttggtcttcaacatccgtttgcaaggcacggcggatcgggcgcgcaccatattcaggatcaaatccagccgcggcaatcgcatcaatcccggctggcgtaattttaacgtcaattccttgatctttgatacgactaagcacggttttggtcataatcttgacgatctcatgcaactcagccttgttcaagctatggaagacaacggtttcgtcaattcgattaaggaattctggacggaagctctttttcagttcagccaacatccgactcttcatggcattgaagtcagcggttggatcttttgcaccaaatccaactgtcttatcatcgcgaatggcagttgctccgatattgctggtcataatcaaaatggtattccgaaaatcgacccgccgacccttagcatcagttaaatagccatcgtccaagacttgtaacaaaatgttgaagacatcaggatgcgccttttcgacttcatcgagtaaaacgaccgaatatggcttgttgcgaaccttttccgtcaactgaccgccttcgtcataaccgacatagcctggtgctgcaccgattaaccggctcgtactgaatttctccatatactcggacatatcgacccgaatcatggcgtcctcggaaccaaacatcgcttctgccaacgctttagctaattcggttttcccgacgccggttggtcccaagaacatgaaggagccaatcggtctggtcggatccttcaacccggaacgagcacgccgaattgcccgtgcaactgctgaaacggcttcatcctggccaacaactcgctgatgcagaatcttctcgagattaaccaaccgttcggattcctttttctgcagttgcgtgaccggtacgccggtccattgcgatacaacttcggcaacgtctgcgcccgtgaccttgatatcggtacgaacaccactttcattcaccggttcaggcgtatcggcaagtttagccttgacgcccgcttctttagtccggattgtagcagccgtttcgaagtcttgatgatcaattgcatcttctttgtcggcaaccagtttagctaattcatcctgaagtttatcagctttggtctccacgttagctttatcaaggcgaactttagccgcactttcatcgaccaagtcaatagccttatccggaagaaaacgcgttgtaatgtaacgtgacgacaacacaaccgcttcatgcagcgcttcatcagtaatcgtaacgccatggtgtgcttcgtaacgcggacgcaagcctttcagaatctgttcggcttcttcctcagtcggttcgtcaacttgaattgttgcaaaccgccgctccaaggccgcatctttttcaatgtacttttgatattcgtctaaagtcgtggcgccgattagctgaagctcgccacgtgccaatgccggtttcagaatatttgaagcgtcaatcgccccttcagcaccgccagcaccgatcaatgtatgcaattcatcaatgaataaaatgacattgccatctttataaatctcatcaataattttcttcagccgatcctcaaactcaccacgatacttagtgcctgcaaccaacgaacccatgtcaagcatcatcaagcgtttgttcagcatatcatccggcacttttccagccacaatcttttcagcgaagccttctgcaatggccgttttgccgacaccgggttcaccaatcaagaccgggttgttcttagtgcgccgcgccaagatttgaatcaagcgccgaacttctttgtcgcgaccaaccaccggatccatccgattttcgcgcgccatctgggttagatcacgggcgaggccatcaagcgttggtgtcccctgaccgtcttggcgagcgccgccacgtgccattggccgccgctttgccgccgtatccgcgatgcccattttcttgaagaccatctgacgcgtcttcgagagactgagccctaagttttgtaaaatccgcgcagctaaaatatcgtcttctcgcaatagtcccagcagaatatgctcggtgccgatttttaacgcccctaagcgttttgcttcgtccccggcaaatgccagaatttccttgccttttggtgagtatggcaaataactatcgctagcttgactggcggcatcaacagttccatatcctgtgaagcgctcgatctcgtcatggacatcattttctgtgacccctaactgacgcagcgtcttaccagcgataccatccttttccataaccaaagccataagcaagtgttccgtgccaacagcatgatgatggaagtacttcgcttgttcctgggctaaaagcaacacatttttagcactaggggtaaataagttgtccataagcacgctccttttttaaaaagccaattataaactgttttatctttcataccgcaaacgatccaaaaatgcaagaaacaaacgcgatcgtaagtgttcttctgtttcttgatcaagaattcccaaagtctcatgattgatcacggctagcattaaattgccggactgttgggaaataagcccattatcaaacagttcctgaagcaaatcccgtgcatcgcgtaaccgcaagcgactaggaatgtgctggcgcatgatttgaatgagatcctgatcatctgtcaatttgaccttcacgatccgaatgtagccaccgccgccacgcttactttcaacaatgtacccacgtgccggtgtaaaacgcgttttgataacataattaatttgcgaaggaacacaattaaagcgccgtgcaatttccgctcgccgaatctcaacagccgcttcctgtgccagtatcgtttttaagtatgtctcaataatatccgaaatattttcgcgctgcatgccattcaatcctttttgactttgaccaatcttgactattacacattatactggcatcaatgtatttatacaaatatatgctttgaggtaaacgaaaacagtgccggttagaattcagaatgtgagtggctgtacacgttataggcgctgagtttacggtcacctacacgcaggcagccaccatgaccaatgttttttggagaacgaaaaaaggaccacgattgtcgtgatccaagaatcgggaagacaagattcgaacttgcgacccctacgtcccgaacgtagtgctctaccaagctgagctacttcccggtaaagcggaagacgggattcgaacccgcgacccccaccatggcaaggtgatgttctaccactgaactacttccgcataccgaatatgaaatttgatcagcgccacagcttcatagcgaccaatgatgcacccagtaggagtcgaacctacaaccttctgattcgtagtcagacactctatccaattgcgctatgggtgcttcaacaaaatgccgaggaccgggatcgaaccggtacggtcatcactgaccgcaggattttaagtcctgtgcgtctgccaattccgccaccccggcataaagtgaaaagcggaagacgggattcgaacccgcgacccccaccatggcaaggtgatgttctaccactgaactacttccgcatatcaaagctattcaattgtgaccgaggagcagcctttaaaacccgagcaaatcatgtaagatacaatgcgggtgaagggactcgaacccccacggtcaaaaaccactagaacctaaatctagcgcgtctgccagttccgccacacccgcaaaaggtgggttaaatgagccgtgacaggctcgaactgtcgacccactgattaaaagtcagttgctctaccaactgagctaacggctcaatggaggatacagggctcgaacctgtgaccctctgcttgtaaggcagacgctctcccaactgagctaatcctccatatgtaagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgttgttggtttgcattgccggaacttaacgtatttcatcgaaacgcgcgcgctggcttagcgccagtttgcgctttacttggttaagtcctcgaccgattagtactggtccgctccatgcatcgctgcacttccacttccagcctatctacctgatcatctttcaggggtcttacttccatataggaatgggaaatctcatctcgaggggggcttcacacttagatgctttcagcgtttatcccttccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttctacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaatgcctccatcgaaactagcgttccgatctctacggctcctacctatcctgtacaagcggtaccaacactcaatatcaagctagagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactttaatttcgctccccatcacagcttgtccttaaggcggcaagcatttcactcgctaccggacttactgcttggacgcacttttccagccgtgcgctttccttagcctcctgcgtccctccatcgcttaaacaaaataaactagtgcaggaatctcaacctgcttgtcatcgactacgccttgcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcaccctgacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcaatggtattcggagtttatctgaattcagtaacccttgacgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctacctactgaagcgccctgttcagactcgctttcgctccggctccgacttttcatcttaacctcgcaggcaaacgtaactcgccggttcattctacaaaaggcacgccattacccgttaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagagtccgccgtttcgtttacagggctttcaccttctatggcgcagctttccagctgacttcgactacgtcgaactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccaacaagctatgtattcacttgcaggcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctattattagaaactcatacaaatacgctgtgttctcggcaatttaaaacatttacaacaatgatatccagttttcaaagaacaaagaatcgccaactaacgtcaacgatcggcctgacggccaatggaggataacgggatcgaaccgatgacctcctgcttgcaaagcaggcgctctcccagctgagctaatcccccataagggttgttcaattaacaagcgaacgcttgatgggcctagatggacttgaaccatcgacctcacgcttatcaagcgtgcgctctaaccaactgagctataggcccgataggcgtgtagaaagggtaatcccctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcacttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcattgccttggtgagccgttacctcaccaactagctaatacgccgcgggtccatccaaaagcgatagcttacgccatctttcagccaagaaccatgcggttcttggatttatgcggtattagcatctgtttccaaatgttatcccccacttaagggcaggttacccacgtgttactcacccgtccgccactcgttcaaaattaaatcaagatgcaagcacctttcaataatcagaactcgttcgacttgcatgtattaggcacgccgccagcgttcatcctgagccaggatcaaactctcatataaatatgagctgttcgaatagctcgatttgttgttctagcgaattgacttcgcaaatgttactttttgcctcgataccgaagtatcaaggaccctgcacatttaaacgaaactttgttcagttttcaaaggactaccttgtcaaaagacaactttgatatattatcacaagcgatcaacgcttgtcaataactttttttgatgttttgttgcacatcagcgttgctcatttacgacgctttttatcataccaacggtttgcgctatcgtcaacaactttttcaattaaaaaaaggtatccggatattttttatcgaataccttatatcattcgtaaaatgatcgtgagagcaccacaaaagtgttggaactttcggaaaataaaaatgccgcctaaaatggcgacattatcacataactacgggcgcaatgttgggaacaaaagaacatcgcgaattgacggtgcatcggttaacagcataactaagcgatcgataccgattccgagtccacctgttggcggcatgccatattccaacgcttcaacataatcgtcatcaatgccttgtgcctcttcattgcctgccgttttttcagctgcttgcgcttcaaaacgctgacgctgatcaatcggatcgtttaattcggtgaaggcattggcgtactcaccgccaccgacaaaaagttcaaaacgctcaacaaatcgtggatcttttggatttttcttagctaacggggaaacttcgattggatggccggtaatgaaggtcggttgaataagcgttgattcaacaaactgatcaaagaaggcactgataatatgaccaaccttccaataaggttcgtagtgaacttcatggtcatcagctaacttacgcgcttcatctacactcatttccggccagaagtcaacgccggttttatccttgatagcgtctaacatgttgatacgggcaaatggtgcatctaagtcaatgtccatcccttgataagttagcttcccggaatcaaggactttgtgggcggcaaatctaaagatgccctcggtttcgaccatgacatcggatagatcccaataagcggcgtaggtttcaagctccgtaaactccggattatgtttcgtgtcgatgccttcgttacggaaaacgcggccgatttcataaacgcgctccatgccaccaacaatcaaccgcttcaagtgcaattccaatgcaatgcgcaaataaaggtcgatatccaacgcattatggtgtgtgataaatggccgcgcattcgcaccaccggcctgattatgcaaaaccggggtctcgacttcaagaaatccatggttatccaagtattcgcgaacagcactcacgattttggtgcgtttaacaaaccgatcaaaactgtcaggattcgaaataaggtccaaatatcgcttgcggtacttctgctcgacatcggttaagccatgccacttatccggcaatgggcgtaatgctttggctagatgcgtcacgtgattggctttgacggtcagctcgcccgagtcggttttcatgacttcgccgctgatacccaaaatatcgcccaaatctgccttcttaaagatcatgtagttttcatcgccaaccacgtctttacgaacatagatctgcattttaccgctgcgatcacggatgtcagcgaacccgactttacctttaccgcgtttggacatcatgcgtccagcaatcgtcacttccggcttttcttcaagtagcgtttctttgtcgtcttcgccaaattcttcacgtacctttgctgcagagtgcgtgcggtcaaaccggtgaccgaatggatcaattcctgcttctcgcaaggcgtccatcttttcccgccgcgcaatcatttgatcgttcatttctggttgctgtccgttatccttagccaacacaagttcctccgtttcaatttataccactctttgatgatgacaattttaccgctaaaaagcaaccttctacgcattaaaagacgttcgccatgatttattgtcaatcaatcatccttgaacgccttttatcatcaaaggttttatggcttaatggctgccttgacgctgacgggcgcgcgcttcagtttgcgccacaaagtcatcaaaaatatgattgacttctgcttgcgtatcaaccatattaacggctgctttggtctttgccgagcgaggaatgccttttaaataataggctgcttgcatccggaattcacgaacggcctggtgttctccgtgcaggtcaaccaaccgttgtaactgcaacttggcagtggcgattttttcgcgcggtgttggttccggaatcagctccccatgatcaagataagctgccatctgcttcaagacccacggatttcctaatgctgcgcggcccaccatgactgcatcggcgccaacctcatcaagcatccgtttggcatcttgtggggttcgcacgtcaccattcccgataaatggaatgctcaggtgttgtttaacttcttttaagatgttccagtcagcatgtccggaatatagctgcttgcgtgtccgcccatgcatggctaatgcggcagcgccaccgcgttcagctgccaatgcattttgaaccgcataaatgtggtcttcatcccaacccgtgcgcatcttaaccgtgaccggctttgaaacggcatcggtcaccgccgccaccatttcgtaaactttctccgggtctaaaagccagtgtgcccccgcatcggtcttggtaactttaggtacagggcaacccatattgatgtcaatgatgtctgcagccgtgttttgatcgacaaacttagctgcattcaccaacgtttccttggtgccaccgaaaatctgaatggaaatcggatgttcacgcggatcaacaaacagcatacttaacgtctttttatttttgtacataatgccgcggtcgctaatcatttcacaaacgaccaaaccagcaccgaattccttggctgtcacccgaaaagccgcattcgtcacaccagccatgggtgcaacaacgagtcggtttgggatctcaacatcggcaatgtgccacatacaagccacctctttcttgctttcgcgttgttaactttacttaaaataagcaaacactgcaactattcatgccgggccaacaaagcttcaagatcggccacactgtaatgatattgattaccgcagaacttacaggtcgtctcggcaccgccgtcttcatcaatcatttcctgcaattgtttccgcggcaaagtggccataatatcgccaaaatgtttcttggaacaattacatgcaaaccgtactgcttgggtatccaggaagcgaacgggctctttgcctgcaacgcgttggataatctgctcgggagtcaagccacttttcaataactctgatacaagcggtagtgttttgacgtttgcttccagttctgacaattcggcatcggtcgcaccgggcaacgcctgtagcatgaaaccgccagcaactttaatcgtgttatccgcattgacaaatacagagagtccgactgccgcgggaatctgctcagacttagctaaataatacgtaaaatcttctgctagctcacctgaaaccagtggtacctgtcccgtaaacggctcgccgattccgatatctttcgtcaccgcaagcatgccgtgtttgccgactgcttttgccacatcgattttaccgacgagattgaggggaagattcacgtgcggttcctgaacatacccgcgaacggttccgagttgcgtaccatctgtgacgatcgagccaaccgggccatcccctttgatacgcacagtcagcaagtcattcgtgttttttaatcccgatgcggctaataacgctgtggcaattaaagttctgcccagcgcagccgaagccgcactccaggtgtcatggcgtcgttgtgcttcgcttaccgtttgcgtggcgtcaactgcgaaaattcgaaaatgggcgttgcgcgacaatgcactcgcgatgtagtcactcatgttggattgatcctcttttctgaaagttaaacgtggctattctaccaaaaattgccgttattgaaaagccggcgcagaaacccacatgtcaaagctttggttgcgatggtcaaagtccgatcatcacgtttaagaccacttgtgttctggcttatgcccataacgcgctcaccggcgcagaagtctgcgtgtaaggaccttaaacgcaatggccaagtccgggccatcaggtttaaggccgcttgtgttctggtttatgcccataacgcgctcaccggcgcagggatctgcgtgtaagggcctcgaacgcaatggccaagcccgggccattgtgttcgaggccacttacacttcgatccctaaacgcgccggttcgcgcttaacaaaaaaacaccaccaacatttggcagtgtttttatacttaggcttgcggattctgatgatcgtcatcggacgggttactgccaggtgttgtgtcgtctggcttttccacactgtccgtcgtattgtcatcatgcgcatcttggtctgtttgatcagcattcgtctgaccctcagacttagcatgtgcttcttcgtctgcttgcttttctttatccttgtgttccaaggctgctttggattgctcaaaagttgcggccttttcgcttggaaattcgtcttgatcgcgttctggcatcttgccgtcattgaacaagctgagaatttctttttcattcaaggtttcgtacttaagcagggcttcggcaattaacttatgctgatcgcgatgggcctggataatttcgtaggcctgtttgtgggcttcgtcaataatccgccgcacttcatcatcaattgccgttgcggttgtttctgagtatggcggtgtttgcccatactgagcacccaagaatggttgtccttcagtctcaagctgaacggttccaagccgatcagacatcccatactgtgtgaccatgctgcgcgcaatttgtgttgcctgctcgaagtcgttggacgcgccagtggattcaacgccgaaaataatttcttcagctgtgcgaccaccaagcaaaccaacaatttgttctgtcaattccttcttggttagcaggaactgatcatcttttggcagcataatcgcatacccgcctgcacgaccacgcggaatgatggtgactttgcgtaccgtccgcgaatcgcttaagactaagccgacaatggcgtgaccagcctcgtgatacgcaaccatcgtccgttctttcggactgatgacgcggtctttcttcgctggcccggcaatgacacgatcttcggcttcatccacatcggctgcatcaatttgcttcttacttcgtcgtgctgcaaccaacgccgcttcattcagcagattttccaagtcagccccgacaaaaccaggagtctgacgtgcaatttccttcaaatcgacatttggtgccagcggtttgttctttgcatgaaccttcaaaatggcttcacggcctttaacatctggtcggccaaccaaaatcttccggtcaaaacgacctggacgcagcaaagccggatcaagaacatcggaacggttcgtggcagcaatgacaatcacgccttcattacccgtgaacccatccatttcaaccagcaactggtttaatgtctgttcacgttcatcgtgaccgccgcccataccggcgccacgctgacgaccaaccgcatcaatttcatcaatgaagatgatcgaaggagctgcttttttagcctgatcaaaaagatcacgaacacgcgaagccccgacaccaacgaacatctcgacaaagtcagaaccggaaatcgagaagaacggtacgccggcttcaccagcaaccgccttggctagtaaggttttaccagtaccaggaggaccctcaagcaaaaccccggctggaatacgggcacccaatgccgagaatttacgcggatctttcaggaactcaaccacttcaaccagttcctgcttttcttcttctgcaccggcaacatcagagaagcgaactttattggcatttttatcggcttgtttagcccgcgacttgccaaaactcatcacgcgaccggagccgccgccttggcctgcctgattcatcatcatatagaagaagatcatcatgatgacaatcggtacaactgtaatcaacaagctaaaccaaacaccggactgcgattcctcctgcgtattggtcttgacattgttggcattggtcattttttggatctgactcaaagttgcatcattcgtcggaatataagtcgagaatttggtaactttggttgactgattgccaaaaaagctcagagagttgttcgtaccggaagacttttcggccttcttgtattcaccgctgaccttataaacgccaccagatggctggagcgaataacttttgacattgtccttttttaattcggacataaaggtgcttgtttcaatttcttgggacgatgttgtcccattatcgcgcatataatacgcaaaaccggtgaccagcagcacaaaaatgatgatatacgtcagcgtgctactgaacaggccgttttgttttttcttcatttagaacctccggcaacattcaattagttccttacatactaccacaaacacggcacttagattaagattttgccgcatagacttctggctttaataccccaatataaggtaagttacgataacgttcggcataatctaagccatacccaaccacaaattcgtttggcactgtggttcccacatagtctgcctgaacatcaacaacccgtccttcaggtttgtccatcagcgcacaaatgcggactgattttgctttgcgggttttaaaaatatcggttaagtacttcaaggtgcgtcctgtatcaacgatatcctcaacgattaagacatcgcgatccttcacgctggcatcaagatctttaataatcttgacctcaccgctagattcagtcgcatcaccataacttgacacgtccataaaatcgagttccatataatcatcaatttcgcgaacaagatcagtcatgaacatgatggcaccttttaaaatgcacaccactaacggattcttccccgcgtaatcacgcttaagttccgcgccaagtcttgtcgtgatggcgtgaatatcgtcttgagaatacaaaacctttaaaatatcgggattcatcatttatcctcacttctgtcaacatctggcaatttcaccagtacaacatggagtatatcagtttgagcagggagcgacaatcgttctaaaggctgaccttcaatccaaaaaatctgatgaccttgcgctaataccagtaattgatcgcgtgttcgggccggaacctttgcattgataaaaaatcgccgcagcttctgcttcacgccattaggcaggtaaacaatatcaccggcctggcgggtccttaatgtaatcggcaagcgcacacgtaccggaataccttggtcaccagccacttttgtttgtagctgaaatgtaccgcgagcagtttggcatttttggccaatacgagaaaatgttgccggcgctagttttggttttggcaccaacttcacaattttggccgcttgaaccgcaatcgtcacgccagcgccaagatcaaatcgtcgttcgcgagtatcattcaggcttttcaggatcggcatgagcagtccgtggttaactcgcggctgccattggcgtagcaaggttaccagcagcatcagctggatcgtgcgcggctgatttgctgccgcgcgccaatcaattgtcaccgaattaatccgcaaccgctgctgccattcactcagttgcatttgagccagtgcaaccaagcccgactgttccgtcgtaaatctttggacatgccgcaacaactcgggattttgctgtttaaatgccggaatcacttgatggcgcaactgattgcgggcataacgcgtatcggcattggatggatcgtcgcaaaaatccagaccgtgcctgtttgcataagctcgaatgtcatctttactaaaattcagcagcggacgcaccaaccgctttttacgccacggttgatccgggtgaatccctacaagggcggccggatcaccggagcgtcctaaccgaaacaggaccgtttcaagttgatcatccgcgtgatgcgctgtcatgatcaccgtggctgcctgagaatcggcactcgcattcaagaagtcgtagcgtgcctgtcgcgccgcagcttcatttaccgcagtggcggccgatcgctgccatgttccagtcacaaccggaacatgataacgcgctgctgcggccaccacaaatgcttgttcctgtcggctttctggccgcaaacgatgatcaaacgttgcgacaacgacatccagattcggtgctcgaactgccaggtccaacaagaccatcgaatccacgcctccggaaactgccactaacacccgggtatgcggcgtaaactcaaactgttcaaaaagctttggactcatgtgtctgctcctccgcttagcatacttggccaagcatattgatcgcataaccactatcaaatcggcttggcaacaaaataggcccagaacaaataaccgtttgtcccagacccgatttttttaactacgccgaccgcctcggccgccgcgtttgccttcggtattgcggcgaagaacacttagacgatcttcgctttctttcaaatagccggacatcattgcatcaaaatcgccttttaccggttgggctttgtggccgaatcgattgccactattgcgtgcgccgccttggaagcggttattgccagcatgtggcgcggatgcgtgtcggttttcgtgatgatgatcattttcacgttgttgcggtttgtcaactgctttccggatagacaggccaatcttaccatcttggatcgaaaggactttaaccgtcaccggttcgccaacatgcagcacatcatgaatatccttgacataagcgtcagagacttcgctaatatgcaccaatccggtcttgccatcgcctaactcaacgaatgcaccgaatttcgtgatcccggtgactttaccagccactttcgtaccaatttcaactgccataaaaaaagaagtcctcctaattaaatgtatctataagtatagcatgagtgaaaagacacgcaagcacgacgtattagcctaaccaaagcaactgaatgcagtcgtcaaaggcaattcgccatgaagaaaacatttcagcgtctgtgctccccgccaatgcttgccacctcatcaagaataccactgaatctcaaaccaacaactctaaagtagccaaatgactgcagggacgcgaatatagaaaacgaccggcacttgcgtttattgcaacccgtttatcgcgtcattgggtaacgtttaaatccggcactttgtttgctttatccggcaaattaaaaataatctctcccggtttcgaatagaggtatttttcacgaatcagcttggccgtgtaatcgtcattatgcaattggtcaacctgaactttaagggcggctttgttcgcctttaatttattcaaattagacttggctttggcaaccgcctgatttgtttcccccagtgtcatttgcgtgcgcattaaactgacgccgcctaagcccaaaatagcaaccatcacaattagcaaattacgaattcgtttcatatgtaccgcgtgtgcccgcgacttaggcacacgtgtcgacttttgcctgtgttcacgtgtatatgcattatttaattgactgatattatttttcgccatctgtctgcaccctcgttttcaccagccgtgtatcactacttcagtaaatcaagtataacaaatcagaggggctgctgttcaataaatcggcattaaaatgtttctttataatcttctttcaaaaccgtgtacatatcggccgcttcgttctttttcgttgtttcaactaagtcatccgcacgtacggtcaatgttttgttaccgaaattaatcaccagcgtgtcgccaaccccaacatcggtactcgacttggcaactttaccgttgatcgtgatccggcccttatccgcaatttccttggcaacggtgcgccgtttaatgattcgtgagactttaaggaacttatccaatcgcatgtctttttacctcgcttttattcgtcgtaacaatcgtaaatacttttttccgcctggcagatctagcatctcgcgtaacgtcaacaatcgcagccatgttccggcgatcaagaagaccatgacgccgatgacaacgccaagtaacgtgacaccgactgccacagttcttgagctcagcggaatccatcctaccgtgacatgcacaataaccgtcataatcccggtcacggcgacaagcttgggtacaaacaaccgcagtgcacttctgcctttgatcgtctcaggaactgcataataaatcaagcacaggatcacacccaaggccaaaattgttgctccgcttgctcctgctgttccaaagcgcatcaccagtggttcattgctcagcgccttcaccacgatgccgagtaataaagccacactgattcctgtataccgatcaaggctttgtaaaatcgcattatacgcgttgatcatggcaacaacggcaatggcaagtgcatataactgcaaggcataagtgccagctgtatcgccaaacaataatagattaatcgctggcatcaaaacaatcagtcccgaagccgccgccaatgcaaaggctaagttgaaatggactaattcggctccgcgttgaatgaactggcggcgctgccgtaattgccgcgcctgagtcagactgggtagcaacgttgtagacaaagacgctgccaccaccaagcccaattgaaccagtggctggccgcgatcataaaccccttttaagctcttggcagttgccattgcaatccctgaacccgtcaaacctttcgtcaccgtgaagctgtcaatcagctgtagcaagatcaacaaagccgcataaagcgtaatcgccccaccttcacggataaaccgactaattaagcggccgtatgcgtgaagcccgggaaattgatactgctgctgaccaaacacttgccgataaggccgccataaagtcaaagcagcggcagccccgccaaaaaatgccccactcatggcaacagcgcccatttgataaacactccagtgatattgcagaaaccaccaagccgctagcagaatcaccgccacccggacaagctgttcaaccacttgactcgtcgcggtttttaccatatcaaaagtaccttgaaaataaccgcggccagttgccagtagcggcatggttaagaacataaaggccaccatttggattaacggcaacaattccggatccgccattgcctgcgcaattgcgggcccaaaaaattcgagtcccaaaaataacgcccacgaaatccaagtcaaaatgacccgactttgatgggccacggttcgtttggcttcgagactgtcagcttctgcaaccagcttggagatataaaccggaaaccctgacaacgcaaacgtcatgcccagtccataaatcggataaatttgctgataggcgtaaaacccagtgtcgccaaccatattctggaaaggaacgcgataaacggcgcttagaatctttgcaatcaaggaactaagactcaagatccacgcaccgcgcatcaaatgtttcatttgttgattatgcatggtgatctcctatcaacatcgctgtatcgctgtgccaaaataacgcagcgcacatcgatatccagcagttcatcttattaggcggcaggctttttttccggctgcggattcacaaccgccagcaatcccttcatgaaagcagttagttgccctagccactcgtcttctttcatggttgctggcacagcgagcgttaccgtcagctttccatcggcaattgctacttgtgctttcaaagtcgtagccgccaacgccttaaagatcggttcgccttgtgctttagcagtcgcttgcggggttaacaccaccgtcattttctggtcgtttttctggacgtgatccacccaagccaaatcagcgaaacgtttcagatgtgcgattgccaaaagattcgtcaccggctgtggataatcgccgaatcgatcaatcaaatcttcactaatctcggtttcggcttcatcactgtctgcttcacgaatccgtttgtacaattcaattttctggcgcgaatcggcaacataatccgttggcaggtaagcttcaagacccaagtcgatttccgcatcggttttttgaacagttttaagtccgcggcgtttgttaaccgcctcttgtaacatctgcgtgtacaagtcatacccaaccgaatcaataaatccatgctgttgtttgcctaacaagttccccgcaccgcgaatcgacaaatcacgcatcgcaatcttaaagccgctacctaattccgtgaaatccttaatcgcctggagccgtttttcggccacttcattaagtaccttcatcggttgatacatgaaataagcgtatgcaacgcggctggaccgcccaatgcgtccgcgcaactgatacaactgggacaacccataatgatccgcattttcaataatcagcgtattggcgttcggcatatcgaccccggtttcaataatggtcgtggtcactaatacgtcatacgcgccatgcagaaaatcatagatgacattttccagctgggtttccgtcatctggccgtgggcatacccgatgctggcgtcaggcactagctcttccaattgactcacggttcgctccatatcctccacccgattatgcaggtaaaagacctgaccaccgcgttccatttcgcgttcgatggcttcccgaatgaccccggggttttgttccattacaaaggtctgaatcggatagcgatttgtcggtggcgtctcaatgacacttaagtcgcgaacgcctagcatcgacatgtttagcgtacgtggaataggcgttgccgtcagcgttaacacatctacattgcttttcaattgcttaatccgttccttgtgcttcaccccaaaacgctgctcttcatcaatcaccaacaaaccgaggtcacgaaatgccacatctttagaaagcagtcgatgggtgccgacaacaatgtcaatcgtgccgtttttgagtcctttaatcgtcattttattttggtgcggtgtctggaagcgcgataacaagccgattttaaccggaaaatcggcaaatcgatccttcatggtgtcaaaatgctgctgcgccaagatggtagtcggtactaaaattgcgacctgcttaccatagtcaactgctttaaatgctgcccgtaacgcgacttcggttttgccaaagcccacatccccgacaagcaagcgatccatgggtttgggtttctccatatcccgcttaatttcttttgccgatcgcagttgatcaggcgtctcgggataaggaaactcatcttcaaatttttgctgcagatcatcatccggcccgaaagcataacctttttccgcttcccgttttgcgtacaagtcaatcagctcgtcggcaatgtcttcgattcgagccgccactatgcgtttggtcttttgccactcggtaccgccaagcttattgacgttaggcgttttgccatctgcagaaacatatttctgaaccagatttaattggtcaaccggaataaacagtttgtcattgttgcgataaacgatggtgatgtaatcgcgatggacaccgtcaacttcaagcgtctccatgccggtatattgcccaatcccgtggttgacatgaacaacataatcgccaggctttaattcattatagctgcggaggcgttccgtatttgccaacgtctgatggcgagcccgccgccgctgccgagcattgaacagctcgtgttcggtcaccactaccagcttcaaatccggcaattcaaagccgttcttcagactgccatcggttaactgaacttttcctgaaagcagctgattaggttcggtcaccacattactaatctcaaagtcatgtaaggtggcacttaatttctccaagcgattcttatcggaaaccaggaaaaccacggtctgtttttgtttcacccaccgatccgtttcggttttgagcaatggcatctgactaaagaattgttgaacattgcgactcggcacgttagtcaagctatccaaccgcaactgacccattcctttttggaaaaggctcaggtaaagccgcggatgccgatcacgctgattaagcgcttggatcgtaggattaggtgttttaggcaacaaacggccttccgcttgcagctgtgaataccattcagccgtatcctgcaccaaattcgtatcactatccaacaggcgactgtaatcatcaaacgctaccagcgcatcactggccagataatcagtaatgcggtgatgttccggatacagctccggcgcatacaatgccaggttttctggccgttctaatgcttgtaactgctggctggtcgtcaacaagccatcggtaatcgcttgctttgccgctgcatccttgactttcgctttgtaagctgttgcctgcttaccgattcgcgcaccggcatcggtcagcacctgatcggaagcgatcatgtcagtagccggtgcaatggcaatctgatcaagctttttcaaactgcgctgggtagcaatgtcgaagctgcgaatcgagtcgatttccgtatcaaacaactcaatgcgaatcggatcatcctgatttaatggataaatatcgataatcccgccgcgaatggcaaattggccgggcgcactcactaatgaatcacgccgataacccatcgccacaagctgcttggcgaccgtttgcggatcaagctctgaatccatatcaacaaccaactcacttgccgcccatgcagccggtgcgggtaaaattcgcttatatcctgccaggctggtaacaataatgcccggttggccgctttgaataaaggtcagtgcgttgatccggtcgttgcgggtttccggtgaactgaccgccacttcagccgccaatacatcttcaaccggaaaatcataaacaagcgcatcgcctaataaactactcaaatcggctgccaactcgtctgcatgaaaccgattattttcgacaatcagcagctgctttttttgctgctgcaagagtgcgccaaaaaagaccgtcttggccgaacctgatagtcctgtcaccaaatggcggcctgtctcgagcttaggccataatgccgacagttccggatctgcctgcaccatgtcgattaaattcatcgctccacctgcttctttcatattcttcaagtttacccattaccccaagcttcatcagccagcgagggacaagttttaattaaacttattcatcaactgggcaaatggcatgccgtttagccaatcttccaatgcatcatccgctttagtgatagcagcatctatcactggttgatcggttttggcaaatggggtcaacacccagtccacaacccgctgccgctgcgggtgctgaatgccgatctttaaccgatagaattcgtcacttcccgtagcgctgataatgtccttgataccgttgtgaccgccggctgatcctcgctggcgcaatcgtaacttgcccaatgtcagatccatatcatcgtgtaccactagaatttcgtctaacctaatctggtaatacatcattaactgccgcactgcgcgtcccgacgcgttcatataggtctgtggtttaaccaggaaaactttttcatcatgaacacgtgtcgttgctgtagcagcatcgaattcaagcttgttaagggtgagccccattcgctgtgccaagccatcaaccaccatgaatcccatattgtgcttcgtgcctgcatattgacgtccgggatttcccagacccacaatcattttcatattatctcctcatcgtatcgagcttaaattcatgcaatcctgcttggtttaccggtgatgctgacacttaaccaagccaagcgaagaacaccaaacgcctaacccaagtaaggaagttagctgtttggtgttgcttcgccgaatgttaaatgctgcatgtccgcgcactgttttctattagtaagtagtataacacatgccggctgactgactgtatgtctcactttctgcgaactgttaagttttgttaattcgtgaaaatagatgttgcaagcgtttacgttcctgaaagccagcttgtcgtaggattcacaagccttggcattgtaaggctcagccccgctttttaacaatgacaaaatcatgaaaaagtcagtcaattttgtttcagtgatttgataatgtgttatactcacaatgaaatgcagtttgcatgcacataagaaaggatgatatcaccgtggcaagtattacggataaggatcaccaaaaagttattctcgttggtgatggcgccgttggttcaagctatgcctatgcaatggttttgcaaggtatcgctcaagaaatcgggattgttgacattttcaaggacaagacgaaaggtgacgcaattgatttaagcaacgcgctcccattcaccagtcctaagaagatttattctgctgaatacagcgatgccaaggatgctgatctggttgttatcactgctggtgctcctcaaaagcctggcgaaactcgcttggatctggttaacaagaacttgaagattttgaagtccattgttgatccgatcgtggattctggctttaacggtatcttcttggttgctgctaacccagttgatatcttgacttatgctacttggaagctttccggattcccgaagagccgggttgttggttcaggtacttctctggacaccgctcgtttccgtcaatccattgctgaaatggttaacgttgatgctcgttccgtccacgcatatatcatgggtgaacacggcgacacagaattccctgtatggtcccacgctaacattggtggcgttaccatcgctgaatgggttaaagcacatccagaaatcaaagaagacaaacttgttaagatgtttgaagacgttcgtgacgctgcttacgaaatcatcaaactcaagggtgcaaccttctacggtatcgcaactgctttggcacggatttccaaagcaattcttaacgatgaaaatgcggtactcccattgtccgtttacatggacggccaatatggcttgaacgacatctacattggtacacctgctgtgatcaaccgcaatggtattcagaacattctggaaatcccattgaccgaccacgaagaagaatccatgcagaagtcggcttcacaattgaagaaagttctgaccgatgcgtttgctaagaacgacatcgaaacacgtcagtaatcttcaccataactgattttaaaccggcatcaaccgtgatttaatcagtgagtatcaaagtagatcaaccccagagacgaaaaacgtctctggggttgatttcgtttacgccaccacaaccgatgcaggtggcgtcaaccaataccgaagatggccgactcaattcccatatcatcaccagtccgtgcttttcaaagtcattggcttgcgcttcgtttcataatgtttttttaagtttaccgttcattaaccgtaagtggtatgataccgcagttccttcaccaccgttcgaggggcgttgcttttatttccggcgttggtatcttataataagtaaaaataacgtcatttttgaggaagtgcttgttacgaaacaggaacaaacaagaagcaggaggcagcaatcagtgaataagaaaaaatggtggctcctcgcgctcggcgccgtagtcattcttctaggcggattctatatcttccgaagtatgcactaccgcgatcattttttgcccaatacagaagttctgggcgttgatgtttccgatcaaaccgttagcgcggcaaataagaaactcatccaacaatttagtgaacgccaatatacctttgttgaagatgataaaaaagtcttgaaagtcaaaggcagtgctttgggtatcagtcaagacttcaagcaaggacttactcaagtgctgaataagcaaaatccttggcaatggacaacttccatttttgcgggccaaaaagcccatgccgaggaagacccgtcaattaataagacggctttaaccaagtttgctcagacgactgctgacaagcttaatcaagggcgtcaggggccggaaaatgcaaaactagtcgcggatggcactaaatataagattcaaaaagaagtcaacggtacccaaatcgatgcggataagcttgcaacaacggtaacgaatgtccttgataatcatcagcaaaccgttaatctggccgctgcgtacaagaagccgactgttaccgcgtctagtagcagcttgcaaacaaccgaacgcgacatgaacaagctggcagggactaatgtttcattgcagattcagaccaaaacggtgaccgttccgcaagcaaccgtgatgagttggatcataaacgataatggcaaggcaacggtttcaagtcaggccgttaccaattacgtttctgccttatcgcaacagtacagcaccatcaaaaaaacgcgtcaattcaactcgcaacaacaaggaacagtgagtgttcctgctggcacctatggctggagcattaatgttagcgccacaaccgccatgattgttgccagtgtcaaagccggacaggatctcaataaagaaattgtccacaacggttccggttactcaacagacggcgacattggcaacacgtacgttgaagtatccaaagaaaaacaacatgaatggtatattaaagatggtaaagtcgtcatggactccgacattgtcaccggtaagccaggtcaagacaccccatccggcgtcttctatgtctggtccaaacagcgtaacgcaacgctacgtggaaaaaacgacgatggcagcgactacgccagtcctgtttcgtactggatgccaattgattacaccggggtcggcctccacgatagtccgtggcagcctaagtacggcggcgactggtacaaggaacacggatcgcatggctgtgtcaacaacccgccagacttcatggcaaagttgtatgccgcagttgacgaaggcacgcctgtgatcgtgtattaagacctacctgataaaatgaaggtacaagaaatggcttgattccaaactactacggaatcaagtctttttttggccatgattggacgtacatgtttatccaatcagaattacagctgtcacctcgaagactagcggtgctctgagtcgtttcccttttgctcgtctgtctgtaaatatgcttttaacgtcttgatctgcgcctcatactcggcaatgccaaccgaaaaagaaagatgctgggttttagtcatgtttggccattcttttagccgcaactgtaatttgtcaatttgcattcctaaccacccaatttgctgttgaatcatcgcttgtaaggctgtatccgattcgtattcaccaaagtagagtcgcatcaagaaatctgaatgacgagtatccggaacaactgacgcatcaagcgagtcttcaaaaacctttttaccttcttcagtaatggcatattgatttttatttggtcgcccactttggacgaccatttttttggaaacaaggccattcttctctagacgtcgcaaggttggataaatcataccaaaagaagcgtcataaaaatgactgaaaatatttttaaagacttcgttcaattcgtaccctgttctcgaatgtttatatagcaagccaaggataatctgctcattattcatgctaaaacctccaatgatgttgtctatatcttaccacgttaatattaacggaaacaatattaattcttgacatataaatgagggcgcgttaatatccttttatattaatcccgttaatataaacgcaaaaaatatggaggcgcaacatgattaaatcagaatggttatctgtcttaaaacgaccaatggtgatcgttgttcttttcttcattactcttattccggcaatctattcaggtgtctatctctcttcaatgtggaacacctacgagcacacgaaggatttacctgccgcaattgttaataacgacactggtataaccgacaacggtcaagcggttaacgccggaaaagatcttgtcaaaggggtgctcaagtcagattcaatgcattatcacgtcacttcaaaacaagaagctgaccgcggtttgaaaaatggcgactattatcttgtcattgaaattccaaatcatttttcaaaagactcccgatcacttttaacgcaacatcccacggccatgaatatcacgtacaaagtgaatccaggaacagatttctttgcctcacaaatagcaaagggcacggccactgctattcaagccaagctcaaccaacagatttccgctatttactttaaaaatctaacagcaggggtcgtttctggaacccaaggcaacgcaaaattactaactgccattgatgcacttaatgccggcagtcaagccttatccactggtctgtcgcaacagaaaacggcgatcaccgcactcagtaacaaccttccgagtacagcccaaccgttggcaacgcagctaacctcatcgaacattgcattatctaacgctgcaacctcgctaacagctggtacggcaaaggttcaaagtaccttgacccaatcacttaaaacgcagcccaaactagccgtcgcctccaagaatattcgcttattatccgcccctgtcaatttaacccgtgttgacatttcccatacacctactaacggcgtcggcatggcaccattcgcgattgcaatcggcctttatgtcggctgcatctcgcttagttttatgtacgacatgtactcaccaaaaacaaaaccaaccaaagcaattgcatggtggtggagcaaatatagtctgctgttagttctaattgggattcaagtaggctgtcaggccatcgttgtcatgagcctaggactaaaaccgttatccattggcaacacttgtttagcaatgttggtcacggctatcaccttcataacctgtgtttttggcctaaataccattcttggtgctttcggcaaatacctggtcaccattttattgattcttcaactaggtgcttcgaccggcgtctatccgttggaaacagccaatgttttcacccgtatctctagcccattcttgcccatgacctatggcatccacgccatgcgcgaagcaatttcaataggcggtcaaatgacccacgacttggttgtcatgttagtagtcacccttgtcatcaatagtttagtcattgtcaaacttgagttggatcgtaaacacgaaaagtttagcgatcttgttgatgatgtcgtgtcatccatcaactagtctcgctggcaatcagcaaaaaagcagatcgcatgtcatcatccaggaggcgtcacaaggaatatggccactaaattaattttgatcgtgtattgtcacccttacacccacagctttaatcatgctgtgttaacgcacttagaaaaaaacctcaccgatcatggtcttcattatcaactcatcgacctatacggcgatcactttcaacctttttacgatattgaagagttgcgcttgttccatcaagggcaaacacatgatccgcttgttaaacattatcttgatcaattaaaaacagctcaagggatcattttcgtcacgccaatttggtggaacagcgtccctggcatgctcaaaggtttcattgataaagtgatgaaggaaggcgacggtttaacgcatactgtcaccaaaactggcgtccgcggctgcttgactaatttaaaacgagcctatgttttcaccacttctacatcaccaacattttggttccttaccacatctggaaacagcattcagaaaatcttcatcaataaaacgctgaaacaattgggcattcagaaagccaagtggtataacttcggcaacatcagtcatgcatcgaaaacccaacgcgatcattatctggtgacatgccagaaacgacccctgctcttttgaaagtcagagttattgcccggcactcatcaaacatagctatcaggtcgctgacagtcttcttccgcatgaacaccccagaaaaacgttacaccgccagcgaactatggtatcataaagcaagattagaacattttaataaagtgatagttgtttgatggaggaaagcgcatgttaattaagtcgttagtattaaaaaaggaattcctgaccactgtcaaggaaacggttacccttgaagaagcgctgaagatccttgaagactccggctttcggtgtgtgccgatcctagatgagagcggcacgatcttccgcggcaatatttacaagatgcatatctatcgccataaatctcaaggcggcgatatgagtttgccggttacttatctgctgaagaatgcaaccaaaaccattccggtcaatgcaccattctttaaggtcttctttaacatcaaggatttgccgtacattgctgttttagatgaaaatgccaacttctatggtattttgacccacgctaaactgcttgggatgctgtcagaagcatggaatgtcgatgtcggttcttacgttttgacggtgatgtcaaccggtgaacgcggagacctggcaaaaatgagtaaaatccttgctcgctacgtttcgatttccggttgtatcacgttggatgctaagcgtgacgagtttgtgcggcggacacttttcaccttgccggccggtacagatgaaaatacattaaatgaaattgtatctcggctagagaagaagagcttccgggttgtcgaaattgatgatctccaatccggtcagccgcttcgagtagacgaagagctttaatctgcccaatcacgtgcgccatcagtacaagacaagcgtgtaagaacctcggacacaaccattaaggccacttagccgttcgtttccgactagccgactcacgcttacaaaaagctcggcagcattgactgtcgggcttttgtgatggttgaaaaatgccatgatgatacgagcaaaggtgctggaatcgtgcactggtttggactttggcgatcctttataatacagtgaacagtgaagttgttttatttttattgctgcaaatgcatcaagtgcgaatagaaaggatgctacatgtgaaacgaataaccgaactgatgcatcatcttgccgcgatgatgcattaccttcattcacatcatctgaaaccaaagtaccggaatcgcctgcttttcattgctgtcttcataacggtgtgtttgatcgcagtctttaccggacaacatgctaaagagtcagcttcgacagcgtcaagctatgcatcggtcacaaaactcgccaagactaaccacacgccgagttacaccgctgctgaaattactcgggttacgcctaagaagattgactggaaagcaccttccgaaagtcggccttatcctgacgtctccaagcatcccaacctctctttgcatgtaaacttgaaaaagcagcgggtatttattaaagatggcagcaaaacgctttatacaatgtatgcatccacgggcattgacgacgcgaccccgcatggtgactttaccattcaggatgagcgcggttatgaattctttaatcctaacgagcaaatgggtgcacattattacaccagtttttacttacacggtacctatctttttcattccgtaccgacagatatcaacggcaactacattcaatccgaagcagcaaagttgggtaaaaagccgggatcacacgggtgcgtgcggctgagtatttctgatgccaaatggatttatgaacatatcccaacaggaacgccggtttcaattcattaacagatgcctatcaaaaaagtcctctgtagcaacttattcgttgccacaggggacttttttcaaaggctaaaccgccaacctataacgcttcacttgccaatgtttgcaaggacgcatcgactttttccgcacacatgcggccttcgtgaatcccccaaataaccaagctggggccgcggcgacaatcgccagcaacatagatctgggtatcattggttgtgaagttagcattcttggcagtgatcccaaatgcatcaaaaacatcagcttccggaccggtaaagcccatggccagcaccaccagatcaactttgactttcttctccgttcccgcaatcggtttaaaatgatcgacttggctaatctcggcttcactcacttgaccatgctcgccaaagaaagcagtcaccgtagcggcataggtggtcacatcaccgccaaaaagcgcttttgcctccttctggccataaccggtttttaacgtcatgggccactctggccactgattgccagcaggacgcttgggtggtaacgctggggtgatttcaagttgcgtcacgccggcacaaccttggcgaatcgcggttgcaatacaatcattgcccgtgtccccgccaccgagaaccaagacgcgtttacctttcaattgggtattcgcttgggtgccatctttgaggaccgtctgagttgctgtcttgagaaaatcaactgcctgaacaataccgcctaactcgcgccccggaacttgtaactcacgagcctggcgagcacctgtgcaaacaataacccggtcgaattgccgcttgagttcatccgcggaaatatctttaccgacttccgtattggcaactaattcaatcccgacttgcttcagcgtttcgatacgccgctgtacaacagtctttggcagcttcatgttgggaatgccgtacatcaaaaagccaccgaagcgatcatcccgctcaaatattgtcacggaatggcctaactgattaagccgccatgctgcggaaatgccagccggcccactaccgatgaccgccacttttttcccggtacgttgcagcggctttccggatgcaataacccagccatttttgaacgcctgctcgatgatgtacttttcattgttacgaatggtaacgccgggaccgttaagtgcttgaacgcaggaaacttcacagggtgccggacaaacgcgtcctgtcatatccggtaacatgttggagcgactcaaccgttcaaacgcccgcttgtcttccgcacggtaaaccagatcgttccattcgggaatcagattgtcattgggacacccgctgaccgcgcgaccgccaccataaaagacaccatgatgacaaaatggaatgccacaattcatacaccgcgctgcctgtttacgtcgttcctccatgctgacgtccagttccaacgcatcaaaatccttgacccgctgcataattggacgcatgggattatctttgcgctgatacttcaaaaagcctttgggatctgccatcacgttgccctcctcatatcattcgtaggtacttctttagtcgtgcttttatcaaaatcatcggctagtgtccattgcccatcgccgtgtcaaaagcctgctcaatgacctgttcttcagacaactcgggcttggtaaacttttgaatgagatcgcgcatcttatgataatcacgcggataaactttcacgaactttgttttctcggtttcccagtgtgtcaaaatcatttcggccgtctcggattgtgtatattgcacatgctttttcaataaatccagcagcacactatcatcgcctgcttcatctagccggtacaagtccacgagctcctgactgcaatttttggcaaagtcatgtgcccagtcgtaaacatacgcaacgccaccggtcatcccggccgcaaaattgcgccctgtgcgccctaaaatgacggcaaccccaccggtcatatattcgcagccgttattgccgacgccttcaacgaccacttgtgccccggaattacggacacagaaacgttcaccggcccgcccgttgaagtaagcctcaccgcccgttgccccaaagcatgcaacattgccgacaatcggtgaatgcgtataaagttcacgcgcctgttctggtgccgccacaatcaaccggccgccagaaagtcctttacccacatagtcattagcttccccgaccagtttgatggctaatccttgcgtaataaacgccccaaaactctggcctgccgtaccgtgatagttaaactgcagctgccccggtttcaacccattattgccaaaatgcgcggcaatccatccgcccaggcgcgttccaaccgcccgatccacattattaatcggtaaatcaatcaaggtggcattttgctgtttaagactggtttcagcaaaccgatccaaatccggccagtcgtattttggcttaaatggattggcttttttacgcgcaatcggaatcgtcttgcctaacattcggtcataattcaatgtctttgccttgccatatggcacatagcgaggttttaggtgttctccgtgtccaaccatttgatctacggtgcgataacccaaagccgccatttgttcgcgcagatcttcggctaaaaattgcatcatatgcatgacgttttccggacgtccggcgtagagtttgcgcaattccggattctgggtggcgatgccgaccggacaggtgttgagattgcattttcgcatcatcacgcatcccagcgctaccatggtcagggtgccaaaactgaactcttcggcgcctaacatgatcgcaaccgcaatgtcgcgcccggttaagagtttaccgtcaacttccaaagtcgttcgctgccgcaatcgatttaatgccagcgtctggtgggcgtctgccaatcccatttcccacggcaagccacagtcacgcgtggagtttcggggagcagcgccggtcccgccgtcataacctgagatgacgaccgtatccgcgccggctttcaccactccggcggcaatcgtgccaactccggtcgaggacacaagcttaacgttgatcttggcataaggattgacttgtttgagatcgtaaatcaactgggccaaatcttcaatcgagtaaatatcatgatgcggcggtggtgaaatcagctggacgccggcaatcgaaccccgaatgctcgccacccacggatatgccttgccagcaggtagttgcccgccttcaccgggtttagccccttgcgccattttaatctgaatttcttcggcactcatcagatactcggtattgacgccaaatcgtgccgtggaaacctgtttgatcttactgttgcggttaacgccatctgccccgacatggaaccgattgcgattttcaccgccttcacccgagttgctacgggcgcccagccggttcatcgcaatcgcaatggtttcatgcgcttcttctgaaagggcgccaaaactcatcgccccggccttgaagcgtttcacaatggcactgaccggttcgacctcactcaaaggaaccgcttgttggccgcttggtacgatcgtccacatcgaacgcaaggtgaccggggttgttttggcttcctgttctacttccgctgcatactgctgataggcctgataatcaccgcttctgaccgctttttggaactggtaaatgctcttagggttataaagatgcgcttctccatctgccttgaattggaagctgccgcctgaaggtaaatcatcaatggcatgatgactgaaagccagttgatacttctgatagtactcattttccaactgattcaggttaatcccgccgattcggcttggggtgcccgtaaagtattgggcaacgacatcatccgccagtccaaccgcttcaaacagctgggctccttgatagccggcagtcgtcgaaatccccatccgactcataatcttaataatgcctttggtggcagcagcacaaaatgacggcagttgctggtcatagccgcgctcacgcaaggtggcaaatgcgccataaggatgaatggccgccgcaccatacccgaccaagcaggcaaaatgatgaatttcgcaagcttcggccgtatccaccactagcgatgccgctgtccctttgccttgacgtaccagataattgtgcaatcccgacacggctaaaagaaccggaatcgtcagctggttatcggcaactggccggtcagtcaagattagaatcgtcgccccgttatcaatcgcattttctgcttgggtaaacaattctttgagcacatgtgccaggcgatcaggtcggtccgtcaagtcgtaggccaaagataacttagcgaccttcaaaagcggcaagtccaaactaagcactttagcgtatgcccggtcatccagaatagggctgtcaattttgagtttgtgacaattgtccgcagtatcgcgcgtgcaatcgccatcgcggccaagaaaaccaaacgttccaatgaccactttttcccgtaatggatcaatcggtgggttggtcacctgcgcaaaagattgtttgaagtaggtgaagagtgattgcgggtggttacttaaaactgctaatggcgaatcaaaccccattgccaagacaggttcgccgccgttttcagccatcgggatcaacgctgtctgaatgacttcatgcgtatacccgtgccgcaaccatagttttttgagctgatcaggtgcaatgtcttctttaggctgaacctctggcaattgatcaagtgtgagccgattagcattgagccattgttggtatggatagccttctgcacaatgccgttttagctcatcggttttgaaaatccgccctgtacttgtatcaagcagcagcatttctgcaggtgccagaatccccttttcaacaatatcgccaggatcaatatccacgaccccggattctgatgcgacgaccagttggcgttggttggtcaaggtataccgcgatggacgcaatccgttacggtcaagaaatgcgccgacttgaataccatcagtgaaacataaagcagcgggaccatcccacggtgccataaacgtcgcattatattcgtcaaacgcgcgctgttcatccgacatttcggtaccggcaccccaggcttccggtaccatcatcagcaacgattgcggaattgaacggccgtgtcgatataagtattccatacagttttccagcttagcagagtcggaatcggtttcgtcataaatttcgataccgtggcttgtcatccaattttcggcgcccttaagcgtattaatttcgccgttatgcgccagaaaacgaaacggttgtgcccgatcccagctgggaaacgtattggtcgaaaaacgagaatgaatcaagcagatagcactttgcatttgtggtcgatgcaaatccggataaaaaagactgacttgatacgcatgcaacatgcctttatagactagcgtacgactggaaaaagaacaaatgtacattgattgccgatcaaaggtcttttccaactggcggcgtaacgcatataaatgatcctcaaattcacgcccggcctttgtgtcagctggacgttgcaccacaatctgaacaaaacccggcattgcttgttgcgcagccggaccgcaattttcataaataaacggcacgttacgggtccaaagtatcggaaagcccgcgtcatcaatttgatcaaccacagcctgcagcatggcggcctttttggcttcatcatggggtaagaacaactgggcaaccgcatagtcacccttagccggcagtgtcaatcctgcttgcgtcatttcatcgcgaaaaaacgcatccggcatcgccatcaagattccggcaccgtcaccggtatcaggttccgcgccagtacccccacgatgattcatccgctgcaacatggtcaatgccttttccacgatttcatgactggcatgaccatcaacttgggcaataaaacccatgccacaagccgcatgctcatattcaggcaaatacattagattggtatcatcttttaatcttttcatagaatctccgccttattcattaacgtccggtccttatcagcgttattgttctcatattattctaatcatgtctcattgacaagatttttttgaccgaacacgcgtgatgattgcgcatatttgttttgtcatgcacaaattaaattgccgtcataaccacaaaaaaacggctccaagcaggcaatttgctgctttagaaccgtttatccgctgtaccatgacacgcttataacttcaaataagtcttcacagattccaaataaaccctgtatcacgaaagaacttaggcaccatccctatttttgcgccatggtcgtccgaaaatgaacaatccggtcaagtgccagcataactggagcagaaagggtcatgacaatgaactcagacagcatcagagatccatatgttggcagaaacatggtggcaaacttcaagtgaccggtccaaataatttcaactgcaatcaacgccattgtcagtgtcatgaccgcaatattcaacgcaaaacgttgccataattgctttagcttaggcgccaaccaagctaccaacaataaccctataaggctctgaccgccaccaaagacaacatccaaccaacctaatggcgaaaaaatcgcgttaaaaatgacgacgccagaaaccacgccgatcaagtagcgccgatcaaagaccactaaatgattcaagctttccgagagtcgaaactgaatcgccccgctggcaagattaaggctggccggtcctaacgataaaacaatataaatagccgccaccaaagcatttaaaacccaaccgcgaatacccatttttgtttgcttcataccgtttaccgctcccttacttaagcttggttatgtattacttattctccataacacgctccccggcgcaaggatctgcgtgtaaggaccttgggcgcaatggccaaagaccggccatacgtctgagaccgcttatgttctggtttacgcccatagcgcgttcgccagcccagaagcctgcgtgtagggaccttgggcgcaatggccaaagaccggccatcacgcccaaggccacttatgttctggtttacgcccataacgcgttcgccggcgcagggatctgcgtgtaaggatctcaggcgcaatggccaaagaccggccattgtgcctgaggccacttatgttctggtttacgcccataacgcgttcgccagcccagaagccgggctggctcacgctcatcaaaaaagcgcctctttttcatcgaggcgtttgcttagtttttattatatgttttcggcttaggcaagctgacgagtccgaccgatatcgccagtgctcgatccaccgctgccattttggcacttgaaagagcggtaacgcgtgcctgtaaccgttgcttatcaattgtacgaatctgttcaagcaaaatgactgaattacgctcaaccccgtcttgcttggcgcgcaaaccgacatgagtgggcattttgggtttttggattttggaggtaatggcagccacaatgacggtgggactatagtgattgccaacgttattttgaataataagtacgggccggttgccgccttgttccgacccgacaaccggcgataaatcggcgaaaaatacatccccgcgtttgactgttacatccatgctttggcccccttgctgcttatcgaatatgggcgtatgcctcactttcgcaggcggagaaagcatggctgatttccgtattgatttgtcccattgccacatagcccgaaatcaactgattgatctcaggtgcttgtgactgcaaaaacttcgccactgcttcagtaatgacatcctgaacacccatatcattcaactcacaataggcatccaaacgcgctttgatagcactatcaagcgcgaccgttactgacgtttccttcttcatgacaacttcctccaacttcccaagttcatggtgatactttagcacaaaatcagctgatgggctacctgtcaaaaaatcgcctcgtctcatcctgtgcgaccgaaaccgattttaacgcgcaatcgggttgatactttgacgtttcaaccgcgatgttaaattgcaggcaatttcataatgaatggtgtggctatacttagcaacgtccaatagcgtaatctcctggtcgccactttgcccgattaacacaacttttgtacctgccggataagcttttggcaagcgaatcatgaactgatccatacaaattcgcccgacgatttcacacagatgaccatcaactaagacgtgaaagccctgtaaccgccgcagccagccatctgcataaccgactggcaccgtcccgataaactcatcacctgtagcgcgatacgtcaccccataagaaatcccatcgccggcatgaacttgcttgcaaaaagttaattcgctctccagtgacaaagccggctcaagcggaaacggtgtggtcggaatcacatcacctgatggattcaaaccgtaaattgccacaccataacgaaccatattgccgttacatgctgcatgccaaagacttgttgccgaatttgacacatggacatagcgtggccggtgcggtaacaaagccaccatatggttgaatttggcaacttgctgtttgaagtaagcatcatcaggatcatcagccgtagcaaaatgcgtgaagatcccttcaatcgtaaacgccttgggatgtgcctgaatgaaggcaacggcatccaaaagtgtctgatcatccgtaaatccgatccgacccataccagtatctaaagcgatatgcagccgcaatggtggtaactccggttgcgcctctaaaactggcaaggcctgcttgagccagtcaacactactgagcggtaacgaaaccgtctgcgcagccgcaatagcagcatactgactcggaacgattcccaaaaccagcactggctctgtatagtttgccgcccgtaaatccaacgcctcatcaagcaacgccacacaaaaaccgctggcaccggccgccttagccacatgcgccacccgcaacatgccgtgtccatatgcatccgcctttaccacggcaaacagttgcgtctgctttttcaagcgcgccacctcatgttgaacattatgcaaaattgccgtttcatcaatcaaaaccgttgctggtcgcaagttaccgatcgtcacgttcaggaccttctttttctaatattacctcggtaaacaccaaagtctcactatgggaaatggaaacaaatgcctttccgggaaagggatgtttcgtcacaattggcttgccaagttcgttattcaaaacttccacatcttgcaaggcaactttacccagccctgtcccaaaagcttttgagtaggactccttagccgaaaagcgaccggataaatactccaccgctcgccgaccatcgagttgttgataattcgccaattctttcggcgtcaaaatcttagcagcaaatccatggttcttctcttgagccgcttgaatccgcgccaagtctgtcacatcaactccaataccataaatcatggccgcctcccacaaatctgtgataccgctattttaacatttcaccaaacagccgcctagtgagcacgaaaaaacgatcccggaagatgcagacttgcatcaccaggatcgcttttcagcactggtcattgattcgcatgaatgaccggtctattaacgtactggtgattattcacccgtacggattttgaaattacgcttaacgtttttacgtttgtcgccaaagttgcgcttcttgtcgtaactgcgcttgccatcgcgattaccttgatagccgccatcgcgtcgcttgcctttgtagccgcctttataaccgccacgattgttgccatggccgtgattgttgcggccgcggcgtggtaatggacgttctggtgtaattttaaccggaacggcactcgcatcgtcagggctgactgccttgagatacgccgaaaccagctgcaacggggtgtagttttccaacaaggtttcagccattgcttcatacttttcggtatcgttagcttcaacttgttccttgatggttgctaagccgctggagatctggcccattaatgcttcttcagctgtcggcggcttcatcggtaacatccgcttcttggtgagatcttcaatggtgtgcagatattcaatttcatttggcgtgacaaaggttacggatacccctttatgtccggcgcgtcccgtccgaccgatacggtgaacataggaatccggatcttgcgggatatcatagttgtaaacatgggtgacaccagaaatgtccaacccacgagcagcgacatcggttgcaaccagaaaatccaattggccgctcttgaactgccgcaaaacgctcattcgcttttgctgggttaaatcgccgtgaataccttcagcccgatagccgcgtgcctttaatccccgtgtcagttcgtcaacacgacgcttggtccgtccaaaaatcagtgccaagtccggatcctgaacgtcaaacagtcgtgtcatgacatcgaacttttcatagtccttggcccgaacataatattgctcaacggtatctgctgtcagttccttagccttaatcttgacaatcacaggttctttcatgaacttgttggttaagcgcatgatcgctgccggcatcgtcgcggagaacagtaatgtttgacgctcggtcggcatttgttcaacaatcttttcaatatcgtcaatgaagcccatatcgagcatttcatcggcttcatctaacaccaaggtatcaaggtgttccaactttaaggtatgacgaccaatatgatcaagaatccgaccaggtgtcccaaccacaatttgcggatggtcagcaagctgacgaatctggcggcgaatatcagcgccgccatagacagcctgaaccttgatcttcttgtcgcggcctaaacggtaaagctcttcttgggtctgaatcgccaattcccgagttggggaaatgaccaatgcttggatactccggtcggctttatcgatgtgttgcagaattggcaagccaaatgctgccgttttcccggtaccggtctgggcttgaccgatcacatctttgccttccagaaccagtgggatcgtctccgcttgaatcggcgtcgcttcctcaaaacctgactgggcgattgcctttaagagatcatgatccaaacctagttctttaaacttcaaatgagttcctccttgagaattcttgcacgcgtttacccaagcgtgttttcaagaaatccgcgggcgtcacgtgcattttcagtaaatgacaaaaaaacatatcccaacaatagtagcacgtccactatcgaaaaacaaggacggcgattgcgagatatgttaaccaggcacaggtaatgcccactttcatctattaaaagtagtaaaagcttttagtattttcaagaaaattaaacttactgatgcccctcaatatcttgttcaaagtccgattcacgcatgtccgcctgcgaccagcgcagccaaaacagtttccagatgcagaccatggctcgcttttagcaacaccatgtcatcgtgcccgacatcgttttgcaaatcgcgaatcatggtacttttggcatccagcgggtaatagtgtacttgatcttgcggatactttgtcgttaacgcttcggcaagtgcctgcatttccgaaccgtataagtaaacctcctgaatctcgtgcggatcaagtgcatcggctagtcccgcatgcaacgcccggctttgctcgccaagttcaagcatgtcacctaaaacagcaatgtggcgtcctgccgtctgaaactcgctaaaatcatggatgactgctttcatcgcagtggggttggcattgtaaacatcgctcagaatctgctcgccgacatcgccaattaaccattgcgtgcgattagccgtcacctgaaaatgcaccagtgctttttgcatggcttccggcttgacatggaaacgccgacctactagcaacgcagccaaagcattgaccacattgtattcacccataatagggattgaaaaggtcaattccggccactgttcgacggtaaattcggtatgattgcgatggccgctaatcgaatgggcaaaaagcgtattttccggatgtaaaccaaatgtttcttgcgattgggtaacttgcttagcgcggctcactaataatggttcgtcaccgttaaaaataaaggtgccatcctctttcaagccatccgtaatttccatcttggcatctgcaatcttagcgcgcgtcttgaaaaattcaatatgagcctcgccaatcatggtaatcactgccacatccggttcggccaacgatgacaatgcatgtaattggccaggccgatccattcccatctcaagcaccagcacttcggtattgggctccatactgagaatcgtcattgggacaccgatttcattattgtaattatccggcgtcttcacaacatggtattgcgttgccaaaatcgccgcagtcatgtcttttgtcgtggtcttcccattgctgccggtgatggcaacgactttagggttcaccttcattagcaaataatactgggctaacttctgcatggcggccagcggatccgggaccaccaatgttggcagtttagtcgtcattggcagatggtcctctgccacaaaagttgcgactgcccccgcagcagccgccgctggaataaactcgtgcccgtcacgctcgccacgcaatgggacaaataacattcccggcttcaatcgccgcgaatcaaatgccaccccggttgccacttgcgaaccgactgtttcagagagcggctgggcttttacgacacgtgcgatctctgccaatgtcattttcatcattaactcgactccaattcttcaacttcacctcgtttttcaacaagatgacaaacatttttcaatcaaaatcacggaacaatttgcaattacaacaggttcttcctgcctaaaaacacgaaactgccccgcaacaggcagtttctttagcgctcggttttttcttgatttctatcgggatctagcaaccattgattcttttgccgcattaaaactagcttaccgagtttacgcgccgtctcatccggaaaaataccatccggaataaaccgctcatgcagcgccagcaacggaatcgtgatccgttcacgcgaaaactgaacgtgacggaaatcaaacaccacaccatcttcaagtaaaggtagcagctgcgtatacgcaccgtgcgacaagtgtgaaaagtgttgttgtcgcagccgcaaccaaaatggctgttcattggcaattcgtcgtaagtatttattgatcgccgcagctaaaaaggcctcaaataagctttcatgccgtaaatacatattgaccgtgccattacgcatcggcaaataaaccagctcattttgcaatttatagtaaaacggtgagttcagatgcgttttcgcatgacctaagtatagcagttctgcgatctcattaggggtcagttcctgcaaaaaccgcgaacgcgaataatccaaccagcagcgggtttgcccttccttactacgcaaaaaatcccgtacttgatctttgccattgataacattaaaccaagtgtgcggatcaatctgttcctgttcattgacaggtggcaacaggagcaaatgttccggcagtttttgatggctattcagcaagtcactcgccgaaatcccataagtcaaaaacaaatgggctaatggttcatgatgaacataaatcagtgcattccgcatggttaaaaccccttaatactcccaccactattatacgactttcgcggctcttcattcatgcagtatgatgaatttaaagcgcacgtgacatcgacaaactgcactgttaggcaccggccctctctgcagctatgaaaacacgctaaaaatcgcacccatcacctaggtactggcgctaacaagaaaagaggaggttgcaacatgctgccatggccaaaaaagatcccacaacctaatttaccaacaattccagaaaccgacctcataccttcgacttatttttcaatcattcaaaatgggattttccctaaaaattggtggttgccgacatcggagccgacaagcgatggtttgaccggcgtcggccttcatgcactggcaacacccggtccggcaatcacctcagacgacctgccatcagactttttgccttttgcccacactgctcaccaatacttcggctttgatttgcatcatgaggttcgccgaatacgttacattgacaccgaagtcgatcaatggctgacggttgcgccggactttgatacgtttctcaagcgcctgcaaccgcgtccgattcagctacctgagctaccggtcgacccacagattttcggacacatggccgtgatggcaacggcttcagattggccggccttatttgatcacgcccgcgaatttatgtctggcgaaacactcggccaatggttaatgtggctagccgccagcgatgatccggctaaacgccaagctgccgcagaagagtaccgttttctcgtgcgctatcagcccaacttgcttacgcccaatgtcaccatgaacctgcaacatttattgcattaagtagcactaggcaactcatttatgccgagcttgatgcggttgaaaagcaaacgtcttcaaccagcttaagtcacgtttaatgccaaaatagccaaccaacgccaaccctaatgaacccagaaagtccatcaataaatcacccatcgtatccatgagcgcggcccgcccacgtaatagttcaccgccagcagccatatatcgctgcatgttcatacccagtaacccatcaaatgtaaactcataaaactcccacaataccccgatggttgtcccaaacgcaagggcaaataaagccatgagcaatggacttgtcgcggccaaccgttttgccggcgtcagcgctgtaaaaatagcaaagccaagcccagcaagcatcgccgcactgaataaatgctcaaacttatcccagtacggtacgctatagcattgcaatcctgtacccagtaaaacactcaagaggataaaaatttcaaataagtaaatcaaactcggcggaaaacggaaatgccaccagtgctccatcaaacgcggcaaactaacaattaagatgcctgatgccacctgagcaagtagcatcatctgaccatgaaacaaagaatgaccactaagataaagcccgccgacaatcagtaagtaaagtatatcgccaccgatgtttaaccaatacaaaaaattcgatcgtttagtcatcattttcctcttttctttgtgattgtgaaccagcttggttactcctggcacgcgcagaggcaacccgcgcttttgtttatgtctgtttccggctcccgcttccatcaatatggtggtcgggagtgcgccatttaagtcgtgggttttggctcaagagcaaactcgagaaacgaagcccgccattttctggcatcagtgcaattaatatgcttttgtaagcgcttggtgtagactcagctttaggaggtgattccatgccaatcaaaacgttacccgaagatcaacttattgccatgagccagtccgtcgtcaaagaagtcgccaaagcctttaactttccttattatgtcaatgatctgacgcatgatgcaaattttgacactgatcacactgcgaccaagctcgaatttgagctcaccttgttgaacgaccccgatccagagcgcaccatcagtttttacagtgacgccagcgccgatccaattatgggcggcgccgcttctgcacaagtgacgattctatctgatatcacgtttatttatctaaacgacgggtacaaggattcgtatctcattatcatccatgatggtaaggttgttcaaaatctcaaattagaacaacagattctgtcaggccccgaaattgaaaacttaatcaaccaagtcatcccacaagctcaatgaatcttagcgttaaaaaagcagctgaaaagctgtttttttgttatcctcggttttgttaaccacgtaaccttcagtttagccgcaaaaaaactttatcgaagcaaaatatacttctcggcagaattcacattttaacggccgatttagggaacccataaatattttatattaaaaatataatgcccacgctcaagactttgagaacacaaaaaaaccaccattaaaggtggaaaagtttgggggaacttttttgggagtgtaagttaatgtgtaagcttaaggctaaaatacctctgccttattgatttaagtatatcaattccttaatgatatgtaattccattttcaacaagaaatatgtttaataaataaaacggcttatgcttatataagttgaagctaacaaaaaagcaacctcaaaaggctgctttttttgcttatttcttgtcgaagccgtacttcttgttgaaacgatcaacccgaccatcagcctgcgtgaacttctgcttgccggtgtagaagggatgtgaatcagatgaaatttcaacccgaaccagcggatattctttgccatcttcccacttaatggtttcttttgaagttttggttgaacccgaaataaatttgaaaccagttgctgagtccataaatacaactagatgataatctggatggatgccttgcttcataatcaattactccttttgccctaaatcattgcctgatctagagatactctgactacaactctaacagtctatcacgcgcaaacagtaaacgcaatctcaatctactaattcaacatctgcacctaaaccacgtaatttcatcacaacccggtcatagccgcgcaagatattatcgaccttcgtaatcgttgtggtgccttcagccattagcccagcaatcatgagacacgcaccggcacggatttcctcggccgcaacttcggtcccttgaagatgatcgcagtggtgcaaaataatcacgtcattttcaatcgtaatgtcagcgcccatacgtaacagttccggtatatgccgaactcgtttgggataaatggtgtcgataatcaagccttcaccatgcgcttttaacataagtggcgtaatcggttgttgtaaatccgttgcgaatcccggatacggcattgttttaatttggaccattttcaagtcgccggatggatagacgaaaatgctatcctcgcccacatccatcaccacacccatttcttccaacttagccaaaaatgcatctaagtgttcggaaatgatgttcttaactttaacgccttcacctactgcagccgccatggctaagtaagtgcctgcttcaattcggtcgggaatgatcgtatgcgaattatgcgcctcaagcgttggcaccccatcaatgcgaataacgtccgtgccggcaccgcgaactttgccacccatattgttcaggtaggttgccaagtcgataatttccggctctttagcagcgttttcgatgaccgttcgtccttttgccgtcaccgccgccagaatgacattgatggtggcgccaactgaaaccatatccagaaaaatacgggcaccatgtaagccttcagccggcgctttaattgccatcgccccgtgttcattgctcactgaagcacccaacgcttcaaatcccttaatatgctgatcaataggccgcggaccgatatcatcgccaccaggcagcccaacaattgctttgccaaagcgccctaataacgcgcccataaaataataggaggcgcgcagactcttaatcttaccgtttggcagcggcacatcattaatttcggttggatcaattgtcagaacattttcggtaaaatccgatttaacattcatatcactcagaatcgccatcaaattatagacatcctgaatatgcggcactgaatcaagtgtcaccggggtgcgcgacaaaattgcagccggaatcaaagcaaccgtgctgttctttgcaccgccgatcacaacttcaccggataatttctttccgccgtggatcagcattttttccatttgaattaaatcctcacttaaggtcgttcatttcaagtaggctgaagctgacctgcattttatgcttcaaatatcaatcacgaacactggtaggcaagccatgacccattcgccatgcactcaatatacaagtttaatgaatcagcacgcaaaaaacaaggactaaaagttagtgagcgcgaaccggcgcgcttagggatcggagtgtaagcggcctcaaccatgatgccccttttgccatcgccttcgagccactcacacgcagaccccttgcaactctgagcgcattacgaaaatgcataaattgacctccgccacaatcccacccccaaatacaaaaacagcctcaaggactgaacctcaaggcagttttcaaacgcaaaaatactaatttttaaaatcgccagctgattggatgaaggctttgaacagtccttctggcttgtttggccgtgattggaactctggatggtactgtgaggcaacgaagaacttattcttcggatactcaatgatttccatcaaacggtcgtccgggctaacccctgaaaagaccaagcctttctcctccattggcttacggtacttggtgttgaactcataacgatgacgatgacgtttctcgatttcatgagcattgtcataagcctttgctgcgacggatcccggctttaagacacatggataaaggccaagccgcagtgttccgccaagattcttcacgccaacctgatcacgcattaaatcaatgaccggatccttgacatcaggatgtgtctcggttgttccagcatctttgagtcctaagacattacgtgcaaactcaatcgaagccatttgcatacccaagcagatgcccaggaacggaatatcattctcccgtgcgtaacgaatggccgcaatcttgccttctaatccgcgatcgccaaaaccaccgggaaccaaaatgccatcaaaaccttgtaacagactttctacattgtcatcattaacgtcttcagcctgaaacatctgcaagtcgatatcagaatcccagtagtaaccagcatgcttaagtgcttcggcaactgagatataggcatctttcaacgcaacatacttaccaaccaaggcaatcttggtttgatgcgtgaggtgctgaaccttatgctcaagcttagtccaatcagtcatatcggctggtgggacatcaaagccaaagtggtcgacgacgatctgatccatcttttgggcttgcagggctaacggaattgaataaagggtcttggcatcgcgtgattcaatgacagcattttccggcacatcagtgaacaacgcaattttcttcttcatctcttctgtaatcggtttttcggttcgtacgactagcatgttgggctggatcccgatactgcgcaattctttgacgctatgctgagtcggcttggttttcatttcatctgccgcgcgcaagtatggtaccaagcttgcgtggatatagaaaacattttccgaaccaacatcacgtttcatttggcgaattgcttcaagaaatggcaaggattcaatgtccccgacagtgccgccgatttcggtgataatgacatcggaatcgctatgcttggcagcgcgcataaccttttccttaatcatgttggtgatgtgggggatgacctgaaccgttgcgccgagatattcaccgcggcgttcgcgttgcaggacttcagaataaattttcccggttgtgacattgctgtacttgttcaggttaatatcaataaaccgctcataatggccaaggtcgaggtcagtctcagcaccatcatcggtgacaaacacttcaccatgctgataagggttcatggtgcctgggtcaacgttgatatatggatcaaatttttgaatcgtaatcttcaaaccgcgattctttaacaaacgacccagggatgcagcaacaatccctttacctaatgacgatacgaccccaccggtaacaaaaatatacttggtcatagccagtctcctttttaaattaatcgggaaaaacaaaaacaagctccctgttcatacgaacagggagcttgaaccgtattggctttacacttctgtaaagcgcccaaaatgtatattaaccaattgtacgagatccgtcaagcattaatgaaaaaaagtaagtatcaaaaccatgaacgaaaaactcaaacctaactgaataaaaggatacgtcaggtcaacgatgctccatcagtgaattttatcagtctcctgaggcccatgtccatcatctcgactgaagtttggtcaaaacacgctcactctttcactcactttcctacaaatatatgagcctaacatttgtgaatagcaataagattgttacaataaggttgtggtcaattgaacgcatgtaaaaacaattttgtaaatgaggaagtggtaaatcaatggcagatgttgtcattttaggtgccggatatgcgggcattcgggccgttaaaactttgagtaagctcgcgccaaaaggaacgacgctcacagtggttgaccaaaacgccaatcatgaagagcgcacacagcttcatgaagtagcagcaggtaccgtgcctgcaacgaaaattacatttaatatccagcaggttcttcccaaagatgttcagtttatccagtcaaaggtcagcaaggttgacgtgtcgagcaagctagtggtactggaaaatcatgcgccgctgcgttacgactatctcattatcgcgctcggctttcgctctgaagactttgggctacctggcgccgcagaaaacgccttgccactggacaatgtgacctccgccgaaacgattgccaagacaattgaacagcgtgtcgccaattacaagcagtcacaagatcccaaagacttaacggttattgtcgcaggcgcagggttcactggggttgaattattaggcgaattgacacatagtctaccggcattagccaaaaagtatgatacgccacctgtcaaaatcatctccatggaaatggcaacgcgtattttgccgatgttcgatgaaaagttagcaaattatgcaatggattatctaaagagccatggcgttacgatgatgaccggttccaagattaccaaaatcgaacctaatgccgttgtttatgctgacggcgatcaggaaaagaaggtcgaaggcaacacgatcatctggacagtcggtgtttcaggcagcgatgtgatcgccgattccggcttcaaccaacgccgcaatcgcgtagttgtttccaatcacctgaatctaaccgaccatcctgaagtcttcatcatcggggatgtatcggcagtgatgacagacgctggccgaccttatccaaccacggcgcaaatctcctcccaagaaggcgatcacgccggcaagaatgtcgccgcagcactaaacggtcaaccgttaacggactttgtttacaaacctaagggcactgtggcatcgcttggcagtcaagacggtatcgcccaaatcggcaagagccacaagtacaccggcttcattgccaaggtgctcaagcgtgtgatcacagataagtcactgcttgaagacgccaatttgagcacgatgttaaagcaaggacgttggccgctttaaacgttccggtaaaagcaacaagcacgtactaggtcaatgatgatcacaaaaaagcagcgaatatcgctgcttttttgatgcttaaaggtatggtattaagtcattccccttgatttgcatttctatcgttttggttaacggcttcctccatcttgcggacagcatggttatattcagtaatgagtaacctgatgtcaatggaatcaaccttagattcattatgcggaagtggtatggttgtgacttgaatccgcagcggcagatttgattgttcaaaaaaatcggatagtgctgaaagaaattggagtgcatgcatgagattgccataggatgaaagatgattaatagtcaagaagatataattttcaatttcttctttttctagcaattctgacaccttacatgcttcagcaaagttattgatggctctatcaaaatatgtcatagcgttcctcccactaatagcggctaattaaaaacaatcttagaagccgaatcgttttccaccgtttgcatttctattagtttgattgacagccttctcaagcttttgaacggcatgacgatactcagacttgagcagctttgtgacaatgaagtcgaccttagattcattcccggaaagtggtatttgcgtaacctgaatttgcagcggcagacttagctgttcaaggaaaccggccattgctgaaagaaaaattagcgcatgcataaggttgttgtaggatgaaaggcctctaatcttaaagaaaacaaagtcatcattctcgtctttttctagaagatctgaaacctgatatgttttcgcaaaaaagtcgatagttttatcaaaatatgtcatgaaaaatctccgcaatcatggtgactgaacgttaacgatcctagaaactggttccaacgtcagggataacactcaataagcatcccgctgaatgtacagcttgccccgacaagccggcatcgccaacattcctttattcgtttcaacaatacccaaaatttcacctatccaaagattaaataaataattatttcaagtataccaattgtgttttttacgtcaacgattttgaaaattttccaatgctgctcatgaacgccttgaatctggtcgtctaggcgtcttattgcggtaatctttatttttgctttgccgaaatgccgtaaaccactgatcaagtattgccggatcaattttcaattcctgttgcgcagtacggctaaacttttcccaagcagccttgtttgccgcttggtcgccatgagcactgcgtaaatcgcgaatgtattcacctacaagtcgccggaatcgcatctgctgatctcgattcatcttcaagtaattccgttgccctgttgtcgccatctgctgcataccggtgagttcgcgggcatcgctgtcgattgtaaaaaatgagcggattggaatggcaatgtacaaaatataagcagctttaggtaaaaataccgccagcaccataattgcggcaatcatcaagaaattttccaagttgtgggcgccgtaaatgctcgtgtagatttgttgcatttcggccttattactagcttgctgatgcacaatcgttcgtgaaataatgcgaaaaacggtaatcactaaaagatacagtgcaccataaataaccaccgaaagcacttcaacgtcaccagacatcaagcgcgtcaatgccggtaccagcgaaagtaggaaaactaaaataaattcccagatgacaattcgccgcgggatttgtttgacctgactaaacaaagtcgcttgctgataccaaatatttgctacaaaacagaaactaactgcataaatgccaaccgctagaaaaaactcgctgatatgtgtatgattttgccaactctccgccggcaattccaaaaccatgatcgtaataataatagcaagaatagcatcgataaacgtatccagacgggttttaagatcctctgaaatcataaatagcctcctgagtgtgtgccagcgtacttagaatcgaagtgtaagcgagccatcagcttggatcattgtggctgaggccctcacacgcaaatttctgcgctgggaaacgcatcatgataagcgtgagtcattacactatgatggcagtatcagcttttcaggaaaaatgtcaagctcgtgaaaacaaaaaagccacaccttaaaaagtgtgaccgttaaaccattaatgtttatcgttgtcgtcttcatcgtcagcatcatcgctgtcatcatcgtcatcgccggagaagtcagctgtgatgtcatcggtgtcgtcatcttcgtcgctgtcattgtcgccaaattcagctagctgaccttcaatgccatcgggaagtccatcatcaggatcatcatcgctgtcatcgtcactatcgccggccttgccgatcttgtcatgaaagccagtgctgtcatcatcatcgaaatcatcgtcatcgctatcagcgtcgagatcttcatcttcaggatcatcgtcgttgtaatcgatcacgtcatcgtcatcggcaacatccgccaagaacgcattaactttcttacgtttcttgcgacgtggcacttcttcttcgtcttccggatggttaacttcttcatcaacggaatcgtatggataccaagcgcgcaggccccaaacgttatcgcctaaagaaatgaagctgccatccacattgagatccgtatagaattgcggcaaacgttcacgaatctcttcgtcactcttaccgagataattctggatctcattggccagatcaacgaacgccatggtatcccctttttcttcgaggatctcatgggctacttcgatcattgataattctgatttatcggcattggcaaatgctttgagtttcaaccgatacacgccctttccacagtctttacagtctgttttctatcatacccgctcaggccttaaattgcaatcgcaaccgataatttcctaaatgttggcgattggcaaaaagctcatactcaacataaatttcacccgcaaccggttccgtggtcattcgcacatcgatccgaggtgtcaccgtttcaaccggaataataccgtatggcgtccgatagcgggtcaaaacccgtttttcatccgcaaaaaacagtttcaactgagtatcgccattactactgccacgcgaaagttgaatatcaccgtcttcgcgcagtttcatcgtgaccggcatgctcgttcctgcatcctcgtccacttcctgatagcgaatataaagtgcgttccccatctgtaccaacgttccgggttcatcaaaaacatgtgtctcctgatcatcaccttgcgtcacaaacgtttcaaggtgaatctgaatcggcactccttgtgaaagatccataatgtcaatcctttctatagagtattgtacgctcacaggtcaagagggtcgagtacagagcgtgagtgagcgcgagccggcgcggttagggatcggagtgtaagtggcctcaggtgcgatggcccgctcttggccattgcgcctgaggtccttacacgcagatccctgcgccggggagcgcgttatgggcataaaagagaactcgcgcccaaaaccttacacgccagactcccgcacccccaaacacctttatcccaatgaaaatggctttgtgcctgacgtgttcggttaccttcgctataatataggtaatctattattatgaaagaaggcgcacaatggacttaacgtcactggctggtcagcaagcagccatcttccagcaagacttcaccaaagatgaggcgccgctcagctttgcccacaccaatgcgttattagcccatcccgagctccatccaccgctgatgctgcatttctggacggctgaacaaaccgtcattcttggtatgcaagatttaaagttaccacaattggggcatgggctgccagtcctgagcagcgaacaatatggcgtctttgtccgcaattccggtgggctagcggtgattgccgacagcggcgttttgaatgtctcgctttttttacccaatgaaacgcgcctgaccatcgatactgcttatgagcttatgacgtcactatttcggaccgcatttccagcgctgaaaattgccaccagtgaaatcacgcattcctattgtcccggcaaatacgatttgagtgtcggcggccaaaaattcgccggcatggcccagcgccggaatcaggccggggtggtcgtgatgctttattgcagcattttcggtgatcaaaatgcccgctgcgatttactacgtcgattttatcgggctgggcatgccagcgccagtccccattttacttttccgcttatccgttcagaaacgatgaccacccttagcgatttacttgatcggccactgacgcgtaatgaggcgattcttgccatattgaatgccttagcaacttacggcatcgcagccgacatgaactcgatgccggcaatattgcgcgatcctgcttaccatcaagcgctcgctgcagccaccgccgatttacgtacacgcaatcgcaacttaaaaaagatgggagaacatcatgcaatttgaaaaattaccacgggaaaaagtttttcgcgatccggttcataattatgttcacgtccaacaccgcgtgattcttgatttaatcaataccccggagtttcagcggttgcggcgaatcaaacaactaggggtctcggattatgtctttcaaggagctgagcatacgcgctttgcccactcacttggggtttatgaaattgcgcgggagatgtgcgacaattttgtcattaactatcccagtcaaacgcctggtgatggcctttggaatgacgctgaacgtccggttgtcctgtgtgctgcactgttgcatgatattggccacggcgcatactcacatacgtttgagcatattttcgggacagatcatgaggcaattacccgcgctattctcacggatccgcataccaatgttaaccgtatcctgcgcggtgtgagtgcggaatttcccgagcaggtggcttcagtgatcaaccatacttatcccaatccgcaagtcgtccagatgatttccagtcaaattgacgccgaccgaatggattacttgctgcatgatgcctactataccggcaccaaatacgggctttttgatctttctagaatcttgcgggtgatgcgaccttattctgatggtatcgcttatgaagccaacgggatgcatgcggtagaagactatgttgtcagccgctttcagatgtatcaacaagtctattttcaccccgtatcccgcggcatggaggtcattctcttccacctactaaaacgggctaagtttctgtatgagtccggacagtttgaacccgggttttcaccacgcttactggtgccctttttcgagcaatcctttagcttaagcgactacctcaagttagatgacggtgtgctcaacacctactttacgtactggttagattatcccgacagtatcttaagcgactttgcggatcgcttcttgaatcgccgcccactgaaatcagtgacatttaccgatcaaacggccgcgctgcttccaaaactacgcgcgttggtggctcaagccgggtttgatccgcaatattacaccgccgaaaatgatagtttcgacttgccatatgatcaatatgatcctgcctcagcgaacccgaaaactcaaatcgaaatcatgcaaaaagacggcactttagaggaactgtcaaccttatcaccattggttgctgcgctgagtggtcgggcaacaggcgataaacggttttattttccaaaagaaatgctcgcctctgaagatagcagcctcttttcacctatctatgaaaagttccaacgttatctgctcaacggtggtgtgattgatccacacttaacggattagcaaggtgggcttcactgtttgggttgctgggcgagccacttagccacggcccagcgatgcgtcggccgtttcaattcggccaaggccagatcgatcggcatgagcatcaatgtattgaaggtttcaagcggatcctgtacaaaagccagttcatcacaggcaaaaaacgtcgccggatggtaataggcggtttgacgatgatgggaataaaaatactcagacgatttgccgagctttttggtcacatgcacggttgccccaaattcttccaacaactcccgtgccagcgtttcttcgggagtttcgcctttttcaacgccgcctcccggtaaaaacaacgcatgattcggcgcttgcaaaatcagcaaccgcgcgccgctatgatccggaatgacgccatacgcgccaattcgggtgtgataatctaactttggatcttttcgaccaaacacaggatcaatcatattgcatccctccgcttttaatcacattataccctaatcaatttctaacctctacacaaggagacttttcgatgtcagctcaggaaacgttatttgtctttaccatcccccttttgctgggaattatttttgctatcagcttcaccattgaaccgcggcgtttgcttaacggctggctgttcaacttattcgccgtggtatttttgatcgctttggcagccgcgattctaaaatccggtaacctactacttattgctgtaaccggaacgctttttgtgattacggtcttaattgtgttcttgctgtttgccttgcacttattttggctgctatggaatgctatccttgtgtggcagcgtgaaggccattcgttaagtaacatgttgacgctttatattgccatcggactgttgttgttggaaattgctgcttcgtttggccgccgttttattcccgaacctttatacgtcgccttggcagtcttctttggcttaggtgggttatatgtcttattaacgctttataacttcttgaccgcgttaatcctgtacaatctccggccacaaccgcataatcgaacttttctcatcgtgcttggcgccggactactgcacggtgatcaagtgtcaccgttacttgccagtcgcattgatacggctattaagttttatcacaagcaattaaaaaaaggccgccccgctccaaaaattattttttccgggggtaaaggcgcagatgaggctatttccgaagcactcgccatgcagcgttacgctttgggaaaagggattcccgaggccgataccttactcgaagatcagtcaactaccacccttgaaaatatgcggttttcaaaacggttgatcatccaagagattggagaagctccttataaagccagcttctttaccaacaactatcacttgcttcgagcgggcattttcgcgcggatggcgggtattgctgctaatggcgtcggcggtaatacatccttttattttctgcctaatgcggttattcgtgaatatctggccttggtggttttgtacaaacgccggcatgccgtggctttcggtgtgattgttctgatcgcgctagggcaattcatccgggcctggcaattgggttgagcgcttaacgtgcagagtaggtggcaatttcggtacactaactatacgagggggttatgttgatgttaaaagaattccgtcaattcatcatgcggggcaacgttttggacttagctgtcggggtgattatcggtagtgcctttaccggtctggttacctccttgactaagaacctgattaacccgattttatcaatctttgccggtaaaaccgatcttagcggtttatccattacgttattaggcgccaaatttacatacggcaattttcttaacgatgtgattaactttttgattatcgcctttgttgttttcatgattgttcgcagtgtcaatcgtttcttgcccgccaagccgaccaaagccgccgggcccacccaagcagaattgctcacggagattcgcgatttattaaaggagaagaacgaccattcgcaggtttaattgattaaaaaagtcaataaaaatcaaatggctcaaggaagacgcagcagcgttatccttgagccatttctgtttattcccatcatttatgaaccttcaataacctgctgcgaaaacaactcagaaaccgtccgcatagcattttttacggccactgtcgcaagtggatcctgtgccatgcttgctgaagttgtctgaagccaagcgccagagtccatagtatgggtgccgtcaagattagcaatacctgaaacacaaatttgacaatcacaacgccaatagtgtcaatgccgccgctttctaggattgttgccatcaccggtgtcgtcgcgtaaataaagtcttgataaagattcatattctttttcatgtcagctacataatctttgattgaacggccagtagaagcaaatcgttgggcgctgtggtcaatttgatcaaggtagcgcggggccaggaccagccagctgatcaataagtaaccatcaccgattgtgggcgtgaaatcgaacccacttgttttcttaaggtgaaagaaaaggattaacaagccatacgctgcaatgagtctcagtcgtttgtgcataccagccaccccacacatcacctaatcaagttaccgggtcctatctgaatgctgatatcataagccgaacaatcacttttgtatagggttagcccaaatgaattgccaaaacgccatattttttctcttgttgcggcgtataaatgcgataggtgtcagcgaccattttagccacggaatcggttggtgcacttcccacggcggtaccctgatattgctgataaagctgggaaaaggttccgaacttttcaagctgagtaactttcttggtaacttgttgctgagtggcgagatcctcaaacacaatttgatcatcaacctttagctgttggcgcttttcgtcattgaggcgaatctctatcgtcttagttcctgcttgcaccaacagaaactgatcatgcgcaagtcccatttccatgccatttttctccttgtcattacgttgctaaatccccaggccaaacctaaaccatcaaaaaagcacaccttacagtgaaggtgcgcaaacttgatgttacttggtgaatcgattttcgaataatggagtcacggatcggttttcctgaatccgcatgattgcacgtcccattaatgggccaacagaaacaacatctaacttatccatgtgtttatcggctggcaagttaatggagtccgttacgaccaccttttcgatggccgagtgggtcaaccgttcaactgccgggccggagaagattgcgtgggtggctgcgaccaagacttcggttgcaccggcatctttcagcgcttgggctgcaagggtgatggtgcccgcggtgtcgatcatgtcgtcaataatgatacattgtttaccggtaacattgccgacgatgttcataacttcagcaacgtttggccgtggccgccgcttgtcgataattgcaatcggcgccttgagaaattctgctaatttacgcgcccgggttacaccaccgtgatcaggcgaaaccacaaccgtatcagcgccgtcataatggttgcgtaagaagtagtcggctaacaatggtgcaccgacaagatggtcaaccggaatgtcgaagaagccctgaatctgggcagcatgtaaatcaagcgctaagacccgggtggcaccggcacgttcaagcatgttggcaaccagtttagcagtaatcggttcccgtgaccgcgctttgcgatcctgacgtgcatagccataatacggcatcacgacattaatcgtatgtgccgaggcccgccgtaaagcatcaatcataatcaatagttccatcagattgtcgttaaccggactggacgtggactgaatcagatacacatcatcgccacgaatactttcttcgatgttgatttgaatttcaccatcgctaaaccgcttcactgacgactttcctagttgcacaccaacctcggcagcaatcttctctgccagtggtttgttcgaattcaaggcaaaaatctttaatctcgggtcaccgtattgctcagacatatgttcctccacgaaatattataggctgcgaataattgttccacaaaaatcttagcggattgacgaaaaaaagcaagcatataaaacgaattataacctaattccaatctggatcgttcgcgagcggcagtcgtttccagtaatcttctttggtcgtttgacgcgcacgggcaatcgccattgcgtgaaacggtacatctttcgtaatcgtcgaacccgccgcaatgaaactatgatccgccacttcaactggggccacgatgttagagttagaaccgataaaggcatggtcgccaatcgtactattccatttttgaacgccatcatagttaacaaacacaacgccgcaacccacattaatatcgctgcccaaggttgcattaccgacatacgtcaagtgaccgactttggtgcgtgcaccgatcttggcttttttaatctctacaaagttaccaagatgaacgtattcgccaatgtctgcgtctggccgcaaatgtgaattggggccgatatcactgtgtgcgtgcatcaccgcgtgttcgatggtggaacttgtcacggtaacatcatcttccagcgtagcatccactagttctgaatgggtaccaatgtggcaatcttcaccaatcacggttttacctttcaaatagacgcctggttcaatcacggtgtcggcaccgattttcacatccgtatcaatgtaagtcgttgccggatcaatcaacgtgacgccattacgcatatgctgctcgttgatacgctgctgcatgagccgggttgcttgtgccaatgcaacccgatcgttaacgcccagagattcggtgtaatccggcatttgataagcagcaaccttttcaccggctgcccgtaaaatgcctaagacatctggtagataatactcgccttgtgcattgtcgttcttaacctggtgcagcgctttgaataacgcctgattatcaaaaacataaaccccggtgttgatctcggaaatcaatgcttcttccggagtagcgtctttttgttctacatttttaatgacattaccgtcagtatcgcgaataatccgaccatagccagtaggatccggggcattggcagtcaaaatggttgccttggcgcctttagcttcatgataagcaaacagatcattgagagtcttagccgtaaacaaaggcgtatccccgctcataatcagcgtggagccttccttttgccccaacaatggctctgcttgtaataccgcgtgaccggtgcccaactgttccgcctgcaacacgaattcagtccgctttccaagtgtcttttcaacttcttcggcaccatggccaacaatggtcacgatagcgtcaggatgaatggcttccacctggctcaccacatgctcgaccatgctcttaccacagaccggttgcaaaaccttataatacttcgatttcatccgcgtccccttaccggccgcgagaatgatggtgaatttctttgacatatgaatactccattcctaattatcttatttcataatagcccagccagccgatactgacaacaactgagcgcgagccggcgcggttagaagtcggagtgtaagcggcctaaaacgtgatggcccgctcttggccattgcgttttaggtccttacacgcagacttctgcgccggtgagcgcgttatgggcgtaagagagaattcatggcctcaggcgtgatggtcggactttgaccattgcgcctgaggtccttacacgcaggtttctggccctgtgagcgcgttatgggcgtaaaggtggatgtacgtccgtcctaaaacgtgatggccctggctttgaccattgcgcctaaggtccttatacgcagattcctgcgccggtgagcgcgttatgggcgtaaaggtggatgtaccctaaaacgtgatgcccgcgccaggtccttccccacaaactcctaccctctcccaaaacccaaccaaaacaaaaaacaggcccgtcgacatcccaagcctgttttccaaatactattcattcgacctgtcatgctcttcatccacatccggtttcgcatcgtcaacctgctgcttaacctccgctggcacttcaaacgtactaacttgagtcgtatcagcccacgcatcataaaagaagcgaaaatgccgcgagcccacttcccaaacaaaattaatcatgaacagaaagaccaaaaccgcaaagaatcctagcgcagccaaattaatctgagttcgttgaaacttggcaaaatacgcaataaagaaattgttcaaccctaccaagctggaaaaggccaggccatataacagtccttcgcgcaacaaaagccgccaaaatccgacagcttgaccatcagtacgcacaattttaatgcgcaccaatccttttccaagtgtctggccgttgttaaaggcaggccaaatgacgaagacaaaaaatagcggcaaaactgcctcgctcaaaaagtccggcaattgatccaaccctaacaaatgaaacaggaatttgatcataagaccgacaatttggctgaataagacaaaatcgactaaaaaagcggctaatcgtcgggcaaaagtcacccgcgcaccacgagcctgacttttagcgtcaatggtatcgcgggatggcaacgctcgcatcagaatcggcgccagcaccccgccaaccaatccacctgtcgtgttaagaatcaaatcatccacatcaaagagtcgataaggccgcggataaaagccatataacccggacagctgtgtcagctcaaagaataaactcaacccaaaactcatcacaatgatctgcggtacgctgcgtttaaagtagtaccgcaaataaaagccaaatggaatcgtcaaaacgatattaaagaaaggttgaatgaaactggactgcttgagcgcggccagccaggtgtgaggattgctcggcacaaagacggtcgtatgaatgaaataccgcagtgccattagcggcgtcagattatacttcgccccggtaaactgtgcgacagcctcacgagccggcaatggcaaaatgatcagaaaataagccgacagcagataaaatacaaacgaataaatgacaatcgcccgccaccagctaaacgcaccgtaacgtcgataaacaaccacaagaaacggtagcgcaagcagcagcgctaaaaacggaaatgtgattactgctgttctaaccggtccaaggtaagcactcattgatgactcacctcaagtaactgccgattctggctaagaaaattaccggctgtggcatgcagcgtatttgcctttgtatccactttatcaacgcgaataagcgaagtgtaatcgttcaccatgcgatcgccgtcaaacttgccctcagcaaaaaccgtaattccgaccatttttgcgttaaactcatcaatcaacgccttcatgccgttaacggtgccgccgcctttcatgaagtcatcgacaatcaagacccgcgaattagccggcagactgcgcttactcaactccattttttcaatccgagccgaggatccggaaacgtaattaaccgaaaccgtcgaaccttccgtgattttggaatcgcgacgcacaataacaaacggcacattcagatattgactgacactttgcgcaatcggaatgcctttagtggctaccgtcatgaccgcatccacattggcttcgcgatactgggtcgcaatcagccgcccgatttgacgtagaacactcggtgtaccaagtaagtccgagagatacacataaccgcctggcaacagtcgatcagtctcggaaagtcgcttagccatggccgcaatgaaattttccgcctcatcttcacccatgattgggatataacgaaccccaccagcggcaccgggcacggtttcaaggatgccggtttgtcgctgggcaaaagtccggcgtacgatagccaaatcctcactaatagatgacttggcactttcatagcgttttgagaaaaaagtcaacggtatcagtgtgtgtggccgttccaacaagtaccgtgtcatatcgattaatcgatcgctgcgtctaactttcattattccgctcctaactccgaatatttagctctgtattaacattgtgggataatcttatccagtataaatgcttttaacgaaaatttcgacccttttacgacaaattctcaccgaacgttcgcatttgtccctagttcactcagataatttttaagtcgtctcagtagccttgtattcatttctatattagaatggttacaaagaggggtggagaaatcatcatgaactgttttgaattacatcatatgacctttgcaccaacgcaaaccgctattttaaacgacatcaatctggatattccttgggggattgatctgaccattgcaggccattcgggttctggtaaaagcaccttgttgcgattgttggcgaccttattgacgccaactaacggaaccattctatacaacggtaaagcccaagccgactacgatccgattgcttatcggcgtgaagtttcttactgcgcccagcagccggcattatttggcgccacggttgctgacgatctgcggtttccatttatgattcgcaacactgaaatgccacgcgaacaagccgaagccgcgcttgaaagtgtcgatttggctaaaagtatgctcgatgcgccaacgcaaaacttatccggtggtgaacgccaacgagtcgctttgttgcggcatcttttcttcccgcctaaagtgctgcttttagacgaggtcacaaccggactcgacccggatactaaaacgattattcatgaacttctgaatcgccaaaatgaaaaaggcatcacgttgattcgtgtgacgcatgatgaaggtgaactgcagaccgccaagaatctcatgacgctggttgccggtcaatttgaggaggttgccaaggtatgaatagtcagttaatcgtttcgccgttagcacttttgctagctttggcgctagttgtgattgcattggtcattaacctcaaagaagatctgggcatgaccaaggatctgatcgtaggggttctacgcgcggtcatccagctaacggttgtcgggtttgttttgacctatattattaaagcggatgccgtttggctgactttagccatggtagccatcatcattttcaacgctgcctggaatgccaaaaaacgtgccggcaccattcctgatgcgtttgtcaccagcctgttagccgtcaccactgcaacagggttaacgctgctcatgttagtgtcggtaaaggccattcggtttattccggcacagattgttccgatcagtgggatgattgccagcaacgtcatggtcgcgatcggtttagcctaccgcagcctcaacaccgaatttaaagacttgcggccacaagtacttgaacgccttgcattgggcgccaacctcaaacaagccagtcagacgctcatcgtcaatgccatcaaaaccgggatggcgccaacgattgattcggctaaaaccgttgggctcgttagtttaccgggaatgatgtccggcttgatttttgccggtatcgatcctaccaaagccattatgtatcagatcatggtaaccttcatgctgctaggcgccaccagccttggtagttttatcgcggtctatcgcagttacccccgcttttataatgatcaaaagcaattacgttagcggccttgtcctccgaaaataaaaagtttctgcagaagcgaatctttttgcctctgcagcaacttttttggtttttatgcattttcacagactagtcagtaaggattttccatcttgttatccggtaaatacggcccatattcaacttgaatcgtggtgtgggcaatgtcaaagctttctcgcaacgataaactcagtgcgtccaagaaggcgtcattgccttcagcagttgttcgcaccacatgtaccgtcaacgcgacatcagttgtactcagcgcccagatgtgcaggtcatggcaagatgcaacggttggataggcgttaaccaatgttttaaccgccactggatcgatttccttaggcaccgcggccattgctaaattaacggcatcccgcaataaatcccaagtcccgatcaaaaccacaattgcaactaaaatggacatgaccggatcaagccattcccagccagtcagcaggatcaatcccccggctaaaacaactcccagcgacacgccagcatcggcagccatgtgcataaacgcaccacgaatgttcaaatcatgttgcgagccgctatgaaaaagaattgcagttgcgccattgaccaaaatcccggcaccagcgacgaccatcatccagccgccttcaaccggagcattttgtgacaatcgggtaatcgcctcgacaataatcgcacccatcgccaccagtaaaaatgccgcatttgctaacgccgctaaaatggacgaactcttatacccgtatgtacgctggacggtcgggtgccgattggaaagccactccgcaaaccacgctaagcccaagcctaggacgtcgctcatattatgaatggcatcggcgaccaacgcgaccgagccaatcccgatcccaaaagcaacctcggcaataatgtaaatcaaattaagcagaataccccagaaaaaggccttgtttggctgaacttgttccatcttatcatcagctcctcagtttccttttccatcatggtttagtgctacctaaaaatcaacccctcagccgatgactattcgttgacaggcaaaatggccgcaacagataaacctcacgacaaaatcccttcatactgttgtaaacccgcattgcccgagaatgcttctgacaaagaccaaacaccgttggaccgctacctgacatttgagcgatttcagcgccgtacttttttagccgctgtttcaatgcggtcatttcaggataacgacttgccgtaatggcctctaaactattccccattccgctaatcatttgggcgaaatcatggttttgaatcccggaaacgacttcaggtgtatttgggtgcaaaaggccggcctgatagtcaattgcattaagaatacttggcgttgacactgacacccgcggcttagccaaaacaacccaaaagttcggtaaacttcccaatggcgtgaccacatcgccgcgtccggtaaccaaggccgtctccgagtaaacgcagtaaggcacatcgctatcaacctgtaagccgatgcgagccagctgcgagcgactataacctaactgcaatagtgaatttaagccccgcaaaacggcagctgcatcactcgaaccaccgcccaaacctgcagcgacgggaatgtgtttttcaatatgaatccgcgcaccttggcggatattggcatggcgttggagcgccaatgccgctttataggccagatttcgcggatcttcaggtaaaaaaccgctatctgtggaaacctgaatgctatggctaggcttaatgctcacgtaatcagccaaatcaactgatgtcatcaccatctgccactcatgttcgccgtcagcatgacgatacaaagcatccaaacttagattaatcttggccggcgctttctcgatcagttccatctaaccaccagtctctggcgatgcatgtatttacagggagagctcacactgcaaacgacgatgcatgcatccgccgtatcgttattttcagtatactgttttgcgtccggattttcattgccgcgtgtcaaaaattcgtcaccttgtacagatcagtctttcaagaagatagcaaaaggcctcgatgccaatgacatcgaggcctgctcaaaataaacgatttaatcgtcggttagtatctgaaattatgacgctttttcttcgccttcgaaggtgatcttgattgacttagtcagaagatccgcgtaactataagagacacgctcgaacgcattttcattctggtcgagatcgaccacaaaaatagccggataagtttccttcaaggtcccccgacgccgagtaaccttcttgcgtcctgcttgtgcaacgaccgttaaattctcaccgattttcccatcgagcttccgtttgatgcttgctagtgtgattggcatgcacttcacctcttgaaatacatcataacacgaatgcaagaaatttgcaattataccatgtgtttcttatttcggcaagatttttataaggagtgagcgcgagccggcgcggttagaagccggagcataagtggccttgggcgtgatggccgggttttggccattgcgcccaaggtccttatgtgcaggcttctgcgccggggagcgcgttatgggcataaaggagaacttgcgtgatgccccgctcttgaacattgcgctcaaggtccttacacgcagactcctgcgccggggagcgcgttatggacctaaagttgggctcgcagccttaactgtgacaacccgctatcccgcaatgcccaagccttcaccccgcaacgcttcatccaaccgtgcaaaatccgcaatcgccaactgttctgcccgcgtctccggtgcaatctccgccaccgagagcgccgtacgaatagcgtccttattcggtttaccaaacaaagccactagattattccaaagcgttttacgccgagacgcaaacgccccacggacaagccggtcaaaactttctggactttgtacggtcgccaacggttctgagcgctgggtcaacgtaacaatggccgaatccacatttggtgccggaacaaacgcgtgccggctgacggtaaaagctgtcgccacatctgccaccagttgcacggcaatacttaaactgccataatccttcgatccaggcactgcacttaatcgcgctgccacttctttttgcatcatcacggtcatgctgtgcagtggtaaatgtgctcgcaacaagtgcagtaaaatcggcgttgtaatgtaataaggcaagttagcaacgacttttagcgtgtggttcccatcaaaatgcgtcgctaccagctcggtcaaatttgtttttaaaacatcctcattgaccacggttgtattaggataatccgcaagtgtctccgcgagaatcggcagcagacgatcgtcaatttccaatgccaccacctgatgcgcctgatcagccagaaactgcgtcagtgcaccaattccgggaccgatttcaatcacatcatcttgctcggagacatcagctgcagctacaattttttgcaaaatctgcgggtcggtcaaaaagttctgccctaaccctttacgcatatgaaagccatgccgcttcaaaatggcattggttacggctggttgtgccactttttcatgcatggttattcgctccttcgttcacctgggcaaccgcggctagaaaatctgcgcgactgatttgaaattcagccagccgccgtaaaagctgtttcccatttgtatagccgatatgcagccgttcgcctagctgttcccgacgctgacgagcaccggttccaccgagcaaatgcgctgccaataaatcctgctgactgatcacttgcggagcatcgggcacttcagtaaacaagtgctggagtgctgcccgcaacgccgctggagaagcatgctcaatcccaagcgaccctttatgatccggcacgccttccgcccgcggtaaaaatgcatgggtaacacctggtacggcacgcgaaatggttttgcgaatcttttcaccgggaaagtcaggatcagttaagacgatcacgccccgttttgcttgggcttgccgaatccgcgccaatgttgcttcatcaatggcactaccgcgagtctcgatggtgtcgatcctgccaaaagtttcttttaatcgcttagtatcatcgcggccttctacaaccacaatttgtttaatcgttgtcatgcgtcttcctttaacttgaaaatttggtgggcattatcccacgtctgcttagcaatcacttccggggtggtttcgcgtagtttagctaaagcttccaccacatagcgcgtatagcccggctgattctgtcggccccggtaaggcgttggcgttaaatatggggcatcggtttcaaccaacaagcggtcactggggattatcttggcactggcatgttcttctggggcatttttgaaactgacgatgccggaataggaaatatacatccctaagtccaaaaaccgccgtgcccagtctgcatcaccggtgaaactgtgcataatcgcgccaaattcttcaacatgcgccgtttttagaagcgcataggtatcttcaaaagcatcgcggctgtggatggacaccggtatgtgcagcgagcgcgccagttccagttggcgccggaacacccgccgttgaatttcacgcggcgaggtattccagtgatagtccaacccgatttcgcctaacgccaccactttaggatcagctaactgttctagcaatacggcttctttagcggcatcatagtccttgcttgattccggatgccaaccgacaattgcatataagttggcatattgatgggctaattgcagcgcgccggcgttcaacgtcgtatccgagccgacaatcgccattttcttcacgcccagctttcgagccgcttcaatgtaactcgcttccttgccatgataaggcgtgtcattcaagtgggtatgcgaatcaaaaatatccatggacgcttactccttttccgctgctgccagtaattgtggcaacaactgctcaacttgggtcggttttctggctgcaaaaagccgttgtagtttggcaaccggcgactgggtcaaagttcgaattaactgcgccattcgtaacggttgttgtttaagctcgggattgaacaacataaaggcccagctaaccggtaaaatccgactcacatcggccaagtctttgaaggcaaccgggatttcaaaatgtaccaccactaagcagcccgtctgcaccaatgagccttctaaatgtggtatcgcaatattaggcaaaccattggcaatctgattcaattgcataccggaaggaaatgtctgctcccgggcaatcagtgccgcttttccctccgtctgcatcacattgcgtgcaaccagtttgcgactaatctcatcaaaaaaaatttcttgggttggcgtctctaaaaagtaaactaatggggtcatactaaactcagccaagcgcttcacctatctttacataaactcaatatggttagagtatagcacgccaagccaagcagctcgcaggtggtttttgggttaaagcttctattattgactgactttctttgagtttcatgaaaatgatcggcgaaaaatgtctattattgtcattttgttctatactaatcgtgtactgaacatttaaggattacctaggaggtatttttacatgtctgttaaacttactgctggtcagttagagcatttgaagcaattgtccaatgacaacaacgtcatctcggctttagccattgaccaacgcggttccctgaagaagatgcttgcagctgcagcgaacaagccagctgacgaaaccacgattgttgatttcaagaaagctgtttctgaagaattaaccaaatacgccagcgcgattctgcttgatccagaatacggcctgccagctgccaaggttcgcgatcctaagtccggcctcttgctttcctatgaaaagaccggctacgatgcgactgaacctggccgtttcccagatttgattgataaccaaagtgctttgcgcatcaagaacgaaggcggcgatgcagtcaagttcttactgtacattgaccctgacgaacctgatagtatcaacgatcgtaaatatgcgtttgttgaacgggttggtgctgaagctaaggctaatgatctgccactgttcttggaattagtttcctacgatggcaagaccaacgaaaccggcaccgctgcatgggcaaaagcaaagcctgaaaaagttatcaagatcactaaggaattcagcaaggcgcaatacaacgtttctgttttgaagcttgaagttccggttgatcaaaagtttgttgaaggttacaccgatgaaggcgtaacgccggtttacagcaaggaagaagctgctaagtactacaaggctcaatccgatgcaaccgatttgccattcatcttcctgtccgctggtgtttccaacgaattgttccttgaagaactcaaatttgctaaggaagccggttcaacctttaacggtgtgctttgcggccgggcaacctggaagccaggcgttaagccatttgctgctgaaggcgaagctgccggcaagaagtggctgcaaacggaaggtaaagctaacatcgatcgtttgaacaaggttttggctgacactgctactccttggacagacaaggttgaaggctaattctttttaactaattaatcgttcaaaaaccagccacagatgcggctggttttttatatggtgagcgtgagccagcccgcttaaaaaccggagtgtaagcgggcttagccgtgatggttgggctttgaccattgcggctaaggtccttacacgcaggtttctgggctggggaacgcgttatgagcgtgaaccagcccgtttagaaaccggagtgtaagtggccttagccgtgatggtcgggctttgaccattgcggctaaggtccttacacgtagatccctgcgccggtgaacgcgttatggcaagtaaggggcaagtaagggccaacgcaaagataaatcatcaacaaccattgcagcacgctggcacagtggtagactgatagatgaatgcgttttcttattttaggaggttgttaagcttgatcacaattgagaatcaacaatttaaagccagcattgccgaacgcggtgctgaactgcagtcactcgtcaacaaaaccgataactatgattatatctggaacggcgacaagactttttggaatcgccacgcaccgattctgttcccggccattggtaaatctaacgaagaccaatatcggctaggtgccaaaacatttccgatgggccaacatggttttgcgcgtgattatgattttgaggtcagcgatcatagcgactcagcggtgacgttcacccagcaccaaaattcagaaaccttgaaaaagttcccgtttaaatatactttagccgttacttatatgctaaccgaagatggtctgagcattcattacaccgtgacaaatgatgacagcaattcgatgccgtttgcgttagggttccaccccgccttcaacgttgcattaaaggcggatggcagctttgacgactacgatttgacggttgaaccgttaaacagcccgttgcagcgctttggtatcgggccagtaccgtttcgcaatggtgacgttgaagatattgcaggcgcagaaggcaataaattgccactcacacatgatctgttagacggtgggttagtgattcttgctaacagtgaaatcagcaaagcaaccttatcctccccgcatcacaagcacagtctcacgcttgatatcaatgacttcccttatctcactatctggagtcctgaacataaaaaggctccgtttattgcggttgaaccgtttgacgggttacctgaccaagccggcgaaccatccgattggtacactaagcttggcaacaccacactttctgcaggtgccaataaacagcttgccttgaaaattgaattgcactaaacaatcttttaatgccgcctgaggtttatgcagacggcttttttgtgcacactttttgtacaaacaccatcactaagcgactgcaaaatagttgcggtacaatagcaccaaagcggtgaaaggaatgaagggttcatgcacattgcagtcattgatgatcaagcagcgactagagaagcaacggtcaagctcattcggcagttagcgcaaccgtcacagccattgcaggtggcggcttattcaaatgccgagcagttcctgtttgcagaaaaatcagccgatctgctgttgcttgatattaagttgggatctggcatggacggcatggcgcttgccaaaaaaattcgccaacatgatcccgaaaccgccatcgcttttgtcagtaactacgacgaattcgtgttcgatggttacgatgtgaacgcgattgactacatcctcaagccgcttacggtggcaaaactcaaacacctaattgaaaaggtagctagccagacgcagccaaaactcttggcattgcaaaccgctgccggtctagtacgcgtgccaatgtatgacatcagcgccatcgaagtcacggatcaccggcttcaagtccatacgcaaaaaaatcactatctggtaaacggacagttaaaagactttttaccgcgcttagatgacaactttattcagatttaccgctccatcgtcattaacctgaatttcctctcgcagctggataaacgaaccgttgtgatggcagatggcaccacttatcccgtttcccgccagcaggcaccgctagttaaacaggcattcttcaagcattttcgggggttgacccatgacagcaattagttggttctggctggtcgcctttgggttgctagtagtaggttgtatgtggcagttatggtggatttttcggcgccagcaaaactggccggtgcgctggttaaacctcatcattgccatcgtatcgttgagcagttggtggttatggccgcttccggttgtccgcggcttgctttttaccatcactgtgttagcaggcagtttggagttcatcttaattcgccaatttctcagtgaccaggatgcggtgtttgcccgcagtcttgataaaatgatggcccaatattcagaagaagtacaagaactttatgcgaatatgcgcggctggcggcatgactaccacgaccaccttcaagctttaaaagcctacttagacaatcaagatactgctgccgcgcgccaatacctaaatgaactggaagacaagcttgatgcggttgatccacttgtgcattccggcaatgccatgcttgacgccatcgtaaatgctaaattgacgttggccgaacgactgcacattccggtaaacgaaaaagtcattgtcggcaacaccccactgatcaaagatgttgacctcgtggtgattttggggaacttactcgataacgccattgaagcaatcagtgaacagccgcccgacgaaaagcggcagttgcggctttacatcggcatcgttaaacagcaattttacatctcggtcaccaacacccggccggccgatcaagtcattgactatcaatacgcctcaaccaaaagcgataaacgaggattgggaattcgccgggtcaataaattagtggcaaaatatgatggcatgatcaatcgtcagtatgaagcttcggtttttgtcaccgaaattgccattcccattcacgcagccaaaccgaccactcacgcataatttgcgtcagcgagtcggttttttggtaggttaaggtcaacgaggtgaatgcgatgaaaaaatatagcctatggaataaccttcgctggtactttgccaatttacgcaaatccaaacctgctttggcatggactgcaagcggcttggctcttgataaggcggccgcggctttgcttggtgtttttacaccggcactgttagtcggcgctattaccacccatgctaccttaggtgaattcgcctggctggcagtgttaaccggactaggattagcgctaactagtgagatagcgtatctgattatgaatcatgatggcgttgcaagctctgcagtacgagtcgatattgaaatggacttccaccaaaaacagtgggagcttgattacgatcagattagcagcggcaaactccaagaattggcccacaccgctttcaataagggcttaagtcgcactttagcaggggccgaagctatctacatttacggtcgtggtactttggtcgatctgacaaccttgattgtcttcttagcgacactgtcatttgcggtgccatgggtttttgcactggttttaatcagcgcggcaattagctacgccggcatgagctggtatcggcagtggtatcaacaaaacaacgtcaagtggaacaagttagggcgccaacaggattatattacccgcaatgcctatgctttggaaaacggaaaagacattcgcatgttcggcatggccgactggtaccatcaccatctcgatcgtctggtgacattgcaagacgcttggcaacgtcgcaactcactccggcgcttcttaggcgaacaagcgggacaactggccggcttggtgcgggacgcaattgtctatggcaccttgattgcagcgattcttcgcgggcgtctttccatcgctcaattcaccttgatgtttggcatgaccaatagtttcatcatcttactggatcaattactcactgattttaacggcttgcaaaatgccagcatcgacttacaagaggtacgcgaatttatggccctgcaaccgcaaacgccagcacggacactgacaaaagcagagcaagcccaattagccaagcgtcctgtcaccatcacgttttcacatgtgacttaccgctatccggaagcgaaaagtgccagtcttaacgatgtcagcttcacactcacagccggtcaaaaattggccattgtcgggatcaacggagccggcaagtcaacgttggcccggctgatgatgggactgctgcatccccctgaaggcaccattaccattaacggtttggatgcgaagctaataccgctagcagctcggtttgctttgttcgcaccggtttttcaggaaaccattgtgctggctcagagtttagccgataacgtagcaatgaccaaccacccagacgcaacccgcgtcatgagcgcattgaaagccgcaaacttagacgcactcgtagcaaccttaccgcaaaaagccgccacccccatgacgcgatacaccagcgatgatggcgttgaattatccggtggtcaggcgcagaagttgatgctggctcgggcattatataaagacgcaccagtgctcattttagatgagccaactgccgccttggatgccattgccgaaaatgaaatctatcaggattacgcccaactagcggctggtaaaacctccctgtttatctctcaccgactggcttcaacccgcttttgcgatcgcattttgttcatggaccacggacaggtacttgagtccggcactcatgaacagttgatggctaaggccggccactatgcccacatgtatcagattcaaagcaagtattaccaaccagctgcaaaggaggtaacggctaatggcaacttctaatcattctgaaccaaaaccttcaaagcaaaccgcaaaccgggcactgcgagtggttcgcatcatccaccagctcgataaattagccatcccggttgaatttctccgcgctttgacaactgtcggtatcccctatttaaacatcgccttcttagggttggtcttgaatcaattgcagcaacatgcaacttttcggccagtcattctcctcattggcggctttttgcttgccagatatctgttgcaacttgctagtaactggtttgccaaactggctgaagaccatgagaccggcgtaaatcgacgacttgatcgcgctaccactgaaaagctgctcaccgtaagctatacaacgcttcaagatccggatatgcgtaatcaatacgccggtgccgtagaaggtaagacttttagtggcgggatcacatcacttatgaaagatggccttcaagacttcttctcgctagtgatcgccatcggttttgcggtcgccactttaatcaacctcacgcaggcaaccaatcatgcagctacttggtttaatgacgcccgctatccgctcttgatcatcgcgttactcctttttccaatcatcgtgggtggttggagtgttcatcataacaatcagatccagcaaaaacttatcagaaagattctgccaaacaaccgccgattcacctatttttcaaacttcacgcaaaatatggacaatcatcaagtcattaggctttatcaggcatccgcgcttgtcatgaagaatgaacgcgacagcatgtatcacttcatggatcagcttcggcttggttactgggaaatcgctaagttcggtcattggcccaatgttgctattgccttatccgtcatcggtttgtacatccttgtcggagccaaagccttaatgggggttctcgccattggcagcgtcatgattgccgttggttattttcagcaactcatgacaactgcttatgagtttctccaagaagttggcgggtatatcaacatgattgattacctccaattttatgctgattttctcaacttgccggaccacgatcagtctggcacactgccggttgaaaaacgcaacgacaatgaattcgctatcgagtttcatgatgtcagcttcaaatatccgggcagcgatcaatgggccttgcgacacgtgaacctgacactgaatatcggcgaacggcttgccttagtcggtcgcaatggcagcgggaaaacaacgctaatcaaactactcgtgcggctatttaaacctactgagggcgtcatcaccttaaacgatatcgacattcaaaaatacgatgaagacgaatatcgcagtcttttgggcgtggttttccaggacttccgcctctttgcctacagcattgccgaaaatgttgccgctactgctcaccccgatcgtgaacgggtctggaaagccttgaaagtagccgatgtagccgaccgggttaagcgtatgcctaaaaccatcgatacaccgattacgacggcgctgagtgatgacggcgtgaccgtttccggcggtgaggcccagaagattgccattgcgcgggcgtggtacaaggacgccccgatcatgattcttgacgagccaaccgcagcactcgatcccatctcggaatatgaaatttatcagcgatttgatgagctcatcgaaggtaaaactgccatctacgtctcccaccgaatgagctcaacccgtttttcgcaacgaattgttgtactcgatcacggcaagattgttcaggacggtactcacaacagcctcatggcagaacccggtatttatcgcgatttattcaatgctcaggcgcaatactacaccgaagatcgcatcaaagcggctcgtaaaaaagtggcaacgacaacaactgcagtggcggattagacaacttattctgacgtcacccagaaggcacactatgaagaatcttggcatggtgtgtcttttattatttttaaaaataccaatgtaaagtttgcttgacattttagccaaaagagactacattcatgatgtaaagtaagctttacaaagcgaggtgtagcttttggaaaatcggatcgaagcattgcgcaatcaacatcacttaacgcaacaagacttagccgatcgcttagaagtgtcgcgccaaaccgttagttctctcgaaaacggcagatataacccctcactcggactcgcatttaagctttcacatgtatttaacctacccatcgaacgcatttttatcgatgaaagtgcggattcgaagttgctataacccatcctgaatgatcaatcactgtttgctttaccaaggaggtaaccgtcatgaaaagaattttgcacgttatgcctttaacgagttggttagcgtggtttggcgctttcgtctttgccatgttataccggtatagcaaggccactgttccagaaagtatcggaaaggttcttttggtaacagttgcggtccttgtcagctatgctatttttgccactcagcagcgaaccgaaactcagcgaatccaaaagctgcaacatggatcgctttctgataagaggcttgctaatgagatgaacgatgagcgcaatcaaatgattatcggcaaagcagcctttctctctattaagtggattgtccttttgaacatcgccgccttgtttgtcatggcagcattggacgtatcaagcgttgccatagttcttcttgcactaagcactattatgatcccaattctcaatatcatccttcaggtacacttgaatcgaacaatgtaaccataaacgcataaaaagggcacttcattttgaagtgcccttttattatagcgttcaattaaccaaccaaactgccattttccaggttttctgagacttccagcaatgtaatcttcttgccgtccaagctttcggctgataacagcatcccctcggacatttcgcctttaagtttgcgtggcttgaggttgaccacagccatgacctttttacccttcaacttttggtaatccggataaaattcacgaataccggacagaatctggcgcgtaccctcatcaccagcgtcaagggtaaacttcaacagcttgtcagcgcccttgaccggttcaacgtttagaatttctgccactcggatttcgctcttatcgaattgcttgaagtcgatttccggcttgcgggtcttttcatcgacagctgctttagccgtgccaggcgtcatcttgctcttgatatacgctacttcttcttcagcatcaagccgcgggaagatcggtgtgccttgttcgacgactttggcaccggcaggcaaggctccccacttcacgactttgtgatcttcgttttcgtgatctaagccaagttgaccgaaaatttgaaccggtgcatgggtcatcactggctgaatgagtaaagcgatcaggcgcaaactttcagccaagtgtgccatgaccgaatcaagctggtctttcttggctgggtctttggcgagtttccatggttcggtttcatcaatatatttattggcgcgggaaacgatcttccagacctgatccaacgcatctgagaaccgtaattcatccataagcttgtgatattgcgccaacgctgcctgcgcaacatcgccaagatcctgatcaaatggggtaacatccggcttgaaggcaggtaagatcccgtcttcatacttgttaatcatagcaattgtccgattcaacaagttgcccagatcgttcgctaaatcataattaatccgatcaatgaaatcttcaggcgtgaaaataccatcgttaccaaatggaatcgcgcgcatcaggtagtaacgcagcgcatccagtccgtaacgttccacaatcatgtccggataaatagcattgccttttgacttgctcattttgccgtctttcatgaccagccagccatgtgcgtaaatctttttcggtaatggcaaatccaaggccatcaaaataatcggccagtaaatgatgtggaagcgaacaatttccttcccgattaactgaacattagccggccagtatttatcaaataaggcgtgatcgttgctgccatagcccagcgcggtaatatagtttaacaacgcatcgacccagacataaaccacgtgtttaggatcagacggaatctgaacgccccaattaaaactggtgcggctcattgccagatcttctagaccaggcttgatgaaattgttaatcatttccgtcttacgcgatgccggctgcacaaaatcaggatgctcatcataatacttcagcaaacgatccgtgtacttgctcatcttaaagaagtagcttggttcatgaaccagctgaacctcgtgaccagatggagccttgccgccaatgactttgccatctttatcacgataaacttcagacagctgcgactcggtaaagtattcttcatcctcgactgaataccagccagtgtattcgcccagataaacatcgccttgcttaattagccgttcaacgatttcctgaactgcctcgacatgttccttatccgttgtccgaataaacttatcattcgtgatctcaagcattttccacagttgcttgatctgtgctgccatcccgtcaacataagcttgcggtgtgacccctagcttgtcggctttttgctcaatcttgaggccatgctcatctgtcccggtcaggaagaaaacatcataacccatcaaccgcttatatcgtgccaatacatctgccgcaatggtcgtatacgcattgccgatatgtagtttgccagatggataataaatcggtgtcgtcacataaaaagttggtttgcttgccatgcaagtgcctcccgtacattaattcagaatgagtctagtataacagagtgtgagcaggaacgcttagaaatcgaagtgagcgtgaaccggcgcgcttagaagtcggagtgtaagtggcctcaaacgtgatggcccggttttggccattgcgtttgaggtccttacacgcagccttctgcgccggtgagcgcgttatgggcataagctggaacataagcggccttaagcgtgatggccgggttttggccattgcgcttaaggtccttacacgcaggtttctgcgccggtgagcgcgttatggtgagcgtgaacagggccgcttagaaaccggagtgtaagtggcctcaggcgtgatggtcgagctttgaccattgcgcctgaggtccttacacgcaggtttctggccctgtgagcgcggttatgggcataagctggagcacaagcgatctcagacacgatggcccgctccacctttatccagctactcttctcaagccaaaatccatacgccccaagcagtcaatcatttgccgccaaccattgatccagaacatgaatgaactcatcatgctgatctagcagcgccaaatgccgactattagcgaacaaatgccactttgcaccgggaatatggtccaccacgcttttggcaatcaaaggcgtgcacagatcatccgttccgctcgtcaccaaaacaggcacatggattttgtgcaactggtcagtcacatcaaaatcactgatggtaccattttccgtaaattcatttggcccttccgcaatgagactagcgcgtttcccattcgtgggtcggcgtaatggttcaggcgaattttcatctggatcatcccagcaatacttttccatgtagcgatcatttgctgccagatacttcacattggtaaaatcaccggtgcgctctgcttcagcaattgccactcggtcttcgtaactaagatacttgattagccgatgttgctcttgaacccacaacttaattgatgccggtgagccatcaatcatgacacttttaatgccttgcgggtcaaagctagtcagataatacatctccaacatcccgccccatgactgaccgagcatatgtaactcatccaagtgcaggaacttacgcaaagcaacaagctcttcggcccaagtttccttcacataaacccccggatcttccggaagcgatgacttaccacagccaacctgatcatacataatcaactgccgaccggtttcggcatagtcatccatgagctcaaaataattatgcgacgaacccgggccaccatgaatcaacaacaacggcgctttatcggcactaggttcaccgacaatgcgatagtaggttttatattcatgaaacggcatgtatccttctttaatcttcacaaccatccaaacattcgacctttcaagaaagtgagcgcgagccggcgcggttagaaaccggagtgtaagcggccttaagcatgatggccgggctttggccattgcgcttaaggtccttacacgcaggtttctgcgccggggagcgcgttatggtgagcgcgaacagggccggttagaaaccggagtgtaagcgtccttagacgtgatggcccgggtttggccattgcgtctaaggtccttacatgcaggtttctggccctgtgagcgcgttatgggcataagccagaactttagcggccttaagcgtgatggccgggctttggccattgcgcttaaggtccttacacgcaggtttctgcgccggggagcgcgttatggtgagcgcgaacaaacggtcttctacgctagcaaacacgttacgttatcgttgccaaaaatcgcacgcacgcaacctagcgtacttactgcgattttactacgcatcggcaatactgtcagacaaaatatggaaattgtctaaaaaaaccattaaaacgctaaaacaaatccaactgccgcggcgccaacccgggaaaatccagccctaacatttcgatgaaactttgagcgtttgctgctgcgtcatgtccgccattgttattgaagataaccgtcacatttttgctcttcaaatgcttcacgattaaggcaaacgcctctaactcggcttgactataccgataattagttcgttccgttgtcttagcaccgctttgcccccaagcctgattgcgtccgtgcaaccgtaaaattgtcagttcagggttcgttgcaattggcaccaatgggactgaaccgctcacggtctgcgcctcatcgaccaccacatgaatgtcaccagctgctttgagcaagtcaatcgttgcggcacgatacgccggtaagtaccagctaggatgacgaaactcaatagccactggtagatcaggcagccactgattcatattttgtaaatatcggacattttccgccgttacgccaaagtatggtgggaactggcacaaaaccgcgtgtaattgatgcgtggcagtcaacggcgccaccatgtcgttgaagcgcgaaaattcggccaccaggtcttgcgttgcggcgtgtttcgtcatcaatttgcttgctttgattataaactgaaagccggccggcacctgcgcctgccaccgtcgcactagatcagcggttttcaacccataaaacgtggtatccagttcaatgaccggaaaatactgggcgtaatcagcaaacgtactgcgcttaccattggccgccaagctagggtgatcggccacgctggttaatccgaccctaatcatggaactcaccatccgcaattcgaaatgcctgaagcgtgtcgccgttaaagtaggaagcataatcatgtttttcgccattcaacgcatatttcaacaacggctgcagatccggcaccaacccgggattatccgccagcagccacgttttggaaaaggtcgctaaaataccttcccgcgtcgctcgcggtcctaaaaacggctcatcggttttcccgaaaaaggcgtaaagctcaccccgtaattggccatcaacatgccaaaaaacgcgcccaacgcccgttaactcatgagcagggatgataatgtggctttcctcctgtaactcccgtgctgcacaaacagcaggtgtttcatcaggcaggaacttaccacccaacgtattccacatcccgcgatacggtggattcgtccggttaattaacaaccaaccacttggcgtttcaacagtcaccaacgtatattttttaaccatacccgaaaaactccttattaaggcgtaacattcaaattaactctagtaaaaaggcgccgatttgatcagcaccctcaacgttggagtaaaacgttagagaataccggtcacaatttggcgtctttttatgcatgacatcaatgctactggattaatcttacttcatcttttccactgtagctttaatgatgcccgcggaatgaacatacttagcacgctcttcatcggtaagcttcaacttaggcgtgttaacaacaccgagcttgccaatcgtcgccggatgaccgatggcgataccgaattcaggatcatagttagcgcacggaaaaatccgcttggcatcactgataatcgcctgtgtcatttcagtagcaatggtggcaataccgtagctggtataatgtttggcctgataaatcttccagccgccagcccgcgccgcatcagctaattgatcataatctacttgcgcataatccgtgattggctcgttgttaacccgcaccgttgaccacgccgtaaattgtgactcgccatgctcacccatgttataaccgcgaacatcggcgacattcacatttagcgattcagcaaccgcgcgccgcatccgataagtatccagcgaggtgccggtgccaataatctgggactttggtaggtcaagtaaatattgccaatagctggtgacagcatcacaaggattggtgatatccagcaaaacgccatggaatccggacgctttcaactttggtgccacatcgtctaatgcttgttttgacgtttgggtttcaccaattcgatcgccgtttgaaatcgcaccgatattgccaaccgcggaaatgacaacatctgcatctttcaaagcatcgtaatcattgacgataatctcggtataagtcggcaatccaccaagtgcatccttcaaatcataactttcgccttcagctaaatcagccttttggtcaattagcaccagacgatccgcaatccccttgctaacgagattaaatgctgttgtcaccccaacatgtccaataccgataataccaatggttcttgccaagataaaaaccccttttcacaaagtttagtttttcgggccatgtagcaaatgccgttcaacccgctgatccgggatggcccacaagagtaacattaccaagtccagtatgatcgttaacggtggccaaagcaaagccaaaatcatggcaacaaatgcgatgatgatcgaaccgattgctttccagttatgctggcgattgtataaagcagccagttcagagtgtggtccattaactcgccgcaatgtttctaccaacaatagataactaatattggccattaaaaccacaaagccatagatcaattccggtccaaacgcatcaacatgcccttcgccaacccagctggtagcaaaaggaaacattgaaatagctaacataaatagcgagttggcccacatcacccgccaatcaatgcgcttaaccagctgaaaaaggtgatgatgattattccagtacaccatcaacgttaaaaacgagaccaggtaaataccaaacacgccgcgaagttcccaaagcgaagccaatgaaccgctgtggggcggatttaattccaacaccaaaatcgtcaaaataatggcaatcacagcatcggtaaatgcttctagccgtcctttgttcacaagccattccccttttcgtgcaccttgtaaatgatcagacgtgcaaatcggcaaaaatatcggtggcatctcccagtaccatgtggccaccttgaggcaaggcaatctgctcccgattaacggccacaatcgtcgcatccggttgcgcataaccgataagtccggcaaatggataaaccacaaaactggtgccaacgacaatcaataagtcagccgaagcaatcgcattaatggcggcactgaccgtatccgggttgattggttcgccatataacacaatatccggccgtaaaataccgccatctgctgcgtgcacatcgcttttcaaataagtctgataatcaaaatgttggtgacacttctgacaataaatgcggtacagattaccgtgaaactcgaccacatgcttggctcctgcttggcggtcaagtccatcaacgttttgcgtaacaatggcgcccttttgattactaatcgccgccattttttcatgaatcacattgggtttggcatcagggtaatacatgttgttcacgacgaattcatgaaaatcttcatgatgtgcctgcagattatcaatggaaagcgcgtactcgggatcaaccttatcagcatacaggccaccctttgagcgataatccggaatccccgaagccgttgacacccctgctccggtcataaacgtcacatacttagcctgagtcactgccgtctgtaaatcaaacattagccatccctccgtcgttatctcttcctatcaccaatatagcaagcatcccaaccagtattatttaattgccgtcaacgtttccccttgacaagtcgtttcaagtccatgacagcgcattcagccgtcaaaaataattttgtatttcttaacattctacggtcgaaaggtgtaatattattctatataaagattgatagaaaggagtcttgattgtcatgaaatcctttcggtggtcgcacttctttagttatttgattatggccattgttttagttttctttgccattgttctttaccaggtagtcatgcttggtattcaatccgtcactaacggcttctttattaatttcggtcatcattaacggattgtataatccagttggtactgcgccagaacgtcattcagcggttgttgatacagctgctggaaggcttctggcgttgttgcgttttcgggcagcggcaagacgaatgcattttggtcatcacttcgacccatggcaacataagcaggctgcttagtctcccgatcgcggtagccgctgtgcttgattaggtaaacctgatccaaggtgagtcgcaattgccgtttggataaaaccggtgacaacgtagcgaattcctgatcgtttgtgggttgatagcctagttgctcaattaaggcatcaaagcggctaaacaaatgcacgatggcacggcgcaacccaaacggtgaatcgagtttctgctcgttaatcaactgaaaaagttcttgagcgtaaggcaatgcttgcgggtaggcagctgccaaatcagcgggcagcttgccatctaaaaagcctaacagatcaagtaacgataaaattcggtagatgaccaattgattgtcagcttcagcaggtacattttgcttgaatccggctaacacttgcgccacgaccgcatccgtgattaacccgtgttcgcgttgccatgccaccaccaacatatgcaccgcagcgttatacaaagcggtactggtggcgtaaagctgatcatcgacttgaggatcaccgcttagcaaatgaaattgcaactgcggatagcctttcatctgatacaacaagtgaagtaattcgtgactcagtgtgtaatccgcattcgttgtatccgtcaccactacctctagcgtaccatcttttttcaatcgctgatggctctggtcgtgagtcaagaccccacttgcctcgccttgaatgaccacttctaacggatgatcatagtgttgtttaacctcgtcaagtaatacctgaacattttcttgcatgccaataattctccttttgcctgcgtgatcggaatattgagccaattaagcagtcatttttccggtaacgattggctttcatgtttttgatccactatcattaaggtagcgataaaaaggaggaaattcaaatgaaactatccgtaccacttgttaacggccagcttgatgatcgttatggcaaacatgctaccggtgctgatgttaaaaacggttacccgattacgagttttccgtttacgattgaagatgcccctgcaggcaccgtcagttttgccctttggttcctcgactatgatgccgttccggttggcggcctgccgtggattcactggaacgcagccaatattccggcatcggtcactaagattcctgctggtgccagtcatcacgacctcgtgccgatgattgaaggtaaaaatgcgacggccggtcacttggtgggtaacacggatccatttacacgggaaggctatgttggcccgcaaccacctgacaaggatcacgattacacgttgatcgttttcgcgttagatactaagttaccactgcaaccgggtttctggttaaatgaagcccgccatgccatgaaaggtcatattttagcccaggcagaagttgacctcccatcacgggtttaagtgcggggttgctaaaaagtaagttactcaaaaagcctgctgatcagtttcagcaggctttttgaatttagctcaacttcgcaactttacagtccagtccttcaactgccatcgccggtgttcatccataacgctccggcaccgaccgcggctaccaggccaatgccgataataccgaccaaggcaaatttgaaaattgcaaaaccgccgagtgcaaacagcgccagactaataaacgggtgccgcaaaattgcaccgaggagtttaacaaccaagaacaggataataatgatggcaacaatagcgccaatcgtgatggcacctgttagcgtatgtccgttttcgctctgtgtacttgccagcatacttggtaacatcatgaaacttcacctctcttaatggccaatcccacgcagctgcccgatttgactaaaacatgctgcgaacccactggacaatgccactaaaaaagctaacgatgccgtcccagattttctgtaggaaattacgattttcctgcgtattcaaactactattaagcttgtcgaataagcctttagctgaattttgaattgaatctgccagtttgccagcctgcgctttaaaatcggtattcttcaaggaaccggccttttggacattcactagcaagttaatgattaattgccgctgattgttattaataatcgtggtcagattattctgtttcagctgactgtcaacgatattgccaatttggttctgcgacagggtttgctgcccattgttactttgcgaagccatttgctgtttggctccggcaactgcattgttcagctgtttgtcggtatagccatctttgcctttattagcctgcgtgatcgaactcagcgtattgacttcctgctgggcggcattaatctgttggttattcaggttctcgccattttgggcaaacgctgcataaacccccgctaacgcaccggaaccatcgattttgaccgcactggtgatgtataaattagcattgctgaccccggccgttaatgcggcgtttcggtattgatctgccgtaatcgtggtaatgttattcgttccgttatacggcacaatggtgacattaataccgccattatttgtcttttgtactaaggcactggaccacacgccggagctttccgtaaacgagctgccagaaggattgagatacttcaccaaggtggcaccattaaccgtcaactgtgtggcattggagacgcccgctgcgttttgtaatgtgctcagcgttccgtttttctggtcggttgtcagcgaagaccctagcgttgcaaccggctgggtccaggcatcatcagcccgcacgacttgtggtaccgctgtaatcaatgccagcccagccgcagccagtcccagccatttaatcagttttttcataactcaaaaccgtcctttaagttgttacgactattatcgctgatttgctgcggctcgtcagaaatcagcattcggtttaagcaatgattaattaatgttcccgctgattcacggctcgggtgttcaggtgatcgtaaagcgcgccttcacgtaacccaaactgtgaaaaggttaagcgatcagaatcaaggtaccgaatcatcgaaataaccggcatgagtccgccgacaataatgtcagcccgatatttggacaatcccggaatggcttcgcgggctgccaggtcggagctgagaatttctttaaaaatattgttggcctgctgtgtcggcatgcggtaaccgtgaatggcttcaaaatcggctaatttttccttacgccgttcgatcttcgccaaggtccgattactcccgcccaacgcaataattggcaggttttgcgcgcgtcgtaaccaccagacactattaaaagtctgttgaataaaggtgcttagcgcaaaatattcggcggctgaaattacatcaggattcaaaaaccgctcagataagttaaccgacccgaatggaatcgataccaggtgttgcaacttacgattttgaaccagaatcaattccgtcgaagcaccgccagtatccataatcaaggcgttttgaatcggcaacgtattgataacacccagaaaatcgtattctgcctcacgcgtacccggaatgacgctaatcgttaaaccggcttcgtttttgacccgtttaagaaagtccttttgattcttggcctcacgaacggcagcagttgccacggcttttagatcaatgtcatcgtacttatccagttcggctttaaacccttgcagcgccttgagcgtccgcgccatggcggcaggttgcagaatacgggaggatcccatatcttctgacaagcgcaccatttcttttagccgtttgacgggcttaacgacttcctgctcaattgaccagattgtcattcgtgcagagttgctacctagatcgatgactgcgaagtggtgcgtcatgcatcatcatcctcctttggtgctgtcattgggataaacgtgtgggttgcgtgtaaatcctcaggtgcctgatcaatttcttcacgtcgtaacgcctcacccatggccacagcgtgttcaatgaagtaagcctgagcgttgagttttgtcacaccgcgcaattgtgcccggatccaggtactgtctggctgtaaaatacgcgttttgacgttatcatgccacataatatcgaaaatcttgatgatccgttcccgaatatcatcttgcaaaatcggaaacagcaattcaacgcgccggcttaaattccgattcatcagatctgccgaggacagatacacattttcctgcccgtctgcataaaagtaatagatgcggctgtgttccagtaactggccgacaatggaatgaacggtaatattatccgaaacaccggggattccgactttcaaattgcaaatgccgcgaatcagtaaatgaatttcgacgccggcatgcgaggcttcgtaaagcttctcgatcatggcggtatcagacagtgagttcattttcatttggatcaaagctttgcgtccggccttagctgccgcgatttcttcgtcaacccgatccattagataatcacgaatgccaagcggcgcaatgactaacttgtggaaataaggcggctcggaaaatcccgatagcatattgaaaatgtttgacgcatcttcgccaatttcgttattgcaggtgaacaagcccatatccgtataaaggcgggcggtgacatcgttgtaattaccggttgccatgtgcatatagcgtttaatgccatcttcttcacgccgaaccactaacgcgagcttgcaatgggttttcagtccgactaacccgtaaataacgtgacagccggcatgttcaagttcttgcgcccagtggacattattctcttcatcaaatcgtgcttttaattccaccaatacagtcacttgtttgccattttccgccgcttttttaaggtaacgaataatgggtgatttgctcgatacccgataaagcgtcatttttacagctaaaacttgcggatcctgagcagcttcccgaataaagtcaacaactggctcaaagctgtcatacggatgctgcatgaaaacatcacgttctttaatcacatcaaaaatcgaagtgtctttaaatgccggatcgatatacggggtaaatggcttaaagagtagttccttatgtccatgcacctgcttaaccaacttactgagaaagttcaaatcaatcgggccgtgaatttcgtaaatatcttcttccttgacgttcatggccttggtcaggcgtttgcgcaggtgtttacccatccctgcttcaatctccagccgcatcactttaccacgttggcgcttcttaagttgtgactgaatctccttcatcaagtcagaggcatcttcttcggccacgtccatatccatatcacgcgtcacccggaaagttgccgtttctttgatgtcagcgcctacaaagagttcgcccacaaacatgcgaatgacctcttccagcaaaataaatacgttatcaccgcctggaagccgcaagacccgcgggaagacatcgggaacctgcaccatcgcaaacgatcgtgacttatcgtcatcatcgtctggtcgcacaagtcggattgccaaattcaggctgttgttactgagaaacggaaatggccgggttggatccactcccattggcgtcaataccggataaagctcatagtgaaaataatccgacacaaaatcctgttgcttttgggttaagtctttggcatgcagcaactgaatatcgacagcattcaattttggtatcaacgagcgtaccagtgtgttgtattgtttttcgaccatttcgtgggcagtttttgaaatggcatcaagctgttcctgaggcttcatccctgcagcatcaggcttatcgtaattaaccgtcaccatttttttcaatgatgcaacgcgaatattgaagaactcatccagattactttgggtgatgcctaaaaaccgaacccgttcgagtaagggattatttttatcccgggcttcttccaacacccgatcgttaaacgccaaccagcttagttcgcggttattaaaataccgcggcttcgaaaaatcaagctttttcataacgtgtttcgtcctttcagctcaagtcctacgccaaaaacctcggagaaaaattcacctttacgcgccaaggtccagcgttcaagttcaatatcatcattggccttcgccgacaacaccactttgtctggcttcagcgaaacgcgcattcgttgaatcttttgctgccgcgatgcatctaaactgtctgctacccgtaaaatggctgatagtttggcgacaactaagcgattctcggtcgacatgatcgggaagttcttcaaatccgactggggggttaccgaactgtgaaagcgcgtgatggtagcgaccatggtgacgtccagtgcatttagacccataatttcagaagccttaatgatgtaattcgaatgcgcatagtgtttgtgcgtttcaatataactaccaatatcactaaccgttgccgcaacctctagcagcagccgttcatgcttgcccattccatgtaatttcttgagtcgatcaaacaattgcaaggcaaatgtacgggttgtctgcatatggtcgcaatcaacccgataacgtttagccagattattagcgctgatgacaatttcttcatctggatcaaaacccagctttttgaagccaccagcatgggccgcgtgcacttccaaaccatcaatcgcctttaaatccgaaatccaaattgattgactgtttaacgtttcaatcaaccgataaaccaacaggactgtcggtaaaaccaatgacgtttgatttgaagttaaatcataagtatcggccagatattggtcggaagcttttgtcacttcatcataaagcaaatcaaagccgggacgatcagtctcaacttgccgcttaccttctggaatcaggttttgaaaaatcgacaagctgctgcccattaaaatcacattggtatattcaaccccttgtggcaataagcgcataaaatccagtaagcggctgtcaatataatcacgcataacctcaacgtaattggttaccgagcgctggacatcactcataatttcatatacccgcaacggtcccagtgacaggttacgtgaaaacccaaacgttccttgactaaaagtcgtcaactcgactgaaccggaactgatatcaataagcacggttcctttttgggtaatcgtttcaaactggggaaacttgaccataatcgcctgggtacggaaaaatgcctcttctgacaaagaagtggttttaatgagccagccggtacgcgtgtatagctgatcccgaacaaactcggcattatccgcctctgcccagcttgtactggcataaacattaacggttgcaacgccatagtctttaaagatctgatcaatagcgtcaaaggcctgcacaatggtgtcaacggtttccggtaaaatttcatgttcagcataaaaatcatcaccaatagcaactgggtatttaccgcgctcgattgccttaagcgtccgtagattcgtgatactaaaaagaatcgactgtgcgctaatcatcacgaacccctgtatattgtttgccatgtccgctccatccgtttcttctgaattttccaaagatcattaatgttctaatgccatgatagcacggctattatccgctgtgagaatttttagacaagccttattcaaagccgttttctcaagcagtttcagtttaccaaagatcccatcatttcttttataaataaagagtgctatttattttttctcagatagccatcaatcggcaatccggtttttgcgcgcttccactggggtcatcacctcaactattggtatttgcgtaaaaagattgtaacgacccaatcttttgcgcaagcgccatcatttttgtgatagtcttaaatcatcatgaaacctttctgaaaggaagtctcacaattgaaaatgatcaatctcgggcgctccggcttaaacgcttctgccatcgctcttggcgtcatgcgcctaccgaatcttgatcgtccgcgcgcaacggaattgctcgatgctgcttacgatgtcggaattaacttctttgataacgccgatatttacagtaatggtaaggccgaacagttattcagtgacgcactgaaaaaagcgagcttcacccgtgatcaagtcttgattcaaaccaaagtcgggattatcaatgatcgcaaaagcatgcaccgctatgacttttccaaaacgcatctggtgacggctgtcgaccaaagtctaaagcgtctgggaacggattatgttgatagtttactgctacaccgtcccgatccgctcatggaacctgaagaagtcgctgaggcgtttcttcagttgcagaatgaaggcaaagtgcgtcagttcggcgtttccaactttaatcctgctcaagtcgatttgctgcagcaagctgtcccgcaacgccttatcatcaatcagttgcaattttcgctcatgcatactggcatgattgatgccggcatgcataccaacatggccgatgcacgttccatcgatcatgatggtggccttttgccgtatagtcaacaacatcatatgaccattcaggcttggagtccgttccaatacggtttctttgaaggggtcttcatcaataatgatcaattccctaagttaaatgcgctgcttcaaaaactagccgaccaatacaccaccaatcctaatgccatcgcggctgcttggcttttgcgcgttccagcgaatgtgcaggtcatcgccggcaccaccaaaccggcgcgtctgcgggcgattgctgaggcagcagacatcaccttaagccgtcaagaatggtatgatctttattttgcggccggtaacgacctgccttaagcctaaatgccattttgattggtagctatcagacaccaactcgtaaatgacctaaaaattgacacatttaatctttctataaagggagtttcgcatgaagaatcgactcgatgatattacagatttaatggcacttggtccgaccccggacgcccgtgacattcagcgacgtcaaaccgcccaccgaatcgcaattgcagacgcttggcaaattcaaccaggcgaaaacatcttggaaatcggctgcggtcaaggtgacttaagtgctgttttggcagatcaagtgggtcccaacgggcatgtcaccgggatcgacattgcttcgcgcgattacggtgcgccgctcacactcggacaagcgtgggatcatctgttaaacgggccgttagcaagtcggctgacagtacactttgataccaatctcaccgccagcctcggaccggttgccaatcaacattttgaccgcattgtgatggcgcatagtttatggtacttcgcatcagccaatgcgtttgccttgcttttgaaaaacttgcgcaccattggcgattatgtcgatcttgccgaatggtcacttcaccccaccgcactcaatcaaattggtcatttacaagccgcgatgattcaagggttactttatgcgattgcgccaagtgatgttgccaacattcgcactttaatcacgcctgataccttagcgcagattgcccatgatcacacatggtcctacactgctggcaagctaatagaatgtccggatctagatgatgccaagtgggaaatcgccaccactaaggctttattgaccgagctaaaacttagtaccgatttgcgtgatcgcgtaaagccgcagctagaggccatgcagcataatggtaccgctagtttgcccacatttaccggtcgaatcacgttctaatgcataggaggcgtcagcatgatcgaatttgttcccgccaccaccgcagatctacccaagattgttgccatttataatgagaccatccccacgcatcaggcaacagcagatttgcaacctcaaactgttgaccaaaaagctgcttggtttgcagcgcacaatgatcattttccggcatggatgattcaggttgatcatcacaatgtcggctggctaacgctttccgcctacagtgaccgggcagcgtatgatcaaaccgcggaaatcagcttgtatctggacatcactgcccgcggtcaccatatcggcagttcggccttggcatttgtggatcaagaagcaccggctcgcggattgacaacgatcatcgcaagaattttcggccacaaccaggccagtcggcgtttatttaagaaatttaactacgaccactggggccatctaccagctattgccgatctaccagaaggaaaagccgatctggaaatttacggcaaacattttaaaagctgattggggcgcccactaacaaaaaatttcctactaaggttaatcgccaaaaaaatcagttcttcctgcagcccactaacttaggaagaactgatttttatattccgtcatgttgcttttcccataacggctacttctacgctttttcccctgctttcgtatcttcttgctgtctaatccgccgcatggtgcggatgtaggagctgaccaatacgagcacgctaccaagccatgccaagggattggccgccgatgccccggcaaagccaaacggtactacaaggaaaatcgccgcaaatgcccgcatacctaattcaaaaaatccggccacagtcggcaccagcgtctgtcccaatccttgaagcaggttccggacggtaaataggatggctagcagccaatacatgctggcattgtagtggaaatacgtttgggccaaagcggtaacggcgggctgattcggtccgagaaacaaattgactaacggtttactaaagacaatgatcaaggcacccaacaccagcgataagccaacattgaccagtaaggtttgatacacgccgcggcgaattcgaccgtacgccttggcaccgagattctgcgcggcaaacgttgccatcgctaccccaaacgaagctgaaggtagtgtcgcgagctgatcaatccggccagctgcagtataggcagcaaccgcattcgtaccaagcgtgtttagcatcacttgcaagataacagcaccgattgcaatgatcgacatttggaacccaattggcaagccgacttttaagtgtttaacaatatcctgccaatcaaagcgcaagtcgctgcggttaatgaccaacaacggaatccgcatgcgaatatagatccaacacagtaacgccgcaatcacctgcgcactgacagttgcatacccggcacccgccacgccggaatgaaaacccagaataaaccagaaatccagcacgatgttaataatcgtcgcaatgatcaggaaaaacagcggtgttcgtgagtcccccaatgcccgcaacatattactcagcaagttaaaactcatcgaagcaataatgccaaaataaatcacccgcacaaaggcaatcgagtcatccataatatccggcggcgtctgcataacggttaataacggccgcgtcatggtcacggcaccgattgtcaaaataacggaaattcctagcgtgatccagacactcgtcccgaaactacgccgcacccgccgataatcacgtgctccatatgcttgggctgtcaagattgacagtccagctgtcgtgccttgcgcaaagccgataatcaaaaagacgatactcgaagtcgcaccaaccgcagccaaagccgctttgccaatcgtacgaccgacaatcagcgcgtccataaaactataaagctgttgaaaaagattccctattaacaacgggatcgtaaataagatgatcagtttcaagggtttgccaattgttaaattgcgcatcaatctatcctccaagattctttcatacctggttacgtgatgatgtcagcgcgtgtgttggttgggcatcatcgaaacttatggggttgtgacgtacgggagcggtttgtagttttgggctttctgcgcttttttcgctcaaatgtgcttccccggcgcagaagtctgcgtgtaaggacctaaaacgcaatggctaaagaccgggccatcacgctttaggccacgacgaaccactttacgcccataacacgctccccggagcagggatctgcgtgtaaggaccttaggcgcaatggccaagaccgggcccatcacgcctgaggccacgggattctcctttacgcccataacgcgctccccggcgcagaagtctgcgtgtaaggacctaaaacgcaatggccaaagaccggccatcacgttttaggccgcttacactccgacttctaaacgcgccggctcgcgctcactaaactgcaatccccccacgatatcacaaaaagccagacagctgaataactgtctggcaattgaaatatatttgcaatcaaacgtcggcaccgccgcctccggagctgccgccgccccagcttgagccaccgccggagccgccgccaaaaccgccgaatccgcctccgccgcctcttcggcctgcagagaacaaagcatctaggatgagccatagccagaagccgccatcgccatcgcggcgccgtccgccacggccaccgccgccgcgaccgccgaagatgactgctacgaccacaacgacaagaaagatcacaacaatctttcctaacaaactgccaccgcgatttcggtctgcattttggtagcgattcatcgtttcatccgagaccgtgttttgatccttagggaatttatactttttatcaataacggtcgcaacggcattgaagaccttacgcaaagcctgattcagttcggctttattacccgatttaatcccttttaggttcgtattgaggatttgtcccgccaaagcgtctggcaagtcaccttcaaggccgtaccctacttcgatccgcagattttgcttacctttattatcagcgtataaaatcaacacgccgttgtcggtgccttttttcccgatcccccatttttggaaaagatcaggcgcataatccgacaatggatcgccgtgggtagactttagtgcggctaccgcaatttgcggctgttgtttggtgctttgataataacgattcttttgatcaaccagttgttcggtttcctgatcaaggtaacgatcctggtccaggtagtaatggtcagttggtcgtgccggcagatcctcggccgctgctaccggacgagctgcaccggtaaacaacaacaagcccgtcagcgcggctagtaaccacgctaaatgcctgcgcatggcgccacctacttcccagaactggagctattgcttgaaaaatcaacactcgggacggtctgtgctgatggggtagctttgaaggtgtccttcttgcccagccccatcatgcttgcaaagatattcttcgggaaggtaacaacgctttggttataatcccgaacctgatcaatgtaacgcttgcgttcaaccgagatccggttttcactaccttcaagctgcgtcatcagcgtgttgacctgattactgctttggaggttaggatagttctccttgatcacattaatcaacgtcccaacactcttattcagttgatcatcggctttagccttgctggttgttgagtcggcgttagcataagacttccgggcctcagcaatatcgccgaagactttttgctcctgacccatctggcctttaactgcattcaccagattcggcaccaaatctgcgcgccgctgcatcacattttccacctggctccattgggcttcaacagcttgattctgcttggccaacgagttataagtgccaataccaaaaatcaggcagatcgcaacaatgacaccaagcacaatgctcgtgactgcaactggacttaatcgtttcgttttcatcatggattctcctctagtacatgcgccgttaataagactgttaatcgtcgtcttcagttataaacttattaactcgcatcgtaatcaattaccacttcctttatattttaccatgttggttgcattcgacatccggcttaagacgtaattacctacttaaaatagttaaagccgatcgcatcccggacttcttgcagcgtttgattcgcgacaacattagctttcgccgacccttgctgaagcatttcggccactgcacccatatcttcggcatagtgggcccgcctcgtccgaattggctcaagaaccgcctccatcacgtcaattaagtagcgcttgatcttcacatcacctaagccgccatgttgatattgctccttcaacttagccacctggtccttgtccggatcaaaaatatccaaataagtgaagacaacattgccttccaccttgcccggatcgctgacatgaatgtgatttggatcggtgtacattgacataatcttcttttgaacagtatccgcatcatcggctaggtaaatgccattgttcaggctcttgctcattttggcgttaccatcgatccccggcagtcgtcccagaccttttggcgggaagtagccttctggttcgactaagacgtctttgtgataggtccgattgaacgtgcgcacgatttcgcgcgtttgttcaagcatcggttcctgatcatcgccaaccgggaccgtggtagctttaaaagcggtaatatctgctgcctgactcaccggataaataaagaatcccgcgggaacgctgtcgccaaacgctttttgcttaatctctgccttcactgtcggattgcgttccaagcgattgactgtcactaaatcaagataataagcggtcaactcaaaaagcgccggaatttggctttgtaccaaaatggtcgtcttatccggatcaatcccgacggccagataatccaatgccacttccaacaacgagtgacgaatcttctctggatcattggcattatcggttaatgcctgggtatcggcaatcatcacaaacggctcatattcgcctgagttctggagctcaacccgattcttcaaagaaccaatataatgcccaatatgcaaccgtcccgttggccgatcacccgtcaaaatcactttttttgccatgcgtgtttcctccttaatttaaaaaagcgtcctatgtcatgacaacataggacgcaagcgcgcggtaccacctaacttgtccgaatttcggaccgctcttggcttaaggcgcacccaccgaacgtaacgcaaacgacccaatttcacctaccctggccatcgacttctcagcgctgccgactctctggcgaccatttggatagggtactcatcgtttgtatgaatatgggtttaggttagctaagattttggtagaagtcaatggctttaaaaaggaacatcttgaccaaaaaccttaaattttaaagatagactgtgcttcgaaccaccataggatacatttacagtcaatttactatttgtttacatcatcttaattgatttcaagcgtgagaagtctaaattgaaaatatggagatcatcgaaatgatattttcagtgagatagttttttctggaggtgactcagtgtttaatcaacgctactggaagtcaaaggcaacactcatcgcctttttattaggatttctgctgcttatttcgcacctgatgaccttactttcacttgataagtttggcgggaaacaaacagtaggctttttcttcttttcgccctatatgaattggttaccggtcgacatttcgtctaacttatttgtggtttggagcatggccgcgccgcttttgtctgtgctggcaggcgggatgtttgctgcttttgagggacgaaagggcttttcgaaaatgctgcgaacccggcttagttttacagcatatcggcgtaagactttactggctggtggcttttggggcgcacttttgccgatttttctcttaacggtggactttttaatgcaatttttgattcagcccaatgttgctcctaatgcgtggttgaataacaatgttgccattagttacttgggcttttttggcgcttttttctatgcgcattcaggctggtacgttgtggggtggatactactggctggtgtgtatggtgctagttatgccatcttttctaactatttatattttgagaccaaaaagatgacgatctcgttgctcggcgtcatggtcttgcaactaatgctattaggactgtcgatgatcttgggtcagagtcttgcgccaattggttacatgcaagtcgtaccaactatcggccagccatcactggcttacgtctttctttggccgcttgtctttattgcgttgagtctgcttgcttttcatcggccagccgtggaggtttgatgcgatggtgaattcgaaaccgcttattggcgtctttggtttattaccaaaatggcagagttttttgtttggtttgatgagtcttgcgtgctcgctcagtttgactttcattggccgcactgccagtaagttttcggtcagtcttctatgggctaatctcgtcattcagcggacattcggacaactgatatgttttctgccgattattggcatcatggcattgatgatcattagtaaattacgaaaagccaatctgttaattcgcttaggttcaagagctgcccttgcaaattaccttttaattagtttactcaaattaactgctattgtgaccggtttgattgtgggtatctggttagcgacgtttgccgttgttggttcttttacgctgacgatggcaagcgtggccgctatcatcaacttggtcatgaacacgctgacggcctgttttacatatacacttgcggccatcgttatcatgctcctggtgcgttcagctgccattggtgtcctgattagcctcggtggggttatttcgatttatgttttgcagcttgatccttttttatcgttgatcacgccaagcttaaccctaagcgatgcactgtggccaattgatgtcgttaaacagctgttgcttttaatcgcggtggcagaagcgttacggatggtgctgaacgtgatccggttaccggcggaggtgtgatctttgtggttacggcgaacacgcctggtttcaaaatcgggatataaacgcttagttacctgttgtggactatttctggttttattgggcggctccatcgggttagatgcgcaatatgtacataatcatttcttagtggcaactcaagacaccgtacaggcgatttttttaggtgcgccaccggaagactttgcgagtggccaggtgctgtggttatttttgtggtttggttacttgtttttgccgatcgttttgagtgctggcgtcacgtcagcttatcagcagaatatgtttatccattacgctgtgcgcttccatcagcgattttgggcttatttatggccgctgagagaattgctcttattgcaaatgatttttctcatcttcatgggtggcacgatcttactggcaaatcaggcgggctttttcgggtcacgcgggtttacgcatccggctttttggctcgcacttgtcttggctcaaatcctgcaattagtcatcatgttggtcattgaaggccggttcaatcttgtcattggcattaccgtttcgctaagcatcttgtttcttagtatgttgcaggtgccattcatgccatttgccaccttgattggcagcacgttcccgactgatgcacaactacttggcactagcagttatctgctcatactcatttgtttattgctactcattcaagtcatctacatgccaggaaggtggttaaataatggcgcaacccactaacaacaatcaaatcgaaatcaagcagctttcggtcgtcctcaagcgtaggaaaattctcagcgacatcaccatttcatttgccggaccgggtatttacggcatcgttgggccaaatggtaccggtaaatcggttctcttgaaaacaattttggggttcattcgaccacaacaaggcaccgttgccattaatcaggtggtgatcgatccacggcgtccttttccagcaaagattggcgcggtgattgagcatccgggtttcatcgaggatatgagcgggtatgataatttgatggccttggggcgtatacgcagtcagcttagccatgatgaagtggttaacgtcttaaaacgcgtcggactggctgctgataaaaaaccggtcgcttcttattcgctagggatgattcaacggctcggcattgcccaagcgatcatggaagaccaggatgtcattcttttggacgagcccacgaatgctttggataaagatggcgttaaaatgctcactggattgctaaccgacctacgccaacaaggcaaattggtgctaattgccagccacgacttagcttggctctactcgttagccgatcacagttacgaactgacggatggccagctaaaaccagtggaagaggcgaatgtctgatgaaaaaaagcctaaaaatagccatgtttatcctcccaatgctcatattaattgggttagtcatatggcgctatcagcaagtcaatcaaccgattacccagcctgctgtcgttaccaaaacctatcgagtgccagcgcgtatcatgttggggcggcgtcaagtccggctgaccgcattcaaatgcaatgaacagaatggtgaatggcacttgcaattgcattttgctagcaccctgacgcatcaagatttagagcaaatgaccttcatgctgtcacaaaaacgaaaaggccgcgatgtcccgtcttcattacgaccggttatcagtgcggacaaacacacactgcagtttactaacccggtttatagcgctgccaatcaaaatcgtcttgccatcatcacgctgccaaaaagccttaacgagccaaataaaattcaaattattcaggctgagtagatcgcttttatgcatctatactgcatgaatgatgcccccgcctcgagcactcaaaaaaggatagacctagcaaacttgattgctaaatctatcccttttgttttaacgttcgaattcctcaaacctacttctgcagattaaaacaagtactgcaaatcactttgcgcactcggataagcatagatccggttgagatcactaggttcctgaccggcatcaattgcagcggcaaaagtgttgatgaggccttccgccagacttgcgaggacaacggcgcctgcaagtttgccggtgcttttatcaacaatcgtccatacctgcgcatccgggtcttgtatgcggttgtatgtgtaccaatgcgttgtctcgttgtgggtgacctgatactgttccggtgcggctagggcatcttcaagcgccacgccgactttagccagctctgtggggccaaagacaatggttggaatcgccgggtaatgaatcggttcctgactgccaagaatttgttgggctacatagcggccttcaaagccagcaaccggtgtcagtttcggttgaggttttaagttgacatccccaattgcataaatgttggcaaccgccgtccgtaagtgatcgtcaacgggaataccgcggaggtcggatttaatcccagcattggccaagcctaaatccgcaacgttggcaattcggcccatcgccgtaactgccatatccacattgagatcaaacctatctgcatgcaagtgcgtcatcgttccaagcggactgatttttgtcagttcaacattagggtgaaaatgaatcccggttttaagcaacagctgcttcaatgcctctgtggcaactttagggaaagcacgtaaaagtcggtcggaatgaccaatgatatgcacatctgctccagctgccgcggcaatgttagcaagctcgacactgacataaccggcaccaataaacgcaatgctagtcggtaattcgtccaagtctagaaagtcacggctggttttcaacaaattggcaccggggatatccggaaaacgcggcgtatgaccggtggcaatgacaatatgttcaccggtcacattttgcgacccgactttaaccatatgctggccgagtaattgggcccgtccgtataaggttttaatgccagtctgcgttaggccggttagcgtcccagccggaataccggttgtgtaactgcgcttgaaggccatgagtgacggccaatcaatcttagccgtaccactgatgccaaaaccgttcatccgcaaagtagcgtttttgacttcaactccgcgataaagcatcttcttgggatcacagccgtaattgggacaggtgccgccccacagatcgctttcaatcaccagcaccttttgcttggcggcaagtccgtaagcagccgccaacccaccgggaccgccaccaatgacaatcgtgtcataatcatacgccatttcgatcatcctttcgtttctgtgtcctgatcaacaaatgcacttgcaagatacgccaccacactatgcgtatcaatcacgaagacgccatggtcactcttgacccgcaatgtttcatgggcgtccaacaacggcagcgcctcggccaacgttaaattaccgccaactgcatgatcagctgattgctcaaccgcaaatggtgctaattgactcaatgtcacctgcaacccttgatttgcctgcgctcctttgaaaagatcagcaacaaaatcattggctggctgcgtggcaattgcttccggagtgtccacctgcaagagccgaccgttatgcatgacgccaatccggtcgccgagtttcatcgcttcagccatatcatgcgtgacaaaaacaaccgtggttttcattgcccgatgcaagtgcagcaacatatcctgaagctgggtccgtgaaatcggatcaagcgcggaaaatggttcatccatcaacaccactttcggccgcgatgctaaagcccgcaaaataccaatccgctgttgctggccacctgaaagctcgctgggcatgcgatctcgatactcgtctggcggcaagtcaaccattgccaataagtcatcggttgccgtgcggatcttttgccgtgaccaccctttcatttccggaatgaccgcgatgttttgcgcaactgtcatcgttggaaataatgcaatttgctgtaaaacatagcctagatcccaacgcaagtcacgtaccttgtatgccatcagtggtttaccggcaaatttgatgacacctgccgttggatcaaccagccgattgatcattttcaacgtggtggttttcccactgccggaagtgccgaccaggacgaacagttcaccttgatcgacctgtagactcaaatcgttgacaaccggcttgtcatcataagtcttcgtgacgtgttccagactgatcaatgccatcagcgcacctccttgagcaaaccatgttgcacgagatagcgatgagcgaccgtggccgctttttgattttgcacactcacggcataattcatcgcctgcatctgtttttcggtgatgtgattggctaaccggttcaacgccgcaaccagtcgtgggtgctgcttggcaaacgcagcccgcatgagtggtgccccgcggtaaatcgggaacagacctttgtcatctttcaaggccactaaatgatactgtcgcaattgcgcgtcagttgtgtagccatcagtcaggttgatctgcccgcgatctaatgcttgatatcgcaacgaggcatccatggaatccaccttaaattgcaaaccatattgagattgaatgcctttatatccatcttggcgatcaataaattccaagtcaaagccagcgcgaattgatggtgcgatttttgccagatcactgatagtttgcaactgataacgcttggcaaaacttgctttaaccaccagtgcgtatgtgttgttataggccattggtttcagataagtgaagccttgccgggccaacaactttttggctaatggataattatttttgcctgccgctacctgctgctgttgggttgcagagggtttcgtcagactagccaagaccgttccggaaaattctgggtacaagttgatcttatcggttcgcaaagcattgtacaagaagctcgtttgcccaaagtttggtttcaatgtgaccccaacatcaggatcggctttttgaatcagttccttatacatatgaatcaagatatccggctcgctgcctaatttacccgcaatggtgatcgtttctttcggcgcagtcacccggctgtaaacctgcgtgccgacgagtccgaaaaccgccaacgccacaaccccgacgctcagcttccagttaattttttgcatcaagttcaataaccacgaaaagacaatcgccaataacgccgcagcgagggcacccataagtgtcagtgcggcatcgttacggtcaatgcccaaaagaatgaaggttcccaacccgcctgcaccaatcaacgctgccagagtcgccgtgccgatgatcattaccatcgccgtccggacgcccgacaagatcaccggcagcgcaatcggcaactcgactttaaatagtttccgcaaccgactcatcccaaatgcatccgccgcttcttcataagaaggatcaatgtcgcgcaggccgatatatgtattctgaaaaatcggcaacagcgcatagaccactaacgcaataatcgccggcaacgttccaatcccgacaaacggaatcaataaccccagcaatgccaatgaaggaatcgtctgcaacacgccggtaatctgaagcaaaactgccgcgactttggcatgtgtctggacccaaaccgccaacggaatcgcaattaccaccgctaaaataagcgcaatcagtgatatttcaatatgctgtcccagtgcacttagcaattcaccgtggcgctcagcaatcgtccgccataaatcagccatctcgaacctccgtgtgaagtcattatgtttaagtgtaccaccttgttttccgatgcaacaacatgaagcaaagtgtagtaagtgtcaacttttctcggttctattctaattaagtgatttccgtgtaaggccctaaaacgcaatgactaaagcccagcatcacgcttaaggccgcttacgttctggtttacgcccataacgcgctcaccggcgcagaagtctgcgtgtaaggaccttaagcgcaatggccaaaaccgggccatcacgcttaaggccgcttacactccgacttctaaccgcgccggttcgcgctcactttacttttccctcaaccgggcgtaagattatcgacactattttaaacacgataacgcgttcgctggttcaggattcgatcctggtcacatcaacgcacgcatactgaatcggagaggagcgccggttatgaagaatgcaacgaaagcagaagaacaggcacgggtcacggcggtcattgcgaaactaaaagcgaggttggctgccatccatgagcaaatcgaagcggcgcaccgtgaaaccagtcgcatcgaacgggcatatggcgaaaacaccaaagtcaacgtgactgaagtcgatgaccaaatggaaaccaacgccgccgttcagcaacaaaaagtcatggttgcacgggcggttgaaaatgaaaccatccttaaacatgaaggcgatcgcttaactttattggcagacaacccgtattttggccgcatcgacattgacgaagacggcgaaccggatacgctctacattggcaccgcgaccttcattgacgaagatggcgattttctggtttatgattggcgcgccccgatcagttccatctattataacggcacgctgggggatgtgacctatgaaaccccagctggcgagcaacatgcgacattgaaaaataaacgccaatttcaaatcgaacacggtcatatcaaaaccatgtttgatacgaacgaaacagtaggcgatgagattctgcaatcggtgcttggcgaccagtctgacgaatatatgaaaaacatcgtcgccaccattcagcgcgaacaaaacgacatcattcgcgatacctcaagtgacttgctagtcgttcaaggcgttgcgggctcaggcaaaaccagtgcggtcctccagcgggttgcctacttgctttaccacagccgcagcgatttggatgccgaccaaatggtgctcttttctcctaaccggctttttgccaactacatttctcaagtcttgccaagcttaggtgaaaagaatatgcgtcaggccaccttgttcgagttcctcgccaatcgttttaccggcctgcatgtcgaaaccttatttgaacggtacgaacacgatgcagccggtttaccgcaagcagccgaaaccattcgccgctttaaagaggctcctagctacttacaagccattgccgattacgccaacgatccggatcgcgtccctcatttcattgacgttgaattcaatggtgaagtcttcttttctgccaccgcgattgacaatatttatcagtcgcaaccgaccttgatgaaacccatcgacaaatttaccgctactaaaaacgcactgattaaacagttaaacgctcgtattcacgacgaagccacgcacgactgggctcaactgcgtgtctctgacttatcccaaaccgaattagaaacgttgacagctgatcacgaatttgaaaccggtgaagacgagcaacaattcgtttccgaagccattgttgcaaaagccttcgccccgatttacgacgcactgtacaatgatcatttttatgacgtcttccaggattatcaacaattcatggagcaagtagcagctccggtgaacgtgccgatttggcagacgatgatcactgcttttagcaacggcattgaagctcatcacttacgcttagaagacgcggctcccttgctttatctgcgcgacctgagcactggcagcggccaaaatagtttgattcaatatgtgttcgttgatgaaatgcaagacttcagtatggcgcaattgttgtatctgaaacatgcttttcccaaggcgaaattaacgttgcttggggatgccaaacaagacgtcttcaccagcaattaccagcccagcgacttcatccacgaaattaaggatgttttttccggctataagatccgtttgattacgttgaacaagagttaccggtcaacccaaccgattacgaactttgccaaagccttgttgccaaaacacgaccacattcaagcctttaatcgcgccggagatatgcctgaggttttgaccgtttcatcggcggacgccactgcttccttatcgcgtttggtcacgcggttgctgacagttgacagtactgtggccattttgaccaaagatgccaagaccgctgcacaactttacgccacactcaagctcgatacgccggtcacgctactgtctgcaaacgaccacagtctgaaaaatgggtgtgtcatcttgccggtttacctggctaaaggacttgagtttgatgcggttgtgggctgggacatttccgcaaccacttaccggaatgaagccgatcgcgatattctttacactctttgctcgcgtgccttgcatcacttaacgcttgtaacgttggacgcaccaagcccattaattactgcattgccgaccgatctatatcggcgaaccggcgatgcctcggaagctcgagtttaaggctattggcagacaaacgcccttgtcgcaaaaagacaagggcgtttgttttattcgtgattattatgatattttattaacatcctcgtttaatttaaaaacttaatacaaactccggaggccatttgattgtgtaacttattacgcaccttcatggctgtctatgaaacgcgcagtttttcattggcggctgagcatctttttacgagtcaacccaccgtctcccaccacattcagcagcttgaacacgaactcaatgtcacactttttgaacgcaacaagcgcagcgccaccgtgccaactaccgcagctgatattctgtacgattttagcggcaacatgttagccgaatgggacaaaaccaaacaagcactgcaaaacagcacggcgacaaccacggtcaccttgcatattggcatatcccaaagtgtcgcggccgtgctgtttcctagcttagcgcgcgatttgaaggctgcttttccctacctacaattcgatgtagccgtcttaaattccctccaggttgtgaatcagctggaatcgcggcgccttgatctcggctttattgaacagccactgacacttaaaggcgctatcagaacgaccttgtgttccgatcagctcacggtctcgggctggcccaccggtacctggatcacccgcgaagaaggttccggcatgcgctattacacaactgcttacctacaaacaaccggcatcacacccaaacacctgatgaccgttaataacaacgctatgctgcgggccttggtccaaaatggcgtggggcaggcgctattatccgatcgcatcgctccgcctgacgccccgcagcaagccatcgggaaaaagtttcaacggcatttttatctgctgcagaaaccgagtactcactggccgcataagcaagcgatgctggataagattattgatctggctaaattagcaacaaaatgatgcgctggatttatgctgtttaaaggcagaaaaaacgtcacaaaagctgtctcatcgccttttcgactattcaataaccttctgcgcgtcttgagcagcagccttaatcccttttcgaatccgccgcagaaaatgcagataatgaccggttacaaagactagcatcagcgttgccgcgatccactcaccccattgcaggacactcatcagatcatgcactgtgccattctgggcaaaagccgcaatatatttggtcaatgcggtggcggaaatgaccaaagggaaagtgaaggccgcaaaacttggataaaacgacaaccgcgtatactgccgaatactaaccaacgtaatgaaatataaactctgcgcaaaaatcagcatccccgttgccagccagaagttaggatggtcaaaactggccagataaccggtcagacacagcgagtccggggctgccataatggttaataatggctgagtcgcttcgggcaaaggcacatgccgtaaccggtgaagcacaaacggaaacaaggcaacataaatcaccaacgccatccagaaaagcggctgacctagcgccggtacaaattgactgctggtcaccggaatcacacccaagccaacaaacgtgacaaaccagctcggataaatcatctgccatgctttcggctgtggaatcaaatgccgcaaaacaaagaaaatcatcaacccaaagtgaatcgccaccgccatcagccaaacaatcgtcgcaaccggcaacggcatcccccaagcaacaaaataagtgcacaagatcatcagcgtcattgaaaaagttggcgaaaccgaagcaataatcggatcctgcaaactaccagcagcatgaagcggcgtcaaacaaagcttcagcaaaaccaacccaaacaacaaccccgctacgatcccagtcaaatcaccaaccaactgccaaccagctaatttatacaaattccccaacgaagccaaccccaacgtcaaccccgccatgggtaacggtacctgctttaaaaaattacgcataacatcctcctgagcgcgaaccggcgcgcttagggatcggagtgtaagcggccttgggcgtgatggtcgggctttgaccattgcgaccaaggtccttacacgcagatccctgcaccggtgagcgcgttatgagcgtaagctggcaagcttacggatcggagtgcaagcagccttaaacgcactggccgcaccttgaccattgcacccaaggtccccacactccgattcctacgccagcaaacgcataatcaatcacatgctccccagtctaacaagaacagctaacatcaaccaaatgaatcttttgcatcgttaatattcatgaatcgaatattagcctcagaaaaaaagcgctggtaaatcaacctttcgctgatgccaacgcctatcgacttgttacttgccaccaggacgaccatcaatttaataaacaagctttttttcgaccaagttgattggaattagcgcaattagtaacaatacaacgaacaaccaaaccagattagccaattgaccactcaaattaccatcagctaatccgcgaattaggcccaccgcatgggttaacggcgaaaaccagccaacctgtttcaaccagctggccacatgattcaacgggaaaaacgtatttgaaaacataaacatgggttgaataaccaacatcgtgtaatagttcagataatctctggtgggtgccatcagtgtgaaagccagtcccaagaatccaaacagggtacctgtaataaacaaaaccattggaattaacattgcccaaaaactgctaatggttcccatcagtagcgccactagcataaatagtgtaccgaagatgacgctccggataccagcccaaatagcttgaccgacaatgatatccggcaggctgattggaccagtgctcatttcataatatgttttgtctaaatgcatctggatataggcattaaccgtgctttcattgttggacgcgttcatcgccgtcccagcaatcaaacctaacgtaataaatttcaagtaaggcatcccgtctacttgaccaacaaaactgcctaagcccaaacccatcgctaccaaatacaggatcggatcaaacagattaggaaaaatagagattttaaacaacttcttgaagctcatccaatcacgatagatcacatgaccgatgcctttaatcttgagtttgttcaatatcttcccgcccctcatcaaaatttgtcattttcaagtaagcctcttccagcgtggcataaccatactttagcggaagttctttaacaggagcttctgctaaagcgacgccatgatcaataatcataacgttgtccgccaacgtctcgatttcatcaacataatgtgacgtgagtaaaatggaaacaccgcgtttttttaaatcattgattcggtgccaaaagacatgtcttgattgaatatcaagcccggtggtgggttcatccagaatgatcagtttgggatcattaataagcgcccgcgctaagactaggcggcgacgcatccctcctgacagactggttgttgctttattttggtaatgagacaacccaacaaactttaacaattgctctgctttttcagctgcagttttaaccgttaaatcaaataagataccatgagcgatcatattttctttaacggtcagcgtcgtgtccagtaagtcatcttgcataaccaccccaatcgtccttttagctaatcgaggttgtttgacaatatcgatcccgttgatataaatttttccggaagtaatggcggtagtcgcataaatcatttttaaagttgtcgatttaccagcgccattaggtcccaagacagctaacgttttcccgcgatccaaggacagtgaaatgcctttaactgcctcaaagtttccataacgcttaactactttttcaacctgtaaaattttcacagccggacacctccactagcgaaacaaatatcgcttttcatgggcttaactaacgcccttgttctaaattttagggcgcagtcatttccatgcgcatcgaaatgtggaataattaaagtgcggttattattcgccgataaagaggttcgtttcatggcaaaagaattacctaacatcaccaagattgcagtcgctttgtccaatcactcaaaaatgctagttttggacagtctcatggataaacgcggtcacacgcttctagaaatagcccgcgaagccaacattcaacctcaaactgccagttatcacttacagaacttcattaacaatggttgggttaaaatggaaaaatccggccgctttcactatttcttcttagtgagtgatcaggttgccgcactcatcgaacaattcagtccactttcaccatcagcgtcaacccataccttaaccagagcccttaaggttgataaaatgcggactttccgttcttgctacgaccatatggcgggaaaaataggcgttttgattaccgatcaactcttggctgatcacctcattagcgaagaacctcaagcatatcaagtcacgccggatggtctgaacttctttgaaaaggatttgaatattgatcttgaaaccgtccaaaaaaagaaacgcctctttaccgttaaatgtctggactggagcgaacgaaaacatcatctcggtggtgccttgggtaatgccatttttgatgcattttcaaagcaagcttttgttgaacgtgatcccaacaccaaacgagcgctttatctgacagcagaaggaaagtattttctacacactgaattgaactgccaatttgaataaaccgaccggaacgtataaaagccacccatcgcagaacaatgatgggtggcttttatacattcattaacgcttttagcaattcggaatctgcccatagccaaggaagctcacgcggcaatgatcggttgctaggatcacgctgcttaaaccaataaaatcgtcgcgttattcagtatgtgcaaaccgattgaatagcgcatgtcccgcgtacgcaggtaggtccaggctaagacagcgccaagtgcggcataaataaaaatattgtagtcaatgcgcgaccccgccacatgggcaaagccaaatgcaaatgcactcaccaacacgctaacccactgccaggaacgtttctgcaatgagccaaagctattcatcaaaagaccacggaataaatattcttcgacaatgggaccaccgacgaccgccagcaatttaatcccccatggatacgtgtgaaccagtttaatcaaattactctgatttgctgccaacggtgcatcggttaattgcataatgagtgaattcgtcacctgaatcaaaagcagtaagccgatgccttgcaagacgaccgcaacgggatgggcaacttttaaaggcgattgctgacgatataaacgccggtaacaaaccatcaaggcggcaatcaatgccccgaatgcaatgataaacgccgcgatcgcaccgaccatcccccaggttagttcgctgcgaacaagtgcaagttcggccagagagtagaacaagaaaccgacaataacgccaaaaatttgaatgatggaacggaggatttgcaaaataaacgatcctttcgtaggcagtcacttggactgacggataacgatgtcacaacattgctagcaacttataataaaaaaagcccgaccagataactatctgtcaggcatttcatttgcagccgtctatcgggcttgaaccgacgacctcatccttaccatggatgcgctctaccgactgagctaagacggcaaatgacttggttgtttaaaaacaactgcctaattaatgtacactaaatcgccattccccgcaagccctttttggaaaaatatcgcaccaagccattttccaactgcaaatttcaagctgttagcaacgtcaacgggttcaaaccgttacaatctgatcaagctgatctttaatctccggacgaaggttatgggtcaccatgatcaatgtggtcttgggtaacgccaccagtaatttttcgatggcgagtcccgacttaggatcaagcgccgccgtgccttcatcactgatgatcacgtggctttggcgaatgaggccgcgcgccaaggcaatccgctgtttttggccgcctgacaagtctgccccattatgttccaagaccgtatcaagtccctgttcctgttgcgccataaacgttgtcagccacgcagcttcaatcgcatgctgaaccacatcatcagctacctgttgtcccagcgtcaagttaaagcgaatggtgtcgttgaagatataaggtgcctgatcaatataggtaatctgatcccgcaaagaacgcggatcaagcatctgataattttgggcgtcccacgtgatttgcccttgataatcggctaatacatcactaatcagtcgcaacaaggtggttttcccatggccggatggtccgacaatggcaattttcttacctgccttcaacgtcatcgtcacatcattaagtaccggctccttgcgatgcggataggtgaaagtgacatcctgcaaatgaataccttcctccaaaccattaactggcactttcggtttttgcggtgctggaattgctttggcaaacttatcaaaaatcggtgcgactgatttaaccgtggtcaaggcaaaactcatcaaggttaagccactgaaagtcgtcccggccaccgaatgaatcgtgacaaccgccccaaccggaatcacgcggttatacgccagcaatccggcttggatcagcaagaaaagttgactgcccagattcaccaaattgatcaaaaattgcgtggccatattgaattgaatgtaccccacttgtgcgtgtccggccgcattcgatgcatgaaacacccgatccaccatgacgtgacgccgattcgccataaataaggtattgaagccttcaagaatatccgtaatccgattggtcagtttctcgttttcctgactccattttgccgccgcagcgcttagctttttacgataaatcatcggaaccgtgatcaatagcaccgcacaaaccaaggtggtggcaaataacgatgcttgataggtcaatagcacaagaatactaagcacaacttgccagctcgcctgaatgagatagcccacattgcgcagtccctgggtattaatggtattgacatcgttggtcatccacgaggtatacaccgcatccgaccgcgcatggtactgttcaaacggcatcgcagcaatgctctttgttatttcggtacgaatgtcattattgagccgccgttgcagtgacacctgataaatattggtcagcgtctgcatcaccagttgaaagatagtcgctaccaccatcacaatcgcagcagtcacaaaggcatttactttaaactgggtcaacgcagtaatcatattcccagtaaaaattgacacagcagttagcgcagaaatttcaagcccatacatcaagataaacacgccaaaccgccacttaagccggaaaagatattgtcgaaacgtcacagctgcatcccctttaaaagcacccatttaaagttggaaaataatggttttcaccatgctgtccgtattaggcacaccgcttcatcgccagacaatgtttcatccaacaccaagcgttgcagccaatttccacttaattatgagtcttttctgagcaagattagaatacccaaataatagcattacattttcagaaaaacaatcgcaccattagcgttccccctgccactctgctttaaattcgtccaaaaatgacagcatcacttgctgccgatactcagcaagctgtctggctgccgatgtattgagctgatcctttaacttcaatagcttttcataaaagtgattgataaccgtgctatcttttcctcggtagctgcttgcggtcagggtcgttcttggcgccagtgccggatcatacatgcgaccgccatgcgcaccggcgtacataaacgcgcgcccgattccgatcgcgccaatcgcgtccaaccgatccgcatcttgcaccaactgtccttccactgataacggttgatgcttgcttaaatttgctttgaacgacatgtggtcaataatttctgtcactgcctgaatctgcacctgcgtcaacccagctgtagccatcgcttgctgtgcggctgcttttgctgcgccgacatctgccaccaacttatcgtcataagtatcatgcatggttgccgcagccacgacaaccgttgcatcaacgcctgctgttttggcaaccagttgttttgcattcgccaccacccgttcaatatgatcgaagccatgtccactatgatcctgcgatgaaactttttgcgcatataccgtcaatatttgccagtcaatcacgcttcaacactccttagctgataatcatcaaaaattaatgtgatgccatgaacaatttaactagttatccgccctaattgttgcgccccttaacctcaagagttcatacttaaagtataaagaggttatgtaaaaaagggggaacatgacgatgaaaaagcaatatttgtcggccagccagtcggtcaaccaatttaatcggcttttttcaccggtgtcaacggctgacattccattgaatcaacaaaatctgctcttttggatggcaaccgattcgacacctcgaacaccaacgaatctggccaaagaaatgcatgtcaccaaggctgccattaccaaagcaagcggtccactgctcgaacgcggcctgctcgacaagcaacccgatcccgaagactgccgcagtttcaaactcgtactaagtgaagccggcgaaaaggctgtcgaagacttgggaccggaatatttaggcaacctcgagcgtctgtacaatgagttaggtgaaaagaaatacctcaaactcatcaaactgctcagccaggcaaccggcgtcacggtaaaagaatagttcgtcacccatatttgtaaaatcgcatacgccttacgcatcaccgcgtaaggctttttggcatattccgataaatttgacgccatgcttactggcgaatgacaacactgcgaacccagctgtgtgccccaagttactttgttcgtatgtaaaaaatagaaaacaagagctggcggagcggtggcgggctcagtggtgaaattggtcttaagcggagtgggcttctccgctttagaccaaggccgagctttgaaaccgcgcatgcactttgcgggttcaaagtcgtgcccaccactctagctgcgcggtcgccatcctgccaccgcggagccagctcggagtatcggaaatcacttaattggagtagaaccaagaaaaagttgacgcttaacctaatctaaccaaatttgcccccttccccagctgcgttacaataaactcatcagccttttcaaactgactcaccgaaacgttttgtctgccaaaggagcgtgttgcaatggcaattccagatcatatcagtgttcggggcgcgtatgtgaataatttgaaacatctcaacgtcgatattcccttaaataagcttgttgcgatcaccggccgatccggttccggtaaaagctcactggcaatgggcgtgctgtacgcagaaggcatgcgccgctacatgagtacgctgtccacttatactcgccgacgcttaggccaaaccagcccggctgcggcagattcggtcaaacatattcccagtgccattgcgctcagacagcggcctgttgttccgggaattcgctcaacagtcggcaccgcaactgaagccctcaacgtcattcgcctcatgttttcgcgcctgggctcacctgtttgtcccaatggtcaccgcgttccaccgacactcgatattgccaaagcgatggatctgcctaatgatggcgaaagcggcatggggatgatcacctgtcccacatgcggtgtccactttatggcatttgcggctgaagattttgcttttaactcaacgggtgcctgcccaacctgtggcggtacgggacaggcgcggacgcttgcggccaatcgcctcatccctgatccaactttgaccattcgccaaggcgccgtggcatcatggcggcttccgggacgcaacttcatgccttatgtggctcaagcaatcggtattgatattgacacgccttttcaagacttacccgaagaccagcaagaacaggtctggcacggccaacgcaaaaagtatgcgatcaacattccaagcaaaaccggcaagattttccacatggatcacgcccaatatgaaaatgcttttaatgccgttgaagattcgctagccaccaccaaaaacgaacgggcaattgaacggttaaatcgtttctatgaattcggcgtttgtccgacctgccacggcagccgattcgcacccaaactgttagcccagcatctggtcgatcaaaacatcgcccaagtcagcgacatgacgctcacacaactaactgctttcatcccgaaaatttaccagtggctgccagctaacatgcaagccttggcgcacgatattatcaaagagctgacccaactgcttaaaccaatcatggatctaggcttaagttacctcacgctgagtcgggccgctgcttcgctttcaaccggcgaattgcaacgcattcagcttagccgcaccttgcgcaccgaaacaaccggcgttctttatgtccttgatgagccttccatcggtttgcacgctgccaatgtcgccggtttattggaagtcatgcatggcttggtcgatcaaggcaattcgttagtcgtcgttgatcacaataccgccatcatcaatgccgccgatcaaatcatcgaaatcggacccggagccggagctgacggtggccagattcttgatcaaggcagtccggccgaaattagtcacgatgctaagtcgttaatcgcaccgtttttaactggcaaaacgcctttaatcgtccgtccacaagccggcagtgcggccattgccaaagccaagcaactgcatctcacggtcacgaatcggtttaatcttcatcatctgaacgtccaattcccgattaattgtttctcggtggtgtccggattctccggtgcgggcaagtccaccttgattttcgatgcgctagtgccggcactttccgcaaccaaagatcagcctgctcccacgtttgtccgcgatctaaaaaccggtggcattcggcatgtggtcgccattgacgcgacgccggttggcaaaaatgtccgctcaacggtcgccacctacaccgatattctggatcatttgcggcatcttttcgccagcttacctgctgctaaggccaagcactataccagcagccatttttcttacaatgtcaaagccggcgcctgcccaacctgtggcggcaccggggttatcaatctggacatccagtatttaccggacatgcaacaaacctgccccacctgccacggccgacgttacaatccagaagtgttgaaaatcaaatggcacgagcggagcattgcggatttactcgacctcgatgtggacacagcactcaccgtttttaaggacgaaccgaccatcgtccacaccttacaaaccttgcacgatatgggcctgggctatttgcatcttggcgaaagcacgccgacgttatccggtggtgaagcgcaacgcctcaaacttgttgcccacatgggacgctcgcaaaaagacacgctttttgtcttcgatgaaccttcagtcggtctgcatccgctcgatgttcagacccttgtggcggtgttccagcgactgttacaaaccggcgccaccgtcattgccattgagcacgacttagatgttattgccaacgctgattacgtcttggacctcggaccaaaaggcggtgcagaaggcggacacgtcatggcagccggcacgccgcaagccattgccaaacaaggtcatggagaaacggcaaaatatttagcggcacatcttgctgcttttcatgtggattgagagcacctgtcaagcattgttcctcaaaaataaaacagctccggagtcaaaaaacactccgaagccgttttttatacttacgcttagccttttacagccaaacgtcaactaagcatttaaaatatcatcaatttgttgaatctcttcagcagtaaaggtcagatgttccgttgctttaaggttatcctgaaggtgttcaactgaggtcgtcccaatgatcacacttgtgacaaccggatcccgtaacaaccacgccaaggccatttgactcagggtttggtcacgatcatgcgcaatttcattaagcgcatttagttgcttaaccacagcctctttgcccttagcaaaagtggccttgttggttggatggattttgaaagtatccggaattccctttaggtagcgatctgataacaagccttctgataacggtccgtatgcaatcaacccggcaccatcagcttttaatgcattgatcaagccggacgtttcagcggtgcgattaaacatgttgtaactgtattgattcagtacaaaaggcgtgtgcaaatctttaaacatcgcaattgcttctttggtctgcttcgtatcatagttggaaataccaatatacaacgccttaccgtcacgcaccgtttgatccagcgcatttaccgtctcttccaaggccacggtatcgtcaaatcggtgggcatagtaaatatcgacataatccaactgcaagcgcttgagtgaatcattcaagccttgaataactgctttacgcgacgtcccgacaccgtatggaccagggtgaatctcataacccaccttggtactaatcaccaattcgtcccgatacggttttaaatccgtggccagaatctgccccagtaacctttcactagagccaaatcccggttcacgatcaccattaccataatgattagcgacatcaaaatgaaaaacgccacgatcaaacgcatccaaaatcaccgaacgtcgcgggccaaatggatccaagttgccataatgctgccacaatcccaacgaaataaccggcaacatcaaccctgtcttaccagcatggcgaaccggcattttctcataacgatcagctgctgcatgatacatcattaacgccctcctcaaacgaccgcaaaataaaaacgtttaccatctctatggtggcaaacgtttcgctaacaatcaaccagaaaccccactttttacggaaaaagctcacttctcaaaaaaatccgttaaaaagttcgccacgccgtcatccacattagtatcggtgacataccgagcaacacgtttcacttcaggcacagcattacccattgcgacactgatcccggcagcttgcaacatacccaagtcgttcaagccatcgccaaaagcaatggtgtgcgcagcgtcaatgccggttttcgcctgcaattcacgcacggcattggctttgtcgacatgctgaggaatcaattccagattcgtgtgttcagacgcagagacatgcaaaacgttgcgtgcctctaatgcggtcttaccggctgccaatgcctgtgagtcactcggtccgaaaataatgccattcgtgattgttgcagcatgggttaataatgccgctgctgacggtaaggcaaccacctcgatcgcgactgaactcggtgcaaaccgccgcgctgctgcttcaatcgctggcggcaaggttccggtgaaataaaccgtgtcatcgctgaaatacaacgcattgagtccaagatcggttgccacttcttcaaccgcagtcaacgccgccgcccccaatgtgtgatggacccgctcaccggaaaagtcataaaccgcaccatttgacgcaataatgttggcataaggttgaaattgatgggcaaccacttctgccagtgcatgcatgcgccccgtcgcaacgtaaaacgctgctccggctgttactgcattggcgattgcctgcgttgtcttttcggtcacgtcatgatgattggcagtcaatgtcccgtcaatatcgctgacgattaaatattgcgtcataatgttcctttcttgtctgtaaaccatgctgcttaccgtttagccgttgtagatcaaagtgctgatgataccaaatcagccatagaaactggattcgtctctatggctgatttaagcctgatctgcctgccatctaaaaatcgtccgaaaacaatgcgctacttaatggcacccagcttcatgcgcttgattaaagtccttgcggcaagccttcaatttgatcggcataccatttagcccatggtgtttccggcgccccttgagcattgaatgtgacattgacctgtttcaaaagatccaacaagttgccagaacgatgtgtcagtaacccactcgttaactcctcacgcgtcaacgtgcgattatcaagaagatagtggttaatatccgccaaatctccttgctcatctagttgagaaaaaacatcgagcccgtcaccaaagaaccgactcaggtaaaacttagcaaaagtctcaagcgctgtcttttgtgctgcttcatttaattgatcaatcgttgtgttgctagttgccatgactaatttcgtcctttctattttattccattataaccacttttcccctgcttttggaaagcaaactggtggaagagcgcgagccggcgcgttatggtgtgccttactcatcgaagtcaagcgcctaagttcaaaaaacatataaatatttttaactttttgaaactttccaccttttgtaccttgatattgagcaacagttgttatagtatgccacttatgttgggaattcaggaaaggttggaggcattatggaaaaagaaaaattacatcttggtgacgcggtggtctgtcaggttaaagaagacatggaagccccttttaccggtaaaatcgaaaaagtctacgaaaattcggcactcttgacgatcactgactacgctgatcaagaccgtcagaacgcgtcagaacttaattttaaaattgttgcaaacttccacgctatgaccaaaaaccttggcggcggaactgtcttggcctttccaccagaaacagaagaagaccgaaaaaaataatggcttagatcacattcagccagtttcaggccgcatgacccgtgcctaaactggttgttattatttacttagtcatcaactcataaaacaaacaaagctttcctggcgagtagattctatgctcgccgggattttttgtttaaggtcaaaccgttttcagcttagaacaaacttaatttcaaacatcaacttcaaaacggtttaagcttaaaagtcactttcattgtcagctggccaaacttgcgtagaataaaatcaaatagtaagcaaacgaggcgaccataaacatgcaaaccaccacttaccccattcacgaacgcctgctcatcggcaccttgctcaccgctgctgccggcagttttgatgcgtatacctacttgttgcacggtgaagtctttgcgggcttacaaaccggtaacgttattttgcttggcgtccatcttggccaaggacagtggtacacggcaatccgctatctggtacccattctcgcctttatgtttggcaccatggctgcacgcgccttgcagctacatgccagtcatcgctcccaaccgcttgccgaacaacggtggatcatccgttatgaaattgcatggctgttggtggtaagtctcttgggaaaatggctgccagatttagtggccagcgccagcgtctcagtgatcgcggctgcccagctacaagagttccgtcgtttaaaaggtggcccatttacgtcactgatgatgaccggcaatctacgcaccgccgcgcagagcctgtatgacggctttattcgcggacaacaaaaaggccgcgcatccgcagccactgtcggtacgatcatcttgagttttgcccttggtgccggggtcacgggtatcctgacccacgctatcggcacctacgccttggctggggctacgctggtgttgctcctgattgatctgttgctttggcgcgaccagaaaacattgccgcaacgcacggcttaaccaagcgcttcttgcccatgatgcagaaaacttagatcgttgaagtccgtcacccgaaagcggtcattaagccacattagcttagtgacactcgcattatccagcatttcgcggccatcaatgttgtagtggatatagttcaaccacattaacgctgccgttccgtgtgacaccaccaaaacgcgttcccatcccttggcctcggcttccacggcaatggctcgcagcgttcggtccaaccgctcctgcaccattcgattggtttctgccgggtttggatgctgatccatattagccgcaaatgccgcatcggctgtttgcgctaacgtaatttcgcgattggctaaggcatcatggaagttggcaatgcccatggtcgccagcgaaaagtcatttgccagttgcccttcgaacttgccataattttcttcacgcaagcccatgagtcgcgttaccggcagcggttcacccaaaccacttaaaataaaatgagcagtatcgacagcccgcgtcaagtcactcgcaaacgccgcatcaaaatgcacccctgccagttgaaagccgcgtcccagcgccttagcatccgcgattccttttggtgttaaggccgagtcagccattccttgaacccgtttttgcacattgaattctgtttgcccatgacggacaagatatagcgttgtcatgatcgcaatcccctaattttcatttatttccaagtcatcgtcattaagccagttttaaataatccgctaagtaatctgccatcccatcgtgatcgttatcgcttggtgtctgcgcgtctgccgcttcaagaatggctggacgcgcatttttcattgccacgccatgtccggcaaattgcagcatgtccaagtcattcatatcatcgccaaacgcaatgatatgtgcctgatcaatgccataccgctgagcgacatacgccaacgcccgcgacttgctcgtatttcggctagtcacttctaacgccgtatagtcgccactccaagcgccccaggttttggctgccaaatgcggatacaaagccgccacttgttgcgaaaccggctcaaacgtcttagcttccataaacatggtgaccgaaatcggtgcctgacgcaacccatgctcatccaataaagcatcagggtgtaagcgatccggcaagaacggaatattggcataaggccgatcagccaccaatagccgcttaccttctgccaccatcactttaaaggtaaagcgttggctgagctggcgtaacgataacgcaaccgaaatcggaatcgtgacttctttttcatattgccaatgctgatgcggcacatgaatcaaggcgccgttgaaattaatcatcggcccctgcaggtgtaacgtatcataaaactgttcggaaatcgcatccggccggccagtcgtaatcacgaccaaatgtcccgctgcctgtgccgcccgcaaaaccgcgatcgtgccagcactcagctgaccttcagtgttgagtgtcgtaccatccaaatccaatgcgataagataacgttccatgcagcagcctcttttcaatctttttttaaataaacaaacatagccattaccaccgcattcccctacaatagatagttagaaagcgagggtatcatggctgaatcaatcgtactatatactgacggcggtaatcgcaacaccggcaatcacgcaggcggctcagttcggcccaccgacaaaagcgcgtgggccgcattactgatctacggcgagcatgaaaaaatgctctctgaaggcgattacggtcggaccaataattatatggaaattatggcggtgattcaagggctaaaggcgatcaaacgaaccgatattccgattgacgtttactccgattctgcctatgtgatcaacaccatgcaacaacgctggtgggtcaagtggcaacaaaacggttggcgcaaccacggcaaacctgttaaaaatgctgaattatggcaagcactgctccaccaaatgaaccgtttcgatcaagtaacctttcataaagtcaaaggccacgcaaccaaccgcaataacaatcgcgttgacgaggcactgaaccaaacgatggatcgcctggacgatcgcacctgatcattttacccttgattgccaagaaaagcttccccataagtttccgccaaaaatgtgtgaatcacctgctgcatccgctggacagaaggtgattttttgatggtcggattaatcaccaaacacaaggttcgtgcgaatggttcggaaaatggatagacgttcacatcccccaccagcttctgcaaggcgagcttcggcaaaatccccaagcccagccctgattccaccatggatagaatgctttggtcatcaatcgaatagttgatcgtgttggtcgacacatgataacgatccaacgcattcttggtatcacgatcatagtcgatttgttgcaaaataaaatttcgcttctcaacatcggcttgcgtcacggttttgccgtttttaggcttgaagcgttttggtgtgatgcagtagatcggatcttttaacaacggctcaaccaccaccccgggtccaaccggcagcgatgaaaagcccatgtcaaccgtacctagtcgaaccgcctccacaatgcggttgaaggtcccttgaatgacactgatttcaatgtgtggatagcgcttcttaaaccgttgaataatcgtcggcagccagttagtcgaaaccgatgaaaacgcaccgatccgaattctgccggtattgacgccattgatgttatcggcgacttgcgacagttgctcttcaaggttctgaatactttggataatcggcagcacctgggccccatcttccgtcagtgtcactccggtacgattacggattagaagtggaaaccccagctcagtctccagctgactgatactatggctgaccgcactcggcgtcacatttaattccgctgcggcttgggctaacgtgccacgttccaccactttactaaagacttcataagaaaaattacccatgttatcacttttccccttttttctacttgatccaagtgacacgcgttgtcacttgagccgcacaatgcctgtcaaatggacgctgaggcctgtttgttgattttaacatgaacaaaattcaacttaagctgaaatagttgagctttactcaatcatacgagccgttttacactagtgtcaataagaaaacgttggttgaacttttaccaacgcgacaacggtatcgcaattaacgtgtggatcggcatcaggttcggttacacgcccgatatcaaagggggattcatcatgaaattcgcaaaacgtacccaaaaaaccggcaattccggattagaagatctgttcgccgcatctggcccgaatgtcatctcgtttgcaggcggctacccggatcggagtttgtttccgacccaacaactgaatcaggcatttaagcacagctttaacagtggcgatactgaactgttgcaatacgctagcactcaaggctacttgcctttacgcgaaaagattgcggctcggctgcgcgcaactggcattccgactcgtgccgataacatcatgatgacccaaggcgctcagcaaggactcgatctagtggcgcgcctcatgcttgatcccggcgatggcctagttgttgaagcgccaacgtatctcggtgccttagccgcctttaatgcttatcagccaacttattatgaaatcccgatgcaagacgatgggatggacattaatgccttacagcgcgttttaatgagtcacaaagtcaagttcatctatacggtacctgattttcaaaatccaaccggcgtcgtaatgtctgtggctaagcgtcaggcgctgattcgactcgccaaccaatatgacgttatgatcctcgaagacaacccctaccgcgatcttcgctatgatggtaaaccgctgccaaccattaagtcatttgacacgcaaggccgcgtcgtttatctcggcagcttcagcaagatcctctcaccaagtctacggatgggctggctcgttgctgcaccggaccttttgcaggaattactagcgttaaaaggcggaagcgacttggaatccagcaacctgaccatgcacggcattgatgcctacatggcggaaaatgacttagacgcccacatcaccgaaatccagaattgttgccgcgaaaagaagaatgccatggtcgcagcgatgaatcgttaccttcctgatgaagcgcacttcaccaaccctgatggcggcttcttcctgtggctcaccatgccagccggcttcgacatgggtgccttcatgaagcaacatctgttaccggaaagcaacatttcctatgtgccttccgccaacctatatgcaacttcggctcaggtcaacggcgcacggctaaacttcaccggtccgacacttgaacagatcgacactggtatcaaagcattaggcgatgcgctcaaaaccgcgctgcagcatcacctagtagccgaacaagcttagttttcttcgtcttaatctactcaaacctttacaaaatggcaaagtaaccatcacactttcgtcacactttgtcagtagtataggaaacatagaaatgagccacccactcatctctacaccccaacctaattttcatttttctcctccaaagaaaaataagatgattggcccccatccaatcatcacaaaaacgcccgctgccaatacgcaacgggcgtttttgtatcatgagcgcgagccggcgcggttagggatcagagtgtaagcggccttgggcgtgatggcccggttttggccattgcgaccaagttccttacatgcagatccctgcgccgggaagcgcgttaacgtaagcaatggcatccaaatcaacattcacgcttaaaacgatggtattcccgaaatatacttattagcaatcgcctcagccatgccttccagatcaaacagtaccgtccgctgtgctaaagtgagctgatactgatggtcgcgcatctcgtctctgatgaaatacccaatcggtaagacttgtggagcaatattaactccttgtatccgtttatccgccaccttatcaatgacctgtttgatacttgcaacaatagcttgcgatgtcacgtcggattgttcctcgaaaagatgttgcagttctagcatctttgcaatgagttcttgtttcttttccattttggctcaccccttcatttgtgaacttatcgtgttcaataaaaaaatttgactcgtccgtgtttctttatgcggtgcaatgatagcggttgcatttatcttagaatcctctatttggtttggcaagcaataacatatgtgcgttttgaagattttttgacgaacatgacacttgaacagtcaccttgaaaattagaacaatccgaagacaaaatgctttacgagaccaatttcctaatatatgctatagccaatttcagacagctatgcacatggagattctatagtccatttttctatacctcgtttactgacttaaaaagactagtaaacggtcaatagcaaagagaggcgaatgatcatggaaacattgtataaaggccaacctgctgatgtttgggaaatcaccaaaacaggcgctcagccagactgggtaaaagatgcattttcacaaaactatctttattggttggataatcgggttcgtattctcatgtgggcgttaaccccacctaacaagaagaatttaaagttcgttgctagcggttcacttggaggtggcgttgatgcactgggtgtttacgcatacggagattcaggtgacttcttggatgcaaccaatcaacgcgtggtatctcgagaaagattcttcaagcaatatcaaattctaaaatccaacgaagcataaccaattaaaggcgcgtgtattaacgtttgttgacatgactgtattattgttctgttggttcacccgaattcaagatccatgataggtgcaaccgtgatgaaagtttttgtgaacaatcgcttggctcttttcctatcaagcaaaagccgcaaccagactcacatcatgtgtaagtctggttgcggctagtacgtttacgcatattttaaactaaacggtcaaccccgaagctggatggatcatctttcttatcatccggctttttgtcggttgttggtttctcttcaggcttcttgtcagccgttgttttctcgtctttagcagtatccttcttttcgtcctcttcttttggcttcggtgcggactgctcacggatcttggcttcgatttccttggatacttcaggatgctcatccagataatgagacgcattgaccagaccttggccgaggcgttccttaccatagttgtaccatgagccggacttggtgataacgtccagatcgttgtctttatcagtcgctaagttgatcatgtcagtattgtgctcgatcccatgaccaaacgacatggtggtttcaacggtcttaaacggcggtgccaccttattcttggtcactttgagcttgctggcaaacccaacaacattcttaccatctttaacctgctggcctttgcgtacttcaatgcgcacagaagcataaaacttcagcgcccggccgcctggggtgacttccggattaccgaaaacaatgccgactttttcacgtaactggttaataaagatgaccaacgtattcgtattgttaatcgtgccggccatctttcgcagtgcctgcgacatcagccgtgcttgcaagccaacgtgactatcaccaattgcaccctcgatttcagccttaggcaccagtgcggctacggagtcgatcacgacaacatcaaccgcggccgattcaatcagcatctcggcgatttccaatccttgttcacccgagtttggttgggaaagcaaaagatcgtcaatgttcacgcctaactcagcagcgtactttggatccatcgcattttccgcgtcaatataagctgccttgccaccggttttttgtaattcggcaatcgtctgcagcgcaatcgtggttttcccactactttcaggtccataaatttcaacgatccggccccgcggtaagccaccgacaccaagggcgagatccaatgacagaatcccggttgagaccacatcgatcttcaactccggtcgatcacccatcttcatgaccgcgccttcaccgaacgccttggtaatcttttgcagcgccttttctaattcggtctcacgatctgtggcatcagacttcttattatcagcttttgtggtcgtttttttcgccatacttgtctccttaatgtcgtacatacttcgctcaaaatacactagttacattatcgaacacgcgtttgttttttgcaagtcttttccgtgattgaaacgccttttctgcactttaaaacggttatagttctattttacctgaaccagtcaaccaattggtaaaaacctgctgttattgatcgccgtaaaacatgctatgatagttcggttaagagcaaccagcatattgaaaaggtgagggaaaatacatgatgttcatggggtcaatcgttaacggcttaacgattatcggcggcagtttactagggctgatcctgcacaatatcagcgccaatgcaaaggacacgattacgaaaagtttgggtctgggtacctttgcgcttggcattcaaatggcgttgcagaccaaaagctttattgtgatcatcatcagtctgtgtctcggtggcttgctgggcgaatggttgcatattgaagacggcatgaatcacctcggcctcaagttacaggaacgctttgcccgcaacaacagccattttgcggaagggttcgtcaccgcgactttaattgccgtcatcggtgccatgagcatcttgggggccattcaagccggcgtgtccggtgataatgcgaccttgtataccaaggcggttatggatggtttcatggccattatgatgaccgcctcgctaggcatcggcgttttattttcggccatcccggtgattttatatcaaggaaccatcaccctgttagccagctttcttgtccagttcatccccaaaacgttgatggcaacctcacttcgagaaattggtgccattggtgggttgatgatccttggtatcggcctgaatctcatgagcatcaccaaaatccgcatttccaaccttttgcctggtctggttgtcttaattagcatactaaccggccaatattttctatcatagtcagtcgcaacaaaaagcaggtcaccatggcctgctttttgtctgaactttttgttgccatcttagaagttcggcagcagtcgttgttttcgactctgaaagcgatgatacaccaacttgcagtgccaatcgcgaacatttgccaaaaaatgcgagttggcatcgtgataccaataacgcaaatcgtctttgatatacaagcgattcaaccacgcgtgatcgtgccgcaaaaacgtaaaactttctaacaaatcctgttcgcgccaaacatcaggcaacaaaaactgactgcgcgtaaagcgttttaactgacggcttgaataatagacgcgctcaatgcgaccaataaagaaagccgtcttccccttgcccacgtacggtgccataggtgcaacaatcaatcccccgcgtaaccgctcaaaccaatctgtttgcggacttactttgattgcatgcgtaatatctttgggtagccggaagtccaaaaccaaaccatccgggcgccgtacccgagccacaatatgctgtttcttcacattaacaccccatcatcttggccaatttaggcgacttgagctgttgggaagagtttaccacgaaatgttcggatttgcatgaagaacgtttgtttcgttaagtaacgttcagccaaactaacttcttaagcaattccaagccgatttggaaaatgtgaacataatcgccataaagacataataaaatgttggatttgccttcacaattcattcacaccctgtctgtagtataagaaacatagaaatgagccacccactcattcctaaaccccaacccaactttttcatttttactcctccaaagtagaaatcgtcgatcgtcccccaaacgatcagacaacaagcagaccgcccacccagcggtctgtttttgtgtgagcgcgagcaggagcgcttagcaatcggagtgtaagtggcctcaagcctaaatggctgggctttggccatttaggcttgaggtccttacacgtagattgctgcgactgcgagcgcgttatagaaagcagaataagactactgaattgcccaaaaaaaaatacttctgtccctgctgcaattttccatccatcaacaccgactttggccatttaggctcaaggtccttatgtgcagattgctgcgactgcgagcgcgttatagaaagcagaataaaaccaccgaattgcccaaaaaagaatacctcttccccgttgcagttttccatccaaaaactccaacgttgaccattgcgactaaagcccttatatacaaattacgttttaaaccaccaaccctccccaaaaagaaaagcctcctgacaccatcgtcaggaagcctttcttttttaccacaaactcacaccttaccgcttaaacaattcatacaatgcatccggcgtcttcgcgtcctgaaacgccttcacaaaatcctcatgcgtcagtaacttcgccgtactcgacagatatttcaagtgactgccactatcatgttccggaatcaggaacgaaatcaccgcattaaccggcttcccgtcaaatgtttgccattcgactggttgcgccagatgtaacacgagcatcgctgaacgtttaatcgttgcatcttgtgcgtgcgggatggcgatgcctttttccatccccgttgagccttctttttcacgtgccacatacttgttgaacacagcatcggcatcagttgccaagtcgttttttactgccatattagccaaataatgcagcacatcatcccgcgttttggcaggaacattgacttcaatgtattctttgttcaaaatctcgctagggtcaaaagtttgctgggattgatccgcagccggagccggttgattgcgagctgatgaaacggccacgtgcgcaaccggttcgtcagcggctgccccttctgttgccaaggcagtttcaaccacaccggcgttgacaccacgttttttggcagagtggccggcaatcatggccaaaagcacaccggatgctgctgcaccgactaaaatccaggcaacccatagaaccggcttattcaccagtagcaaaacaatgaatccaccatgaggcgccggcacctgaatccgggacatatatgtcaaaacggcagcaatcgcggagccaaccatgaacgccggaatattcattaacggatttttcgcggcgaatggaattgccccttctgtaatatgggttgaaccaagcaacgcattgacataaccggcgctgcgttcatcacgattgtaggctttgggattgagtaataccgagattgtggtagccagtggcggcgcaatgcaggctgctgaaacgccggccatgaagaaataattgccttgtgccaacaatgccgtcccagtgagatacgccgccttattgattggtccaccaaagtcagccgcacacatgaccccgacaacaatgcctaaaataattggactggaactttcaagcccttttaaccacgccattaaaccgagattcaaggctttcatcggggtattgatgagatacataatcgatccggaaatgaagacaccgagtaccggatatagaaaaatggcttttaatccccgaaattccttgtcgggcatgaaggcgaacactttttgcaacattaaaatgaccagtccggccatgtaaccaccgacaatcgcgccaagaaagccggatccttgaccgccattgtaagcaatcatcccaaccgccatgccgacgattaagccagaacgtttggccacggcttcaccgatataggccgccagcactggcaccatgagtcccatggctgcactaccaaccgaattcaacatggctgcgaactgattgtattcagcattcttaggatccgccgaataaatgccccagaaaaatgaaattgcgatcaacacaccaccggcaaccaccagcggcagcatgtgcgaaaccccgttcattaaactggtgtaaatcttgttaccaattccggctgtactggtttcaacgttttcatccgcgctagccttggccgcaccgcctttaggcatataaaccggcgcgctgctcaacgcctctttaatcagtttatccggttcgcgaataccggctgcaaccggcacattaaccagcggcttgccggcaaaacgatccgcgtcaacgtcaatatcagaagcaatgacaacgccttttgccccatcaatttctccttgcgtcagtggatcatcgacaccggtttgaccgtgtgtttcgactttaatggtcaaacccattttcttagccgcttgctctaacgcctcttgtgccatataagtatgggcaatccccgtcgcacaaccggtcgcagcaattaaatcatactttgccatcagctaaccctccagtttcttaatcttaatttgcgtcaacaattcatccgtctcagtaaaatccgtaatccatgcgcgccgggccgtatcactgcccgccgcaatcgccaatttcagcgtgtccgctagatcctgcttttgataaagacccgctaaaaaggttcccagcatcgtgtcaccggcaccggccgtatttaacacgtcaatctttggcgcgtttccgaccagcgtcacatcctgattcataaacaaggctcccgccgcaccgagtgaaaccaacacattttgagccccagccgctaatgctttgtggcctaacttcaccatcgttgccaaatcggcttctccggattggttaaaccaactcatcaactccgcatcattcggcttcaccaataatggttgataggccaaggctttaacggcttccggatacgaactgtcgatgatcaacgcgaagccattttcctggctcagttttccaagttgcaacaaaaagctcggctcaatgccgcgtgcaaaactcccggaaacacaaagccaatcgtcagcacccagagtggtcagttgttggtataattgttttaatgtttcggcgctaatctccggcccgggattcactaatttatactcggcattgtcactgacaacgcgggtgaacacattaatccgcgtgaaaccggcatccttataaaaataattgcgaatgccttgctcagtcagaaaatccgcaatgtaatcaagggtaaagccgccgccaaccccaagcgcaacgttatcaaccccgcgccgcttcaagatgcagctcacattcacgcctttaccatttgcctgaatgtcataactatccgttcgattcaccgtattcggcgccatggtctgagttttaataaaaagatcaattgctggatttaacgtcaaggtataaatcacattaagcgctccttcatgtcgtttcttttacttatcaccatgttaaccgctttcaaccgaaaagagttttctgttttcagtcgttttccggattaagcgaaaatgcttttcatctgcatcaaccccactaaacaaggaggccaacctcatggctacactcagtcccacagaggcttatctttgggattacatcgagaatcaccaacaaaccgtcgtcaacttgtccatcacccagctaagcgtcgccgccaacgtctcaccggcaaccattgtgcgcacgatgaagaaaaaaggcttcaacggctacaccgaatttcggcatgatttgctaaaacgcattggcgacactgaaccattcggcatcctcgatcaggtggatgatcaaattaaaaaagtgattatgcaaaatcaaattgaggtttataacacccttgataatctgaaagtttctgtcatcgaggactcggttcaactgctcgccaaggccgagatcgtcctcatttttgcgcgcggcttatccgaatcaatcgcctcggaagtcactttgaagctccagttgctgggcaagtatgctgaattcttcagcgatcccaacatcatccaaaccatcgccggtcagatcagtccgcatgcagtggccatcacgatcaccttaaacggcgaaaccccggaactcgtcgccgctgccaaaacccttgccgcccgcgacattccgcaaatcatcctgacgaccaacgcccaagcttcaatcgtcaagtacgcggatgaactttttgtcggctataaatcaaaagccgcctattttgacaaatacgaggtggcctcacgtttgccgttgcaagttatgagccgcattttgctggatagttatgtggtgcgaaaacggggacagaaaaattaaatcttcggtatgtaaaaagcaatccctttggcctatatgacgagggattgcttttttctgcttattcgttattggcagtggatgttcgtggtaacggccggtgcttgaacatctgcgtggccgcaacagcctgttgccaaccggcgtataaattctcccgccgcgccggtgtcatacgaggttcaaaccgcttgccaatttggaaaatctgtttaagttcatccgtatcctgccaaaagccgactgccaatcctgctaaaaaggcagcacccatagcggtcgtctctaaattggcggctcgttccaacggcttattcaggatatccgcctgaaactgcatcaggtaatcattgcgggctgccccaccgtcaacgcgtaaggctggaacagcaatttgtgtgtccttgtacatggtatcaaccacatcacgcgtttgataagccaaagcctgcaacgtcgctttaataaagtcgtctttagtggttccgcgggtcaagccaaaaactgccccgcgtgcttcggcatcccaatacggtgcccctaagcctgtaaacgcaggcaccacataaacctcatcatcactagtggctgcctcggctgcttgctgggtgtcaggcgattgcgccaccaaccccatttgatcgcgcagccactgaatcgccgaacctgcgacaaacactgagccttccaaagcataattaatctgcccgttcacgccatatgcaatcgtcgtcaacaagttattagcagacattttcggcttatcgcctgtattcatcacaataaacgagccagtaccatatgtattcttcaccatccccggcgccaacgctaactggccaaacaaggcgctttgctggtcaccggccatccctgcaattggaaccgtgctgccgaagaaatgataagccgcgccggtaccgtaaatttccgaattactgcgcacctcaggcaacatggcccgcggaatatgcagcaactgcaaaatctcgtcatcccaatccaacgtatgaatgttgaacaacatcgttcgactggcattcgtgtagtccgtcacatgaatcgcgccgcctgataacttccagctcagccacgtatcaatcgtaccaaacagcagctcaccattttccgcgcgctcttgggctcccggaacatgatccaaaatccagcgaatcttcgtagcggaaaaataggcgtcaatcagcaagccggtcttctcatggatcattttgccatgaccagcctgccgcaacgcttccgccaacgcattggtctgccgtgactgccacacaatcgcatgataaatcggcagccccgtcgtcttatcccaaatcacggtcgtttcacgctgattcgtaatcccaagtcctgcaatttgccgcggctgcaccccagacgaaataaaggtgtccgcaatcgtcgacaacaccgcttcccaaatctcattcgcgtcgtgctccacccagcctggtttaggaaaatactgggtaaactccttttgcgcctcgcccaccatcttgccagcatgatccaaaataaccgcgcgcgtactggtcgtgccttcatcaatggccatgatgtaactatctgccatatgtacctcctgctttgtgtccgctttcacttcagtatacaggaattggtgaatgaggttaaggttcgtacagtttgaaaatcaaccgcttaagttcaatattaaaatcccgtccttttagcacttaccgtttgattgcttaatattaccgtcttcattggcaccatgctataataaaacacgaaagggagcatcggtggtgaccgatactcccctgacaagaccgttcaagacggttggcattaaatttgactaatcaaaaagaccgtcatcttagccaaaagattagcgacggtctttttgattgtcttgtattatcagcataatggtgatgatcagcgcaatcaacgataatacgaaatcaccgaagaccggcatcagcatcaacgcatcagcaacagacaactaggcacctccttccgtatagattttgatcatcgcgcataggcgaccacctcacaatacgttggatttgccaaccgtcattcactttcttgtcttgttcatgatgccatacaaaacggcaaaacgcctgctatctcaatgatttcaggcgttttttaattgtacatattttcttttaaccaccgtttttttaatgctaccttgccttccttgatgaacgctatccttctggttcagtgaagccataagtcgagtccgtctgcagaccccagaattcaggcagcttgtaactaatcgcatactctaacagcgcagggtcatcaaaaggtaaataagtcacccgatactgttgaataaaagtttgcgctttttgacgctggggaaaatactttttcacgatttccgcgtcaattgggccagcgagattacgttgtgtgtatggcaacttatatgggtcaatcccactgtcatcacgaattcgctgataaactgacacaaagtcatcgagatgatgcaaccgttctcggtttaaataagcgacattaatgttgttaatcgtgtattgcactggctgatcgccaatcattcgcaagcgtttgatgacgatgtacgcatcattggcaccaagtttcattctttggcgtactgtagcatcattaccagacgcaacgctcaaaaccttagtccactccggctgagtcttggccatattaagatccgtcaagtaaaccacgcggcgatgattttctttggccacaaaggtaccgcgcccttttatacgcgtcacccagtttttttcttggagcaaattaagcaccttaacagcagtggttgagctcacggcaaaacgatcctttatttctgcttcactgtaaaagcgatcgccttgattcaagcgcccttcactaagttctttgatcagttcatcgacaatctcctgatactttggcttggccatgccttgtctccttttcaaccaatcagatttgggtagtcgttacaggtccggcattttaaaaagtttgcgaacagatttggcaagcatccgtttgcttgcttattagtcagacttaactgtcctgttttcagacttgtaatcaatctgtgcaattctaacgacccagtcactgccataaggataccccgttgcgtcaactgtgagaactcttttatgcaaatcctgcgtaaaggatagatattcttcattatccagccaataaacagattcgattggacgatcaataccaacgaatgaacgcggattaaccccttcaccaccaagtacgacattatcattacctacgacttttagatcaaacacgcataagtaatcatgtgcgtctgcatgcaagacaaagtcacgcgcaccttgtccggagacgatcgcagttggtcgtccgcgatataaggcaggcgcggccatagtcgtccaccgtcctaataatgccatatacgtttttgccgaagccgggatcgcgccttgaccggtcaaaccaatattaaccaaaatattagcccctatatgccgggcatgagcaaccgtttcgataacctctgctggtgatttgtagttcaagtcgttggtcgcaatcccccagtgctgattcaacgtcattgagatctcgcctgcaacatacttcgcgttaggtgcaccgtggtaaatttcgtccggcgttcttcgttcataggtaacgacatcaatctcaggatcacttactttccctcgattcttcaatcccgtgttattgacgatgattgcatccggctggtatttgcgaatcatgccataaagcgcgggcagctgccaatctgcctcttttttattccaattaccgtcaaaccaaaaaccgccgactgggccataatgacggcaaagtacttcaaccgaagcttttaaataatccagataggcagggaaattttcctcatacaggggtgagtgccaatcgtatgttgcgacgtaaaaaaacggtaacagtccttctttgcggcaagctgcaacaaattctgctataagatcgcggttggcaggcgaatgcatgacatcaaaactgctcaaacctttagtgtcgtataagaaaaagccttcatggtgttttgttgttagcacgatatactttgcgcccatcatctttgcggcatgggcaatcgcttctgcatcaaattgatttgctgtaaaagttgctattagtttttcgtattcactgcgcgatcgatggtgaataaattccgtccattcaccaactgctagctgggaatatagtccccaatgaatgaacaagcctaatccaagatcctcataacgcttaattctcggtagtggttctgacattttttcacctcatttattttttgtgacataccctaacacgttaggttgatttttttggtgatttctgcttactatacctatgtcaatgtaaatcggttactttcccactaaatcaggcagtaatcaagtaagcccaaaatattgaagtcgtcattataatatgctaggctttgcgtgtaaagccatcttaacacattaagtatagacgaggtgatcaatatgtatgttctcgcaagtcatggtacttatgctgaagcgactttggcaagctgcgagcttattgctggtaaattagcaaactttacatcagtctcgttccacgatccgatgagtatagacgatcttttatctgcttacgaagccgcctatgcaaaagaatcaagcccggccaacttcaccattattactgatattccaaacggttcgccagccaatgccgctttagcatttaaacatcagcatcccgatattcaagttttttcgggactgtcactcgggctcgtcctagcactagcaactggaacgcctatctctgaagcggtaacgcaatcgaaagccattatcaaagaactttcgctcaaatccgagcgagaagatatttcgactgatacaactgccccctcaacaaataactcgcttcacactggtaacccgctaatcaatgttcgtgtcgatgcgcgccttattcacggacaagtcgcaaccatgtggaccagaacgcttaacgctacccgcatcatggttgtggatgagcagatcgttcaaagcgaagttcaaaagatgacacttaagactgctgttcctggtggcgttcatttgagcatcttaacgccatccggagctgctgagcggatactagcggaccagtatcaaggccagcgtgtcttcttaatcgtgcgtaatcccaaagcgctgcaagtgttggtaaaagctggcgttaaactcaaaagtgtcaacgttggcaacttatcaatggctgtcggtgccaaacaagttgctaagagtgttgcggtgacaccagaagatgtcgcagtatttgatgatttagccgcgcatggcgtgaagttgtatcaccaaatggttccaaatgatcaaaaagtcgattttatggcgttacttaaaaaaggagtgtgaaccttatggcaattgcatggtggcaaattctgttgctaacgttgcttgctttttggatgatcattgaccaaataacagtcgggatcctaactaattatccgctgctctatggtttcgttgccggcatcatcatgggagatgtgaaaactgggctggttgtgggggcaaccttgcaattaatggttcttggcgttggtacatatggtggtgccagtatgccagactttatgactggtgctattatcggtaccgcttatgccgtcatttctggaaaaggtattaactttgcaatcgggctggctgttccagtgggtttactcatggtgcagctagacgttcttgcccgttttaccaatacgttcttcttacaccgcgttgaccgttacatcgaaaaaggcgataccaaacacgttgcacgaaatattgtttatggagtcttcccttgggggctatctcgtgccatccccgttttcatcatgctacttgtcggcaatagtgtcgttcaaaaggtcgtcaatgcgatgccagcatggctttctaaaggactaactgctgcgggcggcattctcccggttgtcggcattgcgattctcttacgattcttaccaaccaaacgcttcctctcatatctcatcatcggatttcttgcagcggcctatcttaagattccgatgcttggagtcgccctgttaggactagcactggcaatcatttactacaaacaaagcaaccattcttccaacaatgaccacgatcattcagaagcacacaaaggaggttttgaaaatgccatcggcgaatacgaagactgaacttcccgaaaaacttaccaagcacgacctctttcgggcaaactggcgctggctatggagcagccagatttgttggaattatgaacgcatgatgtcaactggttatctctacaccatgttgccaaccctgaaaaagttatacaaaaatgatcaagacctcatcgaaatgatgaagatgcataatcaatttttcaatactaacgcctacgttggcggcttcattgtcgggatggatatggcaattgaggaaaaaaaggggcgcaaagccgaagacactgtagccggcctcaaaacaggacttatgggcccatttgcaggcgtcggcgatacgattgtcggtgtcattttgccaacaatctttggatccattggtgcttacatgggcctcaaaggcaatccaaccggtgcaattttatggctgttagtcaactttgcaattttgatattgcgattctttttactgccgctcggctactcacaaggcgaaaagctcatttatgctgcaggagacaagcttaatcgtatcaccgacgctgcaattttactcggcgtaaccgttgtaggtgctctaatccctacagttgtatccgcaaacgtccccctcgttttcaaaaccggaaaagtcgttttaaaagcccaaacagttttaaatcaaatcatgccttccctagttccggtcgctttagttgctttatgttattggttacttggaaagaaaaaaatgaactcaacacgactcatcgttttagtcttgatcctcggtatcgttcttggtgcattcggtatcatcggtaagtagtcacatattttaactattgtttggaaacccgcatggctagccatgcgggttttactgttccttggagagagaaagccgaaaaacagtattctcgtttttaacttcttccatacatcaactcattcatttcgaccagcctcaagttacatatattgactatttacaagtcagcagtcattaacgaccacagctattaaaaatatgtcattgccttcttcttattccattcaggcataacagcattcaaaactcgaattgaaaaggtttccaagccagactagcctatattttgaaatcaattcggctggttcgctgttccggcctttaggagtgattaatatgacagcatcaccttgggacttaagaaaagtattggatgaactaaaacaggatccgcagcaatatcatgaaacagatgtgcaagtcgatcccgatgcagagcttgctggcgtttatcgttacatcggtgccggtgggacggtcgaacgtccgacacaggaaggtccggcaatgatgtttaacaacgttgtcggcttcccaacgacaagggttttgatcggtttaatggctagtcgcaagcgggttggcaagatgtttcaccaagactatcacacgcttggtcgattcttgaacaaagcggttttaaatcctgttcaacccgttacagtcgaagaatcggcagcgcctgcgcatgaagtcgttgccaaggcgagtgacccggactttgatattagaaaactcgttgcagcaccaaccaatacgccacaagatgccggcccatacatcacttgcggcgtagttttgggttccaatatggccaaaacaatgactgatgtgacgattcatcgcatggttttggaagataaggatacgcttggtatttatatcatgcccggtggtcgccacattggtcattttgctgaagaatatgaaaaagccaataagccgatgccggtgaccatcaacatcggcttggatccggccattaccattggtgccacttttgaaccgcctaccacgccgcttggctacgatgaactaggggttgccggagccattcgccaagaacccgtgcaactggttcaggctgtgaccgtcgatgaaaaggccattgcgcgttcagaatttacactggaaggctatatcatgcctaacacgcgtatccaagaagatatcaatacccataccggcaaagccatgccagagtttcccggctatgacggtgatgccaatccggctttgcaggtaattaaagtcacggctgtaacccatcggcgcgaccatcccattatgcaaagtgtcatcgggcctagtgaagaacatgtctccatggccggtattccaaccgaagccagcattttgcaacttgttgatcgtgccatccccggcaaggtcaaaaatgtgtacaatcccccagctggtggcggcaaactcatgaccatcatgcaaattcacaaagataatccagctgatgaagggattcaacgtcaagctgcattactcgccttttcggcattcaaagaattaaaaactgtttggctggtcgatgatgatgtcgatatttttgacatgaatgatgtcgtctggacaatgaacacgcgttttcaaggtgatcaggacatcatggtattacctggcatgcgcaaccatccgcttgatccgtcagaacgaccgcaatatgatcccaagtctattcgggtacgcggaatgagttcgaagacggtcattgatggtaccgtaccatttgatatgcgcgatcaattcaaacgagcagcctttaaaaaagtttccgactggcaaaaatatttgaaataggtgattgaattgaaacgtattatcgtagggattaccggggcatccggaactatttacgctgttaacctgctccagcatttacatcgcctgcctgatgtcgaagttcatttggtgatgagtgcttgggcaaagcaaaacctatcacttgagaccgacatgaaacaaagcgaactcgaagctttggcggattatgtttatcctgttcaaaaccaaggggcaaccattgcaagcggcagttttttaaccgatgcaatggtcattgtcccagcaagtatgaaaaccattgcgggcattgcgatgggctttgatgataatctcattggacgagcagccgatgtcacgattaaagaacagcggcaattgattattgtgccgcgggaaacaccgcttagtccaattcatctggataacctcgctaaactagcccacattggcgttcaaatcattccgcctattccggctttctatcagcatccccaaaccatccaggatttaattgagcatcacaccatgaaactattagacgccttgcatattaaaaccgaaaccgctagtcgctggaatggagcgtcgttaagatgaaaaaagttctcaataaacagagtatcggttttctcatcggcattgcggtgggcctcattgtttacctggccccactgagcggcatcaatgaaaaagcgcaaatggatcttgctttgagtttaatgaccgttgtttggtgggcattccagattgcacagccggcttatattggcggtatttatctgatgctgctgatcttgacgaatgttgcaaccccgacacaggtatttgcgggatcgtggaccaagtcaattatgtggttagtgatgggcgcttatttaattgccggtgctgtccgcgaatctggcctaggtgaacgtattgcctatgctttcattatcaaatttgttcgcagttggaccggtattatcgtctcaatctttgccttaaccttcatacttgctttactgattccgcatccctggccacgtgccttcttgatcatgtccgtgatggatgtggtcgcaaccagcgccaaaatgccacaacaggatcgggctaaacttggactagccgtttttgccgcttcctgtcctctttccggtgcttttctaaccggggatacatcgctcaaccccttagcaattgctgattctggcaaaagcgtcaactttgtccaatattttatttacatgggggttccgatgatcattgccgcgatcaacacgatgctgctctttcttttcctcttcaaaccaaccaaaaaagtcacgattgaccttaatgttctgaaagccaagcaggccgatcaaggggcaatgacgcataaagaaattcgagtgatcgtctggcttgtcattgccatcggtttatggttaaccagtggcatcactggcattgacgttggctggttaactttgattgtcgccttgctgatgagtctgccggttatcggtgaggtcttgacggcgaaatcatggtcaggtgttcccgtcaacgttttggtcttcctgacttcggcaattgcaattggccaagtgggtgattttacgggcatgaataaatggattgcccaaacgattctgccatcagccttaccacataatctctacttactggcactggtcattaccgtttttgcaatgatcattcacatgttcatgggttcggttattgccgtcatgggtattacaatccctgccattatcgcggcaacctcgtcacttggggttaatccgttggcaatttcattaatcgtcttttcagtggttaatttgcactacatcttatcgtttcataacctggctattcttgtcggttccgattcagaaactggcggtggttatacgcaaaaagatgtcatgaagttaggtattccgctaactgccgtcatgtttattgttgcgctggtagaagtcttttggttccagctgactggacttttataacagcgatacccttgttaaaagtcaatatcaatgcaaagtagctcctaaatgatttttctttaggggctactgctgtatcgttaaaatcctgacggctacacaacattcgaaatatcgtcttgggattttgcaatcgcggtaaccattaacctttttcggcgataacttgctggctcaagtagtcagcaaatttaagaattgccggattgctagtgcggcgataaaccagttgcaaatgactacaaatattcggcgtcaatgacttagcaacaaagttcgaattggcaaacggctggtaagattgacggaacaaaaaggtaacgtggcggctgccttcgaccatccccaaaagtgtctcgatatgcggactgctaaagatgattttgggtgcgatatgacgatccgcaaaaaacgcctgcattggctcaaagacaccagagccgcttagcaagctgacaatcgttatggcggctaaatcgtttgcagacaatgatggacgttttgctaatggattggtcttagcgagaataacttgcaactcatctttagccagatcaagtttgacatattcccgcgtcgataagacctctgcttgtgtatcacgtagcaatgccatatctaaatcaccggtcaaaagctgcttgaggatgctaatgccttcctgttcgaccacatgaagtgccagcttcggaaattgagcggcaaaatcgtttattaatcgactgatgccaaactgaccaagaattggaacggcaccgatcgttaaaacaccgttgctcaaggacttcaaactatttaaatccgtgttcatgagctcgacttggtgcaagatcttactggcgtgaaagaaaaaccgttcaccagcctccgtgacaagcatgcggcgatgattgctagtatccaccaacttacttcccagaatagcctcaatatgctgaatacgcttagacaaggctgattgactaagatgtaaaaccaccgctgctttggaaaaactcttaagctcatacagtgctacaaatatttttaaatcctcaaaattcaacttattcaccaccgaaaggaagctataaaatgtccgactaccctgtcccgacttatacgacaaccgtgacacaatctgacgtcactctcatcgccaccgttactgtgatcggacgtgacctactcattaccattactggcggcgaccacccgcatattggcgatgttctcacgttaaccaaagatcaacccattcaaacaatccgctaccccagtcatgataacagatttcataaagatgatttacttgcgcttccaagtgccaaagcgctgcaaccattactgcccggaagctgcaccattttagcaggattgcacatcgatcacatcagcaaagtacaaatccaggctgcattagatctcagccataaactagcgcctaagttaacaacttggctaaaacatcaaacatttgcaacgtcaagaccacactattacggtcccgatgaatcacctgcttaatcgctcaaccagatccgggaattcgttaatggacgctaattgttgacttcaaagatgttccctcaatgatctgctaatttagccgccatcgttgtttgcagtttctcaagcgcattgacgactacttccgcatcttctcccaaagcgttgcgcaaaaaagcatcattttggtcaaagaaatgccgaatatatgccgctactttttgagatttttccgttagctgaatcgctttataccgcccatcttgcttggagggcacacgaacaatcagttccttacgctccatcaattgcaaaagtgccgttgctgaagatttctggatgttgaattcatgttcaacatccgtctgatacaacggccgtttggttccttgccgtgccaaaaaatcgatgatgctcatttgcacctgtgttagacccaattgcttagcttcacgatcagcataacgttgcaggtcattgtttaattttttaaccaaaatacccagcgatactgtcacgatgtctatcccctttcagttccaatgagatctcaggtcagcgtttacattaaaattaagccttgatttcagaaaataagaccgctatagtagctatagttcgatatagaactatacacgatggaggtctttatgacaagaaaagtaacacctaaattatacctttcgattcttgccactggtctgatggcgttttgcggggtactcattgaaactgccatgaatgtcacttttccgaccttaatgcggcagtttaatgtcgatacgggaaccattcaatggctgacaaccggctatttgttgatcgttgcaatcatcgtcccgatttccgggttcttaaaacgacgcttcacgactaaacagctttttcttaccgccagtgccttcttcatccttggcttagcactgtgcagcgttgcaaacagttttgcaatcttgctcgtgggacggctaatccaaggctgcggaacagggattgcactccccttaatgtttaacattattttggaacaggcgccgttagaaaaaattggttttctcatgggcatcgggacgttggtaacagccattgcgccggctttaggcccgacttatggtggcgtgctggttgacattaactggcatttgatctttattttcctgctattcgttatgattgccgctttgattatgggactcttttccatccagcaagtctctgaaacggttcatcttcatctcgactttttggcttggttattcattgcgattttctttgcgaccgcgattcttggtcttaatagcatcgagcaccaacccggacgcgccttgatctttgccgtcattgcaattttaagcctcggcgcctacaccatgcgctcactgcatgttaaagaaccactaattaatttacggttatttaaaaatcttccgtttgatctgcacatgacgaccttcctcatcattcaaatcgtcaatgtcgggtttgcctttgtcttacccaactacttgcaactcgttaaccacacaagttccctaactgccggcctgctcctattacctggggcggcactgggcgcatgcatggcacccatgagtgggaaactgtacgataaatcaggtcctggacgccctatctttatcggactatgcttacagctcatcggaattgtctggctactccttgaagccttaaccgcagccccggtcatcgtcttgatcggctatgccttcatcatgctaggtaccggtttttcaatgggcaacattatgacaagcggacaagctcagttacaccaagaacaaaccactgacggcaatgccatcttcaacaccctacaacaattcgccggtgcacttggtactgcagtcgtctcactcatcatggcgctggcccaagccggttcaacctctgctcacaacactgccatcggttcgcaacatgcgtttggtttcttgctgctattaaccctcgttggtgatgtcgcgattttctttgggttgcggcgacgtcgtggtgaaaccgaaaatgcgtagaatcactattaaatactagaccgaatgtaaaaaggatcgcactaagcagcagtgcgatcctttttcaatacgttcaagtttaattttgatgatccgtacgtgtccctactgttctcttctgccatggcagccgattacgctggcgtcgattgcgaatggccgccagtagttgagcttgacgatcacgttcatttcgagcatcattttgctccagtttagcaaaagctgcgcctgtcaatagcatcacatttgtcggtaaccgccgcgtcaaaaaggcacggatatctgactcaggttgatcaaatatcaatgaatagcttccacctttttgagaccaaaatgtcaccatcgtaccttgtttaatcgtttcggtaatcactcgatcatagcgactataatcgctagcgtgcgcaaccgatccataggtaataaccttggttttgcctaagccttgacgataaaggccaacgcttgcaactaagagcgccaccatcaccagacgtagattgccaatggtgcttgtcgtccaaaacaaggtgacgatcaagctggccgcggcaagtgctacgccgatcttaatctttgatgacttggttttgatttggagttgccgctgctgcagaaattccaggtaaagtaagccaccaagcaacatcgcggtcgtcatcacatctaccatttcaaacgcctcctcagattggcgtcaaaccaagcacgactaccactctgcaatagtgccatcataattcttccaggatggattgctccaaaccaaaccttcttgggccacctctttaattttgtcttcatccatatcaatgccgagtcccggtccttttggtagttgaacataactatctttgtactggaagatttccttattcttcacaaagtccagtaagtcaaagcctcgattgtagtgaatacctaggctctgctcttgaataaagacgtttggcgtgcatgcatctacttgcaaagttgccgccaatgacaccggtccataaggtgcatgcggtgcgactgccatgtcaaacgcttcagccatcgcggcaattttacgtgtttctaaaatgccgccgcacaaggcaacatcaggttggacaatgtcaattgcgccttgacggaatagatttttgaagtcccaccgggtgtataaacgttcgcctgttgcgagcggaattgaaacttcacgcgcaatatcatcaaatgaatcccagttttccggcaaaacgacttcttcaagaaacattgggtggtatggctctagagcatgtgccagtacttttgccattgggcgatgaactcggccgtgaaaatcaatcccaatttccagttgatcgccaacttgatcgcgaattgaggcaaccctatcaactactgcttgcaccttattatacgagtcaatatagtgcagttcagaagtcgcgttcattttaatagctgtaaaacccttgtctactcgcgcttgtgcctgttctgctacatcagatggacgatcgccaccaatccacgagtaaactcgaatccgatcgcgtgccgctccaccgagcagttcgtagaccggtagattcaacgctttccctttaatgtcccacagtgccatctctaggccagaaataatcgtgccattaatcggaccgccacggaaaaatgaacgatgcatctcttgccacaagcgttcaatttcaaatggatcacgaccaattagcttcttgcccatctcataagcacccgcgacaactgtttcggttttggtgccagaaatcatttcaccccagccagtaatgccttcatctgtcagcactttaacaaagatccaacgtggctttactttataaactttgatatctgaaatcttcaatgtgaaaattctcccttcaagatcatctcaactaacaatggtgacattaagcttgggcacttttttcattctgagcatccatggcagcattcacatgtttgataccatcgaagaagtaccacacgccagcaaaaagaaccaaaagtaccggaattgagatcagcggatgccaagtaaatgcgaagtaaaccgcaaaactttggatcatcgaagttgccgcaaatgatgaaatgtacaacgagttagcacccagtttgatcccaacagacttagcaatttcggttaataccggtgccgttgatgtcccgcaccagagaagtgaagctgttactaccaaaccaatgatgatgttcttaagcaagttgccattcgtcaaagctactaccaacgctactcgaaatggtacaaccgctaaatcggcaaatggcagaacttggttgcccggcaatactaatgccatgacgatggtcaatggaataataattaacgctgtggtaataacatcagcattcccaacgacaaccgcggcatccaatccgatgaacaactttcggcctttaaaccgcttttcagaccatttttgtgcagaatccgaaattggcatcaagccttccataaacagcgatgtcatcttcggaattaagaccaaaaccgccgccattgaaacacctaattgcataatcttcatcaagtcatatccggcaaaaaagccaatggccatcccgattaacaaacccataatcattgaatcgccaaagaatcccagatacttctgcgcatcacgaattgaaaacttgttccggcgcatgaatggaatccgatcgagcaaccaatttagcggccaggcaatgactaatgatgacaaagctgacaccgttggtaatgaaacccctggcatgccgaaaaacttctccgtcattggctgcgaccaatcagcaagtttaaatgtcaccaatgccatcataattgaagatccaacaccaagcgcgatgttcttggtgacaaagtaaaccatgacgccgacaattgccatgtgatgataattccaaatatcaacatcaagcgtatgtgtccgcttgataatcagcagcacaatattgactgccaaaatggcaaaaatcaaaatagcgataatcggtgatgcccaggtcaccgcagcaattgagccccatccgacatccagtgctgtcagatgtgcaccagtacgctcaaccatggcttttgcggcaggcccaacgttggtcgtcatgaagtccaagattaacttgatcccggcaaaaccaatgccaagggttaagccggacttgaaggctttatcaatgcgcaagccaaaaatcattccgataatggtgataataactggcaacagcaccgtgggaccggcagcaatcagccaattaaagacattcattacgatattcatagatggttatccctccaattcggtcaaacaaactcgaccttgttgacgcatctgctcacttatccttaacagcctcataaattttatcgagcgcgtcctgcgcccccacaccagtcagcagaggcagtccatgaatataagggacgccatgcgtttgtccttcaaactgaccagtcgtcaccaataagtcatagttctcaaccttaccaggaacttccattagcttagtctgagtggtttcaacctccactcccttttccgccaagaacgttttgatcttagacgcaaccaccgttgaggtcgcaataccattaccacatgcaactaaaatatgagcagccataattcttttcctcctaatttttatatgagcgcgagccaacgagtgtatacatggcgtgagaccttgctcgcagctttccatgtcatataacgccttatttttttacttaaaagtcttcattaataactgatataaagcatcagcatcagttgcctctgcaatcgcatgccgcaactggtcatcctgaatgacatccacaattttttgtaacatctcaacttgcccatgcggctcgccgatagccatcatgataatgacatccacatcgagtacattcttgacatcacccatatcatgaaacttaacaggatgtgccaaggtggccaccgaaatggttgttttcttaactagttgataattcgcgtgtggaattgctacagtcggtctcggtgaaggtaagccggttggatacgcggcttcacgatcgagaattgcctgtttgtaaccttccttaacgtaaccttgagcgagcaaattatcggctatttggctcagagcatcgagattgtctgtcgcctctaaatggggcagcaataattttttatcaagcactaaatcaacagccacaaatcaatgcccctttctacagtgaatttttaacatcgacaaaggcttgtaacgatgctgccaagccggcaacatttcggttggcaagatcttcagcgttaaacatctttgatccgataccaagatagctcgtcccatgggtcaaaaggtctttcgcattgtcgatcgaaacccctccaactgccatcagtggtaattttccaagtggtgcctgaatagctttaaagaatcctgacccgactgtcgttgccggaaagactttgacaatatctgcacctttttcaaacatcgtatgaacttcagtcggtgtcatagcagccggcacggtgatgactccatgctgtttggcataggcaaaaatgtcgtccgtaaactcaattggacttagcataaatttcgcacctttagctatagcgtcttgagcctcggtcagcgttgtcaccgtcccggcgccgatcttgattcggtccccgtactgcgcattaccttcttcgataatgtccagtgcatgcggcgtattcatcgtcacttcaacaccaaattgattttcaaacccagccatcgcctgcataatggcatcagcctgttcaggcgtataaccgcgcataataactgtaaaagtcggatactctgataactccataatcttcctcctgagcgtgagccggtgcattagtcttgataaccaaactcacattattttccttgcttctcaaagcttatgaactcgtgcgtaaccttgcttcatacgcttgcaacacttcatacgcttgctgattcgtttttgattttagtaattgctttagtgccggctcgtcagcaatgagctccgataactcctgaatcgctcgcaagtgctgatccgtattcttaaccgcaatcggtacgatcatgcgaatgcgaaaaccgttcggatacgtcaccggatgcttcagaatgtaaaaagcaaagccgttacgaagaactccgttttccggaacagtatggggaatggcaacctcggtaccaataaagctataattatccggtgccaccgtttcgttcatgagcgtttgccgaaacggctcggtaacgtatttcaattgttccaatgggcggatcgcttgacgcaatgctgtctcccaatcatcgctttgaccaatttgaatcaaactcgatgcagtcatggctgacagttggggttgctgcgtttctggaagtgtctcaacaccttgatcagccagaaaccgccgcaatgcttgatccaatccttcagaatccgtaatcttggcatgtttgcgtacaatcgcagttaacgccgctattccggtttgaatattctttacgccaatatcatttaagacgcgatatcgcagctgcatttgctcatcctcgcttaacagcggatgaataatgtattgacgcgccgaagtcttcaagggaacggttgtgaaaaccaagtcgtaatcgcctgaaaaatgttcaaattcacgagcggatgtggcagacaaaaagctgatttccggaaatagccgacgcaggttctgaatcatcagctttgaaacaatcaggccattcgtacaaacaaccgcagcgcgttctttattggcatgcaaatcagctgacttttccaactcaccatcaaagtaaaaggcgatcaggtttcgctcatcttccggaatcggcttaccggttagcttctcgagtggtgcaacaatggcattgatcgtgtcgaccaaaaattgatgtcgaggatcagccgccatcacttgaccaatcccaatgtcgtgcagatgcaaaccatagcgaacgcggaagattgccggacgcaaatgagcaagtaaccggtttacgaaatctttctggtcatcaattttaataaacgtctgctgttcaaacttggaaaccattgttcggatggccgcaaccaagtcagtatctgctacaccaacttcgccacgaatcgtgttcgcagataatagcaacatcacaatccattcagcatcggaatcacagactaaccactttttaggtatcagcggcttaagcaatgaaaattccttggtgtcattgatctgatgcacaaaatagtggttgtctcttgtccgctgtgatagattacgcgtgacattcatcaacaccgccaacatcaagaagctaaacgattcatccgaataggtgacatgccgaacactttcaattttgtgaataaagtggatcacttgctcaggtggcactgtacttagttgttcgattgaaccacgaccatcatcatatttcagcaactgagttactagataattcagcaaattacggatgatctgctcggatccagcaatgaaatagccagcctgtcgcgtatacttaagcgccaattgccgccgctccagaaaatgtgcaactattttcagatcagcggaagtggtggttcgactaactccactgaaatcatataaatgcaccagtgacaactgttcatcactcacgagtaaatacaggcaaatgagtagcactcgttcatcttcttcgcggtaaacatatggcgccgctgtttcaccgttttgcagattgaaaaattcggcgacttcgcttggtgtcacaaattcacctcgaggagtacgggtaattttaggcaattgacggtcaaccagctcctgattgatctgtgccaaagcataggttagttgccgacgtgtaattttaaactgtttctccaaatcaccacttctcaaattaggatgccgaataatttctgaaaggatttgcaagttgcgtttcttcactcaaccctcacctccaggttcaatatcaattgtacgtgtcaatccgcgacttgtggaggcgctttcatgacggcttttgtacaccccgttagtaatttacatgtacaaggtgaacgcttcatgccacaaagaccgcgctcatcagttttaaattttggaaaaatgcaaaaaaaatacccacaaacagaatgtctgtgagcattttcaaatctgattgacccaattattcgcttttggtggcaattcgtttgtacagatcaaccacttcacctgctagatctcgaaacgtaatggccgtcatgacgtgatcctgaccatgcaccatcaataaagacacggattgatggtgtccatttgcctcatcagtcagcatgctggtctgagcattatgcgcttccgctaaaaattgatctgcttctttaagcttgaccgcagcctgttcaaaatcagcagcttttgccgccctaattgcctcaatagcagaactttttgcgttaccacccgccataatgagttgcataacaacaagttgttgcgcttcatccatgacactttcacctcccaattgactcagctgtcttaaaactttcccgtcatgacggcattaaatctaacgctgtttgtaatacgcgatcacctttcataagcccgtaatcttgcatatcaatgaccgcaacaggaatcgtcaaagactttttaaaatcgccttctaaatagcgaacttgtggccctaacaataaaacatcgggatgatcagctgccaagcgatcttgagcatctgctgccgatgcggcaaatatcgctacgttaatgcctgctttttccgctgcatctgccattttcttgaccaacatgcttgtagacatccccgccgcgcaaactagcatgatcgttttatctttttttgccatgattaaagtcctttcttctatctacctttgttgcccgactgcattgcaagctcgggcacgtgcccggttgacgaaactttttgaaaccagtaacccgattttttaagtgatttggtttgggtgcgcaaatcattgcggatcagaccgtaacgatttttatatgcatttagccacgaccaacaatcaatgccggtccacgaaaagtaaccgtgacaattagcgccttttgcaattgcccgattcaagaattgaaggtgctcagtcataaatcgaatacggtagtcgtcttgtatgacgccatctttcaagaaacgagtttcatctgccacaccaatgccgttttccgccacaaaccaaggtatattgtcatagcgatcttttatattcatcgcaatatcgtacagtgcagcaggataaatctcccaccccttatccaagttcatctttctacctggcaattcgtaatgatcaaaataaatatcaggcaaccatggctgcaggctctcaggatcaattgctggcgcttgaacgcgaaaaggatggtaataattgacgccaagtacatcaatgcggttagccgaaatgatatctagttcatctggtgttgcatcccataaaacaccatcccgctcaagtcggtcaacaagttcttcaggaaaataaccatgaatcgctggctccatataaagatcattggcccacaactcggcaaagtgggcagctgcccgatcattatctgcttgtgacgcaggataaacaggcgtcaaattaataatggtgccaatggtgcccttaggattacgattaagctttctaaatacagcaatggccttagcactagctaggttcagattataggccacctgtactgccgcctttccatcaacaatatttggatagtgaaattgatataaatattggccatcaacgattactttaggctcattgaatgtaaaccagtgcgtgacttgatcactaaagagttcaaaacagcgtgcagcaaattttgcataaagttcaacaacatgtttggattgccaaccgccatattggtgctgtagcacaaccggtaaatcgaaatgatgtaaattaacatacggtgtgatgccaagatcatgcatttctgcaaacacacgccgatagtaatccgcacctgcctgatccacagtcgcctcttccaagtcgtcaatcaatcttgtccactgaatagaaatccgtaatgcctgaacaccagcacgttttaacagtttcaggtcagcaatataatcgttataaaaattcgatgctacatccggtccaacattatgatgaaaatcctgagggcgggtatggtaatgatagtcaaaaatgttttcatgttttttatgaaaagttccttctgcctgcggaccacttgtagctgctccccagacaaaatcagcattaaattggatgataactccccttctttctccgcgtctctgcttaatcaccatttctcaggctaaattgctcgaagttaatggctgctccgtataaattggcatctgcctgaaagctagcaattcgaatttgcggtcgtaatggtgcaatcccaacgtgagccatgacagaatcaagtgcttgctctaaatctgtcagtaaagctgggttttgtgacacgccgccaccaatgatgaagcactccggatcaagactatattgcaaattaaaaatcgtggttgcgacaacatccaacatatcttgaattgctttttttgcagagacgttgccgtgttgtgctaattcatataaccctttaccatctaactttgtcccatttatacggttgtatcgtgccacagcgtttaccactgtaccaagatgactaacagtgtcagcttcaccgtgtaacatgtatccaagttcgccacccaaaagatgttgaccatgccgaacttggcgattcaatacaacagcgccgccaacgcccgtaccgagcactataaaaacagcatctcgcacatcccgggctgcaccagcatgtacttccgcaagtgctgcacaattagcatcattttcaatggcaaccggtaattcaaaacgattatttagttctgctacaatcgggaaattatgaatgtacggaactgcgctggctccgcgaataatcccagtaatttgatcaaccataccgggactgctaatggcaacgccagtaatatcacctactgcacgcaattgtacgatcttcttttgcagcagcttgtaaaattctggcaatgtcttcggagtcgatgcatttgttcgaaatgaaacgcctgttaccgaatcgtattgtccaaacttaatgctcgttccgccaatatcaatcactgctaggctcatggtttcacttcccttttctgccactgaataacatcaagcgccagctgacaaaaagtcatgtttgcccacgaaaaccaagttcgcgtatattgccttgaatcatcttgatgcacaccttcatgacactgcccagtatccccagtagttgcagctattaatgctagtttgtcttgtttgattgaatctgctgttgctactaatccttccatggctacggcgatcggccaaacataccgcggtggtgtatgttcgctgccaattccttgtaacacgctgcctttatagaaatatggattttgcatactagttacaaacgactttgttgctatataaagcggatcttcagcactcaacgcccccaaaaaaggcaggctcaataaactcggcacgttggcatcatccatgaaacaagcgtggccaaggccatcaacctcgtaagcaaatccccgttcaccactaggcaacgtttgaataccatattcagtaattccttggcttatagctgccaccagcgtctttacgcgaatcgctagtgcttgtcgattctctggaatataaggtaataatgaagttaaaactgttttggccaataagttagccggaatgtgatagccatgttcacatcgattatcacttggtcgaaaaccatcccaaattaaccccgtcaccgctacgggactgccataaccttgatgaggcaatgtgtcgttactagctgtattgggacggcggaaaaagtatggtgaatgttcatgatgctgttcctgctcaaaaacatcgacaattaccgctaaagttgtccaaaaatcggtatcaaaaattgtcgcatcaccagtctccgcaaacagacgtaacgctagtagtaaaggagcacaaagggtatcaatctcaaacttacgctcccaaacttgcggcgaaacttgtatattggtttcatccgcatcacaccagtgggcgccactgatcgtttcattaaaggcatttgcgtatggatccagttgaataaagtctagttcgcggcgaagcacaccttttaaaatgacttccagatcggggatagctttgacaagctgaacataaggtaatacctgaaaagtcgcatcccgcaaccacatcgccggaatatcgcccgttgcaacaaaataagtgccatcgggttggagacttgtcgcttttattaatgcgtctggcaacagcgcccggaacattctttgtgcattcaaatctgctaatggatgagcatcaacaaaatcagttaatgctgttgccaactttactttttctatcgtcatgatcatcctttcgaagctgcaacgtcattattaagcgggtaaataccgtatgtacgtatttctccagccttgaatggcgtaagttgatagtgtgagacactggttgcgacagtttccttggtttcgtgattaagggttagtagccgaacactggctagccaagcaaactcaaatactccggggtcttcacacgaatctgatgtgggattataaacccgcacgagataaccagcctggtctgaagttgcagttacactggatataactaggtcacgcgtgttcagccgaagtgacggctggtgttctaaagcagtctgattagcatttatcgggaaatattgtagcggtgttgtaaagcgattaagtgtctgcttttgatagcttaaatctcctatcgctaaagcctgcacgcgttgttgtatctcagccggattgaactgttcatcaaggcaaataccgccctccagttgttgccttcccaacaactggctatcaggtgttggcacgtaccgcgtctgtaaacctgaggcatcacccggacggcgtttcaaatccggacggccaagataaccgacacctcgaaacatcgtgacagctagttgttcaaaatgttgcccaataagctggcattctttctcaccaagaccaagaaatgtccagctagtgattggatcgtgggtatttgcaaaatgaatcattggccgcaaaccagtgggttcttcatgataaccgattgcttgccagtcattcaggtgtggatcaacgaccggacgtttagcaactccaaacggcgtgtcggcaaaactatactgtgcatgtactggcgtcgttaaaatcagtcgtaggcgatgatcaaggatattattatcaaccgttagtttaaaatgaataaccggatcatttgctaacaatttcaattcaagcgtataaggtaggatgacatttgctttttttgcggcgcggtctgaaaggtcttttggtaggtgccagcctcctttgaaactcaattcactgactaactttccctgatggcctgtcacttcagcctcttcaagtgttaagttgatgagccaatcttgatatgctggcgagtaatcatacgtgtcgccttcatcgccaccatcatcaaaatgaatcgggttgacgaaagactgccctgttcgattgtccgtcaatttgagctcaccgttcgtaaaactcagtgtgtagtactcattgcgaatggttgtactgtctgaccttaatggaaccgcttgttgtgcagattctaatgtaaatccaacccagtccattgctttcatcactaatggcactgcaatagttgtctggtagtaaatcatcggcttttcttgtgttttgtcacgacgcaaaaccgcatcatcaacttgaacttgccgcaatacttcataagtaaccggcagaccgtgctcatctttaagagcaaagtacttatcacgggtggcaactgttatctgacctgtccgagtaactgattgtatggttggattccaaaagaaaacattgagtgacggcgctgaactacttgctaatttgcgtaagagataatcgcgtaaggacgttgccagttgtaacgcattgttaccacgctggtaaatatcacgatttgtcacatcggaattacatccgccggaactatcatgcgcttggccacgagcaattgttttccaaacctgttctaccagcccgctttgtgccttaataccttgatgtgcagcaatgaccatcagcggctcaaccacatctaccataagatgttcaagccgatcataaagccgttttaaatctgctcgcgatgagtagatacctcggtgaattttagaagctgagggatcgataaactccccttgatacgtagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactacgtaggcaactccctattttttgccaatgatgcgaagaagtccgggtaattatcttcaactaacttaaatgaatcttcgtgatcgtttgccaatgcgattcgttctttcaagttaaaatcaacagctcgctgatcaccaccgaccggaagtactaagtcatgtgacttggtgtccgttgcaattcgttgtaaaagagttgtggcatcatcattttcaattagttcaactccggcataataaccatttttaatgtttgccgctaatacccttgaaccatcctcagctgtccaataaaagtaacgtgcatccttctcgtgaggcataccgcgccaaaaaacagttgcggtgatgtcaaaccccgaatagatcttgggcatatcttttccctgcccaaaagagtccggtaaatacccaactttcatggccccgcctaaatccgcagctaatttatgtcccaactgtaaattgcgaacaatcgactcaccacttgtcaccatctcatcaatctgggtataccatggaccgataaaaagtcgtcgagcttgaacaaattgacggatctcatcccgcttatcaggattcgtttgtaggtaatcatcgataatcgccatttgtccatcaagaagataagcgtccagctggttattagtaagagcttgcaatacctcttccatatgataagcaaattgaacccttgcatgctgacgtgtgaagtaccattcaaaatcccaatgggtatgggctataacgtgaactctttgcatttattaaacttccttttttcgtcacaatttacttatactgtttatgccgcagacgccatttgacgctcattgcgttgattcatgataacgaatggcgcatataacaggacatcgaatataaccaagacaagtgcaagaatgactggactcgtatgcaatccgcctaaaatccatgtgctaaagaaaattggttcgttaccagaattcaagaccaccagtggaaccacccagccgatagaggtcacaacgtatgcaacgactgcattgaacagagggacaacgatccagggaatcaacataatcggatttaaaacaatcggtaaaccgaagataaccggttcattaattccaaaacatccgggcactaatgctaatttcgctacttctcgctctttttcacctttttttgcaaaaatcaacatggcaatgattagtccaaatgtcgcgcccgaaccgccgatcatggcataaacattggtcattgtattcggcgaaatagtgatgtcagcaaaactaccgaagataaccggttcattaattccaaaacatccgggcactaatgctaatttcgctacttctcgctctttttcacctttttttgcaaaaatcaacatggcaatgattagtccaaatgtcgcgcccgaaccgccgatcatggcataaacattggtcattgtattcggcgaaatagtgatgtcagcaaaacttttggtttcagcaaacttagcaacattttgtagaaatagtggtaaccagaacgcagacacgacaccccagacaatgttgaagccatgcaagccaaggaaccaaagaatctgctctaacaaaatcaccacgataattgctggtaagcctgtccccacggttaatagtggtttgatgataactgtagcaatcagttgaattaaacttgcataacccatcgcttgcagcccaattcgtgcaagtccaaacaacagcaacacttccgccattggaatcaaggcaaagaatgaatcaaacacattttgtggaacactccctggcattttgatcgtaaactttgagcgactgaaagcggcaaacattgccacggccagcatgccgacaattaatccagtaaacataccttcgtaactgaaaaatgatgatgcaaagccttcaatgatcttggcttttggatcagcaaagttaacattgttaggcaccatcacgaaataagcagaaaatgccaacagcgttgcgataataatgttcatatttttgttttcatcgcgctgtttcaattccaccgcataggaataagcgctggatataacgacgattaaaccaacgatccctaatgtcgctgttcccagataaccaaacaagttactgatgcttgttaaccagccccaatgcaaatgttgcgctttaattaaggcatccagctgcatcttaatcaaattggaaaatgagccgataaccgtaaacggaatcgttcgcacaaaagcatttttgaccgcttgtaagatcgtgttgttctgcacccacattgatgccttgagcaacggttcctgtattttatccacgttgaacttcatggtaagtcacccctatgtcaattttgtttaaaccaacttcttgcaataatgtcagtttaaatgcgctttcatattttgtaaagacttatttttaagttgtatatacaaatagttcaacccaaaaatatatttatatacaaataatttaattctcgaatgaatgacctaccaaataatccacttgtgttataatgtttgaaccatgaatttaactgaggtgaaaccgttgtatctatactgggaagtctattctgacataaaaaaagatattctgacgaatcattatcgagcaggcaaaccattaccaactcaagaaacgcttgccaagacttaccaaactagtcgcttaacgatcaaaaaagcactgcgaattcttcaggacgaaggtttaatttatagcaaacagggatcgggcagctatgttcgcgcacgagcgactgatgatgataaagaactcttaccactcgatgcccctattggcgtcacctactcgcatcgagatcaaaaaatcacgagcaaactgctttattttgacgctcgccttcctaatgaaaccgaacaaaaaaatctggtaatcaaggggaacgagccaatttatgacatcaagcgcgttcgccttgtaaacggacattactacagccttgaacacacgactatgcctacccatatcgcgcctttggaccggaaaattctcaaaggctccatttatgattatcttggcagtattgggattcaattaactgatgctcgccgggttttatatgcaacagaggcagacaaagaaaccgccgatgcgctacacatcaagcaaggaagcccggttttagtcattgaacaaactgcttacgatcaaaagggtcatgcttttgaatattcggtctcgtcttttatccgcgaccactctcgatttgttttgaatgttcatcgacggtcaccggacatgccacattaacagcgccggacttgctacgctggcaaaaaaaatcggcacttgagattaactctcgatgcaccgattattcataacctttttcactatcgtctcttcgatagtgagtttttttatttcaatacacgcgacagaaatccgatcctttagccatgtaacacataagctatctatcaccattatttgtcttattcaatttaaaatccacatgatacgagtcttatatttaagcaaggagttcaacgcctgcatctgctaattctctccctatacccatcccaggatcttcatctgtgataacagcttcaagcgactgctcactgcacaactgataataactttttacgccaaacttggaatgatcgcataatagaatggttttttcggctcgttgcatcatcgctcgcttgacgcttgattgctcctggctagacataaatacaccgtgatcagccaagccaacgcatgacataaaaaatagatttgctcgaaaattacttaaaaacgcaattgaatcgtcacccaaaatagacccagatccattccgcaagcgtcctcctgttaaaaaagtcttgatagatggcaaaccgtctaatgcaacggcaatccgcaaaccatttgtaatgactataacatgatttaattttgctaaataaggagctagaaaggatgccgttgaactagaatcgatgaagatggcttgattatcactcaaaaagatactagccgttgcagcaatttgccttttttcttgttctctttcttgtccgcggaataaataaggcaattcaagattgtcaggcttaaccagttctacatatccaaagccacgccgcactttgtccatcttttctaattcaatcaaatcacgacgtaacgttgaactgcttacatataattcttgttctaattctgatgttcccatccgcttcttgtgctgcaagacggaaatgatcctgtttaatcgctcgtttttaaacaaactaatcccccctcttataattcaacaacattctaacggcgatcgtaagcgcttgcaagaatgacgcattatgaagaattgtggcgcttttccatcgcataatcagaccattagtcaacatcagtgacaaccgtcaatatatcaatcttttcaagctataatgacactatccaatacggaaggaagtcatgaacgatggaaatgatgtttcaggccgaacgtactgatcttgcccatacagtgcaagtgatgttcgatcgtaaagataccaatgttgctggcggaaatatgtcaattaaagtttttgatgagaatgagcatccctatatccttatcacacccacttttatgtctgaaacctattacgctgaattgcatcctgcacagatcctagttgttgatgcaatcaccggtcagaaaattgatggtgtcggcgatgtaacccgagaaattaatatgcatgaaaaggcttacgcaactcatccgggtattcgctgtgtttatcattcgcatgctgaagaatctatgttttgggcaactgccggactcgatatgcccaatgtgaccgaagcaaccagagaactcggacgtataagggttctcccctttgcaccagcaacttcaatggcattggctaatatcgtacatgatgctctgcttgaaattggtgacaaggctatggagaatgtctttttacttgatagtcatggtattgtgattacgagttctgacttgcatattgccgttagaatcatggaaacacttgaatggaatgctagaattgcctatcaacaagcaattttcattaaattaggcttgcttgacgattttcactcttgtggcggcaattacaaagatccttacaaagaggttccgccaattgcggtccctagtactccgattaagtcaaaacaagtacctttgccttccaatccaacaagacctgtcagcgaaatgcagttaggtgaagtagagtaactgacatttatcttcttaaaaatgacgatcagagattaaccttaaaaaaagcagcaatgaggctgctttttttcattcaactgctaaagctttgatccatacgaagaacatgctaatgacgtccaagtttagaaggatcgttgaattttttaaaaaccgtttcacgaaaatcactttctcacggacttatcttttcacataaatcaacggcttcttattatgcatacataaaatcagcactaggaaaatcgatctcctagtgctgactttcgtttgttttgcgcttgcttcttctcagttgatcaactaataacacccttcttaagaatcaagttcccatatagggcctgatcgccggtttgtacaattgcaaagcattgtttggaatgttcataaaactcaaatcgttctaaagacttgaactgatagtctgagaatgacttagctatctctgttcgatattgatgccagactggcggttcaccattaggcacatgtttatcgccaggaactacctcctgaacaattgcttgataatccgcgtatgaatctaatggcatcaagactaaaatatcttgcaagaggtctaaaactgtcaggccatctgctcgaataacgtgatcatggttggtattagcaggatagttggcatccgctaacagaatttcgtcgccatgccccatctccatcagtgttttaactagttctggagataatctcttaggaatattctttaacacttgctcacgctcctatacttgcttggtctcccaatagagttcaatgtcttccaatgttctgcctttggtctctaggacattcttatgaatatagaaaacggccagcgcagacaaagcggcaaaaatatagaaaacgttaattcctaaagcctctagcaacattggaaaaatcaaagaaagaatgccattaaagaggtactgtgtgaaagtgataacccccataccaagtgcccttgccttaagtggcaaaatttccggtacgtaggaccaaaagaccggtcccaatccaaaaccaaatgcaaagacataaacgaaaatggcgacaatcgcgatcgttgcattgtcagaccatatacataaagcaatagctggtggaacttgaccaccgagacttatttctaacagcttttttcgcccgaggcggtcaataaatggcagcgataaaaaggtggagacaaccaacgcaccaccaacagcgaagtcagcgagaatgctagcattagccattcctaagttatggaagatttccggtgcgtaataaacagctgcattgatccccgtaaatacctgaaagaaggttagaacaaacagcaaaatcataaccggtctaaaagtgccaaacaattcgcgcaacccagcctcttgcgatttcaagctatcttgaatatctgtgatttctgactcaatctcgtcatcggttatccgcacgcgcttgagcactcttcgcgctttttcaacttgattatcacgaattaaccatcgaggactttgcggcgacaatatcataccaacagcaaagaccgcagctggtatggccccaagtccaagcgtccatcgccagttgtcagccgggaggttataggccccgacagcataagccattaaaatcccgatattaacactcaactggtacagcgaagacattaagccacggatatgagccggcgctaattcagaaagataaatcaacccgtacatgttggcaatgccagctgcaacacctaatatgaaccgagctaccatcaacatcatcgtgtcagccgacaaagcactaaaaatgctaccgccaatgaagataaaaccgccaagtattaaaacgtttcgccgctctatcttcttttccatagctgtaaagacaacaattgatggaagtgcaccaaatagtaagaacgaaacaactaatcctttttctgctgagtttaagccaaaagcggttgttatggatggcaaggcaagtgagatcgcccctgagtcgtaaccatacaataatcccgcaaatccgccaagaatggcaaaaagataaacaatcggtttcgttgctggctgtaataacggtttcttagaatccatccccagtcaccccatctcgatcttcggttccagcagcaaatctaagtcctgttcttgcttaagaagcatttcaaatttcttgagccggttctcaaacgactcaactcggcttggccggtaagtcttgaccgcgtaggagtgattcataatgttgacaacgtgatccggggtcgtttgtttcaaaaccagtaattgcgaaacgatatttcccaaaacacttgcctcaacaggcccagctacaaccggcagctgggtcaaatcggctgttaattggactaacaactgattttgaataccgccaccaaaaatatgaacaactttgactggctctccggttactttttgcaaatcatggatcgtctttctatagaccatcgcaaggctttccaaaaccactcttactaattggccacgatttttaggcagctgttggccggtttgctccaagaacagctttatcttttcttccattcgacccggctcagcaaataatggatgattagggtcgatataactattaatggacgcagcagccttagcttcagccgtcatcttgtcaaaatcaatcatcatgcccttataggaccattcacgttggagttcttgtatgatccagagccctgtcacattcttcaaaagtcggtttgttccgtcaaaacatccttcattagttagtcctgcatctgcagcatccatagtcacaactggatctgttgtctgtcgtccgatgatcgaccatgttccacagctaataaaggcagcccgttgtcgatctttttcttcgattggcaaagctaataacgctgccgcagtgtcatgaccaacaccattaatcatctgtatcgtagaatctaactgtagttctgcgataatgtttggttgcaaagggccaagaacatctcctccaaccgttaagtcaccaaaccactgttttggtatccccaacgattttagtaactcagtgttccagtcgcggctctgcgcatcgagaaggccacttgtgctggctattgtaaattcactttgtttaacaccggtaaagaaatagccaatcaggttaggcatcatcaaaaatgtggtgcctttcgtcagtagaaaaggataccgtctaatgtcggcgaatagttgaatattggtattgataagatccggctggtttcccgtagttagaaatagctttaccgggctaacacgttgatagaatttttcttttacctctgttgttctcgtatctcgataactgtgcggtgcaaacaataactcgtcatggtgactcaaaagtccataatcaacaccccaagtatcgacactaaagctgtcaatttgcttcaagtcacgttgcgctatcgttaatccgtatttaatttcctgaaaaattttcaggtaatcccaatatagatggtggttgacattaactggttgattagaaaatctaaactgttccttcaataaaactcgcttaccatcaaactggccggaaatgagtcgtccagaactcgcacctaaatcaactgcaattaagtttcttatatccatcctcatcactcatttccaagactatcgatacaatggaccgaagtttttgcatgcattgaagtcagccgcctctagattttccgtacctagtgatgcccatgctcgcggacggaaaatactggattccggcacattatgcatgttaactggaattcgtaaaatcgaagccaacgttattaagtctgcaccaatatgaccgtaactaatcgcaccgtgattagctccccagttatccatcacatcatagacagacttaaacgcgccatgtcccgtcaaaattggaacaaagaatgttgacggccaacccggatctgttcgcttgttgatgatgtcaaacacattttcaggaagatctaccgcaaaaccctctgcaatctgtaattctggaccgacacctttgacaagattaatccggctcatggtaacaggcatcccttgttctccaccacgtgttacatagttagaagaaaaaccaccgccacggaagtaaccaatatttgctgggatccaccgcgtgtgtgttaaattagcctgcgcttcttgttcggataattcgtaaaaaggtttaatagccggttcgccattgatcgtctctcggcctgtcgcatcaagtgtttgggctccagaattcgatagatgcaggaacccatgcttagccaatccctcaagtttagtgcctgtcactcgttcaacagcttcagggctccaatatgtccgcacatcagcaaagatttgcggcgtgttggttagtaaataattgaataacattgaagcaccattcaacgagtcattttcagtagcaaatacgtgcggttgatgaatgccattccaatcatactgagagttcatgaaggcttccatgtaatcgccattaggaaaatgatctgtccattgtcgttgcccctggaatcctgcagcaattgcattatgaccttccgcttcttctttaaaaccaaggtctgctaatttttcgttaccatccatcagatcacgagcaatgatcgtcattttgatacagttagccaattgttcatgcttctcttcatcagtgaacttgttaggatctttttcgttataaatatccgggccgattggtgtattcttttctgcccacgccattgcttttttgaactcttcttgatcataaatgccttcgtcccaacgacgaactatttctgacatatcgacgtattcattccgcatccctagatattcttggaaaaagtctggatctaccgttgaccctgcaattcccatcgctacgccgccaatcgaaagataactcttatttcgcatcaaacccgctgccaatgctcctttagcaaaccggataatttttgtttttacatcttcagggattgtggtgtcatcagcatcttgtacatcatgcccgtaaataccgaaagctggaattcccttttgcgtgtgagctgccaagacggctgcgagataaaccgccccaggacgctctgtaccattgaatccccaaatagcatgaggtagatccgccgacatatccatcgtttcactgccatagcaccaacaaggtgtaactgtgatggttccacaaattccggcgcgatcaaatttttccttagacattgctgcttctttaacaccgccaatggttgaatcagaaataacagtctgaacaggtgaaccatctggatatttaagggttgattctaaaagcttggcaactgaatgggccatgttcatagtctgttcttctagtgattcacgaataccacgccggcgtccatcaatcgtcggacgaataccaattttaggaaatgtcacgtttgtcatttattctgcctccaagtttgatatctaccaaatctaacaatattttgttcatcagctgactacggctataataataagcgctttcattcaacgcgccaatagattgcacgattaacggcttttcttcaaaaaaggtcgtcaattttcttcacagttcatcaagcttattagcccagacacataaaagttcctataccacctcatcggcgaaaccatgtatagctttcatccaacccaaaaagcccaccaattgccttcaacaatcagtgggctctttagagtgtgtttaggaggtatcctaccatgagcagataacgttacacttttagcgttacctgactgatgagtgaatcaccgtgaagaaaggctgggttaggcgttaagtcaaaccgtttggccagttgttccagattttcatccgtgatttcgttgatgatgcggccgccttgagcctgaatagcggtgtaaattgtcgccgctttttcaacggtttcaattaagccatacgtttcatcaatggaatcgccggcgccgaagattccgtgttgcggccacatgacgattcggaaatcggccattttttgggcggttgcctgaccgatttcgttggtgcctggggtcatatatggcaagacgccgatgccttcggggaagaccacaatggattcagcctgcatcttccacaaaatgcgggaaaagagcttctcttccagcggcagcgtaaaggacatggcaaccagattggtaggatggcagtgcatcaccacgcgctgatttggatcctgctttagccgttgaatgtgggtcatcagatgagccggaaattcactggttggctggccgccgtcattgaagccccagagtaggtcaacgctatggccatctttggcaatttggactaagccggtgtcgcgggccggaaaatccttgacattcttgaagtagcgtccggttccggtgaccagaaaatactggcccgccagttcactggcatcgaacttaattggcaagttgcgcttgacttcatgcacatcaccataaggggcaatttcagcagccgttaaccggtagctgacatttccgccattgcgttcatcccagccatgttgataaaggttccaggtgactttgcgcatttgtgccacatacggtgactcgacaaagctctgggtatattcgggattcagaaattgtttcttgttatccattaggcgtgttcctttcagaattgacgaattagtggaccaacttggcatcgcgtttgaattgaacgtctttttcatactggtgaatgttgttcatccagtcgaagccgaccggggtgttgtgatcctggcagaacttgtcccaaacagcgccgaatgggaatgacttcaattcttcggtttcaattaagcgggtggtgaagtcagcgttgagttcgtctttcttcaactggtcaatcggtgccagcattgcctgcagcaagctcttttgggtggcccgggcacctacgacccaagctgcgacccgattgatggtggcgtcaaagaagtcaaggccgatgtgcgtgcgatcaagataaccgtcccgaaccagtgaccgggtaatccgaatcagcgcatcgtccatgatgacaacgtggtcagagtcccaacgaaccggacgggaaacatgcatgaacaaacctttgccaaatgggaagaaggcgctgaacttgtcggaaacatcttcagttgggtggaagtgtccggcgtcaattgtccataacttgtttcgactgatcgcatagttttgatagaattcgtgggaaccagtggtgtaggattcgattccggtaccaaacagttttccctcgaaggattcgatggtgttcttttctggcagcggatctttgatgatttcgtccaaggctttgagcaagcgcagccgtggggtctttttgtcaattgggttgtccttaaagccatccgggaaccagaagttattaacaacctgactgcctaacttttcgccaatgtagttggaaatttcccgactgatcttgccgtggcggatccagaagtcacgcactttgggatcgggtgatgaaaccgtcatgttatcctttaccattggatgggagaagaaagtgccgttaaagtcgagaccaacgccttcttgctttgcccagtcgatccagtaatcaaagtcttctggctcaagtgtatcaagatcgcgcttcttatccgttaccgcatagatggcgtgcagctgaacccgatgcttgccgggaatcaggcttaaagcttcgtgcatatctccggctaattcatccggtgtgcgcgcaatccccggataattaccggaaacgccaatgccgccggttagttcctggttagggaataggaacccatgaatgtcatcgccttgccagcaatgaacggacaaaggtaccttttccaattccttcatggctgcatcggtatcaactccgatttctgcgtaacgctgttttgcgacttcatatgccttatcgacttcttctggtttaaccatgtgaaaaacgctcctttatttaaaatcatctattgtgactggttaccgcatttaaacttcgactcaatccaagtggaacacttcatggagatcatcggcgaccggactgttatccgggttggtcttcataagcggctccatatacgcccaccacttcttgcaaatgtcagtgttggcaatttcgttgtacttagcaacgtctggcacttccagataggcaaacaattcgccattggccttgttgagataaatagaataattagtggcgccatatttcttaagggctgctttcatttctggccacagctcgcgatgccgcttctcatactcctcgtatttatcgggataaacgtacatgacttgcccaatacgcttcacgactaaaccgcctccttagctgtctgaaccttgactgttttcataaatgccttatatttagcgaatacatccggataagcggatgaatccggttcataagtcttcaaatcaaacgatgccttaattagcttgcgcccggcgacaacatctttagcagcgccggtcgtaatcatctgaacgagcagattaccaattgctgtcgcctcgcttggacccgcgaccactttgacatttgcgagatcagctgtcagttggttcattaaggttacattcgaacctccgcctacgatgttcagcgtatcaatcggatcggcaataatggtgctgagcttgtgaatctcgttggcataataaagagctagattttcataaaccgcccgcgtcagttcacctggcgtttccagcttggcctgtccggtttcggccacataatcctgcagttctttaatcatgttagcgggattttcaaaccgcttgtcattgatatcaatgaagacgcggaatggcgctaccttgtcagccatttccgccaactctttgaagctatactgatcgttcagctcgcgtttgatgcattgcacaatccacaagcccatgatgttcttcaaaaagcgataggtaccataagcgccccattcattggtgtaattttccttgaaggcatcctgaccattttccggggtgttgagttccgcccctagcagcgaccaggtaccggaacttaagaaggcccaatgattgccgaatcccggcgtaccaacaaccgcactcgcagtgtcatgcgtggcgacggtaatgacatcggtttccggaatatcgtatttcacatgccatttatgactgatcttgccaagcggcgtaccggattcaaccaatgccgggaactgatcctgagcaacattgacttctttgagtaagtctttatcaaaaagtccctgccgcagattgagcatttgcgtggttgaggcgttggttacctcggtgacggcattgccggtcaggacataaccaatgtagtccgggatcatcagaatcttatcggctttagcaagatcatcgcgctcttcagtgtaaagttgataaagtgtgttgaagtcctggaactggatgccggttttttcataaatgtaggattttggaagctcagatgtcagttgccgtactgcctgattcgtgcgtgcatctcgatagctaacaggatcgtgcattttcttgccatcattaccgacaaggacatagtcaacggcccaagtgtcaattcctaagtccactgcggtatagcccatctttttgactttttccaagccggcaaaaatttcatcaatgatgtggtcgatttgccaccgatcatgccccgcttcgtttttgaagccgtttttgaatcgatgaacttcggttagtttcagttgaccatcgacaatcgcacccagcatgagccgcccgcttgatgcgccgatatcaactgctacgtatgctttcatatgctgcacctctctttaacaccatttgtttggttaattaattgactgtggtgaaacgcgttcgctgccggtgtcttttgcagctgtgtcgcggtcggctttgctcttttcatcgtcagttaagaacttgtcaccatattgttcgcgggtaatttcttcaagactcttgccacgcgtcttaggcgtccagattgtgccaatgacaagtgatactaatagcagtccgatcatgaaagttccggcaacggtgaagccgaggctgttgagaattgccgggaaaataatggaccaaacaccggcactggcacgaaccaggaagaacatcacgccttgtgagccagcgcggaattgggtcgggaagagttcggttgcccataatgcataccatgcttgggcaccgattcctgcgctaattccccacaatgctacgaacgcccataagctccatgactgagccatgccggcgtaggtcaatacgatccaagatgctgcggccattgcggcgccaacgaagaagaaaattcgatggttggctttgtcaccgtacttagcgaatccaaagtacgttgccaatgcggtgagaacccaaagtacagcttgcagtaggttagtttcctgattagacaagccgccagcagtttcataaacatatggcatgaagaagcccatcgctccggctaccaagttccagaacatgtaaacaccgactaggaagcatagccatttaagtgaggttttattcgagaacaaggtgcgataaggatgcgacttttcaccggagctcttttcaaacgccttttgatcctgccatgcttttgattcgccaagtccacgttgcaagagccaagcaatgaaggcaatcacagtcagcaatccgaacaatatccggttaccaaacagaccaagtggtgcaagaacggtcccgagaatgaaaataactgccggtcccaatgaccatgcaaactgtgatacaccaatattctttgctcgattgtcatcttgtgacgtttcggaaatataagtccaacttgcaggaacaccggcgccgactgctaagccagttacgagaaatcctgccagtaacattgggaagttaagggcaaacatgaccaggatcgtgcccaccatataaaccaacatgtcataggtgtaaatcaacttacgaccaaacttatcagacagtggcccaccgatgagagcaccaagcgctgcgccaaatgcgttggctgacaaggcgcctaataagccgacttgaaaactgctgagtccaaaatgctgcgtccacagtgtcaagccgctagcaccggcaacaatactgcctgaatccagaaaattcgtgattgaaacacgaatggtggatttcaacgagcttttctctgaagccattgtgttacctcctgcacatttcattttttgtcaccgtttacagttcacatttaaccgcttacatgttatggtcacaatgtcagataaatattatgatcggaacataagcacaggagggtgccatggaattagcaattttaaagcagttgcaaagtttgactgatgtcgaaaaaaagcagaaggagcatcatgtttttagcgatgacattccgccaaccgcgattgacttgcgggaatcaaaaacggctaacgtcccggttttaaacgattattttttccgcaatcacgccatttatgtcagcaaacataatcgatatgccccttatcctttgcacacccatcagttctttgagatgaactatatgttgcaaggacacgccgatgaaacggttaacggtcagcgtgtccacctgtcacaaggcgatgtgctgctactggatatcggaagtgagcatgccattgatgcgttaggcgacaatgatttgctgatcaagattttgtttcgtgatcgcaatatttcaatcgatttcctcaaccagattcaaagtcagcaaagtgtgctttatgatttcatgattaatcatttacggaagcaaaaaaccaagcagcggtatgttctgtttcgcaatggttttcatgacattcaaatcacacttgagcgcatcattgaagaatatttccgcccgcgcgcgttttcggatacgatcattcagtccgagttaacggttctaatagcggaactgattcgtggtcatcaaccaaccatcaaggatccttcgccaacgcaaaaacttgcggtcaagttgcttaacgatatccacgaacattatcgggacttgtcgcttgaagatttagcgaataaatacgcttataacaaaaactaccttggtaatctgttctcaaaagaagttggcaagaccttttccgaagcactgacgcaagaacgactcatcaatgcgcgccgcttgattcagaacaccaagaagcccattagcgagatctgtcttgaagtcgggatcagtaataaaagcttcttttaccacaaatatcacgcgctattcggcaatacgcctaaagatgatcggttgcacactacgggttacatttctcctgatcacaccaacccaccgttaacaattctgtaaatctgtttcgtttttgtttcacactttgccgttgcaccgcaaaagcattaagcgctttcaccgtgaaactaaaaagtcaagttaaacattgggacatatccttagatgtttgtaaacggcgcttgataattttctttattgtgaaacaatgaacgtgtaatcaaatgatgagcaagtgaaggagagattgcaatgaaaatcaaagcagccgttgttgatgaaaaaggtgctgattttaaaattcgggacgatgttgaactagcgccgatgggtcctgacgaccttcaagtccatatggtcgccagtggtatttgccattccgacgaagccttacgtatcggggatgccgttatcggctacccgattgtactgggccatgaaggttcagggattgttgaaaaagtcggcccggaagtcacccagttcaaacctggcgatcacgttgttttaagcttttatgcctgtggaaactgcaagaactgcttgaagggtattccgacccagtgtctcaattacgcccataacaatttgtccggtacccggccagatggctccgcgcacttcacggaaaatggcaagccggtcgcagacatgttcgaccaaagctccttcacaactaccacggtcgttcgtgaacgtaatgcggttaaagttgacaaagatcttgatttgcgcaagcttggaccgcttggttgcggctatgtcacaggttccggaaccgttttgaatacgctcaagccaaagcctggtgatacgattgcggttaccggtactggggccgttggattagccgcaatgatggcgggcaagatctccgggtgcaccaaagtgattgcgattgacattgtggattcccgactcgaattagccaaagaactcggcgcaaccgatgtcgttaatagcaaaaccgaagacccggttgccgcagttaaaaaattgactggtggcctcggggttgactgggctgtcgacacaaccggcgtcaaggcagtgatggaagatacaatccagatgctggctcaaggtggtaccaccgcaacgatcgcggttacgccgcatcatattgacgttgatacctggaacgacctctgcgtcaatgacaagaagatcgtcggcgtcaacatgggcgactccatcccacaaattgacgtaccgcgcctaattgagttctataagcaaggtatgttcgactttgataaaaccgaaaaattctatcaattcgaccagatcaacgaagccaatgctgactcccgctctggcaagaccattaaaccagttttgattattgataaagactatgtaccgggtaagtaattgagcttttgtcttggttctgcctgtggtttgaatttaagcacaaaataataaagcaccaggaactctaacgctgagtttcctggtgctttattgtgttcagccttctttgtttcattaatctctggctttaggcggaacctcattgatcgaaattcgctcataatgagtcacaccatagcgcgtattataagtcaggcgcagtatttgtccgtcagagaaggggccgggatcatactcatccgtcttaaactcaagtagcttcccgcgcccagcagcatctttcgccaacgctcgataaacgtaacatttttggcgcagattaaccggaactgtcaccgaaaattggctgcgtggttcatgtacttttgcataataggcgacaccaccatctctgtacaccgtccaccaaagcgtaagtgcaataaccaccgccaatgcgctcacaaagccaattttataaagtgtctcctctgtttcaaccgttaatcttctcaccccgagcatttcctttctgctttcaaaaagcaccttgatcaagttgaaagaaactgttcattgctatttaacaagtttgaaaataagcaacttgactgcgaattatctctagtattcagtcctggcgctccttaggtcaaagtaccaaaggaagttgtgtcggtaaattattcggttgtttttttaagagatttcttacacttataacaatatatgttattaatttggatggtatgttttatccggattgctgatgttagtaaaacattttttcaatatgactgattatgtgaggcttgaaagtatggtgactcccaacgtattaaaacatcactccgcagccgatgcctgagcatactcattcataatcgccgtattggcctttgtctccacattacccgcatagttcggtgtcaccaatgagacggtgccgtgtgcgttgtaaaacagataaaacttatccccaatcatgttcgctgcggtttgtgaatggctcccttcatcggtaaacgatcccactttaatctcggtgttgcatttgacggtccgcgtttggcctgcagcgtcagcactgaagaccttgattgttttagttgcaacattgcggatggtcgctttcatcgtgacggcatccgcatgttgatactgaatggtcaggcgataatttgctgtctgcgggtccgcttgcaactcaatccgagtcggtgcattcacgccttgccgtgtaaaaaccgcccctgaacgttcccgcaaaagcttggcaacatccacaacataatcttgactaccggctgttgactgagaactgcgctcccgactctcccccatatcgcttggtttgaccgcgctgcttttacttgcatgctgctttgaggtcacctttttgatcgcgctctgttgcgattcagtcattccgcgcttcgtttgttgttgggcaacataaaaatagccgccgataatgcccaatcccaggatcaaaactgctaacggcgccatccactttttcttaggtggtcgttgacgccgtctgctttcactagtctgtttcaagcttaaaaacctcacttaattgttcgcgttacgctgccttatcgactttgttagctcatagaaaaagtataacatggcgctttttaaacattatagttcggctcgtccgtacgcttggcaaaacaactaaacctttacagcatttttactgcacatatggtttgaacctttatactgaaactaatgatcatcgtctgtttgtctgtgcaaaaatcggtgtgtgaggagctcactggttctcaccagacgctcaggttcaggcccatgctcactcacaaggaggttctttttccatgcacaaaagttggtggcaagaagcagtggtttatcaggtttacccccgcagttttcaagatagtaacggcgatggtatcggtgatttacaaggtatcatccagcatttggattacattaaagaactcggcgttgatgttatctggctcaacccgatttacaagtcacccaacgccgacaacggatacgacattgcggattatcaacaaatcatgccggagtttggtaccatggccgatttccaacaactgttaaaagcagcccacgcccgcggtttgaaaatgatgatggatctggtcgtcaaccatacctctgacgaacatccttggttccaggcggctaaacaaagtcgcacggatccccatcatgactggtatatttggcgcgatcccgtcgatggtcatgaaccgactaattggcgcgcggattttggcggctccgcttggacgtatgtaccggaagtcggccagtattatctgcacctttttgcggtcaaacagcctgatctgaattggaccaatcctgctgtgcgcaaggccgtttttgacatgatgacgtggtggtgtgatcaaaggattgatggctttcgaatggatgttatcaatctgatttcaaagcctgatgtttttgctgatgatccacaccttttggaacagccaaacggtaactcgctgggcttaattgccaatggtccgcacgtgcacgaatacttacgtgcgatgaacaaggcggttttgtccaagcacgatcttatgacagttggcgaggcacccggcgttacgcccgccttggcacttcaatatactggtttcgatcgccacgagcttgaaatggtcttccagtttaaacatgttggccttgataacgatccacaattcggcaagtggtcactcaaacatcctcagttgaccgatctaaaacgcgtcctatccgattggcaaactgcactacacggtaaggcttggaacagtttgtattgggataaccacgatcaagcccgcgctgtttcgcgttttggggacgatcgccctgcttttcgggttcactctgccaaaatgctcgccgccactttgcattttctggaagggacgccttacatttatcaaggtgaagaacttggcatgaccaacgttgccttcccatccattcacgattaccgcgacctcgacaccctaaacgcttggcatgaacttgttgaacagcaacatgctcttgcgccagaagatatgttaaaaagaatccaccgtcgttcccgtgataacgcccggaccccgatgcaatggtcacctgcaccgcaagccggcttcaccgcaggcactccttggctagccgtgaacccaaactacacggacattaacgcaaccgctgcactggcagattccgattcggtcttcttcttttatcaaaaactcattcggctgcgtaaacaataccctgatctgattgtttacggcgcttacaccttactcgacccagacgatcctgatgtatacatgtaccagcgccacgccgccaaacaagaactgctcgtcatcagcaacttcaccgaccagacgttgactcgcgatatcgccaaacagctgtcaccttcagccaagctactcatcagcaactatgacgacgacgctgaaaatacgctccggccttatgaaactaaagcgtatttgaccagtgagcgatagtgagttcacttttgatctttaaaaaacgcaacgaatctcattcggaggttgtcaaaatcccgtcctcaccgatttttcttcatgtagaacgcgtctacttgccattacgtaacgatgcggccacatcaagataatcatcgtgatggcatcggttgattcgattctcttttaacggccgtcagccaacttgctactggttatcactagcttcaccgccaattagcaatagttgctggccgttatcggggacgcctcaatcgcgctttacccgtttcttctcccccgggggttctttatgcaacagtgctgttgcgttacataacataaatcattaaaagagaaacgcaaatagttgccgcagttctatccgcaggcgccctacaaatgccaaaccagtcatggatatcatcggtgccagtggctgatcaagcgaaaggccaacaatgaaaggctatttagcatgccatcatgctttcaccttggatgaataatacaaataccatatcaccgtcacaatttcgtcacatctgctctgtagtattagcaacatagaaatgagccacccactcattcctatacaaaccccaacccaactttttcatttttactcctccaaagtagaaatcgtcagccggcctcccaccggctgaccaatacataaataaacccccgcagtgtgaggtgaagtgcaacaaaaaagttagacagttggaaaattagttacgcagcggtctgattccgatattcaatcggggtcaggccatttttattgagtgaaatacggtcatgattaaaccacgtgacgtaatgatctacgatttgcttcagttcctcaagatccttgattggttgccgattgagccgttctcgtttgagtaggttgaagaagctttccattggtgcgttatcatggcaattacctttacgagacatgctgggaacgatgcccatggcgtgcacctgagactggtattcacgggtttggtattgccacccttggtcagagtgcatgatgggtgtgacgccagcggggagtttcttggccaaatcgtcaagcgttaggtggagttgttctttgttcgcagagttgcgcacaatgactgtaataacctctcgactggcctcgtcaatgatggccgagatatagccccagctgtggtcaagcagtctgacttgcgttacgtcggtgtgcaggacagcgaagggctcctgggcatcgaattgttggtgtaacaggttgtcgttcacggtgcctacttttcccttataggagtgatagccgctagtatggcgagaatacagtgtgacactaagattcaattgccccattaaccgtagaattgtattgggtgagcatttaaagccggcttttcgtgccatcacatgaatacggcgatagccataggtctcatatgagtcatggaaggtcttcttgataaataccttcaaggcggcatatttatccggcttattcttgcggtgcaagcggtcatagaaagtagcccgaggcaactgtgccaatgccaataattccttcaatggatagtcatgccgtaacgcgtcaactactgctgttttttgggcggcagattgttcttcgatacggcccctaatttttttaaaaagtcacgctccattcgcgtatggtataactcgccgcgtaatttcaggatctcttgctggtaagcttccttctcactaagctcaagcttcttaacttgtttgggtttcttatgtttcactgtagaccgccttcctcgcggtttcggacgcaacccagccactccctcagtcttgaagatcttcatccagacagccacctgcgaggcattgatcccgaaatgagcagccgcagataccacacccgcaccactggtttggtaatagtctaccacggccagcttctgttccagagaataaaatgtcttcgtatgctttcgctgaagagattcaagtccatggacttgggcttgcttaacccactctcggactggtttcgttgacgggatactgtatttagtgcaaaggctgttataggaaacccgtccagaaagatactcctgtacaaccttcaccttgaactcacttgaatatttagtcataaaaataccccacaatcattagagtatctgtctaacaattatggggcacttcaaggctgcgggggttttgtgtatcgttttgtactagccttttaattgttctagaactttaacgtttctccagtttaccgacaatggctacccaacttaaaagagacaaatttgattcctctagtacgtacctatcttataaaaagccctaaccgcgatgggcatccaaaatctccggaccatgcgttgttccgacaaccaccgttttaaccagatcaaggaacaagccgtgttcgacaatcccaacctgcttattgagccattccgccaacaaatgcgggtgttcgatccggccaagatgcagatcgataatgtaattcttagaatccgtcaaagctttgctgccatcctcattcaaacgataagctggtttcaggccttcatccgccaaccgctgtaacagcttgccactaccaaacggaatcacttctagcggcaacggaaactttccaagtgtgtccaccagtttggtttcgtccacgatccaaatattacgtgccgaattaatcgcgacaatcttttcgattaagtgagaacggccaccgcctttaatgccttgaaagtgcttgtcgacttcatcggcaccgtcaatggtcagatcaattttatccacatcgtccagtgctttcatcggaatttccaacgattctgcctgtttttgcgtccggacactggtggcaacgccggttaaactaagatgctcttctttaatccgctgagcgatggcttcaacaagataaaagactgtggaacccgttcccaagccaattgtcatcccgtcttcaacaaactccgctgccttttgagcggcttcttgtttcaacttatcttggtccatagctaaccatccttttcgctttgttgtcttcattataatatgaaacgaacggcaaatggtggtttgtgaagaaaatgacaaattgacattttgcatgtttaaccgtaatctgcattagttaatgctttttcacaaacactactcgacaacctataagtaaaagttcaaagcaaaaagggcatttaggtcaataataggcctgatcaaaagcaactccgtcaaggggatgcaaaaaagacttaccttatcaaaccgggtatagcttttatatagcctgtttttgctcagtggttagcgtattcagaatatgattgacccgttgctcgcgtagttgataaagcccgcaatgctccctacaaaaagctgtccggtctttcttaatttcggctaaaatctgatccacgatatcattcgtctgttggtttgcctgacgtaaagcccttatcttagcattacagtcatttcgttttttagccattgataagacttttagaatcgtctgtgccttatattcacgaatcggatggcattcttcaagctggtgttttatcaataaatctttcatcaatcaagtctccctcgcatttgttactttttcgatggggccaacgaaaaagtaagcaactacactgatcggttgagtgttgacgcattctgcaaccactgattaaaaggcgttgactcacatccttcagactaaaattcgtaaatcgtaatcattacgatttacgaattttagattattcccaaagccttgttttgtcaatataagcagggttttaaatggcaaaaaactaataccgtcaaacccttagttaagggaatgggtattagtttttgttttgagactacttatcaggtaattattaagcttcactcatcatactttcactcatcaaatggacctcatgatcagcatgccgcaattcaggccagtactctcgattcgccacaatcagatcgtccagcacttcttttgccacttgcgcactaggcaacgtcttcgatagcgtaagtgcctgccagagttcctgataatcatgatgaatccaagcgtccactaccagcttctctaccatcgcctgattaaggatcatcccgcgctgaaacagtggaattttcccttgcgttaacggttcggcaccatcttttccgacgatacaaggcacttccaccatgatgtcgtcatcaatattggcgattgcgccattattttccacaatgagcaacatgcgttcatgtgtattaaaggcaattgcacaggcaagatccacgataaatgaggcgtgactgtcgattggaaacgcgccgacctcactcgtacccgcgtcaatgatcttttgtgctgccgtgaaaactcgtttttctcgaccgtcctcaacctcattagcgcgtgtgtattcaggatcagaatgggcaacaacataatctgggtataaataatacttgaggtacgtatttggcagatagttaggatccactgcaagcagatcctgagcttttttgtgggtcgcctgccaactcgcatccatgtgctgcgtgtccacttctacttgggtcagataaccgtgatgcgctacatagtctcgaatctgtggtaaatattcatggccggctttatccttgacactcgtccaccagccaaaatgattcatgccaaaatagcgcacctctaaatcttctggttgtaagccaacaatttgtgacatccgccgctgagttccaaccggcatatcacaaatattcaaaattttggcatttggccgcagccggcgacatgcttcggccacaatcgatgctggattggaataatttagcatccaacaatccggtgaataccgttccataaagtcaatgagttcaatgatgtcgccgatactgcgcatcccataggcaattccgcctgggccacaggtttcttgtccgacaacgtgatgcttcaatggaatcttttcatcctgttcccgcatcttgtagccaccagagcgaatgtgtgcaaaacagaagtcaacatcggtaaaggcggtttggggatcagtcgtccaagtaaactcgatattaggtgctttttcctttaattcaatggcgatcgcctttgcaattatcgcttggcgggcttcgtcaatgtcgtacagtttcaaagcccgtaacggaaaacgatccgcattttccagcagcatcatgacaatacctgctgtataagtactgcctccgcctgcaatcacaatagaaaacttcttagtcttagtcatcataaactctcctattcaacttctgctttgtcgaaccctaatgctgcatccaccgcggtccgtactttagtgactgctaatccgtagacaacatggacattgttgccttttttgatcaccccactggcgccggtaacattctttaatgtcgcttcatcaaccagatcaggatcttttaaaaccgttcgcaagcgggtataacaattcgtcacactttcaaagttgtccgctccaccaagtgcttcaataatggtcgcgactggcacatcttgggaacctttgggaatttgtacaggtggcgtttgcttcttcgcctgataatcggctttactataaagtttggtttcttcggtatcttgctcacgcccaatggttttcaaattgaatcgtccaatcaaaaacctgaacgtaaagtaatagatgaagaagaaggcaatcccgacgagtatatacatcggccagtgagtttttccgatacccagtggcaggttatacagtagaaaatcaaggaagccatttggtccaattgcccgaacgttaaggaggttcaagacgaccatgctcaaaccgctcagcccagcatgaacgacaaacagtaacggggcaatgaacatgaacgaaaactcgattggttcggtgacaccagctaagaaagaagtcacaactgcaggaattaggattgccttgactttattcttgttttccggtttcgccatttgatacatcgctaaacatgcgccgatcaagccaaacattttcgaaataccacgtgcatcccagataaccgagcgcgatagtaggtgaataccaggatcggccatctccgcgtaataaatatttctggcaccttcaaaaatgtgaccaccgatttcttcaaccccaccaagcgaggtataaagaaacggcgtgtaaatgaggtggtgtaagccggtcggaatcagcaatcgttccagtgacccataaaggaataacccaaagttaccggtctgattaattacgtggcccaaaccggaaatacccatttggatgaatggccacacataggtcagtgcgactgccaataaaaccgtcaccggaatcagtacaataaagacaaaacgactgccaccataaatctgaaatgcactgtggaattcagtatcaacaaatttgttatggatataaccaaacgtaataccgagaataatgcccagaaaaacgcccatatccagaatctgaaccccaagcaccgctgcctggccggttccttgaagattctcagctttggaaagaattccccgcagctccataaacttattcatggcattgatgaaaactaagaaagtcagcaaagccgtgaatccggcctctgcttttttcttcttcgccaaaccaaccgctaaccccacacagaaaatcaccccaagattggtcagaattgacaccaatgaccccgacaaaatcaaaccaaagcccttggtcactggattattcataaatgggacaacttcaagcaatttttgattcgtaaagatattgccgatcgcgatcaaaatacccgcaatcggtagaattagcaccggcacaaacattgcctttgaaaatcgctgtaagccatccatgaccttttgcttcatcccttttcacctctccgataggcatatttagtaacctgatatcgttgctggtttaaacttaacaaagtatcggtggtatgaaaaccctttcaaagtcattgggaacgcgttacgctcgcttggaacaggttccattcagctcatgaaagccaaataaaaagccatacgtttttcacgtacagcctttctctacactataattgttcgatatccacttaaagctttttgtctttcaagcgcccgatataaaacgtcaaacctgaaaccaatcctgcaatgactggacataacagcaatagccacactgattcaatgccaaaaatttcagcaaaataaccaaacagaccaacgacgacagatacaacaatactggcagtgacaacgcgcttctgatcttgggaactggccactcgcactcaccccttcaaaactttatttcagggtatgccattgtttctgttcatgcaagacttgttgcaatgatggtgcagctaattcagtttctccacctcgccgatctccagctcaaacaaggccagcatctgcgggtaaaacagcgatgcccgttgatttaactcatccagtggaaaatcatccgcgactttaagcgtccagtcagccattttagccaatgtactgtctgcgttaccagtgaaggcaacaacgggaaccggcaaactgctgactaaagccgctttatcaatcacactctgcgtctcgccagactttgaaacaacgataaacaatcccaaatcctctaaataattctccaacaacgcagccgaatcacctggggttgagaaaaaacaccgcttacctagaatctgaaattttttaaacatatactgcccaattacgcctgaaaaaccagccgcatacaggtacaaatattgactttcaaccgccgcgatttgttgagccactgcgcgaatggtcgtcgcatcattttgatcaagcaccgctgattgcaacggatcctcagtagcgtcaacgggttgcatgccggcctcgccatgacgcaacattgtcatcaacttatactgcatctctacgaaaccgcgataacccattttgtgtgctaaccgcatgacggtcgtggccgatgtgtaattcgctttcgccacgccgcgtacgcccagatctaacacacggtcaatgttggccaccagataccgcaaaaccgtgaactcagtctccgtcaaattcttccccgcaaccagcttttctagtttcacaattgtcagcgatcttttcattgttcgtcatgctgatttaacaaccaatcctgcgcaagtgaaaatgttcaatcggcatacgtcaatgtcgtaacctgatcgccatgcgcaaccggccccgctttaatcgcatcgaacgctttcaccttatccatatttgtaaacacaaccaccacagccgggtcacgatttgaggctttaatcgcggcaatatcgacttgcgacaaaacatcacccgcctgaacttcatcccccgccgcaatcttagtctcaaacggttccccgtccatctcaaccgtatccaatcccatgtggactaacacttcaagtcctgctacggatgtaattccaatggcatgtttcgtcgggaaaaccgagctgatgacgcctgaaattggcgcataaactagcccttcttcgggcgcaactgcatacccatcgcccatcatcttttccgaaaaaacgccatctttgagcgcctccaacggcattaactcgcctgtcaccggtgcagtgaaaacgtcacgcttttcttttttgaacaacccgaacattaatcgccatccccttctgaatttaactgaaaccctgcaagttcacgggcgttattttttattgtacaggaaaaaggagaaatatgtaaacggtttctcagctgggaaatacgccaagcaaaaacattgcgatgactatttgaagcatgctatcattatttcagtcaaaagattatggacggtctttttgattgtctactattactatttccaaaagctccatgctcgaaagggagtataggcgtccaccaatactcccctgacaagaccgttcaagacggttgacattaagttgaacaatcaaaggatcgtcgccttcgtcaaaaggttatcgacggtctttttgattgtctaggattgctaccttcaatggcaccatgctataataaaacgcgaaaaccgttcaagacggttgacataagatttgcaatcaaaagaccgtcatcttctccaaaagattagcgacggtctttttgattgtctaggattgctacctccaatggcaccatgctataataaaacacgaaagggagcatcggtggctgccgatactcccctgacaagaccgttcaagacggttggcattaagttgactaatcaaaagaccgtcatcttctccaaaagattagcgacggtctttttgattgtcttgtattatcagcataatggtgatgatcagcgcaatcaacgataataagaaatcaccgaagaccagcatcagcatcaacgcatcagcaacagacaactaggcacctccttccgtatagattttgatcatcgcgcataggcgaccacctcacaatacgttggatttgccaaccgtcattcactttcttgtcttgttcattatgccatacaaaacgtcaaaacgcctgctatctcaatgatttcaggcgttttttaatatttggattgtactttctgatatatcaaacagcgttagccctggagcctcacagccaagagttaaacctcagtcactaatccgccgcaaccagctcactcgcatccaccagtcgcttggtcatctcccacagcttggccacgtcttccggtcgcgtcaggccagttgccttgtcaatgatcgaactgtaaacatgcgggatcacctgtttaacgccggcatccaaggcaatttggagaatcgcttcgtaattatccaagtcaatgccgccagtaggttcgaggttaaaaccttccgcggcacaagctttagccactgcgcggaattcggcttcatgcttcaagccgcccatggggaagaatttgaagctggtgccgcccatgtcttgcaatagggcaatggcggtttcaaccggaacttctgcggccggcttttggctgctcttcggtccagtggcaagattaacgatgccgactttgccagttggtgagaccaagccattaatgacggtctcattttggcctaaaagtgcgcgactggtaccaacgccggtgaaaacttgattaacgtgttggggttgcaagacttgcgaaacccgactcaccatggcgctttgattcgggtcgcctgcgcctaagccaaccgataacccattagcggtcacggcttgatattttttcatatcttcaatcgccgcttcatcggttgcgtagttcttggtcaaaacgccgaccaccacatggccttccgcagcttcatagatgtctttggcattgtcgacggaaccagcgagcacatttagagcgacacgatttttataatagtttggggttaagttcatggaagacaacctttctatgcgagaatttctttgagacgattgacgatcaggtccatttccgcttgatcaacggcacgaatatcgaattcgatgatcccttcattagcccgatattcgcgcgtgtagatagccggatcccctacctttagttcggctgtaacctgcttggcattcttgggactggaggcttctaccgtcaccgcggcccggaaaatcgggcgtccggcgccatcttggacttccttcacgttcaggtgtgacacctcattcaaagcggccacgaatgggtgtagccgcttcttcatcgcgtcaccggactctggaccgtgatccagatattggctaagtgcggtggtaaacccgagcagattttccttgccgattttcatggcccggccaatcccaagtccttgcagtttcgtccaaccgatatacggctccttgccgaaaaccaagcctgacgctgggccttcaatcgccttggccccagaaaacagcaccacgtcaacgcccatttcgacatacttgtgcaaatcctcttccgccgcagcatcgagaatcaacggaagatcgtggcgatgagcaatctccaaggcttcctgaattgtcagcatgcttttttgcaccgcgtgatgacttttcacatagaaaattgctgcagtgttggctgtgatcatcatctccacatgttccggcgtgcacatattggcatacccggcctcaactacctgaccgccgccgagttcaatcatgacttcttccggcgtgccataatcaacattctgtcccttaggcaaaatgatttcacgcttggtataccgcgaagaaaacggatgataaacatgatacttactaccttcaccgataattccggcaacagcttcagcaatcccggccgacgctgagttcaccaccacagcgccttcagttcccagttttttggcaatgtacgcgccagttttatcaaccagatccttcatttcaaaaaagtgggtatccccaaactgctgcgcctgaatcgcggcctccgggactttggaaacgcccagaatggtcattttaccgctagcgttgatcacgtgcttcaaatcgtaagtgctgtaataatctgtcatgcgtgttgttcctccaaatcgtaaaccgccccgccaacaactgtgtaaattggcgcgatgagttgctggccggtttttgtgttgccattagaatccgttaataccttatcaccttttgttaggttaaaaatggtcacgtccgcatcttttcctggtcgcaaccggcctttattcaaaagatggaaggtgtccgccggtgcaaaagtcaccatccgaataacttctggtaaggtatagccgagcagcaacatcttttccatcgtcgtcgccatgtcataaacgggaccattttcacgattgcggtggtaaatatccgtgctcaaggatttaggatcaaggccatgatcgcgggcaatctgcatggttttaaaattaaacgaatctgtcccatggcccacatcgaaaacaaccccacggtcatatgcatcatagacgaattccttgatctcaccgttttcatcaatcatcccatttggcttgccgttataagcatgcgtcagaacatcccccgtgcccatcgcctgcaaaatatctttgagttcaggcggattggccccgacatgcaccataatcggcagatgtccgagcaaagccgcatatgatcttgccgccaatagtggcttgatgccattatcaatcaccaccgaatggctttcacgggccttgatgccgacgataaaatcaggtaagtccgcaaccacatcaaacaacgcctgcttgttgactttatctaggtctccgagctcatcctgcgctaaaataccggtgcgaccgatattgatcagtgcgtaaacattggtctttttagcgcgtgtaatgtcgtaaaaactccgaatattgtccgcaccggttgatcccgcatcgatcacggttgttacgccggccttgtacccatcttcatcgggatcgtcatagtacaaagatagcttttcatagcaatgcacgtgatcgtcaatccacccagccgtgacgtaggattgctggtgtaagtcaatttcctgatgaccgcctgctccttccagttttggtgctaccgcagcgatccggccgccattaatgccgacctcgatcggctgttcacgttctgttttaccgttcttaattaagacatcaaacacaagtgattacctgcctttcgatttgattgtagccatttttggatgcaacgcttggagaagtttgaagtgcgtcaacaagtggggaatctgaacatgaaaatggttactccagtgtgctaggctctccaaaatcttgctcttctgccactctccgaaacgcgcaaactggcacagaaacctgtacataaggaccttagaccgccaatgaccaaagaccagtcattggcggtctaaggccacttatgctccggtttctaagcgcgccagtttacgctcttaaagtttcaccgggaagaagaatcccataatcatcgcgccaataatcgcaccgcctgggattggttttttccaagcgtagaacaacgctgcgccgaccgtgctgccaatgccaatcggaatgctggcagtcacggcactgagaataatcagcggcccaaggaagcggcccgtttggttaccggctcccatcataacgtcggcaccaaatgtcgcattgctttggttaatcgtgaacttccgcaccaggaaaatgatcatcccgatgattaagcccaaaatcgccccagttaacaacgccaaggcaaagtttgacaccagcgacttggcgccaaccgacagtaagatcgccggaatcccgatcccgacccctgtcaaaatcgaaccgccaagatccagaatgccgacaagtgacccttccagaatccgggcaaacaggaaacttgccccaaacgccgccgctgcgccatatgagccaccggtcatgccggctttcaacatggccacaatcgccacttcattgaaggccccaacgccataattaaaatacatggatgttccggcaaaaacgcctgccgacatcattgcaacaatcgcgacaaaaccccaatccgcatgccagaaatcacgatctgcggcttctctcaattcttcttcaattggtgcttgatttgctacagcttgtttatccgccatcagtcaatccacctctactttccgcttaacgtgttatgaatattcgacaaccagtcaggtgcatttaagttaaaggacttcagcaagttgagatcgaatccgcggaagaaccctgataagacgaagagcaaaatggccgcaaccaaaattgatttcgtaattcgagtccatcctagttcatcaacacctttaccgacaagaatgcctaaaaccacccctggtaccgcattacccataatcatggccgacaaaccaccaaacacggttccaaacaggcctgaccgtcgaccggcatcaattgccgccaaccagaataagattggcatgacaaggttaatcaactgattcgccgccggaacaagcactttaaccgccgtcacttgcagcgattcgggaatcgaactggacgtgacattcaagaaagcaacgaccacgataccggcaatcgccccggcaatccccattttcttaggattatgcatggtttgttcaacgttacgatttttaaccagtaacccagcagccgcccagttcggaatgacacggtgcgtaatatcctgcgtaaaggcgccggccccaaccgttgacgcccaggcattgaagaagaagcccaacccgaaactaaaatgcgaagccggatcgccttctgccgcgttcatttcgcccagtgttcgaaacgcgcccaaagcttgtgtctttggcgcggtgaacatccgtgctgccccaacccctgccgcaaaaccaaccaatccgccaataatgatggactggaataaaattgtgagaattggcaattcatttcacacccttcaaaatattctttagattcggcaatgacatggcatccggcgatggtgccgcgacgtcttcaaaaaccaaagcgtcaaggtcaatcgccgtaactgcaactgtcactgccagtgtcactgcataagtggtacgcgtgcgtttaaaaaagaaaaacagaaacttttccgtataactcgacttaaccagtttcagcggctcgactttttcgggaacgatccgcaaaatcgcagtttcggtatcaccaatcagctgtttttggatattgctaaaagcggctgcaaaggcttgctgcttggtttcacctttgccagataccgtgacgacttgatgtttggtttcattgacgactgtcatttataaccgcactccttacgcttcgggatacttcttgttccacgcttcgaccagtgctttacccaacgcttcttgatccataaagccaaaaccgagaactttagtgccttcctcgatggcagtcacaccttcttgaatcgagcgcatgccatgacgttccggccatccatattgcgtatgcgcggtaatcgcccccgcaccaccggaaccacagaagctaatgcccatatcggctttttctttatccatcacctgacccaaacgcatatccgcccccataccaggcaccacaacggcagtaccaccagcggcttcaacccctttagcaacgttttgacccttacccatccgatctgcgataactactttaaccatgatatcttcctcctgagcgtgaactggcgcggttagaatcttcgccagttaacacgagataattgcaatcgtaaaatatctccacttcaaatcttgttctgcgccgcttcaaagtgaatcgataacacatacttctccgcatccgccaaatgaccgatgcgccgaaccacttgatcggctaaatccagcgactttttcgagacttccgcaaacatttggggatcgactgccggcaactgttcgcctgactttgagcggttgatcatttcaatcagatgattcgttaacacttgcaactgaaccgcggtaaaatgaatatccgcttgttcggctaactgaatcacgtcactgacaatcacttgaaccgcctgtggatcttggctttgggcaatcattttttgcacttcaacaggtagcttaatttcggcttccagtggtgacatcccccttctgagacacagcatgacctaaattcaaatattcaagaatcgcatggatttccgcgcgattgatggcaaggccatgatcggtaaaaattcgttccacggtgccagctaatttggcatcgtcatgattaggttttccttggtactgcttgccaaacataatgcgctgggcagctaaaaagacgtgcatcatgaacgcatcggcataatacgggtcaatcttggttggcaactggcgcttgagttctgaataaagactgaacatggtcagaatggtttgttgcgtctgcttttccagatcaggcttaggcttaatcgggactaccggcggctctgctttgagttgttcaagtgacacctgcaagcgtttggccaccgcacgtcggatagcggcaatatcagtcgcgtttggcaacggttggacttcaatgacttgcacatccagatgcttcagtgggaaaacgctaatcaccagctcaggatgctcgcgggcaatcagcgcccgtgcatcatcaatggaggcaaatccgaccaattcaatgttgggtatcgccgaagccacgcgctgttgaatcagattggtgatcccaataccggtggcacaaatataagcgacccgcaccgttttcagttggctgtcccgattgagcgataccatgaaatgcaaggcgataaaggccacaaatgcatcgttcaaaatcgggcgataggcggccagctccttatgcaccgtcttttcaattgctgcaaacaactgcggatattcgtgcttgatgtcctgcgtaaacggactgtattgaagcagttgattctccttgccaagcgactggctgaggtgcaggtagagattttcctgaagttgactgtcgtgactgaaatcgtgatcaaccagcgccccaactgccaggataattcggtgcgtcatagccacaaagttgtcgttctgtgccaccgttaacttctgaccatctgctccaaggtaataagcaaagtcgtcggcccaaactggcaagttgtaaaacgccagtgctttgagaatcaactgcccggtaaacgtggtgctgtcgccttgctccacaatccgatgataactattcaccggctgattaatcccttggcgcacaatgccgattgcaagccgaatcatggtcgtgatcaaagcgctgggatcaggcattttctgatcctgttttcccagttgaatcgccgctttcaggatcgtattaaacgcatgatcaaaggtcggctcactcgtcaaaacgagcgcccgtttcggttcaaccaaggcattgaggcaatccaccagctccgccatcaacgtcttacgattcaactgctgagcgataatgcgttccagcaaccggcgaatatccagctccgtccccgtgagtttgtagccataataattcttactcgtgagcttcacattcacttgatgcaaaaaggctgccagtttctttaaatcgttattcaccgttgtttgactgacattcacccgcgcttgaagctgctgttgcgtcgtatagtcacctgtttgcgccaaaatcagaatcatgcggataatccgttcattcggggccaaatagttatccgccaactgctcatcgattttctcgcgcagtgccatgcgatcttcaacgcttgcttcaatccagacgccttttcgtggtgcgctttcgagtttggaatggtgcaacgcaagccattcacgaatatctgccaagtcatacttcacggtgcgaatactgaccgccacggcttctgccaactgcttagatgtcaccaccccttcagcattcaataactgcaacacaatttgccgctgccgagtactcaattgcaacgtgttcaccccctcgtaaaaccacttgccacaacgatgccagacgcctgccagcacgccattcacaccgtccatttccaacctccaccgtcactttaaagcgctttctaaaaagaaacaatacgcaatcattgcacgattaatcgtgcaatcgcatgtgatcgggcaaacaatggcaaaatggtctgttccaattataacgaagactgtattcatgccgctaactttcacccttataaaaatgcttatgtatagggattaaaatgataagtaaacgctgactatgcctgtattgatatggaacaatcgcccagacaggttcagacacttttcacattattaagaacttaatcatgcaaaaatatgtttctcacaccctcaaatacaactgttatctgattttgaatttataaaccacatcaagtttttgaatgcttcacataaaataataaatagttaggtggcacatccacaaaaccccataacttacctcatcgtcactaatcgcagcggcttgcgttcatcaaaaaagcctcctgttgctcaactttcggcaacaagaggcatctttattttgctagtgctttttctcttaaactcccgcggtcctatcaagctggcgtccttcttcattgaacacccgaatcgcatcgttagcagctgcgtttgtcattagctgtttaaagatatcataactgatcgtcacattagcagcgccggctttgatcgcggccatgacttgtgaggcgtttttgaaacttgcccccatgatcttaatatgcgtatcggtactttgataaaagctgtgggtctcggcgatcattttatatggatcaatgtcgagctgctccatgcgattcacgtatggcgcgatatagtcgcaatccacaacgcaagccatgaagccttggcgcgttgaatatacggccgttcccagcagacattcatcgggctttttatccctaattgcagagattgcctgatagcccggttcaaacagcggcactttaaacgccattcgggtatcatccgtgtccggaaaacggcggcgcaattcatgataatcagccaacagttcgtccttggtatcacccaccagctgaacgaataaaacgccgggctttaaggcgcgaatcttagtcagctgttcaaaacgcggctggccttccttaagcaacaacttaggattagtcgtaacgccttcaaactggttaaactgcaacatttccttaatctggctgagattagcagtatcaatgaacatcgcttattcccccttcataaccttaatgacggtgccgacatccaaatccggatagggctttttctccaagtacagtgatccggccagttccggtgtggtcgcaccgtcaaaaacaatcgcggtgtggcctaaattgcctaagttcgtattgacttcgttgcccaccgccgtaatggcataagtctgatcaccaaacatcatcacatcgccgggcttaatcggctcaagaatttgattcactttgataatgaagcaggatgatcgcaacgcgtcaggcgcctcatctccaaaaagaatcgccatgttaatatccttaaacccgcgcgcttcggaaccaacttcaagaatggtggtttcatatttcactgttgctactgacgacaccgcactcacctctctaaaaatcctgctttattttgcatacaaaccaaaacttgccaaccaagcgactacgactcggggtaccccgtttaagaaccgcgaatacaacactgaaaccacgccgacttcaacggtttttgagtctgcttcttcaagccctaaaccaacaggaatgaagtcagccgcattttgcgtattaatggcaaacagtgccggtaatgcatattgcggttgaatgttaccacggccgatttcaaccccgatcagcgtcccgatgacttgggcaataaccgcgcctggaccgagaattggggataagaatggcaaggaacagataaaaccaatcgcaattaagccaaaaacattcccagccagtggcgtcatgagtttggcaaaccaactgcctaaacctgagccctgaataatcccgattagcaacgcgacaaaggccataaacggaattacggtgttaagcatggtctggacagaatcttttgccgcttggttaaaagtcgcaattaccttcccggcaccaattccgattcgagcaataaagttaggctttttcatttgggcagtgatcgttttgttcgtgtcaaacttggcttcgcgagcttcagcagcttgctcgtcggctgctgctgtttgcttttctgtggtcgttgttgccgccgaccctgcttctgccaaggcagcatgctgcttgccggcttcaccgcgctggtcaaatggaacgccatttaacgcctgatccggaacagcatcatccggcaatgcggtaatctgattcacatcaacattggaaacatacaatttaggcacaatatattttgccagtggtccggattttccggtgggcaacacattgatggttaagatatttttcttcggataaatcccacagcgcagcgttccgccacagtcaatgatcgccaatgccgtttcgtcttcaggaatggatgttttaaatccatcgacggcttccattccggtcaattccgcaattttgtccacgatggccggccggttaccgcctgtcacgtagataaacttatgcttctgttcggtcggtgtaattgtcaacggcccgccatagccgcctgatcctttaacgacttgaatgctatgccattttttctcagccatgatcctaatctcctcattttaaaatcacttcaacttcacgctatgaccgctgctaaacttcttggccgttacgtgcagacagatcaacggttttgctcagagtaatgccagtttgcttggaaacataagcagttgtgaagtcggtaatccagccaccgataaagttcatgacaatcccgactaacatatagcgaatagccagatccatttgattcagtccgagtttttgcaccccttgcgcaatccccaaccagacaaacagttcacctggattgatatgcgggaagacgccattactcgtatgacaaaactgggcttgagcggcataataactaggcttgtagtattcaggcaggaaccgagccaacgtgaaacacattggattgcccagcatgaacgccgcaagaaaaggtaaaaccagataacgcattaacacattacgacttgctttttgggcaaaccgttcgatgcgttcttccccgataaaggcaataatcgtattcatcagtaccaacaacagcagcacaaccggcacaatgttggtcatccagctaataaacgtcttgccgccagtttgaaacagcttcataaagccagcggcaaagtcagaaatgtattgcatgatggcatccccttagatcgtattttttctaaaaacatgcgccaatgcatcaggcaatgctttgatgcgctgaccgatctcattaaaaatcggcagtgcaaacatgctgacgcggctcgtatcaaaatcttcgaaactaagattattcgttttataattcacataattacggtaagcattcagaaaacactcacgctcggtccgactcagcttctgcagggccgtataatcagcgccgacttcagcgactaactcaccatcaaattgagcaacttcgcgaaaccggctaaaaacgctcaaccctttcatcacccgaatttcctgaatccgatcatcgtgatccaacccaatcaacatcagactgccttgccgaaaacgccgcggattcttaccgattaagacgcggccttcctgacgaactgcatgataattgcgggcaaaattacgaatttgaaaatagcccattaacgcctgcaataaaaaggcggcagccacaaaaatacctagtatcaaaatgttcattcataatccctccgttacaatggttaacggatcgcgactgtctgtaattttctgaagattagccatcgccgtttcattcaccgccagcaaaaacagcaaatcatacaacatggataagtcctccaacgcttttttgcctaaggtccgcggaatcccgatgacaaaaatataactaacggacttgccgccaatcgtgatggcatgtgtcaacacactcagatgcagaaacaagcgattctgatcaatatcggcaatcgcatggggaatcgccgcgccattatcaagcacaaacttggtggtggcttcatgttgaatgagccgctcgataaaaccggcatcgaccaatcctgcctggcaatctgcctgaagcgtcgcgcgcaaaacagcttcatacgattgccccgggtgattgtcatagatttgcgcccgccagataatgcggccagcatcaatttcatgttgcacagccgaggcgcgcaccttcgtctcaagcacccgatcccgaaaaatgtcgccaatcatgaccacgggaactttcaatctgaatgccaatggccggtctgtaaaaaccatgatgagttgatcctgatgggcaagaatatcggtctcatcctgaaaagtccgaatgctgacttgcgattcaaacatggtgttcaattgactttgcaaatattgcaacacgctttgccccatgcttgaaaagaatccaacttgcggctgatccagcgacgcccgatccgcatgttgcagcgccatttcgaagtaaacggtcaaataattaatctcaacatccgcaatgtgaatccctaaaatttcttccagcttatcaatcatcaccatcgccatatcggccgctaactgaaaccgctgaagcatcttatcggttaaataatccgatggcgaaatatgaaaaatgccgcgattgatcagaaaaatcaaatgatacttcgtcgtttgataaaactgatcataatcaattttggcatcaaccaaggtccgaatgtcagccgcaattcgatcgaaaatgactttgtttgcctgtaccttttgggctaacttttctgctgataataatttatttgcatacaggttaaacggaaacgccaaaaagttatattcttcctgattgaacttgacccgacaccgatcctcaatgtccgcaatgatgttaatgaacaaaggtgaatcttccattaagttcgtgtaatacttgctgatgccgttaagttcatagtgatgacgcttcaggaaaacgacaatttgcatcaccttttggaagatctgggtggtactcgttttgatcttggccgcattgagtcggctaatcaccgccgcgactaaagtcttatcgtcaaaaagccttgcctgtacatagtcgaataagtggttataaatcagcatcgttaaatcgaccgttgagcccacctgcagcttaatgccgcgactcgttgcactttcaatgccaagatcgtaattttttaaccagtgccgacacgcgtctaaatcttttagaagtgtgccacgactcacggtcagctggtcggcaatctcgtccatgggtacaaatttccgttctttgatcaaccgaaacagaatctccgcctgccgtttttgcttgtcgttattatcaatgttttgcttgaacacgcctgactgaatcagtgaaaattttcgataattcagaatatgcaggaagtacccgcttttgttaatgcgaatttcggctgcatcccccaacgactcgcctagttcatggatatatttttgcatcgtgcgtgtcgaaacattctcgctttcagccaatttgtccaggctggaggtaccatttgccaaaagataacgcaaaagccgataatccaaactattcaatcaggtgacctcctccaaattaccgattagccgcgcgatttgcctcctgccacatttgttgtaacgcccgtgatataacttgctcgattcgataagaagtagttcaccaaatccgctacttcactgagtttcccactgcgacccaatggcgtagtcgaagtcgaacgataaccggcgcgaatggcgtcaaccgtggtatcgcgcgtatatgccaaggcttcttcatagctcggtgtccgcaagccggttgcttccataatccccggggcaaccccgaccacgcgaatgttgtatttacccaactctttagcccatgaacgcgtaaacccattaatcgcgcctttacttgccgaataaacactttgaccaacagagccttccaaaccggcttcagaagacatattgaccacgacaccgtggccttgcttcaccattcgccgcaccactgcctgagaaaccaagaacacgcttttgacattaacactgaaaatctgctcaaacgttggcacgttcagttcatacttgccatgcggatctttggggtcaaccaaaatccgcggtttattgatgcctgcattgttgacaacgccccagatttcaccgtttattttttcggccgtagcagctagattttcaaccgcttccggatccgtgacatcggtatgaacgtaagtcagcttcggatctttcaagtcgccttccttcagatcgccgttaactacattggcaccgttatgaataagttctttaacaatcgcggccccaattcctgatgagccacccgttacaacaatcgtcttaccatctaagcctaaccaatcagacatatgctatcgctccttttcatctttcgtttttatggtagcgttttctttggctaggcttaatccagtgattttccatcgaccctgaaaattcgtgaaccatgtcgtttagtttcaggattataaaaaagcagatggatctttcgtaacttacgaaagatccatctgctattgttttcttgtgttgttccacgtttatctataaacttggttatcagaataatataacaaaattgccttcacccaacactcacgcttttgtcgcatggctcattgactttgctccgtcctgaccgtaatacgcattggccccatgcttccgataataatgtttatccaataaatactgcggcaagtgcacatcctgatgcgtcaaagtcaatgcatgataatccatttcggcgatcacttccaaaactttggcattataaaccgccttcgcaggagtcgcgccccagctgaatggcccatgctggctgactaaaacagcggggactgcgttatgatcaatgccgcgatccttgaaagttttgacgataaccttgcctgtattttcctcgtaagcttcttcaatctcttgttgggtcaaggcttccgaaatgggaacatcaccataaaacgtatccgccgcagtggtattcaaattcggaatatccatgtgcgccgaagcaaatgcaacggcccacggtgaatgggtatggacaattccgccaatgtcaggaaaggcattgtacaaaacggtgtgggttggcgtgtcgcttgaaggattcaactggccttcgacaacttcgccttggagattcaccaccaccatgtcatcaggcgttaagtcctcgtaatcgaccccggaaggcttgatgacaaacaggccttgctcgcggtcaattcctgagacgttcccccaagtaaaggtaaccagatccaactttggtaactgcatattagcggcataaacttcttgcttcaatttttctaacattgttaaaacaccccttctcaattcatcaaccgcgttactgtgatacagcgcggtccgatttaacatgtcgctttaggcaccaccgcttaaaagtaacgataggttttcatttgcaaaatctatgaaagcggttttaaaggcaaaaactctgatataatgggacataaccacgtaaagtcggaaaggaagtttacttatgctcaaagccattgcacttgatatggacaacacgttactgaacagcaataaagaaatcagtgtcaccaatcgcgacgtgcttcgttacctgaatcgcaaaggcattcgcattattctttgttcggggcgcccttttgccacgctgaagcccttcttggacgaattgcatgtgaccaaaaatgatgatgtgtgcgtctgcttcaacggcggtttggttcgcctagttcgtgatcacaccgtcattaaggcaaacaccttgagcaaggaacagatcaagccggtgtatgacctcgttaaggaaaacgggtttaagctcgatattgttgccgaagatgaagtgtattcactcaccgaatttggtaaatcaagctatcagacgatgattcctaagcagatgccgtttatcgataccacgttcagtaaagtgccggccaagcttccgattttcaaagtcgtggttgcaggcgagcctgctatgattgatgccgcatcagacgctgcccagtcactcaagcagctgaccgtcacgcgatcccggcgcacactacttgaaatcctgccgccaaatgtcaataagatgaacggtttaaaagccgcactcaacttttaccgcatcccgcgcgaacaactggccgcatttggcgatgaggaaaatgacaaagacatgctagagtatgccggcatcggggtggccatgggtaacgcgattcctgaaatcaaacaaattgcggacattaccgtgggctcaaatgatgatgacggggttgccaactatttaatcgattacttccagatcagccccactgccattcgcctatagttaaatgaatcgtctaaagccggcaagcaattggcggcttttttcgtgtgcaggtcagcaggcgcttcatgatgggacattggtttttgccactggctcctgaacaaaaccagcctgcacaaacagcggatcgaaaaagtccttggcctgcttcacttcttggatcggatcggcggccttttccgtccacatctcgatcgtaaaggcgccgctgtaatcaaggcgtttgagcgtacgcaggcagccggcaaagtccaccacgccagcgccaaacgggacatcgcggaattgccctttgctttttaccgtcaccgcttgggtatccttcaaatgaaccgagacgatgtttgcaattcccagttcaagctcgcgaccgacattgttttccggccaggctgacaagttgccaagatccggatacgcctgcaaccacggactcggaatctcatctttaatcgtcttaatcttggaaagtgaattcaaaaacggatcgtccatcgtctcaattgccagcatcacttctttagccgcggcataggccacaccgcgcttcaggttctcgataaaatattctcgtgaagctaaggttttcggctcatagtagacgtcataaccggctagttgaacattgcgaacgcccagatcactagccaaatcaatcgccttacataacatcgtcagacttttttcacggatcgccgggtctgccgagcctaatggaaaccgacgatggccgcttaacattaaggtatggatccgcacccctgtttgccaacaagcatcacgcaccttcgcccgttttgctgccgtccaatccaaccgggccaaccgttcgtcactttcatcaaccgataactccaaaaagttgaaacccaaatcccggaccattttcaaccgttcaacccaagattcggtcctgggcagtgctttttcgtaaattcctagtgaaatcacaaatattccctccttgtgagcgcgagccggcgcgcttagaagtcggcgtgtaagcggcctcagacgtgatgacccgggcttggtcattgcgactggggtccttacacgcaggcttctgcgccggggagcgcgttatggtgagctgagcgcgagccggcgcacttagcatcaaactgcctatatcgcccactcatcccctatttttggcaacaaaaagctggcgggcgccttttgtccatgaccgatcaaccgaattgttaggctggatcggctaagctaagggccttcgccagcttgctgtttctgaatagttaattagcaacctgcacaacatcaattccttgacggcgcaagtcacgcactgctttttcattggcaaaattatccgtgatcaacacatcgaccgcagccaaatccgcaacatgataattgctggtaaccccgaccttgcgataatcagccacgcaaattactttctgtttcgtccgcctgatcatggtggcattcacctgagcctcaaaaatattctgtgtcgtgacgccgcctttttcactgataccatcgcagccgatcaacgtgaaatccgactgcatcgtctcaagaatctgaaccgcaaccgtccccaccaacgactctttagggtagcgaatttcgccaccagtcaagataattgaagtttccggatggcggacacattcggtggctcggatattattggtgatgatcgtcaaaggcatcgttgccaattgattaatcgcccgccagcacagcgaactggaattcacgaataacgtactgtttttgacaatatagctcgggaccgcagccgcaatcgtatccttcaacagttcaatgccggaacgcgaggcatgattggcaggcgttgcaacgttagccttttcaaccagcccgtgatgccagtgaacctgccccatttctgccaaggctttcaagtcgcggcgcaaagtggtaatcgaaacgtcaaactgccgggccaattgttctaccaccaccggctcgccttgatccaccgcttttaggatcttctctcgccgtgcttgaacattcaccatcgagtttttcaccatcatcacctcataaacctagaccgccgcgcttagaagctaacgaacgcgtcatcataaaaatcaattcgtcttatttaccccagatgcgaataatttcattctggaaatctgtggccgctttggctggatcaggtgcctgagtgatcgcccggcctgcaatgaacgtataaacatcgacacctgcaaataacttcaatgtgtccacgctcaagccaccggttacggaaacccgaaagcccatatctaccaacatcttcaccttagcaagatccttttcaccccatgagcccccggaaagcaaggcatcgcggctttggtgataaattgcctgggtaacgccaatgtccaaccaggattgagcatcttctttggtccagttgccatataattcgatctgaatttctttaacctgcttctgggccgcctgaatcgttggaattgttgcggaacagatacacgtcatccaatcagcacctgcatccgccatattcttggctacggtagatccggcatcggcacattttgtatcggcaatcaccactttatccgggaacaacgcccgcaacgcacgtaccgcaatcgttccttcctgcaagatcaaaatggtgcccgcttccacaatgtcgacaatgttgccaactgcgcgaatatcgcctaacgcactttccaaagtgttgttatccaaagccacctgtaaatttggtttagccaaaatcgttcctccttgtctgccatattgctatgactgttctgttaacgtgatgattgataagacgccagctcacggccgactcgcgcctgtcataacgcgttcgcccgcgcagaagtctgcgtgtaaggacctcagccgcaatgaccaaacccgggccatcacgtctgaggccacttacactccgacttctaaccgcgctggctcacgctcagctttccataacgcgctccccggcgcagggatctgcatgtaaggaccttggtcgcaatggccaaacccgggccatcacgtccaaggccacttacactccgatccctaaccgcgccggctcgcgctcactatttcaccaaatccgtatcttcacgcactcgttgttcaacttctttatcactcatcacattcttaacgccaatcacctgaacgcctttttccttggcatctttgaacatgtcgacaaagtttgtggtggtgaagaccatgtcatattgtttagccgtgcttttaccttctgccaagttggtgtgttcaatttgggtaattggcagattcaaccgcttaaaggctttctgcacactacgcatcatcatcagactggtccctgaaccatttgcacacgatactaagattttcatgatatttttcctccatattttgcgttagcttggtctcattcactttttacgtcgagacccgagttgaaaagactactgagcttcttttttctttgcgacattttccttatattgctcataatcggtgaccattaagaagtagtttttcggatcatgccgatattcgagttggggaatcaagacgaggattaagacaaccaccacgatgccggcaatgcccaagatcttcatcaagacagtgaagaatggccatacggtatcccagtcgaacatgccgaggtagccgccaaacttcgataacccgatccaggtggcaatgagcgctgcgccgaagacttggatcagaccgctgaagaatggcaggatcatcgccgcctttgccccggctcgccggttagcaaagaccccaaaggctgcattatcaaagaagagcgggataaagccggcaatgataatcgttggcgaatggaacaggagcaaggcgccgattgcgagaaactggcctaatgccccaaacaggaacccgattgtgacggcgttgggttcgccaaatgcgaaggtcgcagccacgtcaatccccggaaccgaacctggcaacagccggtcggaaatgccggtaaagctttccgtcagttcaccgacgaaggtccgaaccccgagttgcagaatcgtgaggttaaccgcaaatccaagtgatgtggtcatgatataaaacaggaaactgccatttggcgccaaaccagaggccccttttgaagccgtaaacacgccgataaaataatcccgaccaagaattaacataatgatgccgaagaaaaatagcattagaattccggtagcgaccatgttttcattgaagatcttgaggaagccgggtagttcaatgtcttccagccgccgtgcctttttcttggccttcacttcatgcgccttaaacttgtctgccagccacgatacgaaggcaatcccaaacatttgttgatgcgcgactgcaaacccgccgccatcggtcaaatcctgggtataacgcacggtcatgttcgaaccaactgcccagtaaagtcccaagacaacgcccatcacgagtaaaacttcgatccggcccatttgcgggaagcaaaacagcagaatccaaaacgccgtggctgcttgttgcacctgcacattacctgtcgtaaacaccgcgcgcagtttcgtccatttctggaaccgtaccagtaaaatattgaaaacaaacgcaaacaatagtaacaacatgacatcgccaaaagttcgaccaaatgtcttgtctaacccttccgtcacggcgttttgcccgaagtatgggtcaatcaccgttgccgttaagttgaaccgatcttttaacccggtcagaattggtcggaagctgttgaccaagccgccagacccaaccattaagatcatgtagccaatcaccgctttaaggaaaccggcgatggattcgtataatggcttacgttccaagatgtacccgagtaagacgataaacccgatcatgtaagcaggttgcgtcaaaatatttgccgcaaaataatcccatacgctcactaagaaatctagaatttgctgcatgatgtgctacctttccccttcagctccccgcgtcaacaatcgccttaaaatcatcaacgctattgacggccaacagttggtcaatcaatccttccgtcattaacaagtcggaaagatccccaatattttgcaagtgctgctctggatcctttgctgctaacgtaaagaacaattgcgcctgtttttccggatcagctggatcgaaaacaactggcgccgggaatttggcaaacccaatcgccgtccccaaaacattttcgctttctgccatcgcatgcggcatcgcaacgccgggcacaatcacgatatatgggccgttcttctcaacattgccgataatttcatctacataacccggcaaaatgtattgatgctcaatcagtttaccggctgcttgttgcaaggcatcgtgccaatcttttaccggttcgggccgaatatcgaccaaatccttgtccaaaaagtctttcagtaacattgttgatccccacctcacctgttttatagaaatgccgggaatggcgtatcatttggtaccgagaatgtatcgtggaagccgcggtcatacatgaattccatccgatccttgtcatctggaaaagtgaattcaccgccgacttgccagataaacggcttgaacttgtattgcagccggtctttccgcattttccatagcgcttcgatttccttcgggtcagccataaagtttgtccagatatcgtaatgaaccggaataacgacttttgtcttcagtgattcagccatgcgtaaaatatcgattgaagttactttgtcggtaatgccacgaggattttcgccgtatgcccctaacgcaacgtcaattttgttttcgttaccatgcttggcaaataggttggagtaatgcgaatctgcggcgtggtataaattcccgcccgtggtttcaaacagatagttgacggcaatcttgttcatatcctgtggcagtttacccgcaaggtgaacattcggatcgtcttcggtcactaatgcggtccgatcaaaactttcaagcactttgaccttggtttcgccaattgtcacaacatcccccggtttgacaaccaccgtcttttcagccggaacgccccagccttgccaaatttcacaaactttttccggcccatagaattttgcatccgggcaattggcattaactgctgcagcggtgttgatgtcgagatgatcgctatgaatatgactcacaaacagcgcatccacattcttaatggcaaatgggtcaatcacaaatggctggttgcgcaggtttggctgcatctgctgcaccccgctcatccgcatcatttggtgacctttgcgcatcatcccgctaccatgcgaccgcttaccagtgccgcaccacatatcaactaaaatgttggttgcttctgccgtcttcaaccagatgccggtacatcccagccaccacattgaaaaagtccctgctttgacctgtttatccgcgatttcttcattcaaccaagtaccccattctggaaaagtgttaagaatccagtcttcgcgcgtcacgttattgatcgtcttatctgccatgatgttcctccttaaattcgtttcccgatttcactttttatgttatggaatattgattgcgcttacaacactgctatatgcaccttttgcggattatatgaccttttatgaactttatatgcatcttagcaaagacgatcggcttatttttatgaatcaaatcatattccgtattggataaatacataaaatacatgttgaaataactgccaacctaaaaaacgagccagaattctcgttggaaaaatttgcgaccatgtctgtaaaaagcatcacaatttagttaaacctgatttaatctataaaccttatcttcagaaattgtctaatcagtaccaccatccttcgtgcataaatttatccacttttactagtagatttattaaacgctatttgaatttaaattaaacaaattattcggcaaaatagggcgcgaaccgtttctgaatattttgacgattctttaagatttcattactttcgccaccacccaaaagcgcgtatgttgctcggaaaccgtctatcaatcaagtaaaatatgcgtcagttatatcaactcatttttgcttcactattttgggatacctaacttttatttacctatcgcattggttctgattggcagcaatgaaatgccaacaagaaaacgctactttagccgccactatcggaaaagctttcactgaccaaaattttcatttgacgcttgacacaggcgtcagggggttataagcttgcggttattaagaagaaatgagattattttgtctaaaatgtgatttctttgggtattttggtgttttattttcagattcattttttcttaataccatttaagagggggacgggcgtttatgaacaagaatgcgacgaccgaagcgaaacgtcactataagatgtacaaggccggatctagatggatgacggctgccattatcacatttgggacgagtttagttgttttaggcggtactgccacccagtcggtttcagctgataccaagacaccgactgcagacaaaacgacgcaacctgtcaaccaatctcagacgcagacggcgacatcaacggcaagtagtcaagcgaccactgctgatgccaaggataagacagctgagacacaaccaacaaccaccaccacgactaagcaagtaaccgcgcagtcgcaggccgcaccatcgacagctaccaaggctcaatcacaggcaagcacaacgaaccaggcgcaaccggcagcggcaactaaagttcaaaccggtacgccgtcatctggtgccaacacgcaaccagccgccaacaccgccacaaccaagagtgcaacatccacgacatcatctgccgcgacacaatcggctgcaccggctagcaatgctgcaaccacgaacgccgccaagacccaatctacggccgcaaccacaaccgatccaggaccggccaaccaagacactttgactaaaggtaacgtcaaaggtttatggaatgaaggctatcaaggccagggaatggttgtcgcagtcattgattcaggggttcaggctcacgacgacttgcgcctcagtgatgacagcaccgccgccatcaccaaagaaaaagccgaagctgccatttccaagttaggctatggctcgtacgtcaacagtaagattccatttgcttacgattacgtcaataacgacagcgtcaacaccgggaccacggtggctggctctacccacggcgaacacgttgccggtatcatcgcggctaacggcacgaccgctgacggcgcaaccggcaatgaaaaagccaccacttacgtaaaaggagtggctcctgaagcacaaattcttgcgatgcaggtcatcgatgaattcgcggatgaaaatgctaatgatatttcgcgcgcaattcgcgatgccgtaacgctcggtgccaacgcaattcaaatgtcactaggcatcggcgttaccgagcaggatctcactgacgaagaacaagcagccgtgcagtatgccactgatcacggtgttttcgtctccatttccgctgggaacaatgccaacgcaggcagcattatcggttccaaaacgtccaatgatatctccacggcttactcgcccaaaaatgattcaaccatcggcgatccaggagcggcggcttctgcaatgacggtcgcagccgaaaagagtgcaaccggtgacaaatcagaaatggacggcttttcatcatgggggccaatggcggactacaccttgaaaccggatatttccgcgcctggtgataacgtcatttccacggcgattgatccaacgaccaatacccaaacctatgccactgaatcaggaacttccatggctggtccttacaatgccggcgcggctttacttgtgatgcaaaaaatcaaagcaactcggcctgatctgcaaggagccgaccttgtcaaagcggtcaaactcgcgctcatgaatgccgccgatccaatgaaggatatcaattatcctgatacttacatctctcctcgacgtcaaggtgctggtcaaatcgacgtctctaaagccggcgatctaaccgttagcgctgaaggcaacaaagacgccggttcggtttcgctaggcaaaattggtcaaaccacaagcttcaccgtgacactgaccaaccatggtaagaccgcgcaaaattacgttgtcgataccaacggcggtccgctcacgcaagttcaagacaccagcaatggcaacaccgtccacgatcagaccctcatcggcgcaactgtgaatacggacacagccaacttcacgcttgctgctggcgaaaccaagactgtcaccttcaagttatccctcgacaatactgtcgcggctaaccagcttgttgaaggcttcctcacctttaaggccggcgatacctcgcaaacgatcagcgtgccgtacttaggttactatggcgatctcaccacagaacaggtagttgatgcgtctgctaacagcggcgagtctatttttaatggcggctatttggttgatggcgccaacacaccactaggggtcaccgactcagcgtcactcagcagccttgtcaacactgatacaaccgggaagtatacttggacactggttccaacctacgtcgacaataaaaaggtttcattttcacccaacggcgatggcgccagcgacaccgtctatccatatgtattttccaagcagaacctcaaatccgttaccatccagattctagatgcacaaggccatgtggttcgcgtgttggataaggaaaacaacacgaccaagtcctacttgcaaaatggtaatacgtataactccgatcttggcttgagcacggatatgcgtctcgatccaaatgccttcacttgggatggcaaagtttacgaccaagcaaccggtaaatatgtcactgccccagacggcaaatatacttatcgtctggtgaccgaacaatacaacaccggcgctcagcaaaatcaggactttgatttaccggtcaccgtggatacggttgcaccgactttgacaggtctgagctatcaaaacggtcgcgtcaccgttaactacaatgatcaaggtgcgggcttcaccaagttcagtgacatcgcgttgaagatcggtggcaaagcttatggcgtcagtctgaacaacaacggccagaataacgatggtaccttgagctttgacctcaccgcagcccaaaaagctgcacttgaaagcagcgatggcagtttaactctgacgctaaccgatgtcgccggtaataaaaccagcaaaacgctgcaggcggtcaccggtacccaccaagcaacaacgccaacagcaacaaccgccaatgtggcaccgcagttcagctggaaagttggcgatggcccatacaaccactggcgcacagatggcttcgttcaagcggtatccgaccaaaccagctttacggcctatgcccaagttccagctggcgttgattggattgtctatgccaccgacgccatgactggtaaagtcttctccggtaaagttgacacgaagaccggcaatgtcacctttaacttaaccgcatccgctccatatggcgactttgtgggtaccgtcctcgcgccaacagctgattttggtacctatgaacaagccggccgcgctaacggagatgaaatggtcgtcttcctggatacagatggcaccgcgggatatggtcacttcagccagaaggatcctcacgtcgcggtaccgctgcaagataacgctaaagccgcggctaatgtgaaaacaaccagcggcgccccggtactgggtggtcgtgccttttctcaaatcaccacccacgcacaaccaacggaagggctgacgtttgataaattcaacgacaattccttcaccttggtcggcgccgataaagtagctgacatctacaatgccaaaacaggtcaattaaccatcaccggtcatgttgatcagccagccggcaagacgttaaccgtcaccagtgctaccgagcctgcgaagacggtcacgattggtgcagacggaaaattcagcttcaccgtgccattcaaagccgcagagcaacaagcaatcggctatcgattgacttcccctgccactgatggctccaaatcgacgcaaaccgcgtatggcgagctgcaaatctacctcgacaccattttcccaacactgaatatgccgcaagctgatacgttgcaggttgatgacaaaggcaattacgaaatcaccacaaccagcgacaccttcaccgtttccggaaccgttaacgacaacatcaatggctaccgtctctacacaaacggcgataacattgtgcaccagaagaatctagctgggttcaacaaccacctcgatccgctgtcaacgacttccaacccatacggtacggccgccttcacgcaaacctatcaattagcagacggcgacaattacttcaccatcaccgcggttgatatggtcggcaataaagtcaccaaggtcttccacgtgattaagaccaaggcaacaacgccaacgacgccagaaacaccgacgacgccaacgccgacgccaaaaccaggcacgggcgatcaaaccggcacggaaaatcctaaagggcctaccactactccgaaaacggatgagcaaggcaaaaccaatccgacaccaaaattcgttgatttgacaaacaccaccaagggccaagacaaaaccggtactactgctgaaactggcaagaacaccaaacaaaccgccgcagccaaaaccatgccgcaagctggtgaagcgcaaagtccactggctgttcttggccttgcaatcctaagcatgctcggcttggcaggattcgtatcacgtaaaaagcgcgtctaagccaatcaatcttggttaaggttgaataggaaaggaaggagttgagagtatgcagcccgtcaccattacaaatcttgatcggctcttaacggcgctgattcaagccaaacaacgcggtgacctggagcaaaccgttattgactgtctgccagtcgagcccggcgatgcccatattttcggcgtccgggcagacaacggtgaaatcaagtcactcatccacttccgctttgatcaacctttgccttccgattatgctgccgtactcaagcgtcatggatttcagcttactgttgagcattttaagcaagcgccatgagtgaatggcagcgcattgaggcgtagattcggttgggatgtgttttatctgtaaattaaaacaggcattgtaccagtgttttgggctggtataatgcctgtttttttgctttgcgagccttccaggattaggtgaaatgaaaataaaacgattgattttttacatacaaaccatttttgcatcatcaccgcgttacacttcttaacgcgccaccagcggcaccaccgccccaactaaattcgcatcgttgcgatacttagctgccacaatctccggaagcttaatcgtcctcgctgcaagtggcgttacttgcagataggtagcaacccgtgcccggatttcgtcgatgacacgtgattgaacgctaatcccgccgccgatgacgatcttttccaggtctagaacggtttgtatgttgtagatcatcgccgccacgccttgagtgaaggtggctaggattgcagcggcgggtgtgtcaggcttgagggttttaaagacgcgtgggccaagattgtggccgcgaatgtgttgggcagcagccatggcgttgacggttttgactgctgagagtccggcggcggtttgcgcacgggtgatggggttgaggccgttggtaatcatgaaactcggctcaccgctgacatcatggctgccggtatagagtgtcccgtttaaaaacagtgcggctcctaccccagtcccgagcacgatcatagcgctgttgatggtgccggcgagcttgccttgccaatgttcggctagggcagcagcattgccgtcattttcaatcacgactggtgtgtttaaatgagcagcatccttaagtcgcgcagccagtggcattgtttctagaaacgggagagcggcacaggttttgacgatgccttgctgctgattgacgacacccggcaaggccaacccgacgccagcaatttgtccttgatatcggtggatcagcatcgtcattgccgccataaattcagcccgactgttgcgcgcggtcggctgtttatgtttctccgcgagctcgccttgctccgatactaacgcatatttggtcgaggtgccgccgacgtcaattgccaagtactgcttcatggtaatcctttcttccacagtgcacgattgctacttaatcggcgccttgattcgtttttcatacgcatccagccatgcttgggtgactggcgtaatcgtggtcgtttgattcggaccgggatttgccatgaggatcaccggtttctggctggcagtggcgacgctgaaggtaaattccacattcgttgcgactccccaattgccggcgcggtctaaagcgatgagcgaaaattcaccggctttaccataacggcgctttaacttttcaataaacggataaaccgcttcatcgcaagcttcttgcggcgtacggccttcacccatgcggcgtacgatttcgtaggatagacagcctttcatgatatcttcgcctaacccggttgccgcggcgcccccgatgtcactgtcaacataaaaaccggatccggacagtggcgaatcgccaactcgacccgggcgtttcataaataagcctgatgttgaggttgccgcggccatcgatcctgttggtgccagcgtaatagcgcccaccgtgtcatggccatcgtaaggtttgattttggcgtcagcaagttctgcccggcgcttttcccaacgttttttggctcggtctgttaacatatttcgcatttcgaagccatttaactgggcgtactgggtggcaccttggccgacaaggaagctgttgtaatgatcatgactgagcgcgcgggcgaccgaaaccgcatggagtacttcatggatgccagcaactgcgccttgggccaaagtgtcgccatccatgaaggccgcatccatttcaacttcgccattttcattaggcaaaccgccatacccgaccgatttgtaataagggtatgcttcaacggttttgatcaatgcctccactgcatccccggctgtgccgtttgcttgcagcagctggctggctttcttcacgccatcgtgggccatgcgccaagtggcaatcacgccccaagctgtttcgttcatttatccatcgctcctaaccgaatcatcgcattcatatcaatcatcatatttaacttgagatcgtgctcatccatccactcgtccgccttatgcgcaatgcctttttgaccgggaaaagagggcccgaatgccacaatatttggcattttacgggcataagtcgccccagttgtggtgaccggttgaccctctcgccccgtcacctgttcataggcttgcgtcaatgctgccagccgcggatcgtttttgtcatgcaggatccccggcatgctgcgaatcacggttatttgggtgcggggaaaaacggctgcagtcagcgcgcgggtgacgtcatgctcttgataagtcacaggatagcggaccgccactcgcagactgatgaccgcgccgattttttgcagctgataaggtgtcacaatcaatcggccacttgcggcatcggcaaaatccatccctagcccttcgccgtggtgctggttcgccagcgtttgcaccaaccattggcaatagttggcaaactgtccgtggatcgcgtgttcgtctagcaattccttggctaaggttgtgatcgcatttttacctaactctggggcattgctgggcgcgcggatgccactggcagtatagcgcttgtcattgatcgttgcttgcaggtggtcaggcacatgatcgcttgcttggtcgccggtgatggtggctactttgtcgagagaatcatcggtgatgggcgtgcgcaggttaaaattcacaatgccgcgttcgccatatacaaccggaaatttgcagtctggcgtgaaaccaaactcaggcggggcttccttggcgagatacaaagggacatccgccgaaccgctttcttcatccgagcctaaaatcaaccgaatcgtccgcttaggctgaaaaccggcatccttgagcagcttcatcgcaaataaacaggcaatgcttgggcctttgttatcgagaattccccgcccatataagcggccagccttttccgaaaggtcgtatggtggaaaatgccaatccgtttcgcccgctggtaccacatccaagtgaccgacgatgccgatataatgctggtcatcgtcaccccactgaatatacgccattgccgaattaacaatccccgttttaaacccataagcctttcccagttctgccgcagcggttaaagccgcccgcgggccccggccaaacggtgcatcggcttgttgcgacccgcgaacacttttaatttgcatgatttggcgcaatgcttggataaaagtcatccgttgcgcctcatataaagctgctagcgtttcatttttcattcgcacttacttccttaaattcacacccgatcccgcgttaacgtggacttaaacgaatatttgtcagcgcgatagtacgaaatatcgtaaagaatcggcttggcatcggcagtataggtgacggaatggacgagtagtaacggatcgtcttttttcccgtggagtaatttgatcatgtctgggtcgatcagcacggcttcgacttcctgatgcgaataggcaatcggcacccgcttttcaattaaggcaaaaagcgagccctcaaagtcgtgtgcttgcaggccttcaatgtattcatggcaaattgcaacgtgctcaacggtcatcggttcttcatcccaaaaccgccgtcgcacgagcaggtcaacggttttgtttgcctgctgatcccgtcctagcacgcgcgcaatttcttccgggatcggatccagcgggccaaaactcagcacttcggtacgactcttcttgccatatgcgcgcgcggcttcggtaaagccttgtaaccccatgcggccgctttcgactttatcggtatacgacatgacataggtgcctttccccggtgacttcacaagtaattgctgccgaatcagtaggtcaatcgccttgcgcaccgtgagtcggctgactgcgaactccttagccaaatcatattcagatggtaagcgctggctggtagtgtacaccccgtcacgcacacggcggcttagttcatctgcgacctgttcaaattttgccattcgttttagcctccgttttctttaacaacgcttttcgtaggttcgttgacgttacgttcattttgtcatggttcatgggtgaagcagcggctgctttaaggccacttttgccgttcattcacatgcgacaattgcgcgcgctgctgcgattgtatgcccttccattttttgcttgtttttcacgtgctaccagtttatgcttagtatgcattgaatagtatatactacaagttttattttttgaagcgcctttttcccatgtatcatcgcgaaaaatccggtctgctaaattcactcgtcagtggtctttttacgcatctgcacgcaacctcgtcaaaaattaaataaaggaagtgtcatcatgctgtcatctgcccatgttcctgaagacaaacgctcgccgcttctagcgcttggcatcttatcgatctcattcttaatgtcggttagtaacgcggtttccggaactatcccgctgatggaaaaatatttttccgatgtttcgcgggccaacgttgaacttttaatcgtcatccctactggcggcgtcctactgggaacagtgattagcggtctggtttctaatctgctcgggaaaaagtatacggtcatcgccgggctgacgatttccatgatcttcggcatcatcccggcgtttattttcaactaccctgccattttaatttcccgggcaatgtttggcgtggggatgggggttttcacgccgctcagtgtgtcttacatcacggatctgttccctgaggagacgcggaatcgcctgctggggtggcgtaattcggttggcgcaattggtgatgccatcatgcttttcatcgccggcttcttgatcaacattagctggcacaccacttacctagtctttcttttcttattggtgccgattattttagtcatgtttctggttcctaagcgctacgactacatcgtctcggaaaatggtaaagaagtcgaagaaactgccaaggtgaagccgacaaccaacggcggcgttattcagctggccatcgtcttcctattcgtctgcttgttctactcggctatttcgttaaaactcgctagctacatggtggataatcacgtcggtagcgccgccgcagccacccatattttcggctttctggtattgtgttcgatcatttccggcattgcgtttgaaaaaatcgccaaatggtgcggcaagtataccgtagccattttcgatattgtgaccgcccttgcgatgatggcagtgccgtttgtccattcaattccagccttgttggtactggtgttggcggctggtttttgcaacgggatcatcaatccggccttaaccgcgcgcatggtccactactcgcctaaagggtccatgaacttcaccacttcgattatcatcatcggcatcaacatcggcttcctcatcgccccttactttttccagttcttcggcagcatcattggcaatgccgaccctgcaaccatgatcttgtggagcggtattttctatatcttgttagccgtttacgacttggtaatcgttaaaaaagaccgcttaagcatttgatcgcaaagattaggagccgctacttatgaacgacaatgttacttggtttaaacacgctaaatacggcatgatgattcactggggattatattcgctgctggcaggtgaatatcgcggtgagtcatcgagtgcctacgcagaatggattcagtccaaatttcaaataccaaatgtcgaatacggcaaacttgccaccgccttcaatccgctttactttgatgccgatcaaatcgtggctcttgccaaaaagtgcggtatgcagtacctggtcgtcaccaccaaacaccacgacggctttgccatgtatcattcagaggttgacagctacaacgtatacgacgccaccccgttccaccgcgatgtgattgccgaactagcccaagcctgtcatcaagcaggcctcaagttcggtctctattattcccaagacctcgattggcacgaaccggatggcggcggctacaaatcaaacgacctcgaaacagccggcaccacttgggacaacagctgggacttcccggacgaaacacagaaggattttgaccgctgcttcaatcgaaaaatactcccgcaaatcaaagaaatcatgaccaactatggtgacatcgccacagcctggttcgatgtcccgatgaccctatccgaagcccaaagccaaaccatttatgataccgtccgtgccttgcagcctaactgtctcatcaactcacgcttaggcaatggcaagtatgattttgtctcactcggcgacaacgaaatccccaaagacaaagctgccatgacccaaaccgatgtcgactataacgacatcaccggcttcaaaccgtcaccgctggggttatacgaaacagctggcaccatcaacgactcatggggcttttcctatcacgaccagaactggaaaaccccgcgcacactcttccgctacaaacaacaccttaacgattttggcatcaactatctgctcaatgtcgggcttgatccgctaggccgcgtgccgatgatggcagaggagaatttgctggcggctaaggcgttggaggatgaagctaggatttaggtttggtcgaccttaatgattgcttgatgcgaggttctgcgcatttcaaagtttaaaaacacctaaagtagaagataagccataattccggcttggtaaccatgactgatcagattccgaaccagtcaaaaatcgatgttgggagtaccgagccaaactcctcaatctccggcaagatggggtggcgactcgaagctagagctgtgatggcacttttaactcgcaaagaccgcgatttcaaagtctcctaacaataccagacgggttgtttccactgctgaaccccatctggcctacatttgctccgccttggcactaaaaccattaaagcccattcaaattaatgtaatgaatctaaaaggcgtactattttctcaatgagatgtcaaaaaatagtacgtctttattgtgtagatatgaattatgatccagcctcttcgtttgcattcccgccaagtggttcaggcattaaagatcctttaggcgtcatttattgatgtctgaatctcacacaggctgtgttgcgcgaaccaaattatcaagagatgctcatcttctgttgaaccgcagcattagcatccccataagtttaaaccaatcgtgaataagccgtaaaaaagcgatccactatacgaaaatagaatcgctttgctttacgccaattaatggcggtgttaaagcttcttaaattaattcgaatccttcacagtagccagtgttcgcagttgcgatgtgatctgttctgccaaattaagcatcgtatggtatacattcgcctgcacttcaattggtttcggaatgagaacaatagatcgcgtcgtttctcggggcttggaaaaaacaatcttcacttgaacggtacacaagtgtttgcctttgaccactatctcttcattcaatgtttgaacgacttcaatgctgtcatagggaaaatactctggcttcaagttgacggcagaaaagcgtcgattgttaggtaaacataagagttcatgttgatcatcaaataaaacatagccgtttattcgacgtgtgatcataaagtttgcgctatcggttatcattttttcctgtggtgcttgttgtaccacttgcttaagatccgccaaagtcatgctggtgactgtcttagtgtagtccaaactagaaatcctgtaacagtatttacaaatatacccatcagcagttttgaatttgactaggcccaattttttatgacagagaagacattttctcaacctcttcatctccagtcctcaaggcgtcgcttatcaagagcgttgccattttaaggtatttctggtattgcacatcgtatgcttgcttcaaggatcggtcaggtaaaatgaccacatcatcttctgcttgcgcagttacgttatcaccatcaccgataagtgctaacatgacggcgccatcaattgcttctcgttgaaccgttcgtttgtgtacaggcaatccgaagacatttgcgaaaattgttagccaaagtgtgctcttcgccccaccaccaacaatacgtataaagttagttgccgcacaattgcgcatctgctcgtataactggcgacatccaaaggctaatccttctagcacggctaaatacatattatctttagttgtttcgaggccgataccgataaaagcacctcgcaggtttggatcggcatataacgtcttttcaccgttcaagtgggggaaaaacaaaactgtgttcttccccagcaatcttcggggaatcttccgctgttcggcatcagcatcctcggtattgataattgatctcaaccaccagtcattgagaaccgcaccagtttgcacgacgccttgtgtcaagacactttcgttttctgcgtcaactttgaacatgatattcttgccaatctgtttcagttggtggcggcgattaggcaccacgacgacgccagaagtcccaagcgaaatcaacggttgctgctcctgatccgtcttattcgctagagcagttgctgcattgtcaccggtgccggcaacaaccttaacaactgaaggtaatcctagttgattggcaagtgaaaactttaattcgccaataacatcacttgaagtatgaatagtcggtaaaatacgctcatcaatcccgaattcctgacatattttggttgcccatcgactttgtttgaagtcaaacaacgacgatgtcgaagcatcacaataatcagttgaatagtgccctgtaagccgataaacaatgtaatctactggcatgagtaaatgctgtaaagctttgaaatggcttggctcctcacgttttaaccaaatcagatttacgagcgggcttcctgtggaaacaatcttagcattttccgattctctaatgatgtttagctgttttttcaaacccactaccagcgccttagtccgtgtatcattccataaaattgcgggacgaacaatgttaccgctttgatccagaaaaacggttgtatgcatttgtcctgtaatcccgatggccgcgatgctgtccgaagaacgcgcgtgttttactaattgatgtagcccagttaagacaatgtcaaaccagatgtttggatcaatctccctggctccgttcgctgaattcatatattgataggtttgctgataaccgtgttgcaaggaaaggtcctgatcaaacaaacccattttgattgaggaggttcctaaatcaatgccaatatattgcttgcccaatgatttcaccttcctgaggatcgcctaatcaaacgtcaccatcgtcttcagcgtttctggcagcatagcatattgaaacgcgctttcagcatccgtgtatgggaacgtcttatccaacaacggccgcagattgagtgcttttttgcttataagctgagttgctcggaaatacgtttctctggtaggactcacggtgcccttgataaatttttcgtgtgcatgcacggcaccgagatcaattgaaacgggatcgtctggatgcatcgaactaaacatgaaagtttggccgccattggctgtaaaggcaatagcctgtttagcaattgccggcactgcggttgtattaaagacaacatcagcaccgcgaccatccgtttcattcttgactaacgcaaccggatctttctgcataggatcaaaaacaaaatctgcccccagttctagcgctaatcggcgccggttttcattgggttcgctaaccagaacgcgcgctccctttaacttcaaagtcatcacgtgtaacaaacccatcacgccgccgccaataaccaaggcatcttggccaagctgcacgttcgcccgttcgacactgttaatcacacatcctaaaggttccgtaaaggccatatccaggaaagacgtcgtatgaggatatttgaacaagtcagttgtcttaacggccatcaactgagacatcccccagaaacccgaaatgccgtagtcgttgtgaaatgttggtgacgagtatatttccgtacataaatttggccggccagttttgcaataatagcattcaccacagtttggcagaatatatttcacaacgtggtcgcctacttgaaaatgcttgggattaacagcgttgccaactgcaataatttcgccgctgaattcgtgaccaccgactcgcggataagtccattttgtatcacccgtataatcgcgaacgtcattttggcataatccattggctcttatcttcattaaaatctcatcaccttgaatcactggatcaggaaatgatttgatttcaatctgttttggcccattttctagtactgcttgcattttgataccaacctttctaagcacccaatatacctgtccagccacctataatacctattaaaatcatgatccctatgatcttcaaagaggaccagccgcgtttgagcatcagtaagatcagcagggtaaacgcaaagggcagaatgttgggcattaaaacgtcaagcaattgtttctgaatactgaacgtttgcgttgaggtaacaatcttaaggggcactgtcattttgacatagcttgaaatcaagccccccatcaccatgcaacccataatttcagcacctctaagaattcgatctaagatgcctttttcgaggaaatccatgacagattcagcaccagcgcggtagccaaacataaatgtgccataactgagaccccatgaaatcccgaacatcaggacgaaataaatgatggaaccccagatcgtaccttttctattcatatcaatacaaatagccagcaagattgggatcaaaacaccttgatagatcgtatcgccgacaccagacagcggacccatcatcgatgtcttaaggctcgttatgaagtcaccaggaatatcctttccttttgccttctgttcttccattgcaatgatcatgccaataataacagcgccaaactctacgtgaacattaaaaaattcgatttcgcgcttcatcatatcttttttcttctcaggttcattgttataaaacttcttaacaataggcgtaaagacatgagcgatggcttggcccatcatccgctcatagttgtaacaggtctgcggaaaattttcccaaatgagccaagatttaatcaagtcaccttttgttaacaagcttttgctatcttttgcggtcacctgcattttatcgtcactcatagcttgggcccccttcatcggactgatcctgattcttcgttacctgaacataaacaactgcaacaagcgcagcaataacgccaagtggtagcagacccaaaccggagtacgttgccagcacaaacccgatgtacaagaagactcgcgaatcgcctttgtaaatgtattgcagcgtaatggcgaccccaagcgctggcatcataccgccaatcactttaaagatggttagaaccgtgccgcctaatgccgccacaaaaccagaaatgtaactggcaccgtagtatgctgccaatccacacggaatgatggtgattaaagccgtcaacaattgcgggtacaaaacattggctcgccaaatcttgtgatactggccatcctcaatatagtgatctgcaacatgcacaaagattgaaccataggtcattctcgcataccaaaccaaggtgcccagtagtccgatcggcaccgcaatggacaaggcagttttcgcatccaacccacctgtgattgaataagccgtaccaagaatccctgataaagccatatcggctggcattgacccacctgcggagataaatcctaaatagactaagttaatggttgccccaaccatggctccttttaaaggatcgcccaagatgacgcctgttaataagccacagacaagcggtcgctgaatcgtccatagtccaacaaagggcagattcccaatcgcgataaaatacaaaaagccacagaggaatgcttgaaaaatgctcattttattctcctcctaaataaggttggtaatttcaattaggcgttgttcgggtaccaactgataaaaaacatgcacctcttttgctacaagtttcttgatagcatcaatttcggatggatccgcagcaacattcttaacaaagggcttacgatccccgcgcaaacccattccgcctaggttaacttgcggcagttgaataccgttttccgccagttttgcgtaatatgttggcgactttgtcaacagtaagatgcgttccttctcgttgttgtctccgttcaagtaatccattgcttctttcacattcattgggtcaacacgaacaccacgtggggcaagcgttttcaatactcttcgttgaaaaggatccctggcaaccgtatcatctacaatgatgatgtgattaatccgataagtcggcacccatgcagtgacaacctcaccatgaatcaatcgatcgtcaacacgcgcaaatgtaatctctttcatttcgatacatctcctaatcattagtttccttagttaaatgcttattgacatcaataaaggttgatggcgcctctttaatcaacttttcgcagattgcttcacgaccattatttggattactcctcatcataaatgcttcaagcagcataggtagattcatccctgttatatgtcgaatatcatacgtacccatcaacgacacaactgtgttgaacggactgccgctaaacaaatctgtaaaacagatgacttcttcagttgaaccgatttcgtctaaacgcgcctggatctttgctcgcagcgtactgacgtcttcagtgggttccagcccaaaagctttaacacgctcttgtttgccaacaatcatctcagcactgccaagcattgcctctgctaaattgccgtgtgaaaccataataaattgcattttcccatctcctgcattctcaatctaatatttgtgataactcctgaatgaagtaatcaaaggtaggatgtctctttaagcgttctacaaatgtcgcatcttgaattattttcccaagataattccacagctgaaatactttcgcgttattcttttcaatggcgaccaggataaccaaatcaaccttattaccatctgtatcccattcgattggatgcttgagcaggataaccgagacaaacgtcgcaatcggcaatgggcttacagggtgaggcaatgcaactgtgccgccaaagtaactgcttccaagttcttctcgaaggcgaatagctttgtttatttcagtcgtcttaccagccactgcgggtgacgaaagcgttatcaaatgatcaacaacctgatttttatcatgaagattcgcataatcaaacctgccttctgaaaataagttgagaatttcctctttggtcttaaaaccatcaatggctaatttagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagtttccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaatttaattttcgaatattcgttttcagctggataataactaattagaatcgcgccgagtgcatcagtcaaatccgtttgctcagttgtaaaaatcacatcatagtcctcaatagatgtatctgataagtcggtgacactaaccattgtgagtaccgagatttcgttgttgaaccacgttgcaaagcgctgccgcaacaaaacactctcactgcgttttaaactggtgacaaccaacactttctgtgatccagaaagatcgttgtatctaatcaagtattggttaaaataaatagccagataggagatttcactttcttcaacctttttgccaactttttgctgaatcaaaagacccatataagcagctatgtcgaaagctaatggaaatgatttgcgaatttgatctagtaaaacgttgctgttttgaatatcgaatttcattcgcgtgatgagcggcatgagatgtaacgctaaagaaatgcgtaaatcaatttcttgcgtaaaatccacgtcaaacttttctttaatgtcctcgagggcgctcacaatgaattggtttatatctgacggaacataatcgtcattctgataatcactcttacctcgcagataaatcgccaagttaagcaactctccgtcagaagcttgaaaaccaaatcttttctctaatccggcaaagatttcttttgccacttcaacctcatcagcaaaatagtgcagaaggtgaggttttgctgtgttcaacgaaaagcctttttgaatccgctgaatggatacttcaatgtgaacaatcaagttttggaataatgtgtcggaaatatggtaatgatgtgccatcagaacgttaaccagaatccgttcaatatcttgccgataaggtgcttgcgtaacataatgctcgttttcgtacaaacccatcttggaaagacaacgccgcatgtttctctctgtaccaatcacttgaatgccattttgggaatctcgattaatcttcagttcaaacggttcgattatacctgccattttgtttaaatcagctgtcaaagtagatccagaaacgaatagacgattttcaatctgagtttttgataatggtcgcttttgttgcagtagcaaccgacaaagtcgcttgactctgcccgactgatctaaatgagatgtgctgtgagggcgtaaaaattcactttcaaaagccggaacatctttaacaatcaatcgagaacctaaagagcgcttagagattagagcggcgctttcattttcagctagctttattcgaattttcttgatatcagtttgaaccgtgcgcacactgacttgatacttttgaacaaaataattcgaggttaaagttttcggggcgtgccgataaaaatcctttagcatttctgcttcccgactattcaacacgctgctcaccttcctttacctataaagccccaactttctcgccattaacttctttgatgatggttttggcagtctcgataacgttttggatgcctttagtggccaccccataaagattgaattcattgtggttctcatcatatgcttgaccaaacgttttaatataggctttgcgtaagtctgatccataattaatcttgattagatgatgcttctttgcacggcgcacttgatcaaatggaataccggatcccccgtgcagtaccaatgggacaggcgaaattgccgcaatcttttgcaataatggaaaatcaaggttcggcgacaaatcaagtccatggacattgccaactgcgacggcgagcgtatcgcatccagttttttcaacgaaactaaggacatcttccggatgggttttggcattaatatctgacacgtgatcgtcttccttgcctcgaatccccccaagctctgcctcgaccggaacgccaaagtaatgtgcgtaatccgtcgcccgcttgacttctttgatattttcttcgaatggcagctcagaagcatcaaccatgatagaggtaaaacctgcgtcaatacagagtttgacatcttcaaagctcttaccatgatccaagtgcaaacccatcggtgtcgaaacgtcttccctttccatcacttctcgcgtcatgttcgccacaatttcgggattggataattttaagttatgtgaagaaatttgaatatagccacccaatttcattgcatcaaaagctttaacaatcgcaagcgtcatttcataatttgtggtattaaatgctggtaagacaagctggttgcgtttggcgtagttcataagtgtatatccattaactaaatccatcatttttacttcctttctttacatccttaatcctaatagaaagcgcttacttgagtacgtcaataaattgcatgaaggttcatgcaattgccgactgacgcgtaaacgaaagcgatcctgttcatatgtgatcttttcttctccccgtgcaagtgacacagtttaaaaaaggcctcgacaatcccggatatatcgggatatcaaggccgctcctattgaggctatctttgggaaacgtatacctataatacgatgcatgtcgtacatttagtttcactaaaattcttgttttagtgctatttcagctcaaatctgactttagcatcgtaaagtggtttatattgatgctcataaacatcaagaagcgtgcgaactaacggcgttgtccgcggagagaatcgatgactgggtggttgagcgagcagacgatttttctcagaagtcgtctgggcgatcatatttgcccctcgtgaaactgcttcaggtgttgccattgccaagacatctgcatccagcaaatcagcttttaattggagccaaagaggatctttgattgcaggtccaataacttttatagtttgcaaccgttgattggttaaacattcaaccgcatgctttaactcaaacgataaccctaaaaacagtccaaatatcaacgcctcttggtcaatttgattcgcaagaccataccaaagtccttttgtctgtgttgattttttcggactaccactaccactgaaatgcggaatcacaaagttgatcgcttcagtgggcaactcctcagctaagtagcgcttataagctgaatcggccaatgccataaaacgtcggctagttagttggtgacgctcttgaaaccattgaatgacagaaccagctgatggcaatgctgtaaaaattgtatatagatttggatctaaataaacgccgtatgcgatcccttctgcctcttgggttgcttttttttctaacgtatctgaaagcagtagtattccctcggtagttcccgtagaatcaagaagttcatgcgttgtttgtccacttgagaccgaaccgaccatatgatcatgccctgcaattgtaactgccacctgatcagatagaccaagtgttgttgcgatagcaggcttcaaggttgcaatcttggtacccgatggataaggctgggggaaatcaacattttcaattccgaaaatttttttaactcgactcgaccaatgctttttctgaatatcaaagaccatcgtgcggcttgcaattgaatattctgtagccctaacacctgtcaattgataaacgaggagatccggaatgcataaccacgtatatcgtcggtttgcatcaacactatgctcaagcagccacttgattttgctggcagaatagtgcgcgtgcggtggcaaaccgactacctcatatatggtctttttttcctgcgaggataacctgttaataatttcttcagaacgattgtcataccaagcaatcataggagacgccaattgaccaagttcattgatcaaaacaccggactcgccaacactcgcgaccgaaatcatttgaatcgtatctggtgccgcttttactagttgccgaattgaattcataagttgtttcaataatttttcagtgtcaaagtcgacaaaatcatccactttattcttaggcgttgcaaactttacttgctgaatgggctgaatgttcgtttgctctgaccaaagtgagactttggtgttagtggtaccaacatcaattgttagattcgtcaagactatctgcctcaccaaagaccgatttctttgtcactcggtataaccaccaaataatcaacccaattaccgggatcaagccgagtgcaacaggattaaactcaaagatcttaactaaccaatatcgtagtggattcccaccatcaagaaagctcgttacggccgaatttttagcgccagaataattgacgttttgcgccatcttcgtaattgtccctgctaatgctgaggaaatatatagatctgcaattagacatggtatcccaataagaagcgaacggaaaacatctcctttagttgctaaaacgatcatggaagcgaaaacggccaaattcgctaaatcagccagcggcattgtgccattacctggcaagaagaaagcaagcacaactgcaattggggtcagaatcaatccggtagaaatgactgcaggattaccaattgccacagcaatgtctaatccgatgtatagctctccgctatttttgacgtgcttattcagccaatctttaaccgcttcagaaataggcatcaagccttccatcaggattcggaccatccgcggcaagataaacatgacggcgcctaaattaacaccaatttggagtatgccacgaacatcataaccagctaacacaccaagcagaatcccgagaagggttccaatcatcattggttcacccatgataccaaagcgcttctgaattgtctgagggttaatatggattttgtttaagccaggaatatgatcaataacccagtttcccagtaagcctatgggccaaaaagtaattgatgaaacggttggcaatgaaatgccctcaaggccaaaatatttttcgcctaatggtgctgcccagtcagccagtttaaagacaatcaccgtaatcactgcagctgcaagtattcccaaccagaaattgcccgtcacgtagtaaaccaatgttcctgcaagtgcaaagtgccagtagttccaaagatcaacatcaacagttttagtccacttcatccccaacataataatattaatgacaattgtcatcacgatgacgaaaggcgcaatgggaagcccccaagtgatcgcggatagtgccggccatcccaagtctgcattgggtagactcagaccgatgtgtttaaccataaccttagctgcggggccaacattatctgataaaatcgtcataacagcattaatgccaacaaaaccgatcccaacagttaatgccgagcgtaaagcctttgtccatttcactctaaaacaaagggcaagtatgaagaggaagagtggtaacatgactgttgcacccatacctaatatatattgaacaattttatttagttgatcggcgagttccgacatgctttctccctctattcttcaatatgctttttaatatcttccagcactttatctgcaccaattccagtaataagtggcaaagctcgaataaccggaatttcggtttcatacggaacgttcgttgttgcgacaataagatccgcatctttttgatcgtattctggcaacgaagccacatttgtttgcgtatagttggcatctaatccatgttcatgcagaaagtccattgttttctctgcaacaactgtcgacgtcgcgatccctgtagcacaaacaaataaaatcgtctttttctttcctgaatgagtcattctaatccctccaaaattgcattttgaacttctgttgctatctcagcatctgtagatgtcataaactttttcaatttcgtctgatcttggacaacacgcataattcgcttaaggatattaagctgtttgtttgactgggccagcgagagcaagaagatgactgatactgggataatttcattagtcgtccccatgacgaccatctcaataggctcagcaagaatgccaacggaaactgcattttggttaacgaactgaggatctgtatgcggaattgcaactcctattggggatgttggtaatcctgttggaaattttttctctcgatcttttactgcctgtggataatctaccgttacaagctttcgatctagtaaatttaatgatagtgcatcgatagcgccttcaaatgtaaccgatttcgtaaaatgcttaacaaaagaagatccaaatgcaatcttctttgatgtttgttctgacatttaaacctctcctatcgcacggctgttggtgaattgctgttcatgacgcaaattttatgatagacgacatcttcgatagccttttctgcgtcaagcgatacgttaacaagatcaaacctctctggatccttttgataatcctgaccagcagattggatgaaggcgcgccgcaaatcactggcaacattgattttaacgaccccgttgtcaaccatttgggcaatttgctcatctggaatgcctgaagcgccatgtagcactagcggaactgggcagatagcgtgaatcttctccaataggggaaaatcgatgttaggatcaagatttaatccgtgaacattaccaactgcaacagctagcagatccacaccagtacgttcaacaaaatcaacaacttgttctggattagtcttgttatggccttcagttacgtcgtcatcttctttaccagcaattgcccctaactcggcctcaacaggaattccatagcctctggcaaactgaacagcttcatacgtatgttgaatattttcttcataatcgtatttggcattatccgtcatcaccgatgtaaagcctgcacgcgcggcttggcggacagaatcaaaagtcttgccatgatccaagtgtaaggcaatgggtgtatccatttgttttgcgaatcggttaaccatatctttaataaatccatatccagaaacggggatgtttgtcggggcaatttgaatgaaagatggtatgccgcttttttcaaccgctcgaagtatacccatggttgtctccagattagttgtgttgaaagctcctgcgacaacgtgccgatccttaataattttgatcaaatcgaatccatttactaatggcattggttcaattcctcctatcgtctttgcaaagttgttgtgagaaagtacttatttccttttaaccagacggaaccgtattcgactggttctttttcagaaagatacactgtctgttgcatttttaaagccggcgtggaagaaggaagctctaaaagtttcccacgttccgtgccaatcgtaagtgcttcataggtactgcgggcaaagctaatctttctttttgctagttcttcaatctcattaaaaaggctaatgttgttaaaattgaccttctcaattcccggacagagcgtaatattaatgcgattttcgattaacattaacttatcatcggcaactgatcgcaatcgttctaaatacaagtactgactatcaatagggatcttgagcatatcagcaattttcgcggtcgcgggtcgtagttcctgctgaataacttgtgttgtgtaacttaagtgttgattatcgagcgactcagcgaatgacattaactgatcattcaacgagtactcaacgtttgggttactgacaaaggttcctttcccatgaatctttttgaccataccctccttcagtagaatatcaatagcttttctaacagttccacggctgacattaaggttgcgacacatcttctgctcagagtctaaacggtctccatcctgtagacttccgccatacatcatgtctcgcaaactatttgcaatttgttcgtaaactggaatcatagacgttttgtcaatatcaattttcattttcccgccatctttctattagtttacgaacatcatagaacaaccgtgtatcacagggtacctctgtgaacaagttaaatataaaagccatttatctcttatgcaagcgctttatcttttttaaataaaaaacacgttctcatattcatgaaaacgtgtacatgtttattatttaaggtacaaaatcgatttattaatcaggctttggcgatgatattggaatacaaaagcattcactgcgcaaactcgccaattccttctaaccgatctacaaggcttcattgacggcattgctaaactcagtgaactgtgtagccctaagcctataaatcacaaaatttatagcgtaattatccaagcttcttcaccaaaaactgatccatcaactgatgctgtgcattaacaagtgggcgcggtaaatcagtgaagccaaactcatgataaacatgaacggcggttttaagcgtgtggtaagtttcaagataaaccgactgatacccgacttgccgagcgtaatccaaggcatgctgcaacagacgcttaccaatgccgtgaccttgcaaatcaccgtgaacatagaacttttgcaattcagcaacaccgtgagtcgggtcatactccgcaatgccaaccccgccaagaacgcgaccattttgcgtggccacaaagtaattccgctttggctctgccgcataaaactgacttaagtgatccagtccagcatcaaaataaactgtacccgggcggtcaagatcggcggctttcagacactcccgaatgagtgcggcaactggtgcatcgtctgcagctgtcatcggacgaatcacttcttcatgaactggtgttggcatggacatccctgctttcgaaaaggtttaagcaaaatcatagtattttttcagctaattgcaaggcttctctgtgatattccacgaaaactggccagacacggaatgtttcacggggaacactctcatctcggggttattaatgattccttactatgcactacccgcccttcacaacatctaatcaaactgcgtcacccaccccgcatccgcatgggcagcaaacgccatctcgatatccgccggtaaattacgctgcagtgacagcggtaacgccaacgcctcctcacgggtaaaagtgcggacattttcggtttcgacgcctgtctttaatgtttgcgtcaccggctggcaggcaatgaaaaacttgtatacatcctgcgtgctttgcggtgcatagtcacgcttccggaccgaataaaccgcgagcagttgcgttggtttgaccgttaagccagcttcttcgcgggtttctttaactgcaatctcaccagcactataacccaagtccgcccagccgccgggaatggaccaagtgccacctgcccgctcttgcaccagcaaaaggcgatcctcaataaacgttaccgcccgcacgtcaaccttgggcgttacataaccgatatcctgatccacaaataagcgcacttgctcaggggtcgcatcgctcaattgcagcatcagttgcttggtgatagccgctaattgatcgtaacgttcccgatcaaacacatcttttgtatagtaacgaccagactgcgcaatagcctgcagttggcccaataacaagttcaagtcttcgcttggcatgccctcgcctcctgcgatcattgtagcaaaattgcagctaatgccggtttaaagcaaagaaagcttaacttaaaaagattgccgatacacgaccggcaatctttttaagttcatgcttctgacaatcatccgtggcgtctgctgatcaacaagtatatgccttccacaattgcaataatcaaaatgaaaacgaccagcacggctaatgccgctaaacgtgatgccgcggtctcaacatggccggcaccatccacgcgtctcatcaagatcctgatgccgataccgctgatagcgattgccaaaacgatattcgtgatccagagtcccttatgtttcaaagctattgcccccttttatctcaaggttttgaaagtacggtccagtttttgcaaactagcgccgattaagggaagcagtaatgtcatcgcagttgccatgtaaacaagttgcaacccaaacgccatggcgaatagattttgccacgccagactgaacagcacagctgccagaaaaacgcatagaccatgtaagacttgcggctttaaccattgctgccaccagcttagtaagagacctcccaaaaagccgagtacaaagtctgtcagcaataacatttccggtcgcgcaacataacccaagcggccaataatcatgatcgcaagcgccggtcccagaaaagtgactggtcgcgccgaggttttcttggtggctttggatgggactggcctcagcaattcgtcaacggttatttggtaaaaatcagctagctgacaaaccgtttgcaaatctggctgatgtcggccggtttcccacgttgaaacggtttttcgcgaaacgaaaagctggtgggcaacttgcgcttgcgtaagctgtcttgtcagtcgtaacgcctttaagtgattgcctaaaaccgaagtggtcattctgctccccctctaaacatacacggctcctgtacgaaaagcctagctacacttgctagcacacttgatatatcaaggttttaaaccattttacgattattcaggaacgtttaaataacggtcgtggaaatctgtttctatcattagattatcataatatcatttgcatcagaacccttggagccttcgtccgtttctacgcataagcgttaagatcgcaagtgaccacggattgtctgcttctgcttcgactcctaaccacagtcacaaagaaaaaggctggcaccgtgatttgcggtgtcaaccttttattggcctaaatggcaacgtcttaatcgttattcttgtgatgttgacgcaatttgacgtaacctagcagtccgattaaagttgcgccgagaacagctaacaccggttgagcccgatcaccggcattcggcatctgatcgcgatccttagttgacttgtgcgtgtctgccgattcgccgttgaaacccgcatgcggttgtggagtcttgtcttttggcggtatgcccggttccggcgttggcactggtggattgccaggatccttacccggctctggcgttggtgccgcctttaccaggtgatcaatggcggctttaaggttggcaactgcggcttcaaccttagccaccgctgcttctgaatccttgttaaccgcccgcgcttgggccaaagctgtttgcaagtcggcaaaactgacatcagtgtatgtctccgctttaaactcggctgctttggtgatcaagctgacaagctcggttttgtccggttgcttttcaagttgtagcattgccgccattaaggcatcggcctgttttccaacttcagcttgagcagcattgggatcattcagaaccaaacgtgccggttttaaagctgtttgcagtttggcataggaacttgcggtatagtcgctagctttcagtttttctgtcgctttgacaagtgcagcgagtgattgtttatcggcccgtggtaccaaagcgtcaatggctccctgaagttgatcggccaacttttgctgtgtcgccgcagacgttgttggatccgttagtgcctttttcgcttcatccaaaacggttgtgagttgggtaaagctgtttggcgtgtagtcggcagcatttaggttggccgctactttaacccattgttctagcgccgtggcttgcggttgttgcttcacttccagtgcaaaccacgcattgctaattgcctggatggccgcttgaatttgcgcttgggttgcatttgcatcggcagagactggtttggctgtagcaacagcatccgtcaattttgcaaaactctccgccgtatactggtcagcttttaacgcttcagcagcttcgattaactttttcaactgatcctgagtcacgccgcggtcagcctcgagtttgcccaaagcgtgcttcaggtccgcataagcttgattgagcgcatcaaccgttacgttatcaacgttgagaacttggctcgctttatcgcgttgagctgcaaccgcctgccaactaactgtggtaaacaacttcggatcgagtgcgttaatgccatcaattaaggcggttaattgtgctttagcctgatccagcgcgctcgtatccgctggcaaaatggtgatcggtgccggtacttgcggcaagttttccggaccccactgattggttaacattggatcacttaacgcaaagctgagtgccgctttcgtcatgcgggttttggctcgcaacgtgatggtcgctaacttttgatcgcctgacaagcgcttctgctggccttcattggcaaaaatcagatagagatcgcgactgttatcaccatgcgttcgcgtcttgctgaagttaaccatctgggctgtcgcttgggtcggttcaactttgactaactcgacattcggattcgtgagcggtacccgggcaaagaggctgttgacgttggctagatccttgccaagcagattcaaggtgatcgtttctcccggcagatacgtttgcttttcagcttcaagtgccaaagttccggctggtgcttgttcatccggcttcgtcaccggcgttttgcctagcttggtcatgacatagttgatgtcaaaagcgtcaatgaccccattgcgattcaggtcgccgttttgaacataaccgttgaaatcactgtcaatgttggccgttaagcccgcgtagttcataagcgacgtttgatcgtcttcattcacccgtccgtcattggtaatatcacccaacaccgctttgcttgagccatcccgtttaaacagcagcaattcccgtcctgaaacaaaatcgccgcggcttgtgcctttagggatcacaaagcggacatattgggctttttcatttttgtcaaaagtgattgtcttgtctttgccatcccacgtccaacctttgccttcacctgcttgatgccagtgaatcccatcaaggctggtttcgactttcaatgctgacaaagtaccgttaccgccgtcttcacgcggaacataagtcacatgatccaagtcgtaaacgccatcaagttccgtggtaatcgtcatcggtgttgctgattgcttaggcggcgtggtgaaccagttgctgtgcgccatcgtagtcagatcctgatcaaaaagatgagccgcggtgtcttttccttgccaagtagcgacaccggtaatcggtgatgtgacttgcggattgctcattttgacggcaagccgcagcggattatctttggaactgaaagtctgctcgttactccacttagaaaccgctttggccgttgctgcgcgtacctggaacgtgtgcttggtttggctcttcaccggcgttagcagaaattccggcttggtcagattgcggtaaacaacgccatctgccttgacgtcataacttgtcgcgtccttcaccggcttccagtcaatgcccacagttgtatcggtcgtggtctgatcattttgcttgatctcggtcggcactgctacttcatcgctctcgggtaatgcttcagtggttggatcatcagtagcattgataccgtccacggtgagcttgatcgcattgcttttaacattggtttttcccagcttaacttgtaaaaagttctggtcaatcgacttatctgcaagttgatccaagaaatcattcgtatgatattgtttattaacaaaataaacattttcgcctgcagtaaagtctttgaggttatcgacggcggtcagtttaaccgtttgtccgccaacactggccgtaactttagccggcttgccgctcgttcgaatggcaaattcagtggctcgatctggatttaagccgctgtaatcacctgtcagaggatcaacgttcacggtcaactgatccttttgcaattcgctggtaaccttggtttgggcatgcgcaccttttagatactttttcgaaatgccgtcatcttcgtaaaccgtaaaatcgtttttgccactcgccgggaaaatctgaaactgccgcttggtttggtcaaatgctttgggcgtattgtgtgcgggcgtggttggaatcacggcgccttttttaacgaaaaccggcaacttccaaatcggcgcttcgaagttgtttaagacctgaccgccacgatattccttgccggtgtaataatcgatccaaacttgctgcttgtcagggaggtaaatgccgttacgtacatcgtttcccttttcatcagccgccgtgttttggtaaatcggcgcaacaaggaagttatcgccccagaggtattcgtacttgaccagatcggtatatgcctcaggaatgttcggataatcaaggaacagaccgcgcaccattggcttaccatcaaagacactttgcgcagacgccgtgtagttgtaaggcatcagcatggtcttttgcttgttgtaagcacgattgatcgccgttgtttgctgatcaaacgagaatggcgttttgggattggcaccccagccgtccatgttaagctggatcggcgtgaaggctttccactgaaaatcgcgggtgttgacgatcggattaccgccgccaaaaattccgtccatatcggaacctacatacggctgtccggataaaccggtcccgatatacgttggaatatgaaagcgaatgtattcccactggccaccggtttgatcacccgtccacacgccggcataccgctgcgtcccggcccagccatcaagcgtaatcgcaaacggccgcaacgaatcgcctttgacctgcgtcatcatcgcatcagctttagccagaccatctaagccaaaagaatacccggacccgacccaggccacgtcagttttcagggccttgacaccaatggcaacttccttggcaaaatcacgatcatccggtttcggattggccggatcaactggcgacaagttttgttgcgtccacagcccggttgcaacgccatgctgatccgcataatccgcaaacgacttaagattttgcaagttgcctgctaaagtatcggtctgcccatagcctgcaccataaccatcgtttggcaaaaaccatcccagcggcatatcatttttctgataccgatcaataacggcgcgagcactaaattgataattattcagctccccgttcaacgattctttgataccactttggccagcaggaattttcccaggctgatattctttataatatttgccgtcttcaaacttaatcgcaccgcttgttccttcaggtaccggaacccaagtgtcacggttataggcattcaagtgtgcttcatacaggccataacgcggcatcatcgccggtgcacccgtcaagtcgtaataatctttcaataagtcatagggtttcgcatcgaaaaagtaaactgcatcaaaccgattttcctgatgcgtggtctttacttggccgtcatcgctagccccaaagtcatagttacccagcttaaacgtgttccgcaccacgccatagccagcggttgaccaataaaatggattcggtgacgccaccccgccatcaacccaattacccgtgttttcaatcttgacatttttacctgttagcgtgaaattaccattttgcgtgccaccgccaaaaaactggtcagtgccacgttttaacacttgtgtcgcatgatcgttggtaatttctaacggctgactctcggccatgaccacctttgagccctgggaaacctgcagagttgcatttgcttgattaaatccaatggcaatcgcatcggtcttgatcgtccacccatcaccgttatgatcaagcgtagcagccgcaaacgccttagctgccgatgcatcaatttccttggtaaaaatttttgcgttaagccctttttccgattgggcaggcgcagcaaacttacctgaaggatcagcataaaagcgaaattgattgttcgctaatataaacacccgtgccttcaggttgttggagtaagtaacttcaaaataatgcgtttgtttggtgacattcacaatgttgagcatgcttgtactggccttcttcaccgcgctacttttagccggttcggatcccttagctgccgttaccggaaccgtactactgacatacacgacagtcgcagtcaatgataaaactgcgctgctatataacagtgaacgcggcacccgaggccgatccttcactgtcttcattccattgtgcatcgacaaactccccctaaaaattgttgtggctcctccacgtggtcggtaccactcaaggggattgtaaccgcattcatttgtttacttcaaccacaaaatattgtctaaaagtggcgaaaatctattttctggaaatatttttcagaaaatataaactaaattattgttagggttgtgaactagatattgacgccatcgagtttcccgaagctttgccggtgcacaattaagaacaagagttatactagtagcgcttaattattaattttatacgaatgagaactgaactcatttcattcacatagtacaccatcactaaaatgttgaccaccggaccagttttgataagcgcaaaagtccagaaacttggtagcctctgattcagtttgcgttccttagttaaaggtataaaatggtgatactcaatagcatcaaaacatgattaatgccaattaaaaatatttcaaaaagaactcccattatcatttcaatgtgtttaatgatcatatatacaaaaacaccgccaagttaagacggtaaacgtcataactcagcggcagcgatttagcaaggcacgcacccctcaccattctaacttccggaggtgatcgccatgctaagaggaaagatcggagggttgggttacgctagaaatagcgttggccatcttggttttagcccaggcgtacttgatttacgccaaggcaaccaagatactaaaagaagctaaccgtaacggctagcttctaccaccagtctttctaactcgcgtcgaggtcatcgggtcgcaccccggtggcctcttttcaccttctttattttacctgacaatcaagcttgccgtcaaacaaaatccatctatcgaaaaccattttttgagattagcaagaagagtcgccccaacctatatgcatcagcctcaagccaacccgaccacgttttgctataatcaactccgtacataccctatccacaaaaaggaagattgatgctatggcggatgaatttattgcccatcctttgatcaccattaccaacgttatctggagcttttcgcgtaccacccggcagttgcagatcttgttgattcatcgcgcggatgatccttacgccggctactgggccctaccggaaacgactttgcgtgtgcgcgaaagtgctgatgcagcggcgatcaggctgattcgcgataaaatcggcgtgcatgtcaatcgcggatccacggagcagttagccacgtttacggacccggcccgcacacccggcgagcgggctttggcgctgacttacatgacatatctgccgacgatgcctaagttacggcccggttatggcgcaaccgatgcgcggtggtttgcttttagcgccactgccaacgattatcagttacaaaatggtgcgctcacgtttcagttagatcaacaggcggcgcatctggcttttgatcatgcgcggattctaggtgtcgctattcgccggatccgcaataaacttgattatcaacccagcattttgcaagtactcggccacaccttcaccttaaaagaagcacgtgaagtttacgcgccttttctcaatacgaccgcggccgccattgacaactctaactttaaaaagacgcaccagcatctttttgttgaagtcggcactgcccatgatcgcacgcgcagtggccgtccgcctaaattgtttaaacttgcctagttgaaaaatacccggaacccgcgtatcgtagacaacaaataaaagtctaatgtacttttatactacgtgagtttaagtaaattttactttaattagaaaggaagcctcaataatggctcattcaaatgaagcattgctcattattgactatactaatgactttgttgccgataaaggtgctttgacctgtggcgcggctgggcaagtgttggcccctcacattgtcgctttggctgatgaatttttgcaacaagatggctgggtatacttgccaaccgatgtgcatacaccgcacgatccgtatcatcccgaaagcaaactgttcccgccgcataatgttcgcgggacttgggggcgggcgttctttggttcgcttgcgccttggtatgcggcccataaagatgaagaacgggtgaacatgtttgataaaacccgctactccgcgtttgccggaacgccgctggatctgcgcctacgtgaacgcaaaatcgacaccgttcatttagtcggcgtctgcaccgatatctgcgttttgcatacggcagttgatgcttacaatctcaactatcaaattgtcgtccataaaaatgcagttgcggctttgacgccagctggccaggactgggcgctggaccactttgcacatgttttgggcgccgaagtaacggattaattaaccacggactgataaagaaggcttttaaagatgaatatgaatcaagcaatgttgacggatctctatgaattttccatggccaatgggtattgtgcgaccttaccgcatgaagaccaggccgttttcgatattttctatcgcaatgtcccggatcatggcagttttgttattgccgctgggttacaacaagttgttgaagcgttacgcgactttcacttcgaggatgcagatatcaaatatttgcgttcgttgaaactttattcggatacatttttagactatttaaaaacgatgaagttagcttgcacggtgacggctttaccagaaggcacacccgtctttccgcgtgagccgctgttaacggtgcaagggccgctgatgcaggtccagttgctggaaacgctgctgctcaacatcgtcaatcaccagtcactcattgcaaccaaagcccggcgcatcacggctgcggctgaaggacggccggttatggaatttggtgcccgccgcgcgcaaggaccggatgcctcggtttatggagcgcgtgctgctgtgattggcggctgtgccagcacctccaacgtcttggctgcacaacgcttcaacatcccggctgccggaacaatggcccacagctggatcgaagccttccccgatgaactcaccgcttttcgtgcctgggctaaagtctatcctgacaacagtgcgttgctggtcgatacttatgatgtgctcaagtccggtgtgcccaatgcgatcaccgtttttaaggaactcaaggcagccggccatcacccggttggtatccgcatcgactctggcgacatcacccagctagcgaaacaagcccggaaaatgctcgatgacgccggcttccccgatgccaaaatcacagcttccaatgcgcttgatgaaaccgtcattcagtccctacttaaagaaggcgcaccgattgacaactttggaatcggtgaaaagttaatcaccagcgcctcatctccggttttaagcggtgtttacaaaatgaccgcattgcaagcaaacggcaagtggcttcctaaaatcaaggtaagtgctagccgagaaaagaccactttaccaagtcataaacaggtttatcgcctgtatcactgtgatgatcaaacggcttttgcggatgtcattgcgttggctgacgaaaacctgcctgcagaaattgccgcggtcaatgccaacccgctggctacccaaacgcaagtcaccttacgcgatttcactgccgaaccgttattaaaaccggtcttccctcaagcacaagagccgctcacgaccgatgtctttgccattcaaaaacatatgcaaacagcactcggacacttaccagaagcaacgcaacggctcgttaatccggatctctatccggtttacctcacgccgaaattggcagcgttacaacagaaattgattgatgaacatcatcaaaattgatcagggcgcgtgtttttaggcgtttcttattttgagtataaaaatcaaaaactgcttcgaaagcaagattgcttccaaagcagttttttaatttcgtgaattaaacatcgccttgagctgcattttaaaccggcgccttagcttctttggccaccaagtcgcgcatatccattgcttcttcaaaacgattggtaatgatcccggtgacgtaacgttcgcgcatcagttgtttcattttcagcggatcatcaactgtccagacgcgctgggctttgttgaggtggctgttgtaatgttcaatgtggacggcttccaaatacgatggtaaggtggcgccggttagaacccgactcgttaaccaagccgttttcattttcggcgcaagggtatgaatgacgttaatactgtcgtgattgaatgaggagtagatgacgcgatcctgcatattgaactgctcaacgtaatcttgcgtcagcgcctcaatgcccggatagcggatcttgccggttttaaactcaatgttaaccatcacgtcataatggcttaaaaccgtcaatgcttcccgaagcgatggaatgtgttcgccattggccagccgcatcccttttagttgcgtccgggttaaatccgcaatccagccagtgccatcggttgtacgatcaacccgttcatcatgcatgatcaccagatgcccatccgcactcatctgcacatcggtttcaatgccatcgatgccatgctcacaggcatattcgaatccttgcaaactattctccggaaaacgcgccggataaccgcgatgtccataaattgctactgtcatcatgagcctccatttcgcatactttactgatcaaaaaccgtctgcgccaagctatatcaggcgtctgctttcaaggcccgcacatgagcttcaatttgatcgcggacttggcgaaaaaccgccaacaccgcttcttgcgaaccactcgccgctgctggatccgccagcggccaatgcaaacggcgaacggttggcggtgtcaccgggcaccgatcccgcgcatccccgcagagtgtcacaatcaaatcagcctgctgcagttcggcttctttgagcacttttgattgctgttgcgaaatatcgatgcctttttctgccatgaccttaaccgccagtggatttaggccgtgtgcttcgatgccggcacttttcacctgccactgacgccccagcaattttttggcaaatccttctgccatttgactgcggcaggcattccctgtacagagaaaatagacttttggcatgatcacgaccagctcctttgcgataatgatgtctaacgttatcttgatcatacgcgggttacggtcgttgggcaatatggatgcaactggcaacttaacgcttgtagtccagcaggttgccactgacggaattggtctttgaaatggccgtattcgtatcggcttccgcttcatctaaagccttcttaacatcggcaccgccataaatctgttgcatagccaattcaacattttgccgttcttcttggatattgctgaagaacgcacctgctgtggccgcattgatatgaccttggttcagttgttcaatcggaaccgctaaagcagggtttttcttaattgcatcagccaagctctttacttggttggctttttggttaaccgcaaaatagcccgtgccgagttgccatgttgcttgagacttaggcgtcattagatacttcataaactgccaagccccttcttggacagcggttggtttgtccttagtaatccatagacttgcgccgccaatcgctacaccattcgctttggtaccatccggatgcggtgtgaaggtcacgccgtatttaaatttggcgttcgtttgtaactgtcctaacatagcagaactttgcatgaagatgccgaccttttgcgccaaaaacgccgcgctctggttgttagcagctgctgatccggtcccaaagttttggaaggcgttttgtttgatcacgtcttgcagccaattcatacttttgaccatttccggcgagttcaatgtggcactggttgccatcgcttggcggccgttatcgtggttgacgacaagtgaattttgattggcaaccaactcttccggcagccagccatagatctgcatcgtcatccctttgaccgcacctttactcttttgagtcaacgcaaccgctgccttggtcacgtcgctatacgtcggtgacagtggcaaatcgggaataccatactttttaaacaggctctggttgtagtacataaccgagctggaggagttaaatggcatggaagctaacttaccattgattttataagcggctgtcacccctggatacaattgactcaaatcatagtggtcacgatcaatgaacttttgtaccggtaccgttgaattcaagccgatcatcatagactggttggcctgatcactttgaatcaagtcaggcgaaacattactgccgaccgtattggcatatttcataatcgacaattcataactgccggcgtaaatcggcttaaccgtgtatttggtctgactcttgttaaattgatcgactaagccttccagaaccttttcattcgggccattcatcgagtgccaaaacgtgatggtcgtgcgcccgttgttatcagcagcactggccgattgttggtgggtgaagaaaaagccaagtccgaaaataacaacaatcgctgcgactatcgcaataatcttcttatatgtggttttcaacccttcgtcccccctgcattcaaattacgcttgaagaatttctggccaataagcaacagtgccaaggttggtaacaacacaatgatcgccgtggccatcaccatcccccagttggcgaacgtatcttccgcctgtaactgcttcaagccgacttgaactggccggaaatcatccgagaaagtcgtaatcaacggccacaggtattggttccaatgggtcaggaacgtataaagggaaaaggtgatcaacatgctgcgactatatggcaccgcaattttccaaagaaactggaggcggctaaggccaagatacttaccaaagtccaccaagtcggttggaatctgcaaaaaggcttgacgcaacatgaaaaccccaaatgctgaagtgaaaaatggaatcgtcaagccagcataattgttcagccagccgagtgcttttaccgtctgaaaattaggaatgatctgggcttcaaacggcaacatcatggtgatcaaaaaggcaaagaacaactgctttttgtagcggaagttcataaacgcaaaggcataagcagcaagtgtacataaaactaattggccgatagtgattaatccggcggtcacaaacgagttaatcatatagcgaataatcggtgtggtgacaaatgcctgccaatagttattaagcgagatattggtggataagaagttccccgccgcaatatcttttgtcggtagtaacgatgcccaaatccccaacagaatcgggaataaaagtatcaccgcaaccaccgtcaataaaagataacgtgctccgtgtttgacatgtgtcatgcgtaatacaccttccgttctgtgaaatggaattgaacccaagtggccaaggcaataatgacggttagcacaatggattccgcactggccgttccaaagttgtggaaagcaaaggcatcttgataaatcttatatgctaggaaattcgtggcattgttaggaccgccgcctgtaattaagtcaatctgggcaaacattttgaacccatcaatgatttcaaccacaaacaagaagaacagggttggcgaaatcatcggaaccgtaatcttgagcgtctgcttgaattgtgaccaaccagcaatgtcagcaacttcatagtattctggcggcacactttgaaacgcactcagaagaatcagaaaggcaaaacccaatgccatccagacgctggccaaaacgatgacaatcatggcaccggtcggatcaaccaacaagttggcattggtgacgcccagcgcttttaaggcaaaactggcgaggccaacagacggattgaacaagaacagccagagaatcgaagcagcggcggcactggtgcccatcgtaccggcaaatgccgtctggaaccaactgatccggcgtaacttcatcgttgccaaacgtgccaaaataacaccaagaacgatggtcgccaaagcaaaggcaacgacatagactaaagtgcccgtcagactcttcaggaataaaggatccttgaaaatatcaagatagttaccgagtccgacaaacttagctgattcgccacgaatgttggttgcaaaaaggctgttgtacaccgtcatgaccatgggataaaaggtaaataaagttaggatcaaaagtgacggcatcaaaaaccagaatgctggcttattattttcccgaatcgttgcggcgagcttgccttgcgatttggccgtcgatttattaagttccttattaagctccataagcggccgcctccttaactggcgccacggcaatccgctcaccgtcatcaatattaaagagatgccattcatcggcattagccggcagtaataaattaagctcagcgccaaccgctacggtgaactgttccggtacccgactgaccaatgactggccatcaaagtcgcagaaaatcaaggtgtcattgccaagctgttgcaagctcttcaccttggctgtaatggtatccgggttggcaatcgaaaccggtaccaacttctccggccgaatgccaagatgataggaaccagccggcaagtcaaacggaaggacaaacgcattgtcagtccagaaagtatcgccaatgctaaagcgatcgccttcatcgctaaccgtaattggcagcagattcatttctgggctgccgataaacttggcaacaaattcattggcaggatgattatacaagtccagcggggtgcctagttgctgaatcttttcatcgtccaacacaagaatccgatcgcccatggtcatcgcttcgacttgatcgtgggtaacataaatcaaggtcatgccaatttcacgatgcaaccgcgcaatttcttcacgcatttcggttcgcaactgggcatcaaggtttgacaacggctcatccattaaaaccaccggcgccttggttgccaaagcacgcgccagactcacccgctgctgttgcccaccagaaagctcttttggtttccgatcacgcaaatcggtcaagtgcaccaagtccaacgcccaatccacgcgcttgtttttttcatcatcggttaaatcctggttctccaagccgaagcggacgttttgagcaacgttcatgaatggcagcagcgcatagttttggaaaaccatcgccagcttgcgatcttttggcggcaaatccgtcacatcgcgttcattaaaataaatccgtccatccgtgacactggttaaaccggcaatcatccgcaacagcgtacttttaccggaaccagatggcccaaccataacaaaaaattcgccaggctcaatctcgacggaaatgtcggatagtactttggtgttgccgaaatcctttgacacatttgctagtcgaatactcattcctcatcaactccttacactgagactaccaagcctttgtaaagatcagtgtcaagtcgatgtattaattatgtaagcattctgtaaaacgtatcgttccagcttgaaatttttcaatttaacgcttcatccgcggccatattcagcttgatagccatgcaaaaagcgttggtgaacgactgctattccgctcaccaacgcttttccacaaaagtaatctccactactactattcaatgccttcctgaacgaacacccgcaagattcgcggtgtgatagcaatcatgtaaagcaacgccacaatcccgctgtatacaaagacgaggtaattcttcgcgatgttttgaaacaggaacgtataaaagaaggttgccaccggggtcaccgaattattgatcgtcatcaacgtggtattgacccggcccaaaaaagaagtcgggaccgttttttggatttccacctgaatgacaatgttaggaatcacgatcaagaatcctagcactatcatcagaatcgtgccgggaatcgtcacgccactggctgttttggcaacattaaacacgccgcctaatgcgatcaaaagcacacaatccgctaaaaccggcccgagaatcttaaggcgaatccgtttctcaccactgatcgtactcataaacaaactgccaatcaaaatcccgatagcagaaccggtttccagatacccgatcggtgcactgcccagatgcagcgtattcgtgatgacaaaaggcatgccaaccgtgacgctggtgaagctaaaattcaaaaccacgccaaccatgatgacccccttaaccaatggacgcgttttgacataagccataccttgtttaaacattgccaatggccgactggcagcgtcatttttcgcggtcggctgccgcttggtcacatgaaacttcatcgtcagcataatcaaaaacgagaccgttgacgaaaccatttccacgaaaataaaggcttcaaacccaacaagcgtgtaaagtcccaagcccaacatcggtgaaaaaatcgaggaaatggagccagccgtggatgttagtgagcttaacttttgaattttccgttcattaaccaattcatggacagaagcggcataggcagttgagctgaaatcactgcatatgtagtcaataatggcaaaaagaacaaccggaacaagtttttgcacgccggaaaaccccggtagcgcccacgcgaacagccctagccccagcaaacgcaccagattgcttacgattagaatacttcgatgcggataacgatcaacaatgctgcccataggaacaaacagaagcaaactaaccagcggcccgacaattgttgataaaccgaaactgatcgccaggtgcgtttgattcagcagcatcaaccccatcccaaacgaaaacatgccgccactcaatgagccaattaggttgctagtgaaatctttaccaatttgaagattggattcccgatctgtaatcagaaccgggctggttgcgtgggctacctgcataggctgtcagcactccttcgttttcctcatttttccataataattattaatcatattataataattgctacaaaaataaaaccccgcctgcacacaaagtcatggaacaagacgcttgtgtccaggcggagcttaagccgctgccaactcaatttatatttcagtgtagtcgactccggcgctgctgaaagtcatccacgattaacgcaccaacttgttgattaaaccgcacggccgcttcacgctgatgatcaaacgttgtcaaaacaactgcatacaattgttcaccctcagccgcaaaacaagccgcatcgtgttcgcaattcggcaattcaccagttttccccgcagtccagccaacaaaattcttcatggttggtgccagcagcaacttggtacgattctgttgatgacgcagggcacgggcacaccagtcaccgtcagctggtcggcacggtggggtcaataaggatcgcaataaacgccacgttgctgcggccgagatccagttgtcattgtcggtatgcggctgcatcaaggcacggtttaatttggcgcccggaaactgctgatccaaccatcgccccaccgttgttagcccatacgttttcaacaaagcattggccgctaaattatctgaaaccatcaacattaaagtcaccaaatcgcgcacacaccaggatgaatcggccatgaaccgcagtacccctgcgccgccaaccggccgtggtaatactactttccgctgccactgactgggatcggcttgtgcctgcgctttaacataggcagcaatccccaacttaatcaaactcgccgcggggaaaagcacatcggttcgcgtaccaaaaagcacctgccgctcatcagcaagtaacaaagcgtgcgattcaccaaactgttgctgcagctgatcaagttgtgcaattaagtggtcatgcgccatttcacattatctccgatcgcaagccagccaccatcacttgcgacaagcggtgatgactaacccaagttactatcgatcatacacccacgcatggtcgtcctgccaagagccaaccaagtaacgcccaacctaatccggccaggaagtttcaatcccgaaaaattgagtcagcagttcccggcggatgtgtaaccaagcgcggtgcgtccgactcggataaattcgattagttaaacaaacaaagccacgctgcgtatcgcgatcaaatgcaatcgaagtacctgtgaacccagtgtgccaatattgatggcgaccttgagcccagcagcgccagcccaacgtccgcccaccaacacagtaacgctcaagcaacgaaaatgccgccggaggtaaaaccttctcaccatgcgacactggcaaaccagccaacagccgggtaaaagtcgtcagatcgcctaacgttgaaaataaacccgcgtgaccgctaaccccgtcaagcaaaaacgctttatggtcgtgaaccgtcccacgtaaaaccccaccgcgttctggcacattttcagtcggcacaaaattgcttggtgccactgcttgcggacaataaccggtcgcctgcatccccaaaggttcaaaaacatgctgatgcaagctggcggcgagtgacccatccactgccgcaattgcccagcctagtaatataaagttcaagtcagaatacagggtggtggtgtctggcggggcaactgccgccatcgttttgacggcctgaatcaaccctgctcgatcaagtgcatgcgcgttagggacgtcagcaggtaacccgctgcggtgcaacatgagctgttcgatggtgagttgtgggtagcgcaatccactgaccagcgatccagtcggctgatccagctgaattttccccgccagcagcaattgtagcaagcgtgttgtcgtgccgacgactttggttaacgatgccagatcataccgattctgaggcatcagtggcaaatggtcggcaccggtcccttgaaagcctaaaaaatgcacggcattctcgtccgccccgaccatactaaacgccacgccgaaaactgcctgctgctgaattgctgcggtaatcggtgccaacaacgactgcggttcagacgcttttgccatgcgctgcctcccaagcggtcaaaacatcactaatcacgccatcatgagcagccagcacttgggtcgccgcagcagcatccagaccggttttggccatcacgatcgcaaccggaaccttgtgtgcagctgcctctagcaaagatgccgcctgagtcgcgccgacaccagttgtttcggcaataatgcgttgcgcgcgatccaccagtttggcattcgttggcaacacatcaatcattaagttaccaaaaactttgcccgcccgaatcatcacgccagtcgaaagcatgttcagcaccattttctgcgcggtgccggctttcatgcgcgttgacccggtaatgacttccggaccgaccacgggggcaatggcaatatcggcatggttggcaagtaaactggcggccacgcaggttacggatattgctaacgcctttacttgttgcgcatacgtcaacgcgccaatggcataaggggtccgtccagaagccgcaatgccaatgaccgtatcgttggcattcaggttcaacttcctgagatcatgttcggcaagctcaactgaatcctcagcgccttcaactgacttaaacatggctcccatcccgccggcaatcaagcccactgctcgttctggtggaatcccataagttggtaccaattccgcagcatccaaaacccctagccgcccggatgtaccggcaccggcgtaaatcagccgcccaccgcgattatagcgctgactggcttcatcgatcgccgcggcaatctgggttgtttgcgtagcgatggccggggcgattttggcatcctcatggttaatcagcgccacgatttccggcgtcgtcatggtgtcgatgtgcatgctggcgggatttcgttgctcggttgttaagtctgcgattgacatatttatcccctcgaatcttcaactctccagttaattgtgatgttgcccgataattctgttcggtttgcttaatttcgccatgaaccacgccgagaaaaagaatattggcaacataagtctccgtaaacattgacgtcacggctccgattcgtaacaacggctcggtcggcggcaaggcaatcacacaactggccgcatcgcgcaatgggcttggctcggcacgcgtcacgacaatcaccggtgtctgattccgccgcgcttgctgggctgccaacacgacttctttcgtcagcccgctataggaaaagaccaccaccgcatcagccgccgttgtataatacacgcgctctaatgccgtgtgcgcatcggcgtcaaaaatagccagataccctgcccgaatgagttttaaatataaatcctgggcgactaacgccgacgcactcatgccgacaagataaatatgccgcgcatggcgtaatgtggtaatcgccgtttgaactgccgcttgatccagctcgtccggtaaatcgcgaactgccgcaatcgccgtctgactcaattttcgcatcatcgttggcaaatcatcatcatcctgaacaagcggatcgagtggcgtcagcgcaggggcttgcgtatcccgcaccaaggcgagtttaaatgattgcaagtccggatagtcaaacaaccggacaaaccgaatcaccgatgctgccgacacgccgctagcccgggcaatctgcgcagttgtctgagcgataaaggcctcggcatcggttaacacatagtcggccaaagcgcgattcaccggacttaattgcggcaattgcgcctgtaccttcgctaaaagtgccttcattcgactttatcaataaaagtagcaatcgaggtcttactctcattgggcaccatctgcgcagtaatggtaatcccttgcttgagtaagcgccgaataatcgcaatatcatcggcagtcaccgccactgatggcttaatcttctttgaccccggcttttcagacagattacccacattaaaagacgtgatcggcacgccaccgtcaattaacttcgccatatccggaatattgcgggtaatgacgaaaacctgatcagcggcaaacttgccattttgcaaattttcaatcgccttggcaaccgagctaatcgccaactttttccctgcaggtcgggcgatcttcagtccttgaatcgccatgtcatcacgaaccaccgcatcattgacgaccatcagccgattagcgcccaccgtattggtccacaccatcgccacctggccgtgaatcatccgttcatcaacgcgtgctgccacaattgtcattcgaatcttcctttcaccataacgtttgaactcagcatgtgtgctgatcgccgtttcacgttagtacttaacaagctggcggatcttcttttgaaaagcgtccttaaactaagctgccaatccagccgaaaatcgcgcctaagttgccgagaaccatgccgatgaggattaaaacaaaaatcagccgagtcgagttcatatgcttgcgtcccaaaatccaataagagaacaaggcaatcgccagcggtatcaaagcaggcatgatcttatccagcatatcctgcacattcatcgtgactttgccgactttataggttaaatcgagtttgtaattgataactgcaggaatcatcgcaccaacaacggttaagccgagaatcgaagcaccttccgtgaaagtcgccatgctatcggcaaaagtcgtcgccaaccgtgtcccttgagccagcccgacattaaataacttccaccgcacccataaaataaccaaacagccaattacaggaatcagcaggccaatcggttgattcgataaggccaaatatgccgtaatagaatagataatcgcattataaatcgcgacaaaaatcgtatcgccaacgccggcaaacggacccattaaccctgttttcaaaccggtaatcgctttttcattttcatcgttcatgcccaattgatcttgcaaggccacatccgcaccgacaatcaagtgtgccatttgcggggtggtattgaagaagcccatttccatattgagggcttgtttcatttttgccggatcatctttgtataaacgtttcagcgctggcataaccgaataagcgtaacccaagccttgcatcttttcgtagttccagcccagttgaagtcctaagacattgtggatgaaaatctgcttaagatcttttttggttaacttacttaatttcaactcagacatcgatctcgacctcctcatcatcgctatcaccgctgccgccattatctggcttgctcgggccattgctaccgttgccattgtgcttgcgttcgttagcatctaagacatgtaacgccgcgaagacgaagccaaccaacgccgtgcccagcaaagagaacgactttgcaaagtaagccattaacacaaagccgagaatgaagtatggaaaatatcgtttaatcggcagataccgcatcaggatcgcaatccccatagccggtaaaataatcccggccgtcttcaaaccggtcatcaaccacgtcggaatccaagcgttgatcgccttaaccaccgcagagccaaagaacaagccgacaaaaaccggtaacatccgcgaaactgtccacgggataataccataaagattgttacgctcgacgcctttataatcgcctttagccgccaaccgatccgcatgatgctggaaaatcgtattcgtcatccgcgctaaaatatccatctgggtcagcagcaagccaatcggaatcgccaacccgatcccataggcagccccgcgccctgccataatggcaaacgcactgcccatgatcgatccggaaagaaagtctggtatcgtcgcgccgccataagtagcgacccccaacgttgccaactgcaaagtcgcaccgacaatcaagccggttttcaagtcacccatgactagaccagttaccgccccaccaaacaccggtgaaaataatccgatcttcaatgagagtgcatcaagctgtgccaagccaacatagatggttagaaaaataagtgcaaaagcagatattgccatgatgtttcccctccctacaaagatttcattgctcaacctgattatggcgctatatgaaactcaatttcaagtatttgagttagataagtttacaatgaaattttgtttctaggaggacacggaaaatcgtgtgtaccaattcgcaactggtaagcccgttgcattggttaaacagccatagaaaactgtatgcggttaaagtctgcccattgccaaaatatggtagcaagaacaattaattgacggtcagaaatatatttgctattttccatatgcgagcggttacattgtgttttattttttaagggtaggagatatccatgaagaacgttctgtcgaaatctttttcagcatccgttaaattttcagtgatcatcatcccgttaatattcattcggatactttgggacaccttcactaaagaaagtgcgtcgcttcaaacctatctctaccttttcctccgcacattagctggggcttttgtcttctttttgctgttatttttaattggaaatctggtcagacatcataagtaatcccttagtctcgtctgtgggcatgaagcaaatcccctgccgaaacttttatcagtcagtattaataaacagaatgaccgcagaaagaaaagcacgggctactttcctatgagaccggaaatagtccgtgcttaatcgtatgcaataactttagcgaggttttacttcaactggaacttcaacaccaccggattatggtcagaatactgaaatccggtcgacacaacatggacactttccgctttgatatttggcgacagaatatagccgtcaatcaaggtcacaaaactttttcccggcttatacggctggtccaacgcgcgtactgatggtaccttcgccgctgccagtcccattgtcgggatataaaagccggctggtaactttgacttaggaaacagatgcgtccaggtttcgtctaagtccttggtgtgaaagatttcggcggtgtttttcaagagccggtggttataatcacctgccaccatgacgtagttgccttgctggtaggcatgattgatatatttaaataacttggcgaactgtgcctgttggattttgacattgggcgtgaaggcggacatgtggatgttcaccatgatgaattgcttaccgtttgccaccgtggttttcgttgccgtgaacgcgcgatccaagtcgataattttattgaagtcagtgtccaccggtaaactgtagcggcgggcgctatcgactttggccttactcaaggttagaatcccggacttagccttgccgatcggttgattaaacgggtaaaacagatacgccgaatcgtaattctggccgtaaacgttagcgtattgccgttgcgcattcgtcaccatctcgacttcattcacatgccgcgaacgatcgccatccggatcaatttcctgataaaaagcgatgtccggcttctgcgcctgcgtggttttgatcaccccattgatgcttttccgcacggcttgttggctataagcacgcgaatacttaccgccgtccatgaaaaagctataactgggcggataggagccgtagccgatgttgtacgtcatcgctgtgtaggtttgtccgggcttaaactgcgcactttgctgatgcttaaccttcaacgcttgatcgtctggcaaacgataataagtcgtaaaaagataaatcaaataaccgcctgctgccagcaccatcacgccgataagtgccgctacccatttcaatagtcgtttcaagccgccgcctccaataagtttgcttgcatttattatagcagttgtctttttccttgagaccggtacgattaaggaagtaagtgtcaggcaacgatttttgccaacggactgtcaccgcaaacatttttatcaagggagcttactttacatgtcaaccgaaatcaaacagatccttgctgcttttgaaaaattcgagaccattatcattcaccggcacattaaccctgatcctgatgcaattggctcacaaaccggactggccttgctactgcgcgcggcctatccgcaaaaaaccatctacaccgccggaccagccgcaccggatctggcgtggatcggtccgcagcaagacgtccctgccgctgcgtatcaacatgcgttagtcgtcgtgattgatacgtccaatcgtgaacgcgtggcaggttcgctttttgagcgcggggccatggtgattaaaatcgaccaccatctggaagaagaaccattgggcgccatcaactgggttgacacgaacgcttccagtgcatctgaaatggtgtggctgctgacccaacacagccagcacctgacgctcacgcaaccagccgccgcagctctgtatgccggcattattggcgacaccggccgcttcctgtacgatctgaccaccgctcaaacccatcgtgccgctgccgacttactcgccaccggcatcgacgctccagcaatcggccgccaagaagatcaattcccggaaaatgtcggccgcctcatcggttgggcacttgaaaatgtccacatcactacaaatggtgccgggtcgctgatcatcacgcaagctatcctccagcagttcggtttgcagtatggcgaagaacagcgagcagttggcaacatcggcaaactcgccagcattgatcgctgggtcgtgttcaccgaacgccaagatggcaaatatcgcgttgaattacgcggaaaaacgaaggagatcaatacgcttgcagtccgacacggcggcggtggtcatcccttagccagtggcgctgtggctgatgatgaagccgaagttcaggcaattgaaaaggaattagcttctgattgaggacaacttggatcaggaaccaaacgactcatttaactgtggttcagggtttgaataacgtatcctcaatacagcacatctgaatgaatgaagtttgcacttgggtgaccaaaaggaactaacaattcggtttaacttttcccttgctttggagtgcgctccaaggtttataacaaagtcagcaaataaaaagaaaagagattttacaaatgcagacttttacattaaacaacggtgtcgagattcccgcactaggctttggcgtgttccaaattccgcaagatcagacaaaacaggcggtattggaagccttgaatgtcggctatcggcatcttgatacggcacagtcttatatgaatgaagctgaggtaggggaagccttggccgcaaccaagatccctcgtgataagattttcctgacgaccaagatctggttaagcaattacggttacgaagcgactgcaaaatccgtggaagcctcactgacaaaactacaaacggattatttggatttagtactgctccaccaaccctatggcgatatttttggctctttcaaggctctggccgatctccaaaaagcgggaaagattcgcgcgattggcgtatcaaacttcaatagcgagcgtctggccgatattgtggcttttcaagatgctccagttcaagtcaatcaaatcgaaatcaatcccttctaccaacgcgagcaagacttaatgaacgccaaagcacgcggtcatgttctactcgaagcatgggcaccttttgctgaagggaaagacggtattttctcaaataaaactttaaccaccattggaaaaaaatacggcaagtctgcggcacaagtcatcttacgctggaactttgaacgcggcatcgtcagtcttgcaaaatctgtcaaacctgagcgcatggctcaaaacattgacatttttgattttgctttgacccatgaggataaagcccaaattgccacactggataccaatactagtcaattctttgatcacaactctcctgactcagtagatatgtttgtgaagtttctgcaagaaagagacatctaagattgattggccagtcttcacaaatcgaaaaatagtgagtgatcaaaattatgaatatcaaaaaagctgctgacctatttgatttatcaccagatacgttgcgttattatgaaaaaacaggaattgtgccgcctgttcatcgcgcagcttcgggatttcgtgattatcaaacgcgcgatttaaactggatctatttagtaagaagtctgcgccgcgcaggcatgggcattgatgctttcaggcaattcacgcagcttgctaaaaagcgcgagtcaaacaacggctcatcactcaagcaagtagatgctgcacagaaggcaatcttacaaaatcaacttattgagcttgacgagaaaattgccgaactccaacaaacacgaaaaattttggcttataagattgccacttacgaagatcacatcggcaaattcaagaacggtgaatgggatgcagaaaatcaagaaaagctatgggaacgctaactttttggctctcactatttttcagagaatgctagccaactggcctcaatttctgtagactcgctgttaaacgttgactaagtaaccagagtatctccgtagccactttcgaatgcagaaagttggctatttttttcgcgccaaaacaataaaccgatcctcaaacgttgtgacgctgccgacactggcaatcatatcttggagctgatgcagctttggcatagcctgattaacgtcaaagtttggaaactcccacgggataaccgttgcgtaataaacaatcgcgccaacatccgtgaaacgcattttgacaaacgcagcatctgccttcaagatttcaaacccgttatcctgcaattgcgtcaatacttgcggaaggttattgtcaggaaaagcgggtacatacgcgggatctagaaaccgtgacaacgagtaattgttagttgcgcccacctgctgcgaaacgaagatcccctttgagcgaagtacccgagcaatcgccggaattggcaagccgccatgactgttggtcacgatatcaaaatactgatctggcacctgcgccatttgtccatccggatcggcataaagcgtcaccccttgtggcaccaaggttcgcttcagcaagtcaatgttgggttgccagccttccgtgaccgaggttttaacaaccgggtgtttaaacgtctgcatcagctcgccaccccctgtgtccatatccaaccactcatcactagaccggagatgctgctgtacccactcactataatcccatggcagcgactcggtttcacaccgaccctttaagtgactaaaatcccaaccatgcattgctaggtgactttcttcaagccacgatgcttcttcattcatgtcgtattcacaccttttttaatttgactcgttcatttacgcaaacttttgtgcaaacggccgcatgtaagactccgccaactcacggtttacaatcgcgtgccaccagacttccggaatgacgccttttccgctagcagccagcaaagaggccgcgattgtcgcaacggtgtctgtatcttcgcctaaactggctgctgtcatcacgccttgtttgaaatcagtagcgttgcctgcgacccaaatggctgcttccagcgaatccactacataaccgctcgatttgatcgccgattgcggcagtgccatgaaatctgcggcaaacaggcgcttgaaagtcggtaattctgcctgctcatcgcttggtaaagccactagtgaaaagttcaccgccattaaagcttgagttaacgattttccatgtaacagttgccacaacgtttcgagataaatcacactgccaagtacagcgcggggatggcgatgcgtcatttgggtgtaggcacgataacttttggcgcgcgtgacaaatcgcggctcagcgtataatgccactgccagcggagccaggcacattaacgccccattaccattggcaaactcagaaggatccccgcacatggtcggctcggcttgctcaataacataagtgcgaatggccttagcacaggcattaccaatatcaaacaactgcccggttggcgtatacgcacctgtttccatgtaagctgttaatcgatccatcaatttggcatagctgtcagcgtgtgtcagatgatcaagtagcgccagcgtcaaagcagtatcgtccgaccacgtccccggcgcttgctcccagaaaccaccgcccaccatttccggagcaacagtgtatgtgccacgttgcttgaactcatatggcacaccaaacgcatccgcgacaattgccgcttgaagcatacgcataatccgattcggtgacattacctcacctccagttaatggtttaagtctagcacgcaaaaggtgaaaatcctcacctaatcgccactcgtcactttaattccgatgatgccaatgaccaacaacgcaataaaaaaccaagtcgccggttgtaactggtccttaaataaaaccaccccgacaataatcgaccccacggcaccaatgccagtccaaaccggataagccagactcaacggcaaatgcttcaccgccaatgccagaaacccaaagctgagaatcatcccggctaatgttgccaaagcaaagcccaggcgcgtaaaaccgtgagataacttcataaaggttgcccaaacaacttcgaatccgcctgctaacactaaataaaaccactgcattttcttgttcctcctgtcatttaacccgtccgctacccaataaaaaaggcgacagtatccgcaaccgctgcatagacctaatgcggttgcgatactgtcacccggtagtgactggttattgaattgcgattaatagttatcttttcacatattttagggggtgtcaaattagacgtgcacgatgacgatgtaagctgtccgcttattaccgccgaggcttggccattccttttttgaatcacgacattgacggctatcaattgttcctctattaaacattccacgttacttatccttcaaatagtcaatgccggttttatatttgtccataagattctggatggtggtaattaattcctctttgccttccattttacacccctttataacacgcatttgcactgttccatcttccatcatgttgaatcgaaccttggtattcttctttataccgctccgccgtctaatttcggcaggtatcgttacttgacctttgcttgttacggttgcttctaagaactttttatgggacaaagacatacgtgccacccctagctttattcttactttttgtgtattaaagtttaacatagggtaaggcgaaagtaattatagttcgatctccttagtcaatttttttgagcgtatcaaccgcttcatcctcggctatatattatgagacttcattcagaattatcagtcgcttcattgacaaatcgtaaaatcctaacgctgactttaaaaaatgatcagggtctagaactaccagcgcgttctccttctcttttctggttatttcaggtttacaatatggcgacgagtcatcaatggtatcttcatattcgatactgtcttcccacatttattttccgatgaagtaacgaactatcttaaagtgaggtctaatcctatgcaggcattttataaacatcatcccgccacggtctggcaaatcagcaaaacgaaccagcgtcctgattgggtgcaagaggcgtttgatcaaaattaccttacgtggttagatgatcgccttcgaattgtcatggccggtttgtattcacccatgatcccaagcttgcaaaacgaaaaagccgatattttccatgatcatggtgttatgttcggcatcacttcgatcggttatttaggggattatctagacgttacaaatcatcgtgttgtcacgaaagaacaattttcaaagcactatcaaatccatgagccaggtacttggacataatgggtatttaaaaagcaatcgcctcgtctccaaaaactgacgagcgattgctttttaattgctacagagtcagtgaaccctgtcaaacactttagaaattccgtgcaaaagaccagagaatgacccactgaacaaaaacaaatgaaagtgtataggtcagtgcccagcggctgccggattggacaatgaggaacccggccagatttccaatgatgatcaaaccaatcacaattgcgataagttctttggtgcgatgatcaattttgcctttggaggttttaacgatccataaaataacaacagacgtaaataaaacgttaatgacatcaccgaacatcatggtgaccacctcaaatcgtgcgagccaactcgttgtcgttgcaagtggcttgttaacctgacatgcgagctaagttcctagtaaaagtatcgaacggcgccacgatccttttcctagcgttaatctactgccaattcacactagacgtcaactattgatgcttcttctttcgcctggagatcatcaaatcattttacccgttcaaccacctgctgtatcgcctccgcaaacgcttggggtggggtgatgttcaactcatgcccgcctgctagaacctcaagttgactttgcggcattaaccggttcaagcgcttggctgcaccgcgattagcccagtcgcgagacccgtataagatcgtggtcgggacggcgacgtttgccaactttgcccttaaatcaagttgcatcagcgaatcagtcaaggtacgtacttgcgatttggtaacacctagatcagcgaatgccgaatctggttgaaatcgaaacatcgcatcttgcgccttcatcaataatcggtttggcggtgagtattgcggtgcgctaactaaggccccgacaattttagtggctgggtggcaaagttgcattagcgttaaaacagcacccaaagacagaccgcacaaaataaccggggtttgattcttttgtagatcccttgccagtttgtcattgagcatcgacaatgtcagcgagtcgtttggcgttagtccggcaaatacatcaaacgtgcgactgggcacccgtaactgcttttgaaccggttgccaaacatcggcagactgccctaagccctgaactaagataatttccatatgccctccgtcagtagtgatattaggatcacttttgtataatagttctaatctacctgatgattgacactttgtctgccccgcgcgccccattaagttccctgagtggtaggtaaaaagatccctgcttccgttttcgggataggtgcatgcaaaaagataggcaggttatcagcagaggcaggttgtttcctccgattactgtgccggcttccgcaccataacaagttcccgaatcgtgccaaatttcgtcgcatcttcaaggatcgtcttagtttcaatgaagccaaaacggcggtaaaatgcttgcgccgcgcggttgttatcaagtacgcgcacatagtcattcgtataagtcacatcaagttccttgagcgcggcgttgagcaagcgttcgccaacatgctgccgctgaaacgctggcaaaacataaatcgagtagagctcgccccactcagcacgttctgccatgcgcgctggtccataactgcaaacacccacaatgccggcaatgtcgtcaattgctaggaacgtgttttgccagcggcgctcaggatgccagctggccggactcagttgtttcaaaaagctcgcaggcatcagattgcgataagctacctgccaggtaacgtaatagacccgccgaaccgcattaaagtcgctttttaaagtcgctttttgaatctgaatcatgaccagcgcctccaattgtcccgtcacgatcagtgaacacgatcttaatcggcatcacatcatcaccgtcatttcgttaaatacagatctcgaaaccgattaatttcagctgctgataattgcaacccctcatataaatattgatcaaaagagccaaaatgttctgtcaccacctggaaaaaacgctgcaaatacgctgcatccaccgttaacgcttcgccaatggcctgtagtttctgctcgccaaacccttgcttttttaagccagcgagaatttcttcgttggcttttttacgttcctgattagtccgcagataatccgccatgatgtcttgatcagatacaccgaggatttctaaaataatcgcagcgccaactccggtccgatccttgccggcaaaacagtgaaaaatcgttggccgatctggcaccaataacgcttgaatcaatgcgcgataaccagtttgagccgaactgcttactgccagctgctcatacgttgccaacatattttcgcggacactgccttgctcggtaatcatacggccgagactggcattattggcggtggcgtcttttaaaatgtccaacactgtataatcggcgcccggccacacggtatccggaaactgggcacgctcatcggcactgcgcatgtcaacaatctgcttgatgcctagatctttagctaaataatgttcctgcgcttcatccagttcaaacaactgaccggaacgataaatcaagtcagctttaaccgcttgcccattcgcattccgatacccgccaagtgaccgaaaattcgtaatcttttccatttcaaatccgccctttcactgtgacgccaaccgatactagtttcaactcatgcagaacagtgctactgccgctgcggaaacttttccaatcgataaagctgttgatcatccaccgtcgcatccccatttttaaacgtgtaacccatgtggcggtaaaagttcacagcagtaatcgaagcgggaatttcaacccgatgtgcctttttaaaatagggatcatgttccaatgtctgaatgatcaattttccaataccacgcttttgataagctggcagcacgaaaatgtcaaaaaagctaaattccgtctcactgccccagtaaggtccgatggcgccggtgcctacaattttatccgcatcacacactaagtaaaaatgcgtctgcttggccttttcaatgaagaaagtcggattcattcgctgaatacttgcctctaagtaagcttgcgagtaatccgcgcgatttgagattctcagcgtctgggcaacaaccgcggccacttcttgggcatcttccgaccgaaaccgcctgatctttagcatactgccatccccctccagaaacctgacgtgtccatgcgccccttgtatccgcttaatcctgatccggttcagacgccaagcaagcagccggcaactgtaaattgtgccagtcagtttcgtgatagtcttccataaattgctcgatatactggcaagcataaatatccaacagccgccgtccaccttctgtcaggtacaccagaagggacttttggctggtaaagctgccaattaaatcagttccatacagttgcccaagtgcctgattaagatcggctgacaacccgttcatcatcacgcgcggtcgtttacccaactgaatcagctgataaaagatcatcgcttgcgactcttgggaaaacgtggcatagctgtcatcgatttgaaaggttgtccgatggtgatgcccatattttaccagtgacaagacaaaaaaatcccgatagcaaaaggtcagccatggtgccgtcttcaggaacgccgtcaaatcagccgtcaattgttcctgtgagcgcaaaacaaatgtcggcactttttgaaacccgctgaaagaacgatgattgctgacccgaatcggcaaatattggtcctgcgaatggccaagaatcacgtacatggactggcttttacgcgctcgatagaaactaatcatatgatccccagaatctaatgcctgggcaatggccgctttaacctgcaactcaagcttttcactcatctgcatcagctcacctcgctttcaaaatcccggttgctactaacttaacacaaggattgactagctggtgacgattaatgaaaagttatggttgctagcggcgttctgatgccaaaagtgcaacgttcttcggccaacaagtcttcaactgcctgattgacaacgggatcatcactggcaaaaggttggacctgccggctgtgaagatctattaactcgtacagaaaaagtctccgcaattggagactttttcttcggcatcaataaatactgctacatcaaagcggatacaccacatgaaaagactcaagcacaatccgcgccgtttccgggtcaaactgcttcccttctgccgcgtattcgtttttgaagaatgccagatggacttcgcgccaatatgccaggctccgatcgccttcaccttcgcgataagcgtgatcggcactgacagctaaaaagggctgcacttcaaccgcatctgtatacgtcacacaaaccggttcatctgcaccatttaaaatcacgtcataagcgccaacctgaggcaatggttcatctgctgcgtacaaatcccgcgcactggccgttgccgtttttttgcctgcaaggactaacgccgccaacttatctgcttcagcgccgaattgataggcactttgtaaagtggttgttgtcggcaggttcaaagcctgcttagcctccgtaaaataagcttctggtgtcatcacataaccctttctgttcatattctttgacgaatcttcacactcatttgtgatatggactgccgatattaatcataaaggcccggtaaatctgttccattagtactaaccgcattagctgatgcggcatggtcagcttgccgaaactaagcgtatcattggcccgcttcatcacggctggtgccaagccaagcgaaccgccgatcacgaaggtaatatccgaatgcccgtatgtaccaagatcggcaatttctttggcaaaaacttcggaaggtcgctgtttgccttcaatggccaaggcgatcacccattctttgtctttaatcttatgtaaaatccgctcgccttccttggctttcacatccgccatttcggcttcggaaagattctctggcgccttttcatcggccacctcgacaatcttgacttttgcgaatttgtccattcgttttaaatactccgcaataccgtcgcgaaaatacttctctttcagcttacccacaccaatgatcttaatgttcatacaactcagccctttatcacgtcattaatcaaccggcaacttatccttttcaagtataccagacgttttgcggcgtttgcctattgtcatcgttcggtttttagcgcaaaatatacaagttgaggttttttcaaatgaggtaaattgatgattgttattcagcgtctgatcaaagatcgggtcctgcagatcaccgccttgttggtcgtcataagtttattcatcggacggcctaaagcaagcgacataagttttgccacattatggtcaattcttgccatgatgacggtgattcaaatcttcgaacacctacatattcttgattactgggcttatcggttaacttcgcgagcaaacaatacgcgtcagttaacatggtggtttatttttctggcgatttttgccagtatgtttctttccaatgacgtgacggttttaaccttggtgccgttatatctgcgggtagccaagaaataccaactgccggaaattcttccagtaaccttgatcgggatggctgccaattttggtagcgccttcacgccatttggcaatacgcacaatatcttcttgatgcaccaattcgaaatcgatctccaaaagttctttagttggtccattccgctgttggggtgcagtttcctggtgttagtgctattgagtttattcttgcgtaatgtcccagtgccaaaagtaccgactgaacatattcacatccagatgcgtccgaccctgtttgccattgccgttgcgtgtgtggtttttgccggcgtcattggtgttgttccggcttggctgggtgcaattctagccattgggttgtccgtagcgctggatcctaaagacatgaaagatgttgattatgcggtcgtgctcacgtttgccggcttcttcattatcgtcagtgtagtgcgtcaaattccttgggtgacacattttctgtctagtcttatcaactctgaaccgtctgtttatttcagcagcatcatcacaagccaggcaatctccaatgtgccgtcaacagttcttttagcgcggttcactggctatgttgaagccttgttctacggctccaacatcggcggcgtcggaacgctggttggttcaatggcgaatttgcttgtcttcaaacaatacatgatctatggcagccggccgcacgcgcgcttttttgtcggctttacaatcttcaacttaattggtttattgattctcggctgtgcgggctactggctgaccattcgctaaaatagatgataccgtgacactaggtaaccatagtgtgcactggaaaaaagtctttgggcacttacataataaataacacatgaaatgtatgcgttttcattgcttttccccaagaacgtgctagaattaggatttgctaaagaacgaagcgcatttaatccgcacgatggcgtcagacaaagttttgtctggcgtccttcatttccgcatatgaagcggttcgttcgcggactcaggaggaagataaccatgaagcgcaggacgttgttttcgatcatcgtcgtcacgctgaccgcaggatgttttaccttattctacggcatgcatagtatgtggactgatacccaatcagcccaagccgttcaagctgccaccgaagaagttgacacattattcaaggataaggcacaccaattaccggcagaccagcttagtcaagaaaagatcgaagcggtcgcgaccaagttacatgcagcgcggcaaaagctcacggaacctgaatacgccgccaaacttgccagtgcccaagctgatgtcgatgctgccaaacatatgctaaccgttaaaaaagcggttgcacaaaccaccactaacttatccgacttaaataccttaacaagcgattcacagcaggccttatccgaactggccactcaaaagcctgagtttgttcaggcctatcaaaaacgcgtggcacagttatccgatcaggaagcggcggttgcaaaaattgccagcttatttgatgatcccgacttcaaggagccaaaagtcggtcttagtgctgcccaagtgcaaaccgctttggctgcccttgaacatgtgaataatcaacagtttgccgatcaaatgctgccaatcatcgccaccgcccaacaagcagcaaccgatgatcagacaacgagtgaagccagttcatctgaatcatcaacatcaggcgaatcaagttccgcctcgcgtgcaagcacgagtagcacaccgtcagcatccaccagcagtcaggaatcggcatcttcatcagcttctaataacgaatctgaacaatgtcaaagcgtgccaagcaactcagctgccagttcggctagttcctcaggccagttgccataaaatcgtatcaaaatcaaaaagccggataccagcgcgaccaaattgtcaccgcgccgatacccggctttttttcgttgtcatgatcacaggctggatcacttgtatgccacttctgctatggcctatgacggacagcatgcagaacgtcactaagctgctagtttagtcaccagttgcgttagataatcgataaatcctaagtaatccgcaatagcaacattttcgtttggaccatgcgcggccgagttagcattaccgatgccacaggaaatgatcggcgcatgattaatatcataaaaatatttcattggcccgctgccaggggagtttaactcaacttggacatcatcatcgccataagtgtcacgcgccaatgctactgctgtttgcacgcatgggtcgtcaggatcggtgcgaaatggcggttcgccgagaaagtccgagacctcaatatccgcgtagccgcctgctatgagtgcggctttgaccagtcgcaccgtctcggctggcgtctggtccggaaccagccgcagatcaatcttggccaaagctgtatgcggtagaatcgttttgccaatgcccggaccttcataaccgcttgaaagtccgttaatggtcatgctagggcgattgtacaaggcttctttaatctgatcgtctggcaccgtagccggacgggtgatcccataattcttggcaaaggctgcataatcaaagtcagcttggttaatgagttgcttttgggtcgccgttaaaggtttgatcgcatcaagaaaatgcggaatagtgatttcatctcgagcattcttcaaagttgccagcgcctgaaccaaccgccatgccggattctccgtcaccgcgccgaaactggaatgaagatcgaaatcagcagtcttgacactcatctgaaatgcaacgccgcctttgacacccaaagagatttgaaatttaccttgctcatttcgtccgcctgattcccacaagcaaaagtcagcagcaagcagatcggcatattgagtcaataggtcatcaagatggggactgccttgctcttctccgccttcaaccagaaacttaatcgtacatggcaacccgccttgtgcttgcaaccgggcaaccgctgccagtcgcgctgctaattcacctttatcatcattgatgccgcgtgcatagagatgagtggcggttattttcagttcaaacggatcacttttccaaagctgcaacggctcggctggctggacatcgtagtggttatagaagagtaatgtcggggcctccgctgtttgggcgggaaacactgcatacactgccggattggcaccatccgtctgtagaattcgactggtggtggcacctaggtcagtaaattgttgctttaaaaaggctgcggtttcgggaatctgattttcagccgccagtgaaacggactgcagtcgaagatattgagttaaaaagtcttgcataggaagcgtcatcgtgacacctgctttctggttaatttatttgaagtatgcatagcggtattcagccggttgcaacatgctgtaatgcaagccgccaactttcgtgttaatcaggcggctgttggcactttgataaacaggaatgtaaccggccacgtcaattacccgggcattggcagcaagttcttgttgatagcgtgcggttgcggtttggccattagtatcgttcaccttattcattaaagttgtatactcgtgatcgctaaatttcgaaaagtttgaaatattatcagcagtggcggtgtttagataatctgaggggtcttgaatcgttgaattccagctcatcaagacggcatcgaatttgccattcagtgatcgctgaatccgcgtcattttcggtaagctattcacggtaactttgagttgcggcagtactttggtgagctggctttgtaaatattcgcccacttgtttatcggtaccaacatcggaagtgagaatcgtaaagctgatgctgtcggtatgaagctccttcaaagctgctttgagataggcctttgccttagtcggtgaataggttagcggtgttttggcgtcgctggtgaaatctttacctgtcgtcggattggttgctaatcctttaggggcaaatgccttagctggttgcgagccatcttgcaagactttgctggtgagggcttggcgatccaaggccgcggaaatggcacgccgtaagttgacgttgttcagttgcggattcttggtgttgagttgcaggtaattcatatttgcagcaggcgttttgctcagtgccggattgtccgcttctttttggatcaagttgcctgataacggtgcatcatccagcttgcctgtagcgaaaagattatcaacggtactggaatctttcaaaacattgacgtgtacatgattgattttcaccgacttagccgcataaaaattcgggtctttgacataattccaactgtcactggtcgtgtcaaaatgcttaattttataagcgccattggtcacaattttgtcggcagcagtgccaaacttcttgccgtaacgcttaacggcagcttcattggttggataataaccggtcatctgactggaaaaataaggggttggctggctcaactgaatcttgagtacgtacttactaggtgcggaaacgcccaaagtatccggtgacttttttccagcgacaatatcctgataattcgcgatcgcatcgtattgatacgcgaattcggttttagtcttgggatcaacaatacgcttgagagaataaacaaaatccttggcggtcacaggtgtcccatcgctccatttgacatcgcgccgtaacgtcagcgtgtaggtcttgccattgttggttggcttaacaacctttgtggccattgccggaatgattttgccggattgatcgtgatcataaagcggcgtcatgatctgctgaaggatcccgccgctggttgcatcaaccgcgtgggccggatcaagcgaactggcttccgtgctgactgcaacgttaagtgttcgctggttggttgctgcttttgctgattggccgcatgcggctaaaaggatggtgacgcctaggagcatgaatcccagtgagaattgctttttcattttgtacacctcgtgaaagtatttttggtggtggaacttggcacagacgaaggaggcgcgcctgtgcggatggtgaggcttggggtagctgggtgcctttggataggggcctttcgtttgcgggaaagaactcgcgggaacggagggggttctattttgggcacttggttggttggggattactttctataacgcgctcgcagtcgcagcaatctacatgtaaggacctctagcctaaatggccaaagcccagccatttaggctagaggccacttacactccgattgctaagcgctcctgctcgcgctcacacaaaaaaaccgcccataacaaacttcttgttaaggacggtttcccgcggtgccaccttagtttgatcatgagactgcgcctaggtattgtgtcatttggcagtttatgatcacgcttagcccggggccaacaccccggcgacaactgacgtatgccaacacgtttccccgtactcgcggtgctttcgggggaaccctcagtggtccatttactgacttgcgttcggccggactctcagcaacgccggctctctgtgcgtgcaccatcagcttgatctccacttcaaaggtttgcatgaacggttatttgattacttgcaactctaaccgtttgtcaggttatttgtcaagcgatatttaactaaaaagcctgacgaactttttagctaaagcgccagacaacaaaatattgaaaaaatttttttaaatttagacaacgttaataaagtcaagggctcgcaagttttgcttcaccttaccaaacttgcattcaactagtaaaccccttatattacaactatattaatgtgtaacaaaaaagaaccatttcgtgacctgtttgcaatggtcttgttaagtccagcccgtaccattaggatattggaggtggcatcaatgaagcgaaaacatattttccaagtcttggtcggcaccttgattgcagggtacttgaccgttttctatgggatgcggaatacgatcgatacctcatttacacaacatgccgtccaagcggcaacggaacaaactaaccaactatacacatccacgaaacgcgcctttccagccaaaaacctatctaagaatgcagtgacatctacgcaatccaagcttgagcaattagctcagaatgtggatgatcgcgatcagaagaaagttgtcctcaaagataaacaggacgctgacgctgccagccatatgctgacgattgaagaaaccgtaaaaacacaaaacggtaatctggctcagattgctgaagacggttcccgtgccaacgcagcttacaaagcaatcgcgaataccaaacctgaatttgcggctgactaccaacaacaagtcaatcagctttacaagaagtcactggccattgcccaaattcaaaagttataccaagaccagaatatgcaacatccaaaggcaaacctcagcagcgacagcattgatcttgccgtcaatgccgtcgaaaatgttgagaatcaggattttgccaaaaacgttcttcccctagttcaagtagcgagaaattcccaagaaagtaacgactcggatgttgcgatgaatcaaaaaggtgcaagcagtcagagccaacaaactggtcgggaatcggctgccagtgacgatgaaccagctagtggcgcgggaacaacatccacaccttcaagtcaaaagacaccatccagcatctccagccagcaaccagctgaatcaagccagccgtcctcaagcaacccagctggcagcagcacttcagcttctgatgatcaaggtcagtcatcatcaacccctgcttcaacgggtagcattgaacccctgacaaccgtgcttagtggcggcctttacaaaacttacgatgatgctgtcgccgctattaaggttcaaggcaaatctgttgacgacatgaccgtcaagtcagtcaccatgagtgatggctcttaccagtggacttgggggccaaacggtgatagcggcagtcaaactagcagcagtagtgccgccgcaagtagcagtaccggtgcttcaagcagttccagtcgtactgcctcttcaccaagttccaatgccaatcaagcttctagtcaagcaaattaattgatcattcgttttcataaaaatgctgtcatctgacttggatgacggcatttttcttttgtctggatccatcaattagcagtccagacaagggatttaattgctctgttatccttatgtggcttcccatatgcccactaagcaatgtcttttgactcactaggaattgtcgggcgctcccgagtcactatcccattactatcaaagttttacccgttacagtctagatcttaattatgttttgtagcagcttagcaacccttgatgacataaaatcggtcaccttactgcaaaaagctacttgcaccaaaaaaaggtccaatcagatgcgcttatatcgcgcgtatctgattggaccctgaaatctcttgatcttaaattgttaattaagcacgtgcttctgcgcgaaccggatcaaccaacgcctgccgatgcaagccattacgtgcccgcagcgcatataaaatggtgaccgtatcgacgacttcttgcaacatggcgccaataatcgttggaatgacgccgaagctggcaatgagcatcaatccggtacaaatcgcaatcccgatcagcactgactgcttggcaatgaccatggtttccttggcgatcaaggttgctgctgccacttttgctagatcatcgcgtaacaccaccgcatccgctgactcactggcagccgttgcgccatgtgcacccatggcaatcccaacatcggcaatcgccagcgatggtgcatcgttgaccccgtcacccaccatgacaacgggacgatcatccttaggcacattgtccagcacttcaatcttttgctgcggcaattgctcagcatacacttggtcaataccgacttcttgagcgaccttatcggcaatggattgttggtcaccagagatcatgatcaagttggcatcgtttaattcgtgcaatttggtcatggtttcttttgcttcaggccgaatttggtcggaaaaagtaatggcaccggcatattggccatcgacattgacataaaccgccgttgtatccaaagtgtcttttgcatcggcgaactcagccttgccgactttaaccttatgcccgtcaacggttgcataaacaccgaaactagttgcttcactgacctcgcttgccggcagccgatctgctgctggcactgcgtctgtcaacgagcgcgccaagatatgggtcgattggccttctgcactggcagctagattcaaaagctcatcttgggaaaaaccggcttgcggtaaaactgtcgcgactttcaaaataccacgggtgacggttccggttttatcaaaagcgaaagtccgagcgtcactcaatttttcaagggtagtccccgacttcacaataatcccgttacggctattgcgactcatacccgaaaccatggcaatcggtgccgcaagaatcaatggacaaggcgatgcgacaaccagtacctgcgcaaaccgaaccgggtcaccagataagaaccaacccaatccggcaatgacataagcaactaacgtaaatggtaccgcataccggtctgccatccggacgaaatgagccggacgagcttcggattccttaacaagtttaatgattccctgatattgactgtcttctgctcgctgcgtaactttaacggttaatgccgaatccccgttgatcgtcccagacatgatgtcactacctgcgtttttggcaactggtttggattcaccggtcaaactggcttcatccaccaaactctcgccttccaaaaccgtaccatcgactggaacaacttcttgaggcttaaccaaaatcgtctcgcccacttgaacggcatcaacgtcaacatcttcaacgtggccatcaaccaaccgatgagctgtcgttggtgcgttttctaataactgcttcagttcactgctggcttttgtcgcagcataactttccaaggcgtccccaccagtcagcatcagcaaaacaatcatcgctgcccaatactgactgactgccaaagtggcgactaccgccgtaattgctaacaaatcaaccccgaaattacctgaacgaatggtcttgaccatgccgccgaacataatcaaagcaataattgaccccatgactgtaatcagtccctgagcaatcaatggctgttttaatatgaacgcaaagaccagcgccacagcactcacaacaagcaccatcataagctgccagttcttcttcattgttgccactcccttttcctaagtaccccaattataaccattacaatttaaaaatgcaaccctttttagaacgaatataatctggacgttcaaatcctgtaaccgatataattcagtctaggctaactcagtaaacgatgaggatagcaagtgttagctcggagctgttttctaggccttcacctagacaattctcttttcggttatcctaaatgtttaacttctattatacgcttttacagcgaaacgaatcatcaatttgaacttatttcctgttttcagtgacctcatctgctctgaagaagctgctactgctgtcactttgttcgtcaggatcaaatgaccggtagctagttattgctaagcgcccctgctcacgctcgaaaaagagccggatcagtttcccgatccggctcctcaaggtattcatactagacaaacagatccgattcaatcaatcgtaatctgatgcccatcctgctgctcggctgccatctttggtaaatcaatggtcaaaacgccatcactgactttagcactaatcttaccttcatcaacgcttgtcaaccgatagctgcggctcatgcggccatagctgcgttcagacattagcatattgccctccttgtctgaatgatcagcctgttcctcatgtttaactgcaatgctgagaacatcatggtcatagcttaaattgatattttgcttctcgatcccaggtacatcaaccttcacaacatatgactcgtcattttcctgaatatccgttttcagcaggcgactgttgtcaaccccacgagttggcgtaaagctgtcaaaaatatgccgtcccaaatcattgaagaatggatcattcaaccaatcattccgccgcataagatcattagccatcatcgaaaacttcctttcattttgaaggttacgacttcctcttccgaacatctttagtataacacaaaaattagcactcgtcatgttagagtgctaatttgaattttctgctattttgattgtttgtcgttttacaggttcagcggattatgatcgtacattaacaaatcttgccgcctagcgatttcatttcctcacggcgtttgtcatcattttgcggtgttgaagttacctgattaagggtaacggcaccgtctaaaataccactatcatcacgcaaggctaacgaagcatttttaaaatcaagcgtcaggccgcttccgaaataatcggtttccagatcgcctgtggtcagcttcaagcccgcatcattttccagtggcaatgcatagtcttggtcgtcctgattggtcacaacaatttggtacttattgccaatagcacaggagccgcctagtttcgaatacttacttgagccatcatctaatgccagaaacaaatgttgatcctttgcaacgtgctcgttcaagtacgtcactgcagctggtttaatcgtgattttcatgacggaccatcctttcaaatacattgtgcacaattcttttacctatttcatcgtaaccacttccgcagccgaagtcaaatgttaagtttttcgcagcaaacaacaggttgtccacaccggttatccacatgttcaaaactcaaggcccaaaatatagtattaagtatgcccattgacactaaatagacgattcaaaaaattcaagtaaaaaatttttcgacaccgttcatccacagtttttaattgttcgatttcacaaagttcagccgcttaatcccgctccagcagccgggaacaaacgttttgtcacaagtcaaaaaagtttatccacaagttatccccagtttggtggacaacttactcacacccggaaatcttagttatgaacagtatccacagagttatccacaggctagggcatctttttacgcaaaagttacccactcttgacaaatcttttacttgaacttttccacagattagcgctaaaactttcgtgaaattctgaagaaaccgctttcgactaatttcgctgaaagcgcaaaagagcctcgatcaaaagacgaatcttttaatcgaggctctcatcatttaattcttcaaatcacttgttgtctgtgaaagttttatagatacggtttgctgctcacctttacgatacaaggtcagtttgacggtgtcgccgactttatgcttataaagttgcgtgtgtagcgcagcggtattggagacgctgacaccatccagcgcagtgatgacatcatactgtttcaatcctgccgccttggcactgctgccactggtaaagccgccgacaacgaccccgccggtaacactttcaggtaacttcaaaacggatttttgctgactggcagaaacggtggacaagtcgcgcacttcaatgcctagcgctggccgaacaactttaccattttcgaccaattgattgatgatcgaaacgacttcatcacttggaatcgcgaagcccatcccttcaatcgttgctccttcagaactgctgctcgagcttccggatagcttcattgaattaattccgataacctgacctgacagattgatcaacgggccacctgagttccctgagttgatcgcggcatccgtttgaataaccgttgcctgtccggtggtgttaccactgctatcggtcacatcaacggtacgactcttcgcactgacaatcccttgcgtcacactggtagcatactgtgagcccagcggcgacccgattgccaagacagtttgcccggcttcaatcttgctagagtcgccaaagctggcaactgtgttaaccttactgccatcaattgtcaaaaccgccaagtcagacgttgaatcggttccgactaaactggctgtcagtttggttccatcgctcaaaataacttcgagcttatccgaaccgctcaccacatggttattggtgacaatataagccttgccatctttcttttgataaataacaccagaaccttcgctggcctcttcaagacttgatgaactactgctcgaactactgttattttggttatcctggccaaaaatgccttcaagcccgccaaaagtatccagcccatcgctgttactttcagccttttgcatgttaacaactgagacgactgcgcctttaacctttgcaaaagcctgttctgaagcactgctttgattgactgaaacattggaaatcttggtcgttccggctttaccagaggtgtcggtcacgccaaggcttgtcgtatggttgatcgcccaataggcagtaccgccaccaacaccgccaccaatcaaggcagccacaacagcaacaattgcggtctgcttcaaaccattcttcttcggtttttccgccgaccgttgcggcttctgatcctgtggcgtctcctgaaagttatgacttccgttatccataacggtttcctccttacgggcattctaactcaccctgtttacacagattattgtaagtgacgattttgacgaaactatgaacaacatcgtattttttagtgagcgcgaaccggcgcgtttaggagtcggagtgtaagtggccgacccgggcttggtcattgcgactgaggtccttacacgcagactcctgcgccggtgagcgcgttatggtgagcgtgagccagcgcttaggagtcggagtgtaagcggccttgggcgtaatggccgcactttggccattgcgaccaaggtccttacacgcagactcctgcgctggcgaacgcgttatgggcataaaccagaacataagcggccttagacgtaatggccgcactttggccattgcgaccaaggtccttacacgcagacttctgcgctggcgaacgcgttatgggcataaaccagaacacaagcgcctcgaacgtaatgacccgagcttacccattgcgaccaaggtccttacatgcagactcccacaccagtaaacgcgttacaacgagcgcaaactacgacgaacaccctccccaacccacaaaaaaaccggccagcttacatgctcccatctaagtcgtccgttttttcacactgctaaaactgctttcaaaccgcttcacacaacaaacaatgggtcggcaactgccgggtcagtgtcataaatatgaaagtcatgatccaccgccagaccttgttgtgccaacaacgacgccacggttaaatgcgccagtggcttattgttgttatgcggtgataaatgccccaaataaatccgcttcgtccgcaaaccgatgacatccatcaaagcatccgcaccatcctcattggacaggtgcccttgatcgcttaaaatccgttgcttcaacggccacggatacggacctgtccgcaacatttcaaggtcgtgattgcattccatcacatacgcatcggcatcgcgaatcgtcccggcaacccgatctgaaacgtagcccgtgtcggttaggatagtgaaggccttgccgtcatgatgaaattggtaaaactgaggcgcggcagcatcatgcgaaacgccaaaactttccacatctaaatcacctaacgtcaaagttgtccccatatcaaacaaccgcagctgtgcttcaggaattttgcccacactttttggtaaagctgcaaacgtcttggcattcgcataaacgttgagctgcggataacgtcgcgccaacacgcctacaccacgcacatgatcgctatgttcatgcgtgataaaaacactgtcaacatcggttagatctctgccgatgctcttcatcagcgcttcaattttcttgcctgataaaccggcatccactaacaccttgtgaccaggcgtttcaatataggttgcgttaccagagctgctgctggcaaggacactgacacgcatcccaaaatcttcgcccacgatcaccatctccaaactttttaccatttagtcaactgcctgatctaggcaatcggctctcactgccgtccattctaccacttaactgtcattacggtttttcataactgttcgagtaatcgcattgacacgttttaccgtgacattcccggtcgagcgattcttgacgccaatgtaccaagccgggacataaaccgtactgccttttgcatcaagcaggtaactataagccaactgtgtggacacaatcgccgaattattagggatatcattgtcacgatacaaagcaatgacagcatcctgttcactcatcaagcttaaatgatcccgcaaaatgtttaatttggtcagataagtctgcgtataactaaccagacgattatcggatacatgcaatgtcactgccgcacgccgatcgtaaatcagtccggcttggggatgctgggcaaacaccacgcgttcgtcattagagagcgccggtgcatactcatactccttgccatggtagacattgtttttaacaaaagtcttcatctggcgcagttcctgattcttttttaacgttatgggcacatccagattggcttgcaattcctgataatcgccttcgctaatggaaacctgctgcttcaccaggttcgtgcgtgccgcggttaatgctgagttggcttgacttgcaagataatcgcctttgggtgtctttttgcttaaacgcggcagcttaatttgatcgcgcgtaatgtccgtgatggttgccgcatcgccacttttaatcgttgccaagtcaacctgctgcgcctgaaaatagctaattcccaggaaaatattcaggccgacaaacacaactagaaagatccattcaatccgtcgaaaatccacaaaatcgcctccctcagcaagcagtttattagcttgtcagttagttaaagatccgttattgcgttggctcagattcgctcgcactactatcatcattgctcggcgtcgcagtctggccgctagcggcattggcagacgcatcgctactatgattcagccagctttgataatcccgatattcgcctttcatctcaacataataagtcggctgcaaatcgatcacttgctgatcattgctactaccggtccactggtaaccaatcaggatatccgtaatctgactggcacgatagcccgcagccactagctgattcaccacggtagcagttgccggtaaggtttgtgccggttgatttgtaggaatcggcaccgtcagattggtattagagaaattaatctcctgtgatgtctgcgtataccgaacagtaacatcacctttttgatccacattaaagatcgggaacccttgcgcataggttttataaaccacttcgccacggctggcatcatattgaaaataccgcatactagccaggtttgtcatctgcaaatcgctaagtcctttgaaggtcgcgtgcaggaaattagttaatccactgtcaggaaatgttgccgtatagttttcaaattcaatcgcaccggttcccgaatcagcggtcattcgtcgagtcgaacccgcagtataaagcgtgctatcaccaatttcacgtgcatcgacattgctggcggttttcgatggcattaacaaggagacataataattggcactttgttgatccatcagataagcatatggcggcagtttgattggctgcgtaaagaacgcaacttcgtgattgcctaaccgcttttcttcaattggaaaagcgcgggtaacctgggtcgtcacaagcttttggagctgatcctgtgagacgttggctaacttggcttcgtaaactctccgcgtggcatcgttaattaaggtcagttttttaaccgcaccatctaaattcaccaaaacccgattaaagtgaaaatcggaggctttgatttgatcttgcttgctaaaaaaccactgttcaaattgtttaaaactcatgacgtcttgatagataagttgcaggctgccatcttgttcaaggtaagtttcataattagccggcgagacttttcccaccgctttaacctgcgtcatatgccaatccgccattgcttgttgaacttcatggtcgatattggcattggctttaaatagcagctgcttttgaccacgatgcgtgtaataaacttggttaggcaggtaaacgttgccttccatttttttaacattcggatcgttttcggttgttacctgcacgttcgatgtacttcgacgctccagccgcgatggatttcgccaaatcaatgacgtaaagacgaggcttaaaataaccatggcgatcagactcacgcgcaaaatccaactactaagcttcatcccagtcatctcctccatcggtaatcggttcgtatggcagtgagatatagaatgtgctgccacggccttcttgtgaatcgacccaaatgcggccatgtaaggcttcaacgacttcttttgaaatcgccaagcctagaccggttccgccttgtttgcgggagcgcgccttatcaacgcgatagaagcgatcaaaaattttacccagatcctgacgcggaattcctagcccttgatcactgatggacaaaatcacgtgatcgtgcatctggaacaaccgtgctgtgatcacgccgccatccggactatatttaatcgcgttattcatgatgttatcaatcacttgcatgaacttgtctgtatcgatttcaacccaaagatcttcgtgggtaatttcccgcttaatcgaataacgcttcttttggccatccggctgtggcaacggttgtgcagtccgcgcctcaccggtgtgttcgttatccgtcttgagcatcatgtcgaatcggtccagaacatagttgaagaactcatttaaattgacggtttcaaggttgaacttactggtaccggaatctaaacgcgacagactcagcaagtcgttaatcattcgaatcatccggtcagtttcctcttgcgtaacatttagaaactgcggtgccagcttaggatctttccacgcaccatcacttaacgcttcaatataactacgcactgaggtcaacggcgtgcgcaattcatgtgacacattggaaacaaattccttacgatcgcgatcaatcttttgctgctccgttacgtcatgcaaaaccgcgaccagtcccgaaataaagccggtttcgcgttggatcaagctaaaatcaacccgcaaaatcagatcatgatcaagttgctccgaaaaatccaacaacaattcagtctggtgctcaagtaagtcacgcaaagtataatccttggcgatattgagtaacttcaaaatcgaaacgccaataacatcctcatttttagtattgagaaaactcaacgcggtctgattaataatgatgacattaccgcgccgatcagtagcaatcacgccatcggtcatatgagccaacacgctatccaaccggcgccgttccgcttcggaggcttcttgggcttcttcaacacgcacacttagattattgacggcgactgcaagctggccaagttcatcctgcccgtaaattcgaacctgaccggaatagtccccacgcgccatccgaatcgcctgttttttcatttcgtcaattggccgggtgatcgcgcgactaatgacaatggaaagtaacgtacccaataagccagcgactaaactggaaatcagaaaaataccaacgattttattaatactatcgtaggcttgctccattgatgctgaaatggcaatcgcgccaatgaccgaattattgtcgccggttgcgttcggattcttaatcggtacaaccttgtaataagtcgatcctgtacgctcccgatattcatagccttcgtattgttggccagagtacaacgtgtttttaatgttggaattagctgacttttgcccaatattagtctgggcgttaatatcactgtcaccgcgaatcgttccttttgcgtcaatcacttgtagatcagccgaattggcaatatctgcctgactcaaggtgcttttaatatcgtcattggcattgtcggtatcggtgcgcaacaaatccgcggccagcttatcttgaatatagctgtccacgttaacactcgtcttgaactgttcaatattttgctgctctaaggtcttaacaaaataggccccgatcatttccaatgtcacgaccagcaaaagaataaagacgatcgcgattttaaagtgaattgactgaaagaagcgaatctttttattcaacagtggtgctcctaattattcagcgtcaggatttcgcaaataatagcctacgccgcgtcgggtcaccaaccactcaggatgggacggattgtcttcgatcttctcgcggaggcggcgaaccgtcacatccacagtccggacatcgccaaagtagtcatagccccaaactgtctgtagcagatgttcgcgggtcataacctgtcccaagtggcgggcaaggtaatgcagcaattcaaactcgcggtgggttaattcgatattctcaccgcgtttagataccgtatacgcgtccggatgaatcgttaaatcgccaacttccaattcacgattggcttcgtcttcctcactgccggcagcattggctgatgaggtacggcgcaagttagccttcacccgcgcaacaagttctcgattggaaaacggcttggtaacataatcatctgccccaagctccagtcctaacactttatcaatttcggaatccttcgccgtcagcataataatcggcgtgtcatgttctttacgaatttgtcgggcaacttcaagcccatcaattttcggtaacatcaaatcaagtaaaatcaaatcaggtgattctgattcaactttcttcaaggcttcttcgccatcatatgcagtgacgacatcatagccttctttatccaaattaaacttgacgatatcagagataggcttctcatcgtcaacgaccaagatttttttcgccatcatcggccctccttggtttaagatacacttctatagtataacggttttaaagcaagagcgcgagccggtgcgcttagaagtcggagtgtaagtggcctcagccgtgatggccgggctttggccattgcggttgaggtccttacacgcagacttctgcaccggggagcgcgtttaagcaagagcgcgagcaggagcggttagcaatcggagtgtaagtggcctcaagcctaaatggctgggctttggccatttaggcttgaggtccttacacgcagacttctgcaccggggagcgcgtttaggaaagtgtcaacccttcctcggtctactctttaagtgacttccgctacttcgatccgcctccgcgatggtagccccccagctcttgctttctatcccagaacccgaaacaaggaacttatcccaccgctacttaccgttagttaacaccccacgcatgaatttttggaggttattttatgtttttccaccacgatcatctgaagctctactatcaaaaaagcggccacggaccggcgattatattgctacatggcaacggtgaggatcatacccttttcgccgatttaatcacgtatctcgccccgcattatactgtgattgccttggacagtcgtgatcacggtcaaagttcggctacggagcaacttagttatgatgcgatgacgtcagacgtttcagctttaatcactgaattggagttagcccgaccgatcatactcggcttttctgatggtggcattattgccttgttgctggcaattcggcaccccgaacaagtcggcgctttgattgttgccggggcgaatctgacgcctcaaggtttacgctggtattcgcgcattctttttcgtattgccgctggtcatcggccatctcctaagttagccatgatgctccatgaaccgcaaatcaccccgcaaatgctgcataggatcaccgtgccaaccttagtgctagcgggcagccgcgacttgattacacgtaaagaaactttttcgattgccagttcgattcaaaatgccgaattgcatattctccccggcgaaaaccacaactcatatattcgcgataaccacaagctttggcaccttatcagaccgtttctggccggactgcaagcggtcgattaaaatgaattatttttgtatatttaacattttgcttgcatattcattccaatgagtatatattcaatccataatcattaatgaggagtgaactatatgcggggaatcaaacattgggcggtcgcgatcattgcgctgatcgctatgatcgtcggcttcaccagttatcagccggttccaacggcagctgccagcaaagacttagcggcgattcaaaaacgcggctatttagtcgttggtctgtccgccgactacgccccattggagttccacgccacgattaacggtgctgacaccatcgtcggcgcagatatttccatgtccaagcaaatcgctaaggacatgggcgtgaaactgcaaatcaaagaaatgaacttcacggcgctgatcggggctttaaaaaccggcaagattgatttgatcgtctccggtatgtccaaaacacctgaacgggaaaaagaggttaacttttcaaccccttacctgtatgaaacgcaagtcatggtcattcgcaaggccgataaagccaagtacaaatcgattgccgacttttccggaaaacgagtaggggcacaaaagcaaacgacgcaggaacagcttgccaagacccaactgcccggtgcaaaagtcacgagcctggataaagcaaatgatgtggttgcacaaatttcgtacaacaaattggacgccggggttttggctagtaccattgccgactcctatgttgcccggacaccgagtttaaccgtgattgacccgcattttgcgactgacaaagccccaactgccatcgccgtcagcaagcaatcgcctgccttgttaaaacaagtcaacaagacgatcagcaaagttaaaggcgccaaatacaaaagttatctgcaagccgcctacaaactacaggatcaggatcaaggcttctgggctaagtacggtaactactttatccgcggcgctatttatactttggtcttcgcggtcttaacagtcttattcggaactatcatcggcacgctgcttgccttgatgaaactcagtcgcaattggctggctaaagtggtggctaacatctacatcgagtttattcggggtacgccgttgttggttcaagcgttcatcgtcttcttcggtacgcagatcctcggtttagatctcagcgcatttgttgccggcgcgatcgccatggctatcaactccggcgcatacgttgctgaaatcattcgtggcgggatcaattccgtccctgtcggtcaaaccgaggcggctcggtctttgggtctgcaccaaagccaggcaatgcgatacgtcattttgccacaagcaatgaagaacatctggccggcattaggcaatgagttcgtcaccgatattaaggaaagctcggtcttgtccgttatcggtgccaccgaattaatgtttgaaggtaccgttgtgcaaggcgcctcgttcaaaccattcctaccactggtcgttgtcgccattctttacttcatcatgacgtttaccctatcacgactactacgcctgattgaaaaacggtttaattaacctttgctttagcacgcctgccataacgcgctcacatttattaagggaggatatattttcatgacagaaaaaattgtactagcctactcaggtggtcttgatacatccgttgcgattccttggctcatggacaagggttatgaagtgattgcggtcgtcttgaatgtcggtcaaccggatgcggattttgacgcgattcaacaaaaagcgcttaaagtcggtgccattgattcgattgtcattgacgcccaagacgagttcgccgatcactatgttgcgccggtcatcaaggccaatgcgttatacgaaggcgactatccgttagtatcagcgttgtcacgcccattaatcatcgagcatctggttaaaatcgcccacgcccaaaatgccaccgcaattgcgcacggttctacgggtaaaggcaacgatcaggttcgctttgaagccgcgattcacgccttggatcccgaaatgaaaatcgaagcaccgattcgtgattttcactggtcacgagaagaagaaattgattacgccaaagatcatcatgtgccagtcccaatcggcaaaaagtcaccgtactcaattgacgccaatctctggggccgtgctaacgaagccggaattctcgaaaatccttggaatcaggcgccggatgacgcatgggggatgaccgttgcccctgaagcagcgccggataaaccgacttttcttgatctaacctttcaacaaggggtcccagtagcattaaatggtaaccccatgccgctggctgccatgatcaaacaacttaatcaaatcgccggtgcaaatggcattggtcggattgataaaatcgaaaatcgtctcgttggcatcaaatcgcgtgaagtctacgaagcaccggctgcagcagtcatcatgacggcgcaccacgatctggaaaacctcacgcttgaacgcgacgtccaacatttcaagccaaccattgagaataaattgacgaatatgatttacgaagcccaatggatctcacctttattcgatgctttgatggctttcatcgataaaacccaagccgtcgtcaatggcaccgtcaagatgaaactttacaaaggcagtgccgtcccagtcgcgcgtcagtccactcacaactcactttacgatgaagacctggcaacctacaccagtgccgattcctttgatcaggaagcggccgcgggcttcatcaaactttggacgctgccgaccactgtctttgagcaagtcaaccatgttcactccgaggaaaagcaacatgactgataagctatggggcggccggttcaccgaaaaagccgcgcactgggttgatgcattcggcgcatccatcagttttgatcaacaaatggccaaagaggatcttgaaggatcgctagcccatgtcaaaatgctaggcaaaaccggcatcatcccgcaagccgatgccgacacgatcaccgctggcttacatcacctgcaaaaagaactggcagcaggcaaattgcattttaccgttgaaaatgaagatattcatctcaacatggaagccttactgacagccgaaatcgggccagtcgccggcaagctgcacacggctcgttcccgcaatgatcaggtagcgaccgccctccatctatggctcaaacatcgcctgcctgctattaaagaggccttgacgaacctgcaaaccgttctcgttggtcaggcgaaggcccacgccgccacgatcatgcctggttacacccacatgcagcacgcccagccaatcacctatggccattatttgttggcgtatttcgaaatgttccagcgcgactgggaacgtttcgactttacccaaaagcacaccgacatcttgccattaggcgcggctgcactggctggcacgacttttccgattgatcgcgaacttgtggctcaggaattaggcttcgatcagctgtatcacaacagtctggacgccgtatcggatcgcgactttgcactggaatttctcagtaacagcgcgattttgatgcagcatctgagtcgcatggccgaagaactgattttgtggtcaacatttgagtttaattacatcgaactcggcgatgacttttccaccggcagctcgattatgccgcaaaagaaaaacccggattttgccgagctgattcggggcaaaaccgggcgcgtatatggtgcgctgatggggctgctcaccaccatgaaggccattccgctggcgtacaacaaggatatgcaagaggataaggaaccgatttttgatgcttataacacgatccttggctccttgcatattttcaccggcatgcttagtgatctcacggtgcatgaacagcgcatggccgccgccacaacgcatgacttcagcaatgcaaccgaactggcagactacttggcaacaaagggcgttcctttccgccaagcccacgcaattgtcggcgagttagtgctaaaaggcatcaaaaccggcacggcgcttcaggaaatgccattaagcgaacttcaggaagccgcaccgcaaatccaagaagacgtctacgcagaactcacctcaaaagcagccgtcaatcgccgtacctcccttggtggaacagcggttagcaacgttttgaaagaagttgcccgcgatgagaaaatcattgccgatcatgaaaacgcggcaccttccatgtaagtaaagcaacgatatttgaagttatgcatcacgacaaaataaaatcggtcttagagtggcaagacgctctaagaccgattttgctttccttacgacatttgaatcaacaaggacacaacgacttcaatcattaccttgtgcgtttttgcaaactaaacgttgaccacggtttgattagcgttaacagatctgcgtcatcagccgcaacatggccaattaaattccgctggccatcatcgctaaatggtgtcaaaacaatttggaattcacctttatagcggccatacgcatcgttgacgatcacaatatcgccgcgtttgaagggttggccatggtcgtgggcgggaatactggccgtgctatacgtgatacgaggctgggtatcccgcagtaaatacgccgatgcatccccacgatataaatgcggcgcggcaaatgctattttttcttcaagcggcgtgatacttgccaacatttcggcatgcaagatcgggtatggcgccaggaaagtatcggcaacggttttgagttccgcttcagtcgcgaaggcattaccgatgatcacgtcatcaatcaagccggtcagacacaaatgcgttgtttgactggcaatgttgcgatggcgatcagactccattgtcggtaacccatcatgcagcggccaaggcccgattttaccgctggctgacgacacaaatgcggcggtatgcaatccatactcccggtactgctgggagtattcggtaaagatagcctcactcagacctgtgaacgcctgcggatagaagttatgacagccgattaggttatcgcggttaggatcataagccatgatgctcgcaagataattggtcccatggctcatattcaattcgatttttaagccatagggattgcgggtcatccgcgcttcttccgcgccggtgaagccttcatccagccgcagtccccaaacatgaagcgtttcaaaaaaactcagatcgtcatagctaatcttcagctccttgaacaacgccggattaatatcaacgatcgtcttaaacccaagctgattggcataatcgattgtctggcgaaacttagccagcagatcttcaccatcttcccccagcagttgcaagagtgaggtgaaaatgcgggtataaccatactgatgtgccagatcaagataggctttgttctcctcgaaactgctttgatccggataaagcgagatacctaatcgtttcatttcacaagaatcccttcttagttaaaatactgtgctgccatttgccgtgacatcttcttaaagcgatgtttgcgttgccagtttaataaaaatccggccgtgcgattgttggctttgccttttgcggttttgccttcaatgatttcagtgtaatccagctgcatctgctgatcaccgagatcgcgtaattgataatccacatgataatgatcgcggtcagtgtctagttcatacgcgtaacgctgattggcaatggcatgcgtaatcgtcagctttcccgtcatgccattcgcccatttcttctggtacgtgaacccatcaagactgcccaccagaacttctcgcccagtgtgcgccttgatgtccgcctgagccgagcgaatcagctgcccatacatgaacgccgccggaaccttgagtgtcatctgaattttcaactgaaaaccgcctttctaaaacaatttttcctataaccgtcaatcagcaagctgggctggtttaattcgattggctgctttaacaaatggtacatagattaagaagccgatgatcatattcacagcctgtagcacgactgctcgccagtccatggttgcaactaaagcatttaaaaatggcggcatcgaccagacaatctgattcttgatcggtgagaccaacccactcactaccgcgccataagcaatggaaaccatcactaccggcgccaaaataaacggaatgaagtaaataggatcaagcacaatcggcatcccaaacataaccggttcattgacattgaagaaccctggcgcaattgacagctttgcaactgcacgctgatcatcgcgctttgagaacatcagaatcgcaatcagcagtagcaaggttgaaccggcgccaccaatccaggcatataagtcaaatgaattgcgagtccacagatacggcagtgcttggcctttctgaaaggcattgatattcgccaactgcgccgttaaccagatactatcaagcaccggtcctaatacattggttccgtggatgccgaagaaccagaagacttgaaccaaaatcgtcataatcagcacggaaccgtaaccttgactcaaacttaacaaaggttcttgtaaaactttagcgataaattcaatcacggtcgtaccaaattgagtaaacagatagttgataatacccacgccgtacaaggcaaccgccgccggtacaatcccggtaaatgcattagcaacagccggtggaaccgaatccggcattttaatggtgatatgtttcttcatcaaccagatgtaaatagttgcggcaatcgcgcccatcagcataacggtgaagaaaccatacgccccgaagaacttgccaaagttgaagaatccccacatgctgacatctttaccggaaacaaccgctccggcatcggtcaatgtttttacggcaccttttgccagcccagccttcaacgtcatggtgaagttttgcggcaagctcataatgaaggtgcccaaggtgacgattcctgccgtcacaggttcaaccttgtactgcaccgcgagctgatagccaaacgtgaatgagaagattaagccaagaatagctaaggttccggtccagacaacagcgttaatgccgataagccactgcattgagttaacgaaaccggtccagccaaattgggtcggaatatcccgaatcaaagcgttcagcacggtggaaaccgcccctgccatcatggctggcatgatcgcaataaaagcatcacgtaaggccaccagccaccggattgatccgatacgcgctgcgattgggacaacatgtttattgagccaattgataagtccgttcatcttgtacactctccttgagttttaagcacgctggccgcttcttggcacaccagcgcataatgatttcatttgaaccaacttcggttttaactaccgattcaaatcgatattggtcgtatggtagtacaacgttagacccggataaacaaaataagttcgggaaaagttgaagactttgccgctagctagatagttgatcccgtctaagcacaggtgatcagtctgtgccgacatcgccatcaactcggcatactcggctggtaatggtcgtgattggatataattttccgttgtgcttccaaccatggcataggtgttacgcaaatacgtgaagatcgaacccgccgcaatctcagctgaaagatgtggcacaattgcttgcggaaaatacgattcttccaagtcgtacaattgcccttttaaatagcgcaaccgcacgacttgatagaccatatcgccgcggctgacattccctcgttgcgccaaggctgctgtcgcggggataagcgcaaacttaaccactttggaagtcagcggtccgcctttcaccatggctgtctgatcaaagcctatcgacatattgaggacagcatcggattgagccgaatgatcaatgacatagtacccgctaccttgaacccggcgaaccaacccatgggcaaataccacatccagtgccttccgaatcgtattgcggctggcttgataacgatccatcaacacctgttcagtcggtagcttaaccggatactgaccagccagaatatcttgaatgagttgttcggcaatatcgtgatacatcaaagtcctcctccaaacttaaagtgttcatttattttcaaacctatcagccacgggcagttgccattgcgcgctaacggcatgatccgcaacctgacaggttaatgagcacggcacaatgttctgaaagcgcttgtaaaatttgtacctacgaattataatatcacatgaaacggaaaacgattacattatttttaaaaaggagccgattttcatggcagaaaaaaagatcatgttagtttgtgcagctggtatgtcaaccagtatgttagtaacgcggatgcaaaaggccgccgaaaaagatggactttcggttcatatttttgctacagctgcctctgatgcagacaacaaactggaaagcgaaaaaccagatgtcttaatgttgggcccgcaagtccgttatcttgaaagtcagttcaaacgcgacctcgatattccggttagtgtcatcaacatgcaggactacggattgatgaacggtgaaaaagcgttaaaggcctcactcaaagccattgatgacagcaaaggagcggaagcctgatgccagaagacgaccaaaatcttgaaaccgttatgggcttgatcatgaacggcggcaatgccaaaagttcagcctttgaagccattcacgctgctaaggccggtgatttcaagctggctgacgataaactaaaagaatcggatcatttcctcaccgaagcgcataacgtccagaccggcatgctcacagctgaagcgcaaggcgaccacgccaaagtcaccctgctcatggttcacagtcaggatcatttaatgaatgccattaccttccgcgacctagccggagaaattgtcgcactgtacaaacggttagccgaaaaagaggcctgacaacacactgtagtcacctgcaaaggcttatttgttgtgtctaattttcgatatatcgataccttccagaaattcaaagcaagcaaaaagacgactcacttgaagtcgtctctttgcttgctttattttactttgactgccgctgtgcttgccattcctcacgtaagatgccgtacttcacggaatcccaataccgatcctgatagtagcgaacctgccgcacgcgggcttcttgtttcattcctacagacttggcaaggccgatcatgcgttcattgccggaccaagttgtgatccccagatgtggcaaatcaatgagtccgaaaatacgatcaatccactgatctaatgcctgcttgccaatacctttactccaataagtttcatcgtaaatcacaatgcctaaatccagccaccgttgcaagtcgccatcttcgtagtgcgcagatacatccccaaccagaatgccatcgacccaaataccattgacaaaaggattcgccacccattggtaccctgtttgattagcctgattctcctgcatctcttccagtgtcggaactttatcgttaaagtaaggtccattccatttgtgccattctgcattgggatcggaaaaggcaactttccacaacgtttcaagatcctcggtttgaaaatgttttagcgttactgtcatgcctcagcactcctcttttatgtttgttaacaacataccacaattattgcccgggaaataatctaagttgtagctaggttaatctaaattttagtatgacacttatttggtgctggtgttagaccatatttaacctgtaggctggttggcgtatgctgtagctaggtttggtgatttgtgtttttgggtgctgcaggtggtgctcgctcaccggcgcagaaacctgcgtgtaaggaccttaagcgcaatggtcaaaacccggttatcacgcttaaggccgctcatgttctgatttatgcccataacgcgctcaccggcgcagaagtctgcacataaggaccttggtcgtaatggtcaaacccgggcagctcgcttaaggccgcttatgttctggtttacgcccataacgcgctcaccggcgcagaagtctgcacataaggaccttggtcgtaatggccaaaacccgggcagctcgcttaaggctgcttatgttctggtttatgcccataacgcgctcactggcgcagaaacctgcacataaggaccttggtcgtaatggccaaaaccgggcagctcgcttatggcggcttatgttctggtttacgcccataacgcgctcaccggcgcagaagtctgcgtgtaaggaccttaagcgcaatggccaaaacccggccatcacgcttaaggccgcttacactccgacttctaaccgcgccggttcgcgcttactttttttaggaggttttcccttggcagattatgttaaacagattcgtgcaaaagttggccatacgccactgattatggctggggttattggtattttggctgatgaagcgggacgggttttgtttcagcaacgtagcgattttaaaggtcaatggggtcttatcagtggcaccattgagtatggtgaaacgcctgcacagaccatgattcgcgagtttaaagaagaaacgaacttaacggttaaggttgtttctttgctcggggttgatggtgacctcatccttacttatcccaatggcgatgttgcacaatggctttgtccggtgtttctcgtgaaacaattaggtggcgagcttagtgccgataacgatgaaactgaagagttgcaatactttgcgccaagcgaggcaccgcggctttttaatcagcagcatcgtgccgcattggcccatttcattgctgacgaaacggggtacttcgattaatgaaacaacttattatcctccgaggtaattcaggtagtggcaaaacaaccaccgcaaaggccttacgtaagcatctggctaactcgctgctaatttctcaagatgttgttcgccgcgacatgttagccgaaaaggataagcctaatagtcctaacatcgaattgattgatctgattgcccgttttgggttttctcatcaacaaattgtgattgttgagggtatcttaagtgcggctcgctatggccaaatgcttaaagcgctcatgaccactgccgatcaaagtctggtttactactttgatctatcgtttgacgaaactctccgacgccacgcccaccgcccgcaagcagccgcttttggcgcagaggctatgcatcggtggtttcgaccgcatgactatctgggcgtccccaatgagcacttgattcaggctgatcaatcacaagacactgtcgtcagtcgaatactggccgatcttaacaagcgaaactctgatcaagcgcgctattccgactgaaaccttagcccacttcggaattttggtttaaagacgttgtataacctcctcagggcaaaatattactgctttcgtctgtttcggactagaatgatggcgtgatgatgttcttggtaagtattggcattcatgagactgcgttaactggtacggcagctagcaagtaaggaccgaacagcatattgggctgagggtttaaatcgcctacctgttggctgtcgttttcgcagttgacgcccactaaggagtgtttttcatgacaagttatccacgtcgcgatcccgtgacagatcagctgttaaccccggaaaattctgctttgattttaattgattaccaaccgacccaagttgagtcgattggctcgatgaatcaccatacgctcattcaaaatgtggtgatgacggccaagttggctcaagtctacaaagtgccgatcatcctttcaactgttaacgtcaaaagcggtcggaataaggacacgattcctgatctgaaaaaagtccttggtgatctgccgagtattgatcgaacatcgattaatgcgtggcaggatcaggactttgttgaagcagtcaaagcaacgggccgcaagaatctggttatggcagctttatggaccgaagcctgtctgacttttccaacccttgatgctttagcagaaggcttccatgtctttcctgttgttgatgcagtcggcggcacatcaacgattgcgcacgaaaccgcattgcgccgcatcgaacaagccggtgctcagttgaccacgaatgcccagttagcttgcgagtggcagcgtgactggaatcgaaccgagactgtcccggattttgttaaattgatgcttgagtcaggcgacttcatcaatctgggcgcttagtttaaggtgctacaaggatttacaggttgaatcggtcttagaggcgaaatatgtctctaaggccgatttctcttttcgcatacgccttgttctagccggatcagtcaaaatatcgttcccacataaataataggtgggtcgcggaggtatttcatatgcaacatcttacaaccacgtctaaacgctggtggttactgattgcgttgggcttttttgcgtttatgacgaatcttgatggttcaatcgttaacattgcaatcccgctgatggccaagaaccttcatgtctccgctagccggatggaatggactgtgtcgttatatctgattgttttaagtgctttgctgctgccttttggtaaactcggtgatcgcattggtaaacgccggattttcaaatggggtacagggacttttgtgcttggttctttgatggcgggaattaatctgggctttaactttttgatgttgggccgcatggtgcaggcgctgggtggggcgatgacgttagcgaacacttatggcatcgtgacttccacctttgctttggcggaacgtggccgggcgatgggcgtcgtgagtacctttgtcgcactgggcggggttgccgggcccagtcttggcggacttattctggcacactttagctggccgatgatttttctgattaatgtgcccattggtttgatcgcgctgggcatctccttgtggtcaatggacaatggtcggccccaacccggcgcttatgacggcgtcggcatggtgttgcaagcaaccgccattgccagcgggttctggggacttaacttagcgcaacaaagcggttttagtgatcccctcgttcttgccacgttagcgttggcatttatcagcttagtggcgtttcttggctttgagcatcatcagtcagctccgctactacccatgagtatctttcgggtccgcatctttacactcggcgttttgactgttttcttcatcttcatggttcagttctttagtaccgtcttgatgcccttttaccttgaagacgcgcgcgggctcacaccgggtgcggttggggcgctgttgtcgctgtacccgttgatgatggtcttctttgctccattaggcggatggctggcggacaaatggcaggttcctgctgtcgcgctgttaggtagtctactcattgcaatcggcagtctgctgggtgccacgctcaaactcaacgccccgttaactgtctacatcatcagcacgcttttgatcggcatcggaagcggcttgtttcaatcccccattggcgacgtggtcatgtcagtagtgccaaaagcgcaacttggcattgccggcagctttaatgccttagcccgcaatctcggcatggtaagcggcaccgcggtagcaaccacggtcttatttggcaccatgagtcacttggcagcgcgccgggtcacgacctatcccgccaaccacccggaatttttcatggtcggcttacagattgcgatgctcgttgcggccggattagcgctccttggtgccattgccatcgcactcaccatcaaaccttggcaggcgcacgagaagaactgacgaaccgtcttcaccccggcatcttttccccttcactgaaaaaagtgatagcataaaatcactgggcacatttttgaggaggaaaaagacgcatggaaaagaaccaatcaacaactttgctcacatggggcatacttttggtgggtgcgaatctgcgcctgccgattaccatgatcccgccgctactacccaccattgaacgcacattggggttaccggcttcgatggctggcatgttgaccaccattccactgttgatgttcgcattagcatcgccactcatcgccaaaatgggaaatcggcgcggtaatgagtggagcttgcttattgcactcattattttattacttggcagcttacttcgcattatccctagtctcatcgccttggtaatcggtacgctgctcatcggctttggcatttcaggcggcaatgtcttgctgccggcgatcatcaaggatcagtttccgcagtcgattggcgccaaaaccagcctctacaccgtgaccatggggctagtcgcatcgctgggaaccggactggcaggactattgaaccaacaatttcatatgaagttcaccatggctgccttctccttagtcggcgtggctggcttagtagtctgggcccttgcctttcgtcggctggcaccggtaaaaaatcaggccgcgactggccggcgaaatgttcgcgtgtcccgttcgctgttagcctggtggattgccttatttttcggcttacaaagttttctctattactcattactgacatggcttcctagtctttggcatgcggctggtttttcgcaactggctgcgggcaacctggcaacaatttttcagttgagcggcatgccggcaaccctgtcgattccgtttatcgcagagcggcgtcatggcatggcctatagcgtttggggaattatgctcggttttgtattaggggctttgggcgtgctcatccccggagccaacttcgggttgaatgtggtcttctccttactaatgggcgtggcttccggggcggcttttgcgatctgtatcgtcttcttccagaagaaaactgccgatgcgtacgaaacagccagtctatccggctttgcgcagagtctcggttatctctttgctgcagttggccctgtgctttatggttttattcaaacaaccaccggctcatggaatctgttattatggatcacagtagggttaaccctattcatgtttggtgccggacttatcattaacgccaaacacagtattttcgcccctagtgatcatcggtagcgcttgcacgattaatgcgtattccttaaactgacattgaaggacaacaagaggaggccacaaaatggcaatcacaacaacaattggaaaaagtcatgtcatcaccggcaaacttggtttaggcaccaataaagttggcggccacaacctttttccgaatctacatgatgaagacggacttgcggttgtgaaaacggcgctggatcatggcattgagatgctcgacacagcttatatgtacggtcttggccaatccgaaacgttaatcggtcaggccatccaaggctatgaccgcgcaaaaattgttttggcaaccaaagccgcgcaagatccccatcaagatttaaaaccgaataacgatcctaagttcttaacgcaggcaattgacgacgccttgttgcgccttaaaaccgattatctcgatatcttctacattcattttccagatgacaaaaccgataaggcggaggcggtcaatgcagtcgccaatgcgcgtaaagccggtaaagttcgcgctatcggggtttccaacttctcacttgatcaaattaaagaagccaaccaagacgatcaagttgatgttgtggaagatcattacagccttgtccaccgcgatgccgaaacgacgctgttcccttatctaaaagagcatcagatcagctttgtcccatacttcccccttgcctcgggcttgttaaccggtaaatatgggcctgacgatgctgacaaattcaagaagcgcttttctgctgatgaattcaaagaaattttagccgcacttcgcgaagttgacggcattgcggatgcacatcaagcaacgattgcgcagattatgctcgcttggtacatgaagaaccccgacattgccgttgtcatccccggtgcccgcctgccagaacaagctgccagcaatgctaaagcgctcgatgtcgatctacgggatgcagaatacgaatcgatcaatgagttgttcaaaaacttcaaaacaaagtaaccggcgcttgctgatttccagcagtgaaaataaaccgctccataaaaaaacagctcacagccttcaaaaaagaagtcctgtgagctgtctttttgtcttatacgcctgggatcgttgctacttcttgcgtgtaaaggcgcgctttacgacttgccagaaagttaacgacttaacaattcgctcggcgggaatgtgcacccgaatggcacgtaaaacccgcttaggatctttcgctgcaaacgtatacgtcccattctttttggttttaatggcaaagcgcgggatccacttacctttgaagatgacggaagcaatgacccagtccacttcattccacggaatctgatagaagtcacgtacgtttttttcattgaaaaattcgaatcctttatcaccgatcatgatcttgccataggccggcattcccataaaggccgtaccttcaatcactaactcggatttggtgttgattgattgaaccattttttgccatccttttaaactgaacttgactgtgcttgctgatgtgccttgcttgttgggtttattggttttggagagactttcgccaaaatgcgctcgtggcgctgcattcatgtaaggatctctggcgaggtttaaacttaccctccaaaacgcgctcaccagcccagaaacctgcacataaggaccttggtcgcaatgaccaaagcccggtcatcacgcccaaggccacttatgctccggtttctaaccgggctggttcacgctctccattataaaacaaaagcccagactttgtgtctgagcttttgaagtcttggttcgacttttggtggttgatcttacatcaaaccgatgacgtggaagacaaccccgacgacgaacagaccaagaatgataataattggagaaactttcttcttcagcaaccacatgcagaacaaggtaagcagtaagcccatcaaacctggaattaagctatccaagttatcctgtaaggtcgtaaccttgtttttagtcagtgacaagccttgagattgtaattctaaagccttttgaactccagcttttccgcttggtaatgaactccagtcaatgtaagcacctttttggtttggaacatttgaaacaaccggggtgaacttgacggatacccagcggttaaccagtgatcctaggataaacataccaaggatcgtggcacccttcgtaacttcaccaagcaagccacctgacaagtcttcagtaatcttactacctgctttatagccaaattcctgcgtgtaccataggaaggccatacgaatcgcattccataaaacaaagtacaaaattggtcctaagagattgccggccatcgccatggatgcggctaacgcaccaataattggcttaaccgtgaaccagaacactggatcgccgacaccagccagcggacccatcatcccgactttgacaccctgaatggctttatcgtcaattggggcaccattagcacgttcttcttccagtgccatcgtaacacccagaatcggtgaagccagatatgggtgcgtgttaaagaattccaagtgccgcttcaaagcagcggaacgatcttccttagtatgatacaaacgcttcagtgctggaattaaggtataagcccagccaccattttgcatacgttcgtagttccaagaaccttgaaggaaggttgaccgccaccaaaccttaattcggtcgccttttgtgatatgaacttcttcagccatgtttgtcaacctccttttcaataattatcaataatgtcgccgacaggatcaccggcaccactattcgaaccgccattacctgagccgccgccttgcttggacaatgccaagtaaatcagtgccagtgaaataccgatagcaccaaggccgatcagggtaatttctttaactgttgccagcacaaacccaatcgcaaagaatggccatacttcacgagtcgccatcatgttaataaccatagcgtacccgacagcaacaaccatgcccccgccaatgccaagaccagtcgttaaccaatcaggcatctgttcaagcaatgcccgcactgggccggcaccaacagcaagaattaaacctgcaggaatcgcaatccgcaagccctgcatgcagatcgcgacccattgccagaaatcaattttcccgaaactgccttcttcagcagcacggtccatgatatgaacgatcgcagttgccaaggtacgtactaaggtggtcagcaacaaaccggcaaccgccagtggaaccgcaatcgcaatcgctgaactaacacctttagtaccctgaccgccaagaactagaataatagctgatgcaactgaggccaatgcagcatctggtgcaacggccgcgccaatgttagcccagcctaaagcgatcatttgtaattggccacccagtaccaaacatggggccagattgccggtcacaagtccgatcaacgtgcacgcaataactggctgatggaagtggaattcatccaaaataccttccataccagcaaggaatgacacgatgaggaccagaatgatttgaataaaattcaaagtcatgagtcttcttcctccgtttcaaaaattacttctgcgcattcagttcgtcttgtgctttcttcaaaattgcattcatgtcatccggatgatcagatggcaccttgcgaacgtcaaacttcacaccatcatcagccagcttatggaaggtatcgatatccttctgatcaaatgctagcactttgttaggttgaactttacccactgaatgtgacattgaaccaatgttgagttccttgattggaacgccgccttcgattgcgcgaagggcgtcttccggtgtttcaaataatagcaatgcgcgctggccgccaaagtgtttgtcatctttggccagcttaatcatctgatcaattggcacaacatgcgccttaacgccagacggagctgcttccttaatcaggttcttccgcagttcgtctttggcaactgaatcagaaacaacgataatccgtgttgggttcgttgtcttggtccaggtcgttgcaacctgaccatgcagcaaacgtgaatcaacccgcgccaaaacgtattggaatgaacccggttgaccagcattagccgtgcttggtgcagcagcctgagcagctggtttcttcactttatccagtgcttccggcttgatcttgattccgtcacgtccggcatcgagcaaatgcgctgcgatgtcttgtgcagaatccatcgaaagtcgcgagccatatgcttcaatcaacatcggcaagttaagcccggtcacaatcgcccatttatccttgtgctcctcgtaaatcgagtttgcctggttaaacggtgatccgccccatagatcgattaaaaacaatacttcgtcatctgggtcgaacttagcgatcgcgtcttcgagatgcttgtgcaagtcatctggtccttcatcgggcatgaaggtcacagcttcgactttttcttgctcaccgaagatcatttgaccggattgcttgatgccagcagcgaattggccgtgactagcaagaatgattccgaccatttttacgcctcctaaaaatttgtggttgcctcgaaaataatatctgctaaaaacaaaaataatttaaaaaacaaggcttcccaatagcttagtatgacgtcccgggcacagctatgcaagcattttcactcaaaaacaaacctaaaaaagaagcgtatacattgcaagtacgcttcaaaaaagattttttttaaatcggtctaattggtagataccaattattgcaaaggtttcctaggccttagagggatcgctttcaaaatcggtaaatatcggatcggcaatgcggttacccatcaccaaaagtgctaaacacagtataagtgacaaacatgccatgaccatccagctaactgcggcgctcacgacattggcaattgtgaagaataccatttgtcccactggcatcccgagtagcgcgacgagattaatgaccccggctgtcgtccccatctgccgctcaggaacgagtcgcatcatcactgttgaaagccgtggattgattttgcccataagataggcggttgcaaaactaaagatcatcgctgcccaaagtgactgcagaagaaagaagctgcaacttaaaccgatcatggccgccatcaacaagcccaacagcttaaaggtgctcagccgctgcaggccgtcttttgcaaatagcgcccccagaatcagtcccactgaaaagataatgttcatgatcgcaacagttgtcccgaaattgcgcagccacatcatcggctgttgaaccagcgtgactgacatcaagccgtcaacggatgagcccagtgtgttaaccagcatcgcaaagataatcactgccaacaagaagtgattcgttgtcagaaatcggatcacattgcggatgtttttaaaaatcggttgatgaacgtgggttgcaacaggcggttcggcttgcttgagtcgtttattttgccggatcaagacaaccgccgccaatagaaaggtcacggcattgatggccccaaacagtgcatagttgtgatccagcagaacaatcagactggcgcccactgcctgaaagaccatttgcacggtcgtccccgttgcactctgaaaactaatcgccgtatttagttccttggccggaatcaagcggtgcaagattggcaaggttagaccgttaccatattgccccaacgtatcggacaagatgttgatggtaagcaaccccaagaataacggtaggcttgcaggcaacacgatcatcccggccagaccacagaaaagcaacatctgcccgatccgcgcagctaccatatggcgggttttggcttgcgtccgatccgcgagactgccggtgatcattgacagcatcgtcggtaaacttgtcgccatggcggctaaggtaaccgccagacttttaaatggcattgtagcagcgtagataatgaaaacgatattgtataggctatcaccaatgccacttaacagactggcgtttaaaatggcccgatagccatgattgttcatgtattcatgcatgacgaccacactcctttttgtactgcgtgatgaacttgtttgtactttgagtgtaggtagtctagaataacaccgaggtgaaattccactatggtagaaaaaatcgatccaaccgatggcgccgtttttcgccaattgcggcttaatcaccaccaaaccttggcacaagtagcagacgagcagaattccactgcgtttattagtaaatttgaacaaggcaaatccaatatcagcttttcccggctcagccacctgcttttccgtatcaatatgtcagtggaggagtttcttttcattcgcgatcttcaagccggaattgtcccgccgctcaaggattcggagttcacttacaacatgttgattcatcgcgattttgaagcggtacttgcttttcaggatcgctttagctctgaagaaccaacattggccgactatcgctatttacttaagcaagagaaaatctggcagcaacgttacgctcaggatcacaatcgccaaacccagttcgaatttatcaccattcgaatttttcgcttgaccatgattgatcgggttaagccgcctgaacagccatcgccatttacaaatgttgaagatgcgatgacccagttgcaggcgcttgccaaaccagttgttagctacctgtacacggtcgaagtctggaattattttgaactgtattggtttcgacatctgatggtcgctttgccagttgagacgatccataatcttttaccgctggcgatcaagcgctccgaaaaatatcgtgcgttcaatcaaatcggaaccttgcgtgtcaaaaccctcttttccgcctttacggtcttcatcaatgcccgccagctgccggatgccaaaaaagcacttaccactgcagaacggcttttgtatgacgccaatgatctagccaattcggcactgcttttattccttcgcggctggtatcaagccgtcgccggccaaacagctgccggctttgagttgtgccagcaagccattagtttggaacacattttggatcaaccgcggcaggaacgatggttgcgttatttattaaaatttattcatcaaaacattgcggatcctgaaagtagcgctctttttctgtgagcagtggttaacagccaaaaagcccagcttccttggcgacgtttcacgtggaacacaatatcacaccaaaaaggacgcactcgccatcctctcggcagtacgtccttttcaactgtaaacactcactttaatactgacacgtcacgcttgatctaaacactgtttcataacgcagctttaagcatccttgccacagcgttttgcttctgccagtgcttccagcgccggcagccaggatgacgtccattccggcgttgcaatcttctgcagcatggcaattaacgcgtcaagttcctgttggccgcgcagcgaaactcggcgatcaggggcatcaatcatcaataagcgtttggtgcacgcaatctgaaattcaacccctaaatcaccaaccgttgcctgtctaatgaaggccagtgtctgttgtgcttcttttcgccgtcccgcgtcaatataacgcagcgttgcggtcaaaaaagtccggttagccagattcaagtgatcttgcggggtattcgggctttgcacctgaaccgaaaatgcatgcgtcaactgcgctaaatcacttaaaggaaccaccgcagctagctgcagagcaatcaagcgtagtaacaatgaccaggccgccgtttttaacaataacgtctgtgcctgcatttgttcacgagccagaatcgaaaatcgctccggtgccaggttgtgcagagtcaggtgcaaaagtagccgctgattcgtgttcgctaatggcaattgccgcaagattccggccagcgtctgcacatccccgtggcgaacggctactaaataacggtgcaaaaacggtcgcttattatcggactgtggctgggtaaaggtatcccaatccaagttcaaccgatccagcaacaggaaaaatcgatcggcagctaactgagacgttccattttcaaattttgacagactcgataccgataaaatatcgcccgcagcctcttttagcgtaagtttgcgttctttgcgcatcaacttaaactgtttgccaattgtcaacttgaacgcacctcctcttcaagaaaccgctgccaacttttggtcaacaattgcgcgaaaaaaggagaatctaataacgccaatgtcgccaacaacttttcgatctcggctttggctgcccgatgctgacctcgatgatacatcagcagttgatgctggtaacgcagcatcaaccgcgaataaagatcgtccggcggtattgccaagttcatcgcaatatgccatagacgggtcgcatccgcaaactcacggcgatgaatcaacaaggcaatgctatttgtcaaaatagcccacaaatactgatcccgcaccggatgacttttagtatcaggcaagtccagaaccattccggtcaccaaattaaccaactgctcactgtcataaagcatcaaggtagccgcaaaaagatccagttcatacaagccccaatgccgaatccgttttagatacttgatcacatcatgcttcatcttcatagtggtctgaaagctcggatcggaaaattcattatgggctaaaatattaatctgattcaggcgataaaagacaaatcccgtttgccgccaaagctggtactgcttctgcgccaacgcctgcaacgccgacttacctgctaccgttgcccgttccacttcttgaaaaaagttctcctgattgagcgcccgatacccttgctgaatcgaggccacgtcttggtcaaatcgagtcaacagtttcaaaaccacagcggcactaagctgtgtctcgccgcgttcaaaccgtgacaaagtagcggccgttgtgatcccagccgctatttcttctaatgaatcattttcctcgagacgcaaagtacgtaaataggccccgattttgatagcttcctccgtcatcagcacccgacccttttatgagaactttattaaacaaatttaacacgttttgccattttttaaaatatctttttgcttgtatcttcctgatgatatgttttaatcaagtatgacaccgtttacatcaataaaacgaaggagaatagccatgagagaatcgcaaacctggatttcttttttaagcaccagaaaccccgccctcaagatgcgtcccttggcatactgtttcataaagacttgtctattagccggcccgtatagcgcttttatgagcttgttcatcaccggtgaaatattatggactttttccgcaattatctttatgtgcatcgtggtctttgttgctaatatagttgcagctatctcctatgcaaagaaaggaaccttggtaagcctttttaagtccaaaaagaggtggctcgtacaagcttttgcttcagcgttgggaacttttttactactttcgctcaggctcttagtcgcatatatgtaaaagcgattgctgcccagacttaaactctgactatgactcttcaaatgttggttaagcttcgcagcgatgcgtcatggctttagcagaagctatagcattgtcataaagcaccttaactctgccaacttgaacttttaattatcggttaacaatgtctcagccttgccagctgtcaccttcatgtatagagaaaagttaaaatacttcgcctctaacattctaactagcgctatacgtgctatgattagcaccaccgttattcactttatcaacaacttgtgctcatttacattaagaaatcgcgtagaggggtgtgataattttgggccttgtagaaaactggtttccgtttatctggttgctactcttaggaagtgggagtctttccgtttatacgttttatttgcgtcgtaagtttcactacaatccgtacagtctgaaaaaggcctttagtaattcaccaactaatccctttcaatttggaaaacaaagcaattctaagatacgccagttaataacttggtcaaaggtgacgctgcttctttttgtaattaccgatattgctacattcgttcttttaattatgaccatcacagatgtcatttccaataattcaattgataatccttggtcaatcatcattgtgagttcctttgctgttggactagggattctttttaacgtcatcgctcagaaaaaaatgacattacagataaagcactatcaacaaataaaaaataaggtaaccttcgcgatgccgattcaaagtttttttgacagtcaagcgccgtctgtcggttttcgtatccttagcctaagcattatcaacctagtttgtctatagagcgctatttttgcgactgttatgcttctagcaatccctaaccttcattaactctgcatttacacttactttttctggcttagtacttgtattgagtgacgatgtgttatgatcgacaacaacaccactgcatgctagtgttgcttccgcacccctgtcttctcgaggaccaacttgaaagcgagtgatatgctcttgtccttttcagtaaattggttaataatggcgattttccccctatttctcagtatctgtctttcagtttattctggatacttaaggaaaaagtttaggattaatcctattagtataaaaaaggctttcaaaagttccgatgatggttattttcgattcagagaacaaaataattctaaaataggcaaattggcgtatttgcaaagaatgatgctggttattattggactcggttacttcattagtttggccttcttgctttcaattttttgggaactctttaacaggcatcctttaataagaaccgctcccttcgccttatgtgctgtgtctttaacgttggtatttgatattcttcttcaatcgactagcaaaaagaagttgatactccaaattatggaataccaacatcttaaagcgaaagggtcactaactgctccggttaaggattttttcggatcaaaacagcctttgattagcatgagactgtttactctgggaatgaccagttcggccctcttgatagtttcctttttctgcctctttattgatctaacgcagcctctatcccgttaaaactatccaccaaaatgttgggtaattttttcacggtgaattgagttcactgctacgaactgtcaaacttcctttgagtatggcaatctattcttgttatttagacatttctagaggatttcttcacagtattagtttagatcaatattattcctgacactgtccgcctggtgtattctcttgattttggttcggcctttaagcttccctgacgttcttaattttaaatcattgtcttcattaaagttacagatgctgacaattgacatactccaaaagactctttgaatggtaaaagcagactttgttaccatcagaaaattgcttcccgttattttttgatatcgctcgaaaggtagtgacgtttctatgttttcactatatagttgggttatttatgccatactgtttctcatcgcaagcttttgctgtgccttttattcactctttatccggcacaagtttaagctccatgacagactattgacgaaagtatttggtgatcccctccataatccgtatagattcctagaaaccgaagatgatcaaattgcccgcttatcacaagcgtttaaattcaccacgtttatagggattggttgctattttattggcttatttctctttttcaaaaacctgaatgatttctcaaaccaaattaatctaggcttaattgccattaccatttgtttcatgttaatcggaatcatcagtttgatcctagcccaactaactgatcagcaaaaaatgatacgccaaattaaggcgtatcatcaacagaaatacaaactaaaattttgtgacttctttgattctgctaaaccaagtgcaagcatccgccgaaatcaggccaacatagtcggattattatttctactagcaatgcttttttgcattttcatgtttttcaattcagtaaattcttctcctctttcaacttcccgtatcacaccaacctatcttttgttaggcaaacactaaaataagcgccccgccaacaatcaccgctgtcgcgaccaaacttgttgccgccgaaagatagtttgttcccatatttccagctaaatctaaggaaaaacctgttgaaaacactggacgctcggcgaccttaacctcaggatgattctgccaatagataggcagaaatttaatcttccagttaaccgcaatattcacatcaacatttgaaagctttttagctttgataacgtttacggtgatatttaactcgattgtcccaatttggtctgttttaattgagtaatcgattgacccttgcgaaatctttgcccccacttgcattaccttcgactgatcaattacagcttgataactggttgcatctttgatgtttccaaaattcgactcaaattttttctgcaatgctacactatctagtttgccatctttaataccaatagggccgttcccagccgtgaaatctactgaccaagtggcgattacgcctgggatcggcattggaaacgtgtattctttgcttgctgagaaatttaccaaatcgtcaatcaagccattcatcaagtcattagcaacaactacttttgctgattctggtaaagtaccaggtgtgaatgtcttcgtgcctgggtcactaattttgacgtccgttgcaacctgatcaattggaatgtcaccaatgctgtactcaataaattgatcgaagctccagttcaacggcattgcataacctaaattacctgaataacccgttgacatatcggatacgaaacagcgcaccgcgtatcccgcttttaagacatgtgcacaaacatttcgcgtgccatagattccagcacgaaagcctgatttagcaagccctgaattgacaccccgcatataagcgaccacagttgcctcaatatcgccttccagaatgtcaacatcacaagcaaagtagataatagtgctattaggaaagccaagaactcgtgcagttgaagcagccgtcattgcatcaagcacaccttgagtttcggtgaaatatttaatgtcggcgccgccatcttgatagattggaaaaatgctcatgccgccatcggtaattgatttaatctcagacgcagtcaaattcttaggagtaaaagcattccctactgaccccgttagatatcgcccgacaatgctgaaaccatatttacgtaacaatgcaacatcagaactcgtcagttgcttagatgtgtcacaagcgattgaatcgcgtgttgtatcaccattgctagttaatagccccttaataacccgattaccagcgattctccctgtggttggttccaggttcatcattgtgctaaaggcagccactgcatcgccaactgcactggtgaattggccattagtcggaatgtctgtgaaaccatttactaacagaccgtattgtaggatgcgaacggcgtcagtatctgttgatccctcagataaaacagggcaattgtcaattgtcttctgcccatagataccatttgcaacatcagcagccatcccttcagctctttgcaatgcataaatcaaagctgtgttagtgtcacgttgatagatgccatcgcaaggtagaatgccaatgatattactgaaccgtccattaagatattgctgcattgaccgaaccttctccgatcccccagtaaccaaggtaaatgcagccatatcgaacaacgccgccaaaagattaactgtaactacaccatttgcggtaatacccgcgtagtgttttgaaagcttgctctgttgcatcagaaaagtcctgattaaagtcgctaccaggattgatgcctttacaccagaaggcgccttgaatgagctgggcgatattgcccttataaccgggcttcaaactgcctaccaccgaagctaatgctgtcttggttgcatcgccaaatccttcaccaatagcgctaataccaatttcatgttgtaaacccatccgcaaactataaatagtgggccatccagtttgtccgttctcgggcgctgtcgtgaagccagaaacaccgctatatgtcttattaagccatttttgaacggccagtaccgcttcatctgccattttaaaaatctcttttacaaattttaaggtgacacgtctgtcatcgaattaaaccgaacacatgttcgatttaattctactgcggagacttctttttgtccaaacttttcttaaataaacttctgatcgcacaaaaaccaagttagcgattacgattactccacaaaaattgacattccgcccccgttccgctacactcgtttttgacatttaaatacaccaccaagaaatagaggttgcggtgggcaacgaaaactggggagtgccgagtcatgttgaaccagtcgtaagtgccgccgccgaaatgttggatcgtattcggacgattcgcattgggccatgggcgcataacccatggactgtcgaagctggttgcttcggggcgctatgattctggttcatgactaaaatcgatggaatcgacctttattgcggtatcaataaaggtcgattttttggttccagctctatttcccactacaagaagggagaaatgtcacttatgagaaaacattgggttgcgcgtttaggcgtgctagggttcgcattgagcctcctgcttggcagttttgccgcaacacctgtcagtgctgccagcgatgacaacacgtttaaagtcggaatggaggccggctatgcaccgttcaactggacgcaaacaacgagtgccaacaatgcggttaagattcaaggcagccaagaatacgcaaacgggtacgatgttcaaattgcccgcaaagttgccaaggcgttgcacaagaaggttgtggtggtcaaaacatcatgggatggtctgccgcctgcattaacttctggcaaaatcgatgccattattgccggcatgtcgccaacgccagatcgtcgcaaaaccatcgatttcagtaatccgtactatatttccaacctgacgatggtcgttcgcaaagatagtaaatatgccaaagccaaaagtattgccgatttcaaaggcgccaagattactgcccaactgagcacctatcactatcaggcgattaatcaaatcaaaggcgttgtcaaagaaccggcgatgaacgattttccagccatgcgtgtggccttggaatccggcacgattgatggctatgtttccgaagtgccagaagggattacggccgaacgtgctaatccgaatctgatgtatatccactttgccaagggtcagggatttaaaaccgatgccagtgatactaacttagcgatcggcctgcggaaaaatgatcctaataaggccaagattaatgagttgcttgctacgatctctacaaaagaacgggcacggttgatgaacgaagccgttgataatcagccgtcaaccgaaaaaagcggtaactggttcatggcgattatgaaacagtatggtcccatgctattgcgcggcaccggcatgacgctgctgatttctttggtcgggacacttgttggctttatcatcggtttgctggtcggtattattcgaaccacgccaaagccaaagaaattgggtcagcgtgggttacgggccgtgatcaactggctgctgtccgtttatattgaagtcttccgtggtacgccaatgatcgttcaggcagcggttttgtactatggtgcggctcaagcctggcatctgaacatggatcggacaaccgcggcgttattgattgtttcgattaacacgggtgcgtatatttccgaaattatccgtggcggtattatttccgttgatgaaggtcagtttgaagcagccaatgcgcttggcatgacgcatctgcaaaccatgatgaaagtcattctaccgcaagcggtacgcaactctctgcccgcggtcaccaacgaatttatcgttaacattaaggatacttcagtgttatccgtcatctcggtttccgaactgttcttcagcggcgaaacgattgccggacaaagcttccagttcttccacacgtatctgattgtgagtggcatctacctcatcatgaccttcaccatcagccgattattccgtctcatcgaaaagcatctcgatggtccaaaagattacaatgtgatgaacaatcaaatgcaggtcgaaacacccaagatcagcacggcaaaggaggactaactgatggcaaacgaacctttaatccaagtcaagaaccttaaaaaggcttttggtaaccatgaagttctaaccgatatcaatctcgatgttcaagcaggcgaagtcgtttccattattggtcgtagcgggtcaggtaaatcaacgctgctgcggaacattaatcttttggaaactcctactggcggcgacattctttttcatggcaagagcattctaggcgatgatgtcaagctgagtacctatcgtgccaaggttgggatggtgtttcagagtttcaacctgttcaacaacatgaccgtcttgcaaaatgtcatggtgccgcaacaaaccgttttgaagcgtgatgctgctgccgccaagacacatgccttggaattgttgaaacaagtcggcatggacccgtttgttgctgctaaaccggatcagctttccggcgggcaggaacaacgggtggcgattgcgcgagccgaggcgatggatcctgaagtcctcttgtttgatgagccaaccagtgcgcttgatccggaaatggtcgatgatgtgttaaacaccatgacggccttggcgcataccggactgacgatgatcatcgtgacccacgaaatggccttcgcgcgcgaagtttccgatcgtgtcgtcttcatgaataatggcgtcattgccgaatccggcacaccggatcaaatcttcggcaatccgcaacaacaagccaccaaggaattcctgaagcgttatttgaatcgggtatgatgattcaagtgcgtgcggttcttagttgaaaaaagcatacaaaaacgcgaccctgaatttccgagggtcgcgtttttggtgccggttagtattcaagtataaccgtgacagattcaccgtttgaccggcttatttgcttttgaagctgcctgctcacgcttcttttcccgatgttctcgccatgtgtctaaactgacaacgattaaaaataggaaaaagccgcccacgactgactctgccgtcaaaacaagataacgcagcgccaggtacccttttccagccgtaacgtcttgatagccgacatagccaaacgtcatcagtacggctaggcccaagaccagcagcgtataaatcagggtgcgttttaatatccgtttgaatgtcgtcatggacatggcctactttctatcggttcgttaacgattgtctttcaaaatggtttctgcctgcttttgtaactgagtcaaaaccgtcttcggtgccgccttcttggaaacggtctggtcaacggcatccagaaggttattacgataggtgttatagccaatgaatggggttgatgaaaaggcgtcgtcataagccttgatcgcagcctgatatggtgggttggccttcagatatgcctgataagcacttgatttggttgcggtcgaaacaactggcacgtatccgctcgccttggcccattgcgtctgaatcttcttactcatcaagaatttcataaacttaacggcacctttgacttgtgctgccgatgcccctttgaatacggaaatgccgttgttgcctagaaccgaactggctttgccttcaaaactcggcataaccgcggtgccccagtgcatgtctttaggtgcggtacttgcaatctgctgaatcgtggcactggaaccgaagccggcgaagatcttgccttggacaaatggcacattaaagtagttatccaacccagcggtgacggccgtcttgtcttgcaacatgctggtaatcgccgtcatcgctttaatgctggccggcgtatcaatcttggcctgatacttaggggtaatcaggcggttgccggcatcataagccagcgtttcaaactcaaagtcatagctcttattaaaggcaacgccggtgataccgtcacctttgagctgctgcccgatcttttcgagttctgaccaagtcttaggtacactgagatgatacttgtctaaaatgtctttattgtaaaacatgatccgagtgccagtagcaaacggaatctgataatagctgccatggtatttcagattggtggcgatcccgggataaattgatttcaattccgcagaagaaaactgatccttcacctgctgatcaatattgaccaacatcccgtcatgaacgtattccggaataatcgtgtccgtcacttgcccaatcgtcggtaacgttctggatttggccgatgctaagtatttcttttgcagattatcataagagccttgcgaagttgcaacaactttatactgcttctggctactgttgaaaatcttgatataactttctagtgccttgttgtaattaccggtcatgcgatgccaaaacgtaatggtaaccggacccttggagcttttgggtgctgaactgccgccgctgctgcaagcggtcagcgccaatgccatcaatccggtcgcaataccaagtaaccaacgtctcttcatcatgattccctccatcattgcgttgtgtcatggacaggcccgctaacttaccggccccgtccggctaccaatcatctagaaaccacatacagtataccaatactcacggcagctaggggattttgttttatcataacgcgttcgccagcgcagaagtctacgtgtaaggaccttggtcgcaatggtcaaatcccgatcatcacgtctgaggacgcttatattctggtttacgcccataacgcgctccccggcgcaaaagtctgcgtgtaaggaccttaagcgcaatggccaaagcccggccatcacgcttaaggccgcttacactccgacttctaatcgcgccggctcacgctcactttctataacgcgctccccgacgcagggacctgcatgtaaggaccttggtcgcaatggccaagaccgggccatcacgaccaaggccacttacactccagtccctaaccgcgccggctcgcgctcacaaaaaagaaagccgagaatcaatcccgctttcttttaccaagttatgctgtgttatgctgcttgtttgtccttcaacttgagatagaaattcgcaaaggtcatagttcgatacggcatgacccaaatagccgccaagccaaatgtgatcagttcgagcagccaccaaccgagaaaactcaggatcaagacgaaaaattcccatttgtagccttccatcagctgccggctttgggtaatcgcttcggtatagccaatcggttgcccacgatcaatggcgtcacgataaagccactgtgcctgcgaatatgccaaggctttgacgattcccggaacaatgagtagcaatgtccacagaaagacccacacccactgcaataaaccaataagcaggctgcctagaaaatactcgcctcgttcaaatattttgaacatctgccgccaaccaaaatgatgatccgagcggccgcgcagcccatccatcatggcaaagccgacgccaatcatcaagagtaatcctgaaagcgagacaaagatgagaattgattgccacatattcaagtattcattcatatgactacctgtgactgtatcgaggcgactttttaccagtatttgccattcaccgtgatgtgcttcttgaatcgttggaaacgggacaattgccgccaaccctgtcaaaagcaacgccggtaaactaataagtaaataatagctgaaattgggattcaactccgccttagcttgatcttttaatgctgtccgatccatcgataatgcccccttctaacgacgatcacatgttgtcatcgctggggctatcataacagaaagcgaccattctagacgaattttagcggcacctttggattaagttgcggttttccgcgcaacaaagtaaattcatccccattaacggtcaactcggtcttggtatcaaaaagtccacaggtgtaactcttaatcaacaccggtccgactggggaatcaaggtgcgcatcaaatacatctggcacattacggcgcggcaatatcagcagactgaatttagcttgcgttggatcgtgatacgaccgcgaataagggccgatgccatcatttaaatctaaaatcaagacccgatccgcgcgtaatagcggcgccaaccgagctgctgcctgtgcagatatattaagctccatattccgctccttttagtatcataatccctgttttccccattatgaatccattgtcgccaggatacaactggcttgtaaaagtttatcgaaatgcctaaaattggagtaacgagttccaatgttatttagctagctaagacgaggtgtgccaatgaatatttattcggctttaaaatttgtccagatcgatcatgcaccagtcaatcatttacaggttgtcgtcaccgatcaaagtggcaaacctgatgctggcatgacagacttattaatcgactgcctcaacaagatcgacattttcgttgatctcagcaccaccgaccgcgtcagtgacgtgattgatgatctcaatttactgacgccactgccttatgatgttctcgaagaatatcaaaagattctcgagcagcccatcaccggtatcaacatcgccatgaaaaaacagttaatcgaattcgtttatgcgcccttagtttaactgtccatcacggtgcttcattcttacaagtccgcctgtcggtaagcaacgcatgctaccaatgacagggggatttttttatatggtgagcgtgaaccggcgcgctcagggatcggcgtgtaagtggcctggggcgtgatggcccggttttggccattgcgaccaaggtccttacacgcagattcctgcgccggtgaacgcgtcgtggctattatctcacaagagtgcacccagtttcgactggcattcgttaaaaaacccccgttattccaacacttttgaagcgtaaacggtttcgtttagaccaattttctgctatcctgacgaaaacggaggcgacgaacaacatggaacaaacaggacaggctttaccggccaccattcaacgaatctggcgtgccagtgccgcaatctgggctttggtcattctaattgccggcttacttttgattgcggcgtggcatttttggcattggtcgctatggttagcaataggcgccatgggatttgccattttacaattgattttccgtcttgctttagtgccctatcgctaccgtttctggcggtacaacattacccccacagccgttttcctacaaaaaggcttcttctttcaaaaaaatgaagccattccgattgcccgcattcaaaatgtgacattagaagccgggccgctgctgcaatggcaggaacttcagcaagtcaatatcgaaacggccagcacggcacatgttattgacggtgttacccgatcggttgcggatcaactgcgaaatcagattctacaactggcccaggaggcgcgcaatgaatgacaaacccaaaagccttgcacccattgccatccccattcattggttgatgtcatttattgcttggtggccgctatttgtcagtggcggcttttcaatcttgaaaaatgatatgaagccccaagaatttttgttctggatcagtctggtattaggcattttggtattaacgctgctttggtccatcgtgcattatttgcgctttacctacttagtcgcaccagacggcttgaccatcaatagcggagtcttcattcgaaaaatcaatcacatcccatacggccgtattcagaccgttcaacgccggcagtggttctttttaaaaccgcttggcctggagcaggtctctattgaaactgccgggaaggaatccaagaaggctgaagggatgctcgccgccgttccgaccacggtagcggatgccatcaatcgttatcggcaagggctgactgatacgccaaccgcttcggctagtgaccctacgactgagggtgcgcaaaccgaagtaacaccggcggcaaaaaccccagacgctgcttacaaaatcaatgcgcatgatctcaatcaatatgcactcacttcgcttgggttcattcccatcattaccgggattctctggctggtccaaaaggttcaggaataccttcccgacagctggtataagcaagctgaacacgcgctaaccggactggccatttatctgattattgccttaacggttatcgtcttagtgctcggctttgccatttcctacctgaacattttgcagcgctattaccatttcacgcttgatcgaaccggtaacgaattgcaaaccagtcgcggcttttttcagaccaacaccgtcagtgcccaactatcccgcgtccaagccgtacgcttcaagcaaagcgtgttacggcagtggtttcatctcagcacggttcaagcacttctggcatcaagtgctgccgatgatgaaaaaaacgatgatttggttctgatgcccgtcatcaggcaacgacaagcgctaacgaccatgcaaacattcatcagctggttgccaaccgccgcccttaaattagagccgataccgactcgtcatcgctggtactatgtgcgaaacatcgtgctaggtaattttggcttgatcgtcttgccggctatcttagccagtaccttatggctgcatctcagctggtggctgtggctcttaccggttggcttgctatggctcgtcatcgttgctttacaaggccaatatgccggggctaatgcagcaatcggcatcgcagcccccgatcagctcgtcattcaagtgggcgaaacctggacccggcaacgttattttgtgcgcaggaaagatattcaagccatgagtttcaaacagtcgctgtggatgaaaccgcgaaaaatggcgcatctggaaattcacatacgcaaaggcaataacgatcagagtgtcagttcacggtacatgaaagccgatttagctaaacgcatcatgagctggtaccaaccattgccttaatcagtcgctttaaaagtcaggggtcttaccgttgctactcaccaagatcgaatacgcaccaccacgtcatcacagcgattacccgtttaatttaccttggcaagccgattttcacgaattaaccctgaccagtccggtgactattttaaccggcgataatggtagtggaaaatccacgttgctcaatgcgatcgctgccaactacaatgccatcctcatgagtggtgccgctttggaagacgaccctgagtatgacaatagccgcgccttggcccgccaccttaagctaacgtggacatatcggaccaaagccggctttttctttcgcgccgatgatttcatttcattcattcgcgccacccgcggccgcatcaagtacgcgcaaacacaacttgaacatctcgccccgcaaagtttggagcgtctgccctatctcaataccctaagcgcaatcaaacatttgtatcaggtggatttagacactttatcccacggccaggcgtttctggccttatttcgggcgcgattgcacgccaacgctttatatttattagacgagccagaatctcccttgacgccggaaaatcagctcagcctgttagccctgattcataccgcagtcgcaaatggtgcacagtttatcatcagtacccattcccccatcctgatggcttatcctgacgcccaactgctcgcattaggcaacaccttggcacccgtgcactatgatcaaatcgaccatatcacttttctgcgtaacttcttagatgacccgcaacgtttcgtctatcacctgctcaacgactaagcgattggcatgatcgctaaaagtgttttaagctgagggtgacaagtagctaacattgtttgtcaaagggaaatccgatgccaaaacgcatccatgaaaggagaaggcgtatgctaacagcagcttggactaagcaattaccgttacaacacattaccgcgatcacaccagtaggcggaggcgatgtcaatcaagcgtatcgggttgacaccgcggaaaagccttattttctactcgttcaaccaggctatccggccaatttctatgccggcgaaattgccgggttaaagtcatttgagcaggcagacattctggctccacgggtgattgctaatggcaccattgagggtgatggctacctgctgcttagcttcctgaccagcggcagtggctcgcagcgtgatctcggtcacttggttgcccacttacatcaacaccacgaaccctctggccgctttggcttcgactatccatatgccggcaccagcgtttcgtttgccaatgactggaccgactcctgggctgacttattcatccatcaacgcctcgacaagctcgccgcccatctgcgtcaaaaaggcttgtggcaagcaaccgatcagacaacttttcaacaggtgcgaaccatcattcaaaaaacgcttaatcagcatcatagtgaggcgtccttattgcacggcgacttatggggtggcaactatatgttcacagcagacggtcagccggcgttaattgatccagccgctttgtatggcgaccgcgaactcgatatcggcgtgacgaccgttttcggcggcttcacccaagacttctacacgggctatcaggaagtttatccacttgatcccggctatcagttcaggctcgaattctaccggctgtattatctgatggttcaccttgataagttcggcatgggctatgctggcagtgtcgccgccgtcatggatcgtatcttagaccacggtttggcgtgagacgtccatgttctgctaagcatccggattatttcccgggaaatgtgacagcaatttcgaaaataccactcaaaaaatcggctcaggataatatcccgaaccgattttttagcatatcttatgattaaatttgaataacctcaggcattcaaaaccttatttaagaagctcttagtacgctcctctttgggatgctcgaaaatgtctgtcggcgtcccttgctcaaggatcgtaccgttgtcaaagaagaccacccgatcagcaacttctttagcaaagcccatttcgtgggtaacgatcaccatcgtcatcccttgtttagcgagtcggcgcataacgcccaagacatcgccaaccatttccggatccaaggcactggtcggctcatcgaatagcataatatccggatgcatagccaatgcccgggcaattgccacccgctgttgttggccaccggaaagctgtgccggcatcgcatctgccttatcggtcaagccaaccacttcaagcatctccttagcttgttgggttgcttcttctttgctggcaatgcctagttcaatcggagccaacgtaatattacccatgaccgacatgttcggaaacagattaaaatgctggaagaccatgccgattttttcgcgaactttattgatattcgttcctttatgcgcaatgtcttcaccgtcaatcaagatctcgccgcttgtcaccgtttcaagaccattgatcatccgcaaaacggtacttttcccggcaccagacgccccgatcatgacaacaacttcattgtttgcaacgtttaaattaacgcctttgaccacatcgttatcgccaaagctcttgtggacatttttcatttcaactcgatactgactcatgctttcaccttcttctgaacccagttactcagccaggttaatagggtaatgataattaagtaaatcaatgcgaccattgtccaaatcttgaacccttccatgttccgggcaatgatgattttcccggtttgcgtcagttcaagtaagccgatgatagacagaatggacgtatccttcaaggtaataataaactggttgatgaaactcgggatcatgatcttaatcccttgtggcagaatgactttgcgcatcgctttaccaaaaggcaaccctaaactgcgcgccgcttccatctgtccgggatcgacggcttggatgccgcctttaacaaacgccgccgtgtacgccccttcgtttaaggttagggtgacaatcccggcgatgaatgccggtacttttgatccgatgagacttggcaccccagtataaatgaagagtgccagaaccatcaacggcagtccccggaaaatataaataaatgttgttgcgatgccttggcacaacttatttggaatgacgcctaagaagccaatcaaaatgccgaccaaagtagcaaagaaaatggcgacaatggtcaagaccatggtctcacgcaggccacccatcaaggtcgaccagttggctttcagtaagccgataaatgaccgatcagtggtctgactgttgccagcggcggtcttttgcgattcggcactgccattgccaaggtagtgctcgatgatcttatcgtattgcccattggcccgcagcttcttgaggccggtattaaacttgctgatcaatgcctgattattcttagaagctgcaaacccataagaaccttcacgtgccggtttaccaacaagcttcagtgccatgccgttattgatcccgtattgcatgactggctgatcttcaaaacacgccgccgaattacccgtaatgacatcctgatacatgttgttcgagtcatcaaaagtgacggtcgtaaagccgtatttttgtttaatgctattggcataatcggccgaatccgttccggtcttgatggcaacacgtttgccgcgtaaatcttttaacgacttgatcgtactcttcttggcaacggccatgaccacgccggatttatagtacggatcactcatcaaaaacttttgcttacgttctggtgtgatggacataccggcaatcacaccgtcaatctgttttgcttcaagcgcctgcaccgctgcattgaagcccagcggtttgatttcgaccttgaatccttcctctttggcaatggccttaatcaaatcaaggtcaatcccgacatacttgttatcctgattggcaaattcaaacggtgcaaaagtgacatccgttccaatcgtatatgttttctgtgctgccgccaccgtcttgccggggattaatgccccgagcattaaaggtaaggcgattagcagacttagcagccatttccgcttcaacccaaacaccacgctttctaatgattaccagcccattaggccgttattgcatgcgccagtttaaaaataactggttgtgcgccaaccaccgtcactcagtacattgctgcccgagtctggttctgccacctacttgtttaagtatgcggccaagcgcagctcatctcctcgtactagttcgatttttaaacttactatcctatgctagcggaactaaatagttgctgtccagcgttgatgttagcttttcttacatttgtcacattattttacgtagccggtctaggcctccatacgttgttgtacccagttgctaagccatgtcagcacggtgatgataatcagataaatcagcgcaaccatggtccaaatcttgaacccttccatgttgcgggcaatgataatcttcccggtttgcgtcaattccagaataccaataatagacagaatcgaagtatccttgagcgtaataatgaattgattgatgaaactcggaatcataatcttgatcccttgtggcaggatgaccttccgcatcgcttttccaaatggtaagcctaagctgcgggctgcttccatttggccgacatccactgcctgaataccacctttgacaaaagctgccgtgtacgccccttcattcagcgtcagcgtgatgatcccggcaacaaacgccggtatcttggaaccgattaaacttggtacgccggtgtaaatgaacagcgctagcaccagcaacggtaaaccgcggaaaatataaataaatgtcgtcgccaccccgcgagcaaaccgattcggtaaaacacctaacaacccaaccaagatcccaacggcagtcgcaaagaaaatagccacaatggtcacgaccatggtttcccgcagcccgttcatcaaggtgccccagttttcccgcaataaacctagaaaactccgatcagtgtcttgggtcttggcgcttgtctgcttttgcgctgcttgtgtaccattgccaagatacttggcaacaatcttggcataagtaccatcagccttgacctttttcaagccggcgttaaacttttgatcaagttcgtcactgcgacctttttgagtggcaaagccgtaatagctggccttactttcaggtccggcaagtttgagcttcaaaccagtcgcaatggcatattgcaaaaccggcttatcatcaaaacaggccactgaattgccggtgatgacgtcttgatacatattattggaatcatcaaatgtcactgtgctgaagccatacttagacttcaggctcatcgcaaagtccgcggctgcggttccagtctttaaggcaacgcgtttaccgcgtaaatctttaagctggttaaccccgctgtttttcgcgactgccattgcgacggccgttttataatatggatcactcatcgcaaacttctgcttacgttccggcgtgatctgcatgccggcaatcaccccgtcaatctgatgggcttctaatgcctgcaccgctgcgttgaatcctaatggcttaatgtcgacacgaaatccttctgctttggcaattgcctgcatgagatcaatatcgatcccgacatactgattatgcttatcggcaaactcaaatggggcataagtgacatccgttccaatcacatatgttttcttcgccgcctgcgttgataccggcatcgccaagctcagtgtcagtatcaacgcagccaccccggctacgcaccacttccaaactcgtttcatgaaaacaccatctttctcatatttacttaacaccacgacaaatcaaccatcgtgatccggcagtggccctttatgactgagtcccaaaaacattttgccgtattcacagctaccaagtctaccgattttctgaaagcttgtccatgcgcactgagaagaagattgttttatactaagagaaactaataagaaaatgggatgaagccatgtttagctacctaattgattatgacctgaaactagcactacctcgtccggaaattgatggtccgcttttattcgagcaaatcgaaactagtcgcgattcgttaatggcttacctgccgtgggtcgccacaacgctaactgccgatgatgaaatcaatttcttaactgccaccttgaaaagcttcggtgaacaacgagcgctgcatttggtcattcaccaagctgataccccggttggtattatcagtctcaataccattgatcacacccttcatcataaggccgatatcggttactggctgacatcatctgcacgtggcaaaggtatcatgcataagtcagtcgaagccatggctgatattgcttttcatgactacgatcttaataagctgacactgaatgcagccgtcaccaacgacgccagcaatcacgtcgccgaaaaagccgggtttcatttggatggcattttacgtcaggaagatccgcatcacaatggcgactttcttgacgtgaacacctactccttgcttcgatcagaatggtcttaatgttccacgagaaacattaagtacttatttttcaaaacgggcacttattgaaaagtggcccacgaatcatttaaaaagcgaatgagtctccttaaactttaggagaactcattcgctttagtttatgttgccaaaaaagattgacactcggttcaagacaaacatccatcagctatcaatgaacaatcagtcgcaaaagtaccggggtcacaaaaccttcaatcaacgctgccactgcaatcattggtacgacgatgcaaacatattgtaaggcaatggctttgacatccagcggtgacttttcataatgagcatcagaaaagaaacgcttgatcgactggcgcagtgcacgattgacttgtgctgcaagggtcacaccaatgatcaaagcactcatttcaagaatgccgtgtggtagaatccccaaagcaaatgcggctagtgctccgctgagacccatcttggctgcataaacgcccatgactaagccgactgacgcacatgtcaccacatacgaaagccaataaagaaatggaatcgggatcatgcttattagcatcaggcccaaagcaacgcgttcattattaagcaagatcatccaaaaagcatggagattgtcttttggttctgcaaatttgtctgacaatccggtcacaatttggtgaataaacgccgggttcgcgtccatcacaatgtaggtaagtaagctcaccataatggtaatcgcaataaacaagagccagcctactaacaaataatgcccgataacatccaagtgatacgtcaaccgttttttcatatggtcccctccaatcagtctgcttatggggtcaggctatagtataccctacgctgaaataaggcgctattgagaagattaccgccaacaacatcagcatgggtttgactgattgcccacactgcagaaagaagcaaaaaggttgcccctgacggactcagcttgtgacttgctgtttctacaattttactgaataatggccgcatggaggtgtcgtgatcgtgatggaaatcagcgaagcacaagcaacttttaacgcagcgcgcaaacaggtcgaacaagtcgtcgttggtaaaccgatgccgattttgctggcatttaccgctttattagctggcggccatgtcttatttgaagatattcccggggttggtaaaaccaccctcgttcaaaccatcgccaaaaccttggacatacccttttcccggattcaatttacgcctgatatgctgcctagcgatgttctgggtacctcaatcttcaatcgggccaccaatgcatttgaatttcaacgcgggccaatcttcacaagcgttttgctggccgatgagatcaatcgcgccacaccaagaacccaagccgctttactggaagccatgggtgaaggccgagttactgtcgatggtcgcacttatccgcttccgcctgactttttcgtcatggcaacggagaatcccaccgattacgccggcacctatccgttaccagaggcgcaattagaccgtttcatgttacgcctatccctgggatatcccgatgcggccgcagaaaaaagtctctttgtcagtcctgatcggcaaaccatgattgcaaatttgaaacccgtccttgatgcggctagcttggctgcaactaaacaaatcgtaccaaccatcacagtcactgacgccattgccgattatgtcctgaagctggttcaagccacccgcgccgatcagcgaattcgactaggcatcagtccgcgtggtgggattgctttagtgtcagcagcaaaagcgtttgccctgctcaacggacgatccttcgtcaagccctctgacattcagcatttgatcattcccgtctttggccaccgcttgattcttaaagacccgactttaaaatcagccgatctgttaaccgagattcttcagcataccgccgctccaattcggaggtgaacccatgcattggcgtaacgtttttctgaacagtgcccttatcgccatttttgcctgcctaatctgttttggcatggcgtttaattcgccgacaagttggtttgtcagcgagtttgtgttcgtgttgttgctgctcctcgttcttcccttattactgccattgcgccggcgccttaagtttaccgctgacaatcccactttaattgccaaccggccagctcggcgtttctttactctgacccaaggcaaatggctgcctaatttaattttattagatgctgctaaaaccagcacttggcaccttcccagcggtcagcgaacagccagaatcacgttacaattaccccgcggtgtttatcgccaacttcctttcagcgtgaccgtgaccgattggtttggttggttccgcaaaacactacccttacagctcacagcgccgctaacagtgggccctgcccgtcagcctgaagctgctgcgcggatggccgaccattttgttcaaaaaatggccgcttcggaagcaggtctgccgagtgatcggatcaaaaatttccgtgattatttcccgggtgataacattcagcaaattgcttggaaaatcagtgcccacgctgattcattaatcgtgcacgatgatgaacatgaaagccagaccgcttggaccttgctgctcatcatcagtccttcgctatctgttgaagcgggactaagtttgtttgcaagcttaatggataccggaatctttagtggggtggctttttgctggatcagcggctcacgcgtatttttcgtggccaacaagatgctttgcttgcagggtttgaacctaagggcagtgccaatatcgaatggctgcatgacttatccaccccgggtcaccaacgcgcctacctaattctcgctgccgacactgcaaccgctatcccgtttcaacaagcacttgctccggcggtgacaaccgtggcaacactgtcaggaggtggcgaccatgcctaagtggctgcaacgacttttagcagttttgttatcatggtggctgcttgcgcttttcttagaaccttttgctgctatcaatccaatcgcccacccacgcgcattaatcgtctatatcctgatgatgagtctgattgactttttggccgtgctactaccgcgccaatggccatggtggctgctattgggctgcggcacgacaatcggtgggctttggggcgtactgccgctgaagcagccatttggcgtttcgtggttcacggcgtatttacacacctttaccagtgcaaccggaaaattcgtgcaggctggcggcgtcgatgttccaaccgtcctcagcatgacgctggtgatcacgttggtggcttttctgttgctgttaacggttgtggttcgtttctatcctggcgctattgccatcgttcttagttatctggtggccgtgcacatttttaacggcagcaaattaaccattcaattcattcagctcgctctagtaaccggtttattggcgatcctccacctttatgctgatcattggcgcccgttcttactgggatgtgtcttcataagcggactaacgcttggcctcgcttggctttcatcagcgaccccactaaatgatcagctggcaaatgtgtcgattccttttcgtgaccggttaaatcagcgtggtttttatgccggtattgagacttatatcaacggtcccggacgaacgggctttacggaaaatagccgcgttttgggaggaccggtctacgatgaccccactccggttttcacggcaaccagtgctaaagccagttattatcgcgttgccgttgatgcagaatataccggtactggttggcaggctggcgctgatcaaaaccagcgtatgccattagacggtgccaccatgcgcgactcggcggccactatcgattacgggcctgccacaagtacaaccttaactttcaacggtggtaaaacctatttaccgcttccttatggtcaattgaccttcaccggcggccaacccgatcccacgaccgattttttgctcaatccggaaacccgccgcatgcaaacaaccgaccaagcacgttttcagcgattggacattcaggtgcaaccaaaacagatctcagcagcacaattggccgcggcgaccagttcccgtcaaaaggttgcgtcccgttatctacaattgccacgcaccttgccaaaaagggtcagaacacttgccaagaaaatcaccgccaaggccacgaccccatacgaaaaggtactggctatccaaaattatctcaagtcagatccgcgcttcacgtattcaaaaaccgatgcacgccgcaccccgccaacccgagactatgtggattattttctttttgattcccccatcggttactgtgataacttctcctcggcaatggtcgtactatgtcgcagtatcggcttgccagcgcgctgggctaagggattcaacactggcacattgctcggtggttccggaaatcagaaaagatacgtgattcgcaacagtaatgcccattcatggccggaagtttatttcgacaacttaggctggctgccatttgaaccaacaccaggcttcagtgacccggcaactcccgatgaaaatgttacgcctccaagtcctagtaacagcggcactgaaagcgttcaaccgtccagcactagcaattcatcctcgtccagttcgcgtgtgtccgccagtacagtgtccaaacaaacgaaacgacaatctcggccgtctctcagccgcctaaattggctaaaaaaatcattgttcatcatcctattagctctactgttgataagtgtctggcagttaccagcgctcgtcatgctgatattaggaatcggactgggatcgacaaacttttcggcgcgttatcgcatacttcttcgggcgttacgttgggtcaagaaacgacccgtgaaccagtcgcttgatgattatgctcagaccatcgataaacgattaggccagcaagcgcatatgtttaacttaacgaaggcttatgaagaaaaggtttttggcaatctgcaggttaacacagccatattgcgacctcattggaaagcactcactaagcaacttgtacatgatcgttactggtggcagcgctcgaaaaaacataaatcatagcacgaggctgtttcacgtggaacactggacttgatctttaacaacacaagtcctagagcatcctttgcgccattttggaaaatcagcataaaagcccgcttccgatgacagcatctcaccataaagcgcgagcccgatgcagaaactgcatgtaagggacttagacgcaatggctaaaactgggctattacgtctgaggccgcttatgttctagcttacggccataacgcgctccccggcgcagaaacctgcgtgtaaggaccttaagcgcaatggccaaaacccggccatcacgcttaaggccgcttacactccggtttctaaacacgctggctcgcgctcactaaattgccggttacagtcgaaaagcaaaaaaattttcttgtgaattttcaatttaggttataagatagataagtaacgccttagcttacgttgcagttacacgtgaaacagaacgcaaacaattcagccacttatcataatcccttttttctaaatgaaacaagcgctcgaagcccttgataaatcaacggttgtgagaaaaacttgcacttactaataaaaagcgcgtatgataatataaacagtttctcaaaagaaccaaaaactgttatgaccccgctactatttttttagtagttgtgccacttcgactggacgctgcagtcagctcgtaacgtactcagaagaaaggggggagccgctgatcttagcggcgaacacttatgaaagttatgatcgttctagaaaatatcgtcatggatggcgttaaacgcgcttcaaccgttttaggtaacgacctcgtcaagcactacgatgttagtttttatactttagcagatgcccctgcctactttgagttggacgcacctctgctcatcgcaccgcgcccaaccgatcctaaacttttaaacttttttggtagtgacccatacacccactatcatgaccaaattgcggatttgatcacgacgattcgggatcagcattttcaaacagttatcttaccagcaggtttaacaacgagttttgctccgctgattaaacgggctttgccagacgttaatctcattggctggatgcacaataactacgctacttacatggaagattactatgtccagatgcaagctgagttcgaaggtggcttgcaagctgtcgatacactcgttacgttaaccgaaagcgatttgaattcctataagcgtttcaatccgcgtaccgttaaaatctacaatccgctcacccttgttcctactggtgaagctgatctaaacgcccaccgcatcgccttcaccggccgaatcgccatcgcccacaaaggaatcgactttttgcttgaggcagccgcttcacttccggacgactggaagatcgcaattgccggcgctggtaccgatgaagacatgaaaaacttctatgacctgatcgactactttaacgtcagtgacaagcttatttatcaaggaccgctaaaagatcaggctttgcgtgatcattaccgtgccgcttcaatcttcgtgtccacatcgcgttgggaaggcatgccgctggttatcggcgaagctatggcctcagggttaccggttgttgccatggaaaataccggttcccgcgaataccttggcaacaacgactatggcctgctgaccaaagcgcaggatgtcccggattttgtggctaacctcaagaaaatgattaaccaaaccgatttgcgccggcactatgcccatcaaagtttggaacgcgccagccactttagcccggaaaacattgtgtcgcagtggatgccgattattgagcaccaaccaacacacgtctcaattgccggatagttagcagtacagttctccaaaagttaccaggcttcatcaaaaaagcactcacggaaaattgaagtgccccataattgttagacagatactctaatgatagtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagctggccgtggtagactattaccaaaccagtggtgcgggtgtggtatctgcggctgctcatttcgggatcaatgcctcgcaggtggctgtctggatgaagatcttcaagactgagggagtggctgggttgcgtccgaaaccgcgaggaaggcggtctacagtgaaacataagaaacccaaacaagttaagaagcttgagcttagtgagaaggaagcttaccagcaagagatcctgaaattacgcggcgagttataccatacgcgaatggagcgtgactttttaaaaaaattaggggccgtatcgaagaacaatctgccgcccaaaaaacagcagtagttgacgcgttacggcatgactatccattgaaggaattattggcattggcacagttgcctcgggctactttctatgaccgcttgcaccgcaagaataagccggataaatatgccgccttgaaggtatttatcaagaagaccttccatgactcatatgagacctatggctatcgccgtattcatgtgatggcacgaaaagccggctttaaatgctcacccaatacaattctacggttaatggggcaattgaatcttagtgtcacactgtattctcgccatactagcggctatcactcctataagggaaaagtaggcaccgtgaacgacaacctgttacaccaacaattcgatgcccaggagcccttcgctgtcctgcacaccgacgtaacgcaagtcagactgcttgaccacagctggggctatatctcggccatcattgacgaggccagtcgagaggttattacagtcattgtgcgcaactctgcgaacaaagaacaactccacctaacgcttgacgatttggccaagaaactccccgctggcgtcacacccatcatgcactctgaccaagggtggcaataccaaacccgtgaataccagtctcaggtgcacgccatgggcatcgttcccagcatgtctcgtaaaggtaattgccatgataacgcaccaatggaaagcttcttcaacctactcaaacgagaacggctcaatcggcaaccaatcaaggatcttgaggaactgaagcaaatcgtagatcattacgtcacgtggtttaatcatgaccgtatttcactcaataaaaatggcctgaccccgattgaatatcggaatcagaccgctgcgtaactaattttccaactgtctaacttttttgttgcacttcaaatccgcgggtgcttttttgagtgaattagattatagaaagcttgtacgttccacgtgaaacctattgttgatgacaaaaagttccacatgaaacacctaaaccgaggatgcttgtttcatgtggaacagttgtgtcacttggcaggaaatcacatcaattcttaccgaccgcagctgctttaggaattggctcttggtttgtcatgactgctggtgagaacagtcgcttgatcaactcatctggcagttggtgctgccggcgaagaagttcaggaatggcaatgtgggttttaagactggtcttaacgagtttagttgtcgcttcatagcctaggtacggactaagaatcgttgcgctaatcgccgagtgttgcacattttcatcagactgcgcttcgttaacggttaatccagtcacgcaattcgttgtcaaggtgtcaatgcctcgggctaaatagcgctcgccttgcaacaagtcacggaaaataatcggctcaaaggcatttagttccaactgccctgcttctgctgccatactaatcgttaaatcctgcccgataacctgaaaagcaatctgattgacgacctcagggataaccggattcaccttccccggcataatcgacgaccctgcttgtttcgctggcaaatgaagctcattcaacccagcttgcgggccactgctcagcaaccgcaaatcgttagcaaacttagataaatccgtcgccaaccctttcattgctccggaaaaggcaactaagacatcacaattctgagtggcatcgatcaaatcatcagctgattcaagctttaagtcaatgagccggttaacctgggacacaatgtgcgcgcgataataaggagtcgcgttcaacccggtaccgattgccgtcccccctaaattgacctggcgtaaatcttccgccgctcgcgtcagccgtttttggtcgcgctggaacaaactggcatacgcatgaaaactatgaccgaatgtagttggcactgcatcctgcaattgtgtgcgcccgactttaaccacgttcgcaaactcgtccgctttgaccaacaacgacttaattaaaaaggtcaaggcttgctgcaatggcggtaaagcttgcaaagcagccattttcccagctgtgggataagtatcattcgttgactgactctggttcacatcgtcattcgggtgcaccggctcagcggtatgctgactggccaagttggcaatgacctcgttaacattcatattaaccgaagtcccggcacttccttgaatcgccggcgccaccagtgcatcacgatgttcacccatcaacaagctgttacatgccgcaacaattgctttcgctttagcggctgacaatgtcccgccagcagcattcacttgcgccgccgcctttttaatgataatcagacttttaaaaagcaaagcatcggtccgttcatgactaattggaaaattcgccagtgcgcgggtcgtgtggatcccatataaaacatcctcatctactgccagcttgccaatacaatcttcctcgatacgcattgtgaactccctttcatataccaatatttacgttcttagtatatgcgtgttccaacaagcgtcaacgtttaatgtgagctagtctaacaagtacatcaaaaagtataccaattaagaaatctttttgtcatcttagtgatcgcgatttaccttgtcgaaatcggcaagcgcccgccatcgttccactggccaatcatttgatgcgcctgacatgcattggcaaattttgtcagacgtcggcgaaataatgttggctggtgactttttatttgaatcgtgtcacaccgaactcgccgataaagcgccggacatgattcaaaaaatgcccacgctccgggacgccgcttgagtgcgcgaataattctgggatctatcttaaacccgcttggatcgagatcaggtaaccgcgcatagccagccgccgtcatttttcctaaccgaatcatgcgacggcaacgctctttatttaactctgaccacgcacttcccggctgccgcggaacaaacctttgtgacgccggttgatctggcgccagtttcttgtaggtactgtcgatccacccgaaacacaacgcctcttcgacagcatccacataccaaaatgtgccatcagctttcggaatgccacgtttaacgtccacccagcattctgacgcatcttgattatgcatcgccagccaagcccgaaactgctgccggtttgtaacggttaaatgattcataaccactgtttaagcctcttttttaaataacgcaaaagataacaaaagattctacgcaacagcgttaagctcacgtagaatctttgtttttccgattaattaaaacccagctactaatgtccgcgatgtttcgctaatcgtttggtttgtttcttcaagcgaacctcgctggcatgctgatctttcaactgctttcgcctttgcttcttaagtttcaagttttgcttatgttccagcttcagaagcgtcgttgctttgccttttcgcaaacgctgaacttctttgcgtgcttgccgactccgccttttaggactcattccgttctgaacctttggcaaagcgtcagcctcacccgcagcccaatgcaacttgccccatcgctgttgaaccaactgcaacaattcgtttgctgtcggagcttgagtaccaaacgtaacttttgcaacacgataagtatcgccacaattctgctcaaatagcccccgataaaaaggcgattcaaaatacactgttagcttgccttgaatgatcaaactaacacctcctttatttttaaccctatccggacatccaaggaggaaggatactgacggcccaagccgcgtctggagtaccaaccagactgtgtttttgatagcgcagtgttattgtctgactttactagaatcctgtcaaattttgcagaagaaaagaaagatgactaaacagtggacagccaagggcgttacatctgatattaagaacatttctaacttcttaacagtagcgcctatgacttaagaaccctcgtgacagcaatcacctctacttcactctttatggattattgttttccaaaactatatataacttttccaaacttttaaatgacataaagttggacaaatccaaggaagcatcacccttaacaacgaccttctcagaaacgatgccacgcaagacgttatcgagagcacgctgcgtaaacatcttttcttcctgaagactttgtatgcggagaacaagtgccttcagtcgcttgttttttctatgaatgactacaaagcaaattaaagggccaatagataaaactgctacaatcaggaaagccgcaattaagtgattcatattcgaacagctcgcttctataagattaaaaccggacaacccggggacggcagcattgccgaaacctgagccttacttttcgatcttcattgtctaccgtgcaggctttttcaaattcttggaaaatataacaactagaaaaacaagtatggacaaagcgaaaagtattcgtaatccttcaaaagtaaataattctccatcttcaaagagttgatgaagattaataaactcaaacataaaaagtaaacccagcggcccaaaaaccgctcgtctttttcgttctatttcactgtgcgcgaatccatcttgagatttaaccttatgatcatcactgagtgccacacttatccctccctacaggtataagcataacaaaggcggtcatcatttgatccaacaacatttaaacgtagggatttcggcatttaacgttcatttcagctaaagttacgcgacaaattcctttttcacctaatctacgtgtatctgtcttaattcttatagataacgccaagcaaaaagcccccgtacgcaatcgtcaccgatcttgtaaggaggcttctaaattgatttctaggctttcgctgttgcttttgccgcgttccgaacgctttctgctaccacttcggcaacatccccgtcaaacgcattggcaatgatgttcgtggttgacaattcatcatccggtatcaaactggcaatccctttagccgcggcaatctgcatgtcgatcgtaattttgcgtgccctagcatccagagcgccgcggaagatgcctgggaaagcgagcacattgttgatctggttagcaaaatcactgcgcccggttccgacaatatatgcgccagccgccaacgcttcatccggaaaaatttccggctccggattggccatggcgaaaataatcggtttaggtgccatggttttgatccacgctggattaagaacgtgcggcgccgataccccaacaaagacgtccgcacctttcaaggcatcttctaacgtcccggtgcggttttcccgattcgttatcttagcaatcgccgcatgatgtggtggcagttgatcagcgttctttttagctaaaatgcccaccttatccaccaccatgacgtgtttgactccggctgccaagaatcgccgggcaacggatagccccgctgagccgccgccattaaccaccacgcgaatgtcttcaatctttttatccgctactttcaaggcattgtacaaagcggcgagcaccacaatcgcagtgccatgttgatcatcgtggaacaccgggatgttgagctcatcaatgagtcgtgcttcgatttcaaaacatcgtggcgcactgatatcctaaagattgatcccgccaaatgttggtgcaatggctttaaccgccgcaatgattgcttcagtgtcttgcgtatccaacacaatcggcacggcatcaaccttagcaaaccgtttgaacaaagcggcttttccttccatcaccggcatcgcagcctcggcaccgatattgcctaaccctaaaaccgccgaaccgtcactgacaactgcaaccgtatttttcttagtggttaagtcataaacgagcgactgatccttggcaatagcagaagaaactgccccgacgcctggagtatacgcaatactcaaatcatcgcgcgtctcaattggtactttcggttccacactcaattttccgccatttacttttgcttgatctagcgctagttgattaaaatccttctttgccatgtgaatcatcctccttaagtttcgaaactagtcgatttaaaagatcatccgcagaatcgccgtcatggtaataacggtaatcgcgccacccaagcgtgttgccacctgagcaaatggcatcagattcatccgattcgccgtactgagaatagccacgtcgccagtaccgcccatcccactctgacaagccgtcacaatagccgtttcaaccggattcatgttcaggaaccgcgctacgaagaaaccggtggaaaccacagtgagcaccacactgataaccacgataaaatattgccaactcaacatgccaacaacatcttttagcggaatgtatagtaaacccagtcccgccatcaacggaaacgtaaaattactggaaataaacttgtataactgtttggcacctcgttgggtttcacccggaatgacattgacatatttcagaatcgccgcggcaacaatcatcaaaaccggccctggaaatccggtcactgattgcaacaacatccctaaaatgaacaaggtacatgccgtgaaaacgcctgcgcccatcatttttagatcaagcggtcccgtatcgtctttcaacgcgtctgccaagtcatcttctgccccattcagtcgaaccaactgtccctgccccgataactccggacgtttctctcccaaccgattcaataaacctgaacacataatggcaaagaagttaccgataatcgttgccggaattaactgagccacaagcgcgccgctggtcgtccctgtgatcgtgctgtatcctagagacagcggcaagatgccttccccgatgccgccagccaaaaccggcgtcacgatgaagaacaacgtatgcttccactccagacccaataacacgccaaccaaagtacccacacccatcgccagaatcatgccaagcatcatgggaataatcatccgcatcaacccttgaatcaggatcttgcggttcatccccaaaatgctcccacagactagacatgcaatatagaaataaagaaagtttgcttgcttcatcaacatgtcagttgcttttaacacattcggattcagggcgttataaaacacaaggatcgatgggactaacaacgacagtatggctggcccgccgaaattcttaaccaccggaatgttggcaccaattgtccctaacaaccagcccatcgtcagaatcactgcaaagccaccaagcatattgaccggcagctgctgcatcgcgccggcaaggatgatcaccatggccatcaccagataaactggcaacggcacggaaccaatcctgatcgccatccacttactttgtgaactttctggtgcgctaggtgttcccgttttactcgccattttctttccccccttaggactcttactatctgcagcataatgtaagcgctttaaatagtgaagattatttaacttttttaagcatcaaagcatttatttaagccattattgcgtgattcacaagcaataacttctgatggaggaaggtgaaaggcttgaaaataaaaggatggcgcctctggggttggctatcactcatcttcacctcaactttattggtgacggttttcacagtctatggcttcaccttattggaaaatcgccagcagttcgagacgcgtgaaagtcaacttttactgtcagtcggccgccaattggctcaagaaccacgtgtcatttctgcgcttaaggccaataaggctgatccggcaacgcgcgcttacgccaattctgttgccaaaaacttcaaactcgactttgttgtcatcatgaacatgcaagcgattcgcctcacccatcctgatcccaagcagattaaccgccatttccgaggtggggatgaggttcgcgccttgcagggacacgcctatgtttctgtgcaacgcggaaccctagggcgctccttacgcgggtttgttcctgtctaccaaaaccgcaaacaaattggggtggtggcactcggcattaaagtcacagccttacaaatgctcattcataactcccaaaacggctttcgcttggcattgctagtcggcatcgttatgggcatcctcatcgcctttttggtggcttattacattaagcggcaactacacgatcttgagcctaaagaaattgctcggttgcttgaggaacgtaatgccatgctggaagaaaccaaagatccggtaattgttgtggatctcaaccagacgattgtgctagttaatagagctgccagcaaactgcagcgccacctcattcatgaacaagcatttattggccggccgttaaccactttaattgcccatccggaacgcattaagctgacggtcaagaccgagcagttttatcagcaagatggtcaggattatctgttctcagccgcgccgattatcgtgaagaagcaaaaaatcggttacgttatctttttacgcaacgccactgaagccattttcgttgccgatcagttggcgaacaccacagcttatgccaacgcactgcaaagccaatcccatgagtttatgaacaaactgcacgttatttacggattggtcgcgatcaaacagtacgatgaattggcgatttatttacaagaccttttgaaaccggaacaagaatttgctaatcgcctcgcattattagtaaaaaatccgctcgtagctgggttcatgattggcgaacgcgagaaatttgccgaacgtaaaacaacgctcaactttgaaatcgtgccagaactgcctgccaatcccaatgttagcgaaactaaatcacttttaaccgtcagccgttatctgcactttggtcttttacagcaagatttgcctgcgaccattctaattcagctcgattatgctcagaaccaactgaccatcacctatcatctagcacaaccgcttagccgtaacacgttgttgtcagtgattcatcaagattacttccaacaattactttctgatttgcatggcacagccaccctaagtccaaccgacccacttgtgttgactttggtggtggactaccacgaggaggcaaaaaaatgaccaacattctcatcgttgaagacgatcccatggtgcaatttattcatcgcaactatctggaaaagcttggcacttttgagacgatttactcgtcggagaccattgccgaggccaaaaaactgctggcaacccgttcgattcaactcattctcttagatattcgcctaaaagatggtaatgggatcgactttttaactgaactacgccgcaccaagcaaatggttgatgttattttaatcaccgcagccaatgaagtcgaaatcgtgaatgacgccttacatctaggtgtcatcgattaccttatcaaacctttcacgatggaacgcttcgaaaaaagcatccagcgttttaaaacgaaaaatcaagcgctggtcagtcagcaattgaaccaaagtcaacttgatgcttatttagaaccacacacgcacgcttcttccattcgcgacttggataaaggtctaagcaaagcaactttggaaatgattcaagccgcaattcaacaactgccatcatcttttacggtcgcacaattaaccgctgaaaccggcttgtcgcatgtctcggttcgaaagtatctaaactttttggaggatcatcgcttcctgaaaagtgatacgatttaccgcaagaccggccgtccattcaagacttaccaagtgatagcgccattaccgatgctgtcgtaacttaatccggaagacttcagtacggctagttgatggttagctcagtgcctttctataacgcgcccacataaaaaacgttaacgtcaatcaaactgaatagttgatcacgttaacgcttttaatattggacgaggtgcttttttgactgattttttgaccactgacgatgcttgctcgcttaccgattagtgactcgtgaccatattagtgaagacccgtgatgtgataaccggatcgtccttagtcttctgcgattgtgccgacgttcgccaatggtaacgatctaacggtttcacctgaatctggtgcgtttgcggatgcttcttctgcatccctttcaacgtgcgataccagctatgctcacctgttttcaaatcgattaatgcatagccttcaccatttatgccagactttcgaaaatcatagttatgatcttcttttgacttcacaaccaacattcggcgattccaccccaccgcctgcacatgataaagcaacgtgttggcgtcagtagttgtttgaagctttcgcgggatccgttcgattagaaaaggcccaacgccggattttgtgatttcaaaatgccgaggcagtttgattgaaaagccttctgcatcggctccgggatcacgtttgttctttggaccataaaggctcgtcgcaatcgagctgactgttaacaaaacacttaatccgatcatcgctgatattgccaccaatgttctctttttcaagtgtttcctcccgtttgatctagctaagtcgttcgttcaaaatatgttgatttcagtataatatctcttttcggtgccctaccgttatcagtttgaaaattatagaaacttcagaattttttgtaaatgattccaacccagtttcacgtgaaacaccctcaaaactttaaatgcttttaccgaataaacctttaaaatgatgggagagaaaacctttgcttaatacgaaggctctaaaactgtatatgttttcttcaacgataggtatagtcatgtggttaaagcactcattaacatcccaatctattggggtcgcagtttctctgaatttaggttacattttctttctaatcggtggcatatttcaaaaacccaagttggtcgtggccagttccttcctcatcatctatggaaatttggggtttgttaagcaagtaaatggcgatgcaggccattccttctcaaaagttgcctctcttttaatcatcattctttgccttataacgttttatctgctgaaaacaaacactttgtcgttccttatacccttggtttcactaataataaatggggctttagtcagtataaaaacccatgatcagaattgatgagctctcttaagccgaacgatcaaaatgaaatggccgcggctttttatttttctgatttagaaaaagggttcttttacacccgtttgaacataaaccatttgcaagtgcggaactggtcaacatcacgatcaggaacttttacaccaaggatttacgttaagcattaatacaaccaaaaaaagagaccccttttgcgtgaaagagttgtccctttttcgatatatcatgattattccgaagcatttggcagcgccgtcttcttattggtaatatcaataaacttcgcctcgccgtcaactgaatcaaccgctttttgcaggcgtttcatggccgccgtggcgattggcaagtcgacaaattccttggtcgcgttgtctaattcgacttcatcagcaaccgagtctttgagtggccgcggattgctttcgtctagtgctcggagtacgactggcttaagtggtcccatctgtaacaattcgagcgtggtttcatagtcaatgccgtatgcatcagctaaatccaaggtttcgcgaatgccggcttcggctgccataatcgcaacattggtgatcaattttagcttagcgccgttgccttggtcactaacatacctgatcttgccaaaggtctccaaaaccggcgcaactgtctctaccacttgcttgtcaccagctgcaatcagcaccagactggcttcacgagcatatttcaccccgccgatcatcggcacatctagcaaagtcgcatgtgctggcatggcactttgaatcgcggtgatttttcgaggatccaatgttgaagtgacaatcagcgtgctgcccggctgtaaataatggacaattcccgggtcatctaccgtcccgatatgcaatgctggcacatcagctgacatgaccgacgtgataatgattttagaagcggtcaccgcatcttccagtgaggtcgccgcccgaacatgatctcctgccagtgccgtcattttagccggttctttgtcccaaatcacgacatcataaccagcctgggccaaatgcggcacgatctgactacccatatcgccaacatcgataaatgttattttcatggctgttttcctttcaatttaaggctaagctcccaacaaaattattaaaaggttgcaataacttccagcaataaaaagataaaacatttgtgcataatcatcacgcaaccgggcgaatcatttgccacggtatcaccttcaaattagcatgattaaaagccgatttcaaaaacaaagctcacctgctggatttaattttgccaagacgcaaaaaacgctgcctcgcgccgattagttatttttaaaatccacttatttggcgatccttattttttcgtagctaaagatcggcgtaccctgcgtttttgccgtatcagccagattactctggtgccttgcctgacacgcgcgtcagactcacggtcaaaacattgtccttggtcgtgttatagtcagccaaaattcccttcacaacgccttgcgaaggtccatgcgttcgggttgtttcttcataattttgaatccacgtactgaccgcattgaagccgaattcaaacccttcaaacacctgcatgtaaaccgatgagcgcggattggtcgcgatgatcgtaatttttttgacgcggccattttcaatttgcatggtcaagttgatgagctcgtcagcaattaaagtcacggttccattttcagcagttcgcggtaatttataagccgccaagcgcatattagcgttatacacccgctgaacataagcataactccccaggtcttcgtgcatgattttcactgcccttcacttgtgtcagtcaacagctggcctacgcattctgatctgctgcgccccgttatttaatagtgtacaatttatctttaaaaaggagaaataaacagctcggtagtcaatccttaaagaaaaagccgcctcttcactgagacgactctttcaaattctattttgttggcgtagttatgaaatccagcatacggaagatggctaagcggttagcctctggtggatcaacgcgcataatttctgcggccgtttgatgtaaagcgttatcgtctaaagcataagccgcatcgttaattgctatttcgcgaacatcatcagcttgcggttccagatgaaactgtaaaccaattacatgatcaccaagtaaatagccttggttttttaacaattcattactgaataacaacgtcgcttcatccggaacttgaaacatttcttcgtgccaatgcaaagccagcaacgaatctggtaaaccgggaatcatatgcgtttgtagatgtacaggcgcccaaccaacctctttagccggtgctttgctaactttatagcccatcgtctttacgatttgttgcgcgccataacaagcaccaaagattggtttatgctggctcaacagtgtcttaataagacgacgctctgccttaatccaatcaatatcgtcatttgggctcatcggtcctcctaaaacaaccaacaaatctgtttcagaagcggttggtaatgtgccgtcaaattgataaggatggtaaacgtaaagctcatgtccgtaaaaatctgcccaagtcttaatagcccccggaccttcattgggagtgtgttgcaaaacgttaattcgcattttaaatcctttcacatctccggcaatgtttgatttgggtttcgcctgcaattacccaagatgatttatcttaacacttactcaggaatttttatatctcaaaaagcaagtgacgagttacgcttacatctttgcagccagtacggtaatcttttttccatcacacaagctactgtgattagcgattaatcgaccgcgccatccgctgaatcgtatgccgttccccacgaattgctttgctgacggcgtataaattgtcgaccggcgactcaaaaccccacgcagaatcgccgacatgttgcatatcgacaccgcagattttgttgcgaattgccattgcctgcaacacccgactgccgctgccttcctgactagtaccgatcgcactcatgaccaagccgcctaactgatgaaccactttcacgacttcggttaattcggcttcgtcaaatcccggcactgagccaactgctggtgctaaaatcacatcggctcctgcttcgataaagtctttggccgtttctgctgtcataatccgttcatcaactccggaagcatgcattttacccgcaataatcaagccgctgaagtattgcttggccacggtaatgctatggataatcgcttcattagtgacccccgtgcccggattcccggttagaaccatgaactgaaaacccattgcttctgcttttttgatgacagcctcacttgcggtacagccgggtaaaatcgcaatctgttgttccatcatgttaggatgatcgccaatcggttcaagattaatccccactggccgcccaaccaatttcttcaatcggtcaatgctcgctttgccatcatgcttaggcgcagcagcaagatgccgttcacccggataaagaccgaaaattttcggatcattcacatccaaccgattacacaaaatcatatccgccccaaaagcagccgcaatttctgccgtcgtaatgctatccagattctcttgcgtcacgatattttcactcacaataattcggccttcactggctttgatgctttctttcaactgctgcccattaaactgcatgacttcactggtactggcactcaacaatcgtttcaccatgactgtaaacctccaaatttattaaaaagttagttcaacctttgatatcatcattatacttccgccgctgcttcgatttcgtcttcgtcaaacattgattcgtcaacgccccagaagaaaaatccagtagtgtcaccgactaaatgcaaaaatgtttattcacttcagcaacaaaaaaaatcacgacccgcaagcatattttatacttacgaatcgtgatttttttatctattctgggtggtcaggggaaacgtaactgttttacatgaaacgccttaaccatgcaccctagagctattaccaaccatccttaaaacccccgtggttttctctgtggttttctaattcaattttgcatatatttagcaagtgccgcggtggcctctgattcctgctttgcactgacgtgagcatacacaccaagcgtaatagtcggatctgtgtgccctaccagtttttgtactgacgtaacaggaacaccagcaatcagtaaattagatataaagctatgcctgaacccgtgaatggttattctaggtgtaagtccattgtcatcttgcagcttatgcagtcgcttagacggtgtgtttaatgactgatacccgtttttagtattagtgaaaagcaattgattcggttgcatcgtattaatacctagttgtaggaatgtttcctgctgtattctacgccaccgtttcaagtatgccatcgtttgaccgtctaccggaatggtgcgccgtccagcgcgtgtttttggtgcctgaacgatctggtggcctttatcaccttgcgttagtgttttgttcactttgatactgttttctttaaaacttacatcattccacgtcagcgctagtagttcaccacggcgaacccctgtaaaggctaaaaccctaaacatgatgaagacatcgaagtggttctcttggtcgatacaggcaaagaagtgattcatttgttccttagtccaaaagttttcaggcttatcaccagccagatcgtcatggtgcggtaaaacaacggctttggcgggattcttactcatatacccttgtcggactgcgtagtccataaccgatgaaacatagttataccagcgcttatagttagcagaggtgaactcaaaccacctcttaacagccttctgtacgtccttagtggttatagtagcgatccgcttaccaccaaatgccggtaggatgtgattattgaacataccagcagttcgagcccacgttgattcccttactgtattaatgtagtttccataccactcctcatacacatcccgaaagaacacgggctttggtttctcttcttctaagtcaccgttgctgattgctagctcaagtctagctgctgcaacagtggcttctttttttgtcttaaaccctcgccgcaccttgtacttcttgtggccagtctgtagatcattaccagcaaagacctgaacgcgccagaactctttgccgtctttcgttgcgtactttttaattgatgccatattcttctcctatccgtcacgctgggcaggcggtgttagatagaatttttggcggccgaattttcggccatgatattaatcacattgcttctatgaaacaaaattagttctattgtgctattcgtagtcctggattttttgagtgggacttttttgagatatatcaattatatctgacagttcttttgcaaaatctgtcttcatttcttcaatctgatcggcggaataatcgtgcgtccgtgctctaattatccccgcaactatgctggaaaatttcataatcgccacgttctgtctttcaggcttcatgagttgaacaaacctcatcgaattttccaaaaaagttttttcttgccaagttaacttttttacataatcatctgaaaacagttcagtccacaagttttcggaattaacttccaaattatgaagccactcatctctctgcttacgtagctccatctgctgatcctctggaagatcttcaaaagccggtttccctgtaactaagaactggacggaaattccaccatggttggcaatttttttcattgtatctgctgacggtgcagagagaccccgttcccatctcgatactgctgattttcctgaacttgttaatccaaccgaaagtgcgaactcttccatggtctcacctttagaaatcctgatgcttttaatcctttctccaagggaaagatggctgtttggctccaatagttttgtcatttcagatcatctcctaaaaagttgatgcatgttgttgactccagtatgagtccgtggcatactaaagtcaatcagttgatgaatgttgacgtcaacagaaaggagcgtgctattatgcaacgtattaaaggttaccgtgtaatgctaaatttaagtcaacaagatgttgccaaagaactcggtatctcgcgtcagtcttactggagcaaagagaatggtagaacatcgttcaatgataaagagaagacaaaaatccgagatcttttcaggaaaaccggtattccagtaacgattgattctcttttttttgacggaaaagttgactaatgttgattttggaggtgaaggaacatggctttaatgaaagcgcaaattacattaccagccgactttgatcaaattttacaggaacgaattcatcgagaagttgtccgcgtgatgaacgagactaagcagcagccgatgcaaaaaaagctgaatatcgggcaagcagcagcttatgccggtgttgctcgtaacacgctgctgtcttggactaagaaagggttgttggtacaggttgtcggtggcgtaaaacgtatcaataccgcagacatagacgattacatgaataaccacggcaagtaatcacgctgggcaggcggcaaattgtaagcaacttatgacaggcgcataaagccagagaggaaacattatgaatttgtttagtaaagaagagatagcactagatcacgagcttggaaatttgattgacgacattcagcttaacgttcatgccattgcagaagacagtactgtcacggttgatggcaagtatatttccaatagcgagttggccgttacgactgcaaaagagctgctgcgggtatcggaaatcctaaagctgtatgaaaacgaggacgatgccgatgactagccttattgcgtggctactaagccaccctataacagttccagcactctgcatggctttcatggtcgggagcgtgtttggagcgtatctgcaatttcgagaggatgatgaccatggcacgaatggctagcacaaggctcggctttcagtggcatgactacgtccaagctgatgcagaatgtgatcgatactgggcgtttaaaaaagctgaacgtcgttcactacatgaagccacaaaaaaatcgccaagagtggtacctcaaggcgagaagaagacaagcgaaaaaatctatatcgacttttagcttgcctctaagtggttactttgtcaaggaaaatggaggcaattatgatgaaaaatgtttcaaatagcaccaaagcgcctgatttaggtgaggcgtcttttgacctcagcactgcaaaaggacttctagaagcccttcgtgatcagttcgacactatggaaggttctgtagtttcatatcgaaacaatcgtaccgaaaatgctgcaatcttggcgtacagtacgaatcgatcattttatacatggatggcgctactgaaagcaattcaagaatacgttgaaagcagcctggcaacgattgatgaggtaaacaaatgatgaaggaagattactatacaaccgcacaggcgcttttgagcgatacaagtgcaatggtgaatatcttgcgacatcagattaacgatgaacagcaatcagcgctggccgacacagtcgctgatatgatcattgatgctcgccgtctacttttggaaggagatgtggccgatggtagacgtgcttaaagtagcgcttggttatcagcaacacggctttgcagtctatccccttgcgccagagacacgaacaccacttgctggttcgcatgggtacaaagatgccaccaaagacccagaacaggccaagaaatggtggggcgaacatcctaattacaatattggcttaggacttgatggcgtgctggtattcgatatcgatatggggcataaaagcggggctaatggcaatgatacgctggctaaattgagtgctgagggtcgtgctgatcaaatcccatctacctatatagaaacaacgccaaacggtggacttcatattttcttcacctatcccaaggaattgaagctaaccagtcgatcagatctgttctctaagaatggcgagaaaaccggccttgactatattgcaactggtgtgccggtttttcctagcattcgcgagaacggcatgtatcaaccactcaaagggcacaagatcaccaagctagccccagtgcctcaatggttactagatgaaattcaacgtgtcagccaccctaacccagtgtttggtggttcaacagtttatcgaggtaaacgatggacgggcaagctgctagatgaaatagtgaatggcactagtaccggcaatcgcaatgattttctgaccaagattgctggcaaaatgttcttcacaggtgcagagccgcagacagtttataacttgctgtttacaactaatgataactatctagatacacccttggcagaatccgaagttaataagattttcaagtcagtattgaaagccgaagagaggaggcgtgcggttggttaaagcgatgcccgaagatattaagcaagaagccaataaagtggtcaacgttgattttacaggtcaagagcaatggcgaaatgaccttaaacttgatggcaatggtgggattagaaaagactcggtggttaatattcaactgctacttgataatgatcaagccttcgccaatgtcgttgcttgggacgacttttcagagatgctcatcaagacaaaaggcgttaaaggattgccgattcgtaagggtttttggactgatgaagatgatgctgtcgtccgctcatatatggagcgtaagcacaatctcttgtttagcaagcagaatgagcaagatgccatggttgttgttggcaaggaacattcaattaatccggttaaagactggatcgaagctgagcaatgggacggtacccctagagcagaacgttacttcatcgactatctaggtgccgaggatagtgaatatacccgtgctgttactcgtaaatggttagctggggctgtaaaacgtgtctatcagccgggttgcaagtttgaactcgttccaattcttgaaggtaaacaaggacttggtaagagcacggctgctcgtaacttatttccgacaaagttcagcgattcattaaaatcaatgggcaagacagacgaagattacaagaagctgcaaggtaactggatcatggaactcggtgaactttccgcaatgaaaaaaactgagattgagtcagctaagagcttcatcagcgcccagtcagattcataccgcgggagttatagccactatgtttatccacatttacgcaagtgcgtgttcattggtagcactaatcaacaggactacttgaaagacgctactggtgaacgccgtttcttccctatcagatgcggtgttacaaagcccacaaagaccgtatggcgcaatgaagaaagcgtaccgaagatcaaccacgatatacatcaggtactggcagaggtaaaaacatgggtggatgcaggtgagagtgtctttgctgatgataagctgatgcaactggctaaaccatatcaacaagaagcagagacagttgaccctatgaaagaggccattgaagactttctcaacatgaaagtgccatcgaattgggaaaatctgtcattgagcctaaaggccagcttctttcacactcatattgaccataacggcgatgttgccacttggttacaacagcacttggatgctggagaattacaaccactgcaacaaaccacgaccagagagatcatggaagtggtgttcgacaagtcagtcgatcgttacctaatgggccgtactggatcggaagcaaaacgtatcaagctcatcatggataacatggatgggtgggatcgtgaacgagttcgaatcaatggtcagcgttcaagaggatacgtcaggaagtaaagtgtttgtttttctactgtcccacctgtcccagtgctacaaatgccggtatatcaacgttttgctgggacaagtcacctgtcccagtgctgtcccaacgtgtcccactactgtcccaagtcctaatttggacatgtgcgggacagctcgggacagctcgggacatgtgtgggacatgtctgttgtcccagaaaaacgcctacataccaacgtttataagcccgggacacgtgggacacttaaaaaacaaacaaatttaaaactgtggaggttaaaacaatgctatatccagaaagcacatgggctaggtttgaacaagaattccctatccctgagaagtatcgcaaatactatgagtacaagaattggcacattgaacctaagtcatctgatctcagccagtttgaacaggatcatccattcgcgtttatgttgatgcctgaggacatgcagaacgctttatatctctggactaagggactggccaagcgaaagacaatcaacagcgactatacctcatacggtatcaagcacctattcactgacttacccggtggcttctacatcactaacggcatgatgaaaggcgcactattggcagctggatttgagatagccgactacgccgagcttaactggcgtgccaacatttcagggcgaagcatcaaagagcagatcaaattagcacctcatatcagttagcaaagaaatattattaatgaaagcgaagtgatgcaaatgagtgtgcctttgcacatttgcatgcaccccgggtgtcgtcgcatgatcccgttcaatcagcgtttttgcgaggagcataagcaagacaagagcaaacaagcgacgaatcaggaacgcatgcaatacgaagagaaggaattacgtttctacaagtcaacaacatggacaaagctttcaaagtcattcaggttgcgcaatccaacttgtgctagctgtttgaaacgtgggattattcgtcaagctgtgcttgttgatcatattgagccaatcaaaacagcttatggttggcaacacaggcttgatgagagcaatttacaaagcttatgtcagacttgtcataacgctaagaccgcacgggaggtagcacaacgccgaatgagatcccccgacagatcgacccccgccccaaaattttagagcgaaagaacggtcggcctcttttcttttcgatgaataccgaaaatcatagaacctaggtataatcaatatgttataattataatagatataaacgaatacaaattcagaaaggacgttacacatgggagcacccctaaaatcagtgactaacctaagtgcacatttatccaaaaagcagttagctgatcgtgttgcctctgaaaaagcactgttcacttacaaagaattgcaagtacagccccctacatggcttgatgactatgctgtgaccgagtggcaccgtattgtaccattgctaaaaaaagacattccagttagtgaactagatgctgccctgattgccagtcattgccaagcctattctgacattcagaaagctgccgagctggttcaagaacaaggtatgatggttgaaaccaccgatagtgtgaaagctaacccagcagttaaaatgaagctggatgccacaaatcaaatgatgcgcattgacgaagtattgggactgtcagtgtatagccgggcgaaacttgccttaaagagtgagactaagaagaagcctgacgatccgtttgcggagctggtgtcatcgtgaactatgcgactgaatataccgacaaggtgctaagcggtgagattgttgccggtaaaaagattaagcaagcagcaagacgttatcgcagagacttgaaagccagcaagcgcaaaaagaatccgtggccgtattactttgatgaggactttgccaacaaagccattgagtttatagaactgatgccggcacgtgatgggtcaccactcaagctagaacttttccaaaaatatttgatctcagagcttttcgggtggagagacaaagaaaccggaaatcgtcgttatgatcgagcttacatcagcatggcacgcaagaatggtaagagcttcctgatggctgatctaggcgcgctgtatctcctcatggaaaacaaaccagccatgaatcgcgaaattgtctacacagccaacagtaacgcccaagcgcacttagcctttgatatgctgtctagtggtttgcgtcaggtctctaagatgtctaaatcggtgcgtgatcgtttgaagatcaaccgtaacgaaatcatcgacttgccgagcaacagccgagctgttccgcttgcgtctgatctgcacagcctagatggttatcaaagtgacttggctattattgatgagttcgccttagctcgtactgatgagattctacgaacactaaaatcaggccagatcaacagcgacaacagtttgctagccgtcatctcgaccacggggccagacctgaatggccctatgtataaagaatataaattcgtctccaaaatcttaaccggtcgcgaacaagcagatcggtattttattgccatttttgagcaagacagcaaggctgaagcctttgcaccagagacttgggagaagtcaaatccactactggctaatgctgaaagagcaaagacaatgcggcctagcttgcaagctgatgttgatctagcagccaagcaaggaaccctgcggccaattctcgtcaagaacttcaacatgtggcaatcagccagagcagacagttatatcagtcttgacgactgggagaaagccactatcgagccaccagacactagagaaaaggacgtgtatatcgggcttgatctctctaagtctagcgacctgaccagtatctcgtggttagttccagaagatggctacctgtatgctgacagccattcattcgtggggacgaagtatggactggaagaaaagatcaagcgtgatgggttcgattacatcagtggtgctagtcgtggcgaatgtagcattaccaaactggaaagcggcatgatcgactatgacgaagtgctacgcttcattctcgacctgatcgagcgtaaccagtggaacgtgcgtgccatctgttatgatcccttcgccatgggctacctgattccagaatttgaaaaacgcgatttgccactgcttgaggtgcgacaaggtgttagaacactttcaattccgacaactcgttttcgtgatgatctcttcaatggccagttaaagcaccctgataatcagttactggcctatgcggtcaacaacgctattctgaaatatgacgctaataacaatccaattatcgataaggcccacaacgctacgaagattgatcccgtagccgcactgatgaacgcttacacaattgcaatggatcaaaacaaggaaagcgaggtagcagacaatgacttttattcgagcgatgactttggtttttaatttgcagaccgtgctgttaatactgggactgatctgtatggttgccggtatctggtggctgttcgggtttggtgttggtatgttagcagtcggcacggccctgatctccgtcgcagtcattatcaacttcaataaagggaggtgaaacaatgagctttttcacgaatagcgcgacacaaccacgcgatgacaacagcgacccgttcttagatgcgcttgtcagcatgaccagcaacgacagcggcctatatgtggggattggtgctttacgtaattcggatgtatttacggccgtgcgcgtgattgccggtgatcttgcaaccaatccgattgaatacagtgacaagcgtatcagcgtgcttcttaacaaggcacccaatgaccacatgaccgcgtgggggttcaagtttgccctagctactaacatgctgctgaatggtaacagctttgcacgggttaccaagaatcccagcggacaagttactggcttcgagttggtccctaacagccaaatggtggttaaacaagacgatacgaccggaattatcagctacgaatacacgcctgacagtggccgctcacagcgtttaaatgccagcgaggtcttacacttcaagtgcttcacacaagacggttacaaaggactatcgccactttatagccttcatgatgaggtcggggtacaaaagtctgggcatgcgttgctgaaaggtttctttaactcaggtgtccaagggacaggcattcttaaggtcaacaagacacagttagacaccaaggccaaagaaaacatccgcaataaatttgaagctgccaacagtggtgataatgccctcaagaccatcattctcgacaatgatatggattacaagcaactcgaagttaatactgacgtgctgaatctagtcaattctagcgactggacaacgaaacagattgctaaagcgttcgggttgccactggatcggctgggtatcgaaagcgagcactctaatgccgtacagtctaacgtgatgtacttgcaaaacacgctgattcagtattttacctgcttcacaagtgagatggatgccaaactgtccacaggtgacaaccggttcagcttcaacactgacaagctgttttcagcggacccagccacgatgcaagaactagcagttaaggggctgcaaggcggtgttctaaccactaatgaagcacgagccaagttaaacctgccaccaattcccggcggagatgaaattatggccagtctgaactacacgccactaagcaacctgacaagctatcaaaacacaagacaaaggagtgatccagaaaatgaatcaagatgacgtagaaaaacgtctgaatcctaacgctggtctaactgccaaagcagacgacagccaaggccaagacgatccagacacaaagaaacaggacgacaccactaacggtccaaagaaactaagtggttatgcagtagttttcaatagcccaagtaaagacctcggtggctttaaagaagtcgttgatccgcacgcattcgaccacgtggacttatcagacgtctatatggtttcaaaccatgattttagccaagtcttagccagcaccaaggccggaaccttgaccttaaacgtggatgataaaggcttgcagtttgaagcaaccttacccgatacgaccacagccagtgatgcttataacaacgtccaagctggtaatctatcagccatgagttttactttcaatgctgcgccagacggtgacacgttcactaaagacgacagcggacaagtcattcgtaccatcaagcaagtaaagagcttgtttgacgtctcactggtagctattccagcgtatgacgataccaacgtccaagtggacaaacgcagctacactgaatggttgaaagaccatgtagaagatccagaacagcaactaccaccaaccgaaaaacgaaagggagtcaatcacatgaccgaaaaaactattattgataaagaagaacataccgaatctcgcgcttacgaagactacatccgcagcatgggtgaacaacgtgacggcttgaccacgaccaccgctggtgcagtcgttcctaaagaagttatcaatgacgtttgggacttaaagcaatcagattatgacttggctaaatacgtcactgtgaagcaggtcggtaccccagtcggcacctatccgattgccctcactaacaatggcgtcttagccaccaagaaagaacttgcagacgtggccgatgttgacgccaatatgtttaaaggcgttgactacaaagttgctacccgtgctggcaagatttatctgtctaatgaactggtagaagatagtgaagttgatattgttgccgaggttaagaatcaactcaagaagctggtacaaaacacggacaacagtaacattatcagtgttctgactggcaagtccactaccggtgataacttcaagcacctcactggtactggtctcgatgacctcaagaaaaccttcaatattgagttggacccagcactgtccttgtctgttatcgtcaatcaggacgctttcaactaccttgataccttgaaagacagccaaggccgctacttgttacaaccgtccatcacggcaccatcaggcaagcaactgtttggggcaccggtgatcgtggttgctaacaaagtattgccgactgataaggtaggcacctatcgaatcatcatcggggacttttctcaggcaattttcttagcccagaagaacgaagttaacacccagtgggaacgcttcgatagctattctcaaggcttggctgttgtcatccgcaacgactatgaagtggttgatccagatgctgctcgaattgttgacatcacaccggtaaaggcctaagagcataatttagtggggtgtgccttagggtacgcccctatttttataaggagatgagcacatgagtgttaccacagaagatttaaagaaagcactgcgcattagtcacagcgaagatgatgctatgttgtcagcctacttgttgacggcaaagcagttcgtgattagcgcggttgaccagacccttacggatgaaaactttggagatgatcctcgttttgactttgctgtctcgttgttagcacaacactggtatattaaccgtggtgtcgatggggcaacgtatgtaccagatagcgttgtgagcatgattcagcaattgcgaggtgttgactatgccactggtaaatagcatcagccaactgaatgaacccattactttagtgagctacacgatgggtaatgtaaatggggttcctgtgagcaacgtcaggaaagagcacttcacgacatgggcacttgtgttaagccaatatttaagcgaagtgagggcgtcagttgggacgaagctcgaagatacggtgacctttgttgttcggtatgatcagccagaaaccatccttaactcatggcgcattgaatggcaaggaaagaagtacgacattgtgaaactgacaccggacacagccaaaaaacaatggacaacaatcataggaaaaccagttgccaataaataagtattaacttataattaggatagtcctaggcgataagcgggcagaaccgttttaaccgacgcacggcatagctaaccggtggcgcattttatagaccaagtcagattgatttctcgtagcaagtgaagagcattcctcaaccctcgctgatacgatagtcatagtcttccttgacttgtttcattgtttttcatctaaagtagcaatatcattgggcaaagcgggcagagatgcccgtttttttgtgtgctgagagacgcattctgatgcaagctgaacaagtttaacttgaggtatggtcgttctggacaataaaaatcggttaggcaatccggaatttcgggattggctcaacaaagtccgaaattctgacgttcaagaacgaaccagcaaattgtgggttcgttgggaaaaggcaagtcaaaaatattgacctgcttatgagaaccaagtgacaaatattcacctagtcaatggatacaaaaatagccacctcatagcgaagtggctattttgtgttagtcatgtagcttttcttgtagtttatctccagcattatcaatgcccttagctgcgaagactgtacctgcaactaaaacaccgccaacgatgagagtactagcaaccataaacttaaatgcagcttttaaagcgtccataaagatggcctcctatcagtcttttgatctgccaacaaagaaggagactacggcaacaacaataattgcgccgataattgaaggaatcaaagccattcctgccagttgtggcccccaatggcctaaaagtccctcaccaattgcagaacccactaatcctgcaatgatgttagcaaaccagcccatcgatttgcccttgctagtgatagcaccagcaattgcaccaataatagcaccaacaattaaagcccaaagaaaatgcatgataattcctcctttttggttatattgtctctatagacgaacacagtataacatacagtagcaacaagagataataaaatagccgcccataatggacggccaccgcctgccaagcagaaatgaactccgtggttttctcgtggttttcttttattgataatcaatgataaccaatgacaatctggttaaaataaaaaccagtaacgacgctgttttgacaacgtttgctactggttgataacgctattctgggtggtcaggggatcgaaccctggacccacggattaagagtccgttgctctgccagctgagctaaccacccatttatttatgtctgtcgcgcttcacgacttaaatataatatcatgtaccccttactggcgcaagtgttttgcgaacttttttgcgaaaaatcgttcaatttggtattttgacgccttcgacagacttctccatggcgtattgccgacttgctttgagccatgctgacatgcaaaaagacggccgcggccgccttttaaaaattgttagaataaaacgtgaatggactgattgctgttgatcaacttgatggccttgcctagcatcgggccaacagaaatttgatcgagtccttcgaattgatgcttgggatcgagttgaatcgtgtcagtaatgacgaccttcttcaatcctagatgtttgatccgatcaacggccccgcgtgaaaagacgccgtgagtagcagctgcataaacatctagtgcaccagctgcacttaaggctttgtaggagtcaacgattcgatcacctgtatcaatcaggtcatcaatcacaatggcgtgcatcccttcaacgttaccgatcacgccgatgtgttcctgatcacgtttgtcgacaatcgcaattggcgtatgtagttcttctgccaatgcccgcgcctgtttggttccgctatgatcaggggcgatgacgaccacattatcgccaagattcagctttctgaagtagtcgccgattaaccggtgggctttcagatggtcaactggaatgtcaaagaatccctgaatctggtcggcatgcagttcaaccgccacaatccgatcgactccatccatttccaacatattggcgaccagttttgcagtaatcggttcgcgtgatcgtgctttgcggtcagcacgcgcatagccatagtatgaaatgaccacgttaatatggtgtgcacttgcgcggcgcaatgcatccaccatgatcatgagctccatgaagttttcattcactggatcagagaccgattggatgacataaacatcagcaccacgaacactttccggcagctcgatttgaacttctccatcggcaaaatgattcactcgagcgggcgataacggtaaacccacttcggccgcaatcttttccgcgagtggtcgattgccattgagactgaataattttaattcgtgcatcgatttctccctttttcacatttaacggtttgcaatgttattatacgagataaatcgagaaattgcgactggttatgcaatgagttaaagtaataacagaatatttgcagattcataagcaaggcttcggcaagcgtccgctttagcatttgccatgctttgatccaactgcaagactaggaaatgggaggctctttatcatgaaacaaagccatttgatcggccttgcaaccccactgttgttgtcagcgggcactttagcaactgctgagcgtttttaccaatatgcatttcggcgaatcaactacattcctgatgcccgtagctccatgcaaaaatacgcctcatcatattaccgtcatgtccactgggttgaaagtcagcggcatattgaagcctggcatatgacagctccggataatcagcggcttgaagcactttggctgccgcatcccggtagtcaaaaagcggtgattatcggtcatggttataagggcaccgggattaccatgagtaactttgcccacatgttttacgacttgggcttcaatgtgttgttgcctgacgatcgtggccatggtgaatccgatggcgagtacatcagttttggctggttggatcggcttgattaccttggctggctgcaacgcattcttgaccggcttggtaacgatgcccagttattgctgtttggcacgagcatgggtggcgccacggtttcactggtcgcaggcgagccgagtttgccaaaacaggtcaaggccgtaattgaagattgcgggtacacggatgttgaaacggaactggcttatcttttaaagaagcaattccaccttccaccgctgccactggtaccactagccagcttcatcaattatcggcgcttaggttatcctctccgcgtggtcaacgtccgtcaggctttaacgcgaaaccgcttgccattactagtcatccatggcgctgaagatgtttatgtgccaaccaaaatgggccgcgaaaattacgctgcctccgctggtcccaaagcgctctggattgtcccgggtgcggcccacgccgaaagttactggattaaccccgcggcctatcaagcgcacgtgaagcggtttttggatattttcttttagcgcttgcactcctaataatagtcgtcatgtggcagctacgtttcgttgccatttcctccgcgtagccttcaaactgcgcggtttttttaatctaaaaagactcagatcgcctctgagtctttttctatcgccggatgagtggctgctatgactgccacttccgcagactattcaaattcgttttcttcagcttgatcttgctgcttgcttaacgcatcaaacgtccgcagcatctccaagttcgtctcaatactttccggccattcccaatgttgaacattaaacacatgcttgaggtgtggccccgcacttgccggccatagctttgttgtataggtgacgtgattagcatcgaacaccttcaacaaggcttggctttgcaagtaaaagctgtcattttgcccgccaatcagcataaacggcggcaggtccaagcctttgacaacctgcgagaaattcaggtgatcggccagtgcctgatcgccgccgcttaacttgtccagataaaacgcggccatatcgctcatgtcaccggctgcttctggaagcttacttggttcggcgactggacaaaccagcgccaccagggtgaagttgaaattaacccgactcacaccaaagagttcctgtaactccgcactctgctggatgcaggcaaccaaggacgccaggtggccgccagccgaatctccggtcaaaagcacatggtcaaggtcaaatccgcgttgagggccaaaatgcgataaccagcgcagactagcaaagatgtcttgaatctggccgcgtaaatcaacatccggtaacaaccgatagcccatacccatcactgcgtatccttgactagccaaatagcggcaataattacgattcaaattacgatcaccataaaaccacccgccaccatgaatatcgatgacggtcggcatggttgcgttgcgtcttttggccggatagtacaggttcagggtttgctgcggatcagccgactgttcgtatcgatattccgtctcccaatgaacatcttccggtacccgttcatccgcgtaccgtgccttatcccgagcagccgtttgcgcccagctcgcttgaacctttgccaacattgcctcttcatctgccattaacgaatgcctccatttcctcgtgttaacgaatcgtgttaaaaggttattcctatattaacgcaaaaagactgccggtgcgtcacccgacagtctaatcgtttgattttaagcccgttttttaacgatccttggatttaacacttgcttcaacttcatcaatcaaagcagcatcttttaacccggttacttctttaatgacgtctactaatggctgatctttgagcatcgcctgaagtttaacggcttcggcatcattaggttcaacataatggaacatcatgccaaccgtatccatcaagacgctgtaatccaagccgcgttccttcagttcccgaatcggccggatgaagcgttcgttgtagccaagcttacgaattggcgtccgggcaactcgcgaaatatcatcggaaatatatgggttctggaaccgttgcaagacccgattttgataagtttcgagttccttttcgtcaaagttcttgaattcagctaaaagcagcgagcgggtttcggcaagtgcacctttggcctgattgaagactttaggatccttgatggcttcaccgatcgtggtgtagcccaagtacttgccggtgtaagccgtggttgcgtggccagtgttgactgagaagagcttacgttcaatgtatggttcgagatcaggtacatagtcgacggtcttaagcttcagatcatggttcttcatctggctttcgtcaacaacccattctttgaagtcttcaacactaacggctaatggatcatcatgtttttgctgcgggacaatgcgatcaaccgctgcattagggaagccaacgtacgtatcagcaaaggtcttgccggcgtcatcaagatgttcataaacgctcttcttcagcgactgtgatccgccaatcatgttctcacacgcaatcacatctaatggttggtggttgttagcggccgcgcgtgcttgcaaaccttgagcaatcagcggcgcaatgatcgggagaatcttcgggccaatcgccgtcgtaaccaagtcggcttgggcaatagctttcacaactgcctcaggatccttagcgttattcaacccgtcaacattgtccacatgaattttcttttcacccggggcggccaaagtgatggtgtattccccgcgctgatttaacgcattgataatcgtctcgttaacatcgacaaaattgattttgaatccattagcggcaagcgtttcaccgataaagccgcgaccaatattacctgcaccaaaatgtactgcttccatcatgatttattcaacttccttcagtaaattgacgatttcttccggcgtttgtgcgtcggccagtttttgaacattttcaacatcgctacaataaagcgcaatttgtgagagtagtttgagatgctcgccgtttaatccggcaatgccgaacacaacggtgacgagattctcatcagccggatcatccgaccaatcaaccccccacggatattgaacgaccgagataccggtctttttaatatatttcatgccgtcttcagtgccatggggaatcgcaataaagttacccatatacactgaaacgtcacgattacgatcaatcattgaatcaatataacccggttcaacgttgccattgtcgaccaagagttggccggcctgacgaatggcttcttccctggtcttcgcttcttgaccaagtttgatcgtctttacgtcaagtcctttcatcatgtcaccttcgatcaattttttgaatttcgtgcataaagacttctgtcatcacttgatataactgactatagtggcctttttcaaaaagctgtatgtccgctggtgaagcaactagcttggcgctaactgcactcaggagggtcaatgtttcttgtggaacaggattcggcgtcagcaacaggagaatccgctgcagttggatcgtgcccatgtccattgccgctaaaggtatcgctgttttgagatcaaacgccccgatatatggggttgtgacaccgcgactactcgtgtgaatcattgctaaacctgtattcgggatgccaaccggcgctaattccaatctttttaacagtgcttctttgacaattggcggttcaacgacaacggtcggtaaccgagcaagcatcgcatcgatagcagcagcaatcgtggtgaccggctcattcaagtcgttgacggcaaagtgttgtaatagcccatctgctgccatcaccatggtttttaggctctcaaaggcggtaactgtttggtccagtgacggttgattcaacggccgcacttgtttaggtgtggcgcgttgaacaagccggcgcacttccgctatttcctcgcgtcccaatatcggcgtaatcaccaagtactgatgcttaaaccccggcagcggcatggtagcaagtaccagatcgtaatgttcaagttgttgttccggtaaatcactcacctgaacaatcttaatcttacgaatttccggcacctgcacgcgtaactttccagcaatcaggctgccggttccgggtccatcactggtaaccaatagcacggcaacgggtttttctgccggagcgtgatccaaaaccgaagcgaagtataaaaccagataggcaagcgcatcgcctgtgaaggctccttggccgaaaacatgatcagccgccttttgaaccgcttggtaaagttcaggataatcatcttgcaaatgagcaagtacgggattggtcattgtgacaccagacagccaatcccctccggccgttcgttggacatgagccagtaatgaagaataaagctgtgggttcccggaaaatttcccgggaaatgatcgggctacttcccgaataagatcctgaacttcaaggttgatggttaaatcaaattgatcaaccggttcgcctgccaacccgccgcgaatattactcagttcgatggcaaggaattgataatcaccgacacgtactttttcccggattgtcgaatccatctcggctaggaattgtagcgccagttgttggtcctgaaacagtcgttcctgatcaaaatgctgttgcggtttaacgtgatggccctcacgcaatcttcgtgtattaattgcaactgttagtagtactgctttacgttgattatcatttagatctgctaaagctttaatctgagacagtgcggtgttagctgcaagtatttcttcttgcggtaaccgttcaatgaaatagttcgtcaccggatcaaagtcttgctgcggatcgtttaggaagcgaaagaacacatacggattaatttcagcattcaagacgccgaccagaacccggcgaatatcaccttcttgtccttcaatccagataccagctgctttttgccgattcagcttgagatgatattcatttaacgccggttcgagaatatccagatcttgcttaatcgtcgtaatgctgacatctaccgcatcagctaaagttgtcatcgtcaaagtttcatccgttgtcagcaacatcagtgttagcgcactctgcctctgactgggatcaaaggtgagatcttgccgttgatgtgacaaggctgcagatagactggctaaatcagcggctgcccccacaatccggtatgagctgccattgcctttgtccaactttaaattcaccgttgcgatatcatgctccagttgcgaaagctcacggtaaatggtccggcggctgacgcccagctgtcgctccagctcgtcgcggcttatgccggcgggctgactcatcatcagtctgatcatttcctgttcacgattcgttagtaacatgtttttcgccccagacggccgcaactcgacctcgcttatttcaatttctcaataagtttatcatagttcgtcgcgttcaaaagaccatccacggtatagacttgaacattggcaaattgtaatttaacacgccgggcagtttctttcgatgcgatgattaagacatgatccttatcatcaatctcaccgatcgcaacattacgaaccttgacgtctttgttgagttttcgcaactcagagcggaatgtcgcttgcgccatagttgccgagccgatattttgatcgtgatgcaggaagtctacttctgtaatcttatcgaagtcgatatcgttaagctcgtcttctggcgtttcctgcttagcttttggcgtttctttagttgcggtttcatctgtcccgccaactgcttcagccttcaaactagcaatgatctcatcatacttaggactattcaagaagttctcaacagcgacgtgtgctgcatcaggtgtttgtttcttagcccgatcagccaattcttcttgcgtcacaactaagagtcccggcttatcctgcaagttgctaatggccgtgttggtaaccgacagatccaaaccagccttcttgactttatcacgaagaatcgaagcacccatggcactggagcccatgccggcatcgcaagcaaagataatttgcttaatgcctttagcctggctcatgacatctttagcagcagccacatcctgacctttagcttcagctttcatcgacttcatcttcgcttcactggctgccaactcatcgccagtacccttatcgcggcgcaagatgaatgccgaaatcaggaaggaaacggcagtggcaccagtaaccccaacgattaagccgatatagtttccgatatcaaccggtgacatcgcgagcaacgataggatggagccgggagatggcgaactctttaagccaacattgaagattgagaacaaggtcgtcccagtcacaccaccagccataactgacaggaacaatgccggtttcattagaacatatgggaagtaaatttcgtgaatcccccctaagaaatgaatgatgatggctgaaggtgcagaacctttggccgcacccttaccgaataaggcaaatgcaagcaggacaccaagccccggacccggatcaggttcaagcaggaacaggatggacttaccatgttcggctgctgcctgaatcccaagcggtgttaagatcccttgattgatcgcattatttagaaacaggatcttagctggttcaataaaaatatttgctaaccataacagaccatgattgataatccaatcaacgccggctgccattgcgttagtcaagccggaaatgatcggtcccattaagaagaagccaacaattgctaatagcatcccgataatgccggcactgaagttattgaccagcatttcaaaaccttggcgaatcttgtcttggacccgatcgtcccatttcttaatacaccagccgcctagtgggcccatcaccattgccccaatgaacattgggacattggttccgacaataacccccattgcagcaatggcgccaacaacgccgccacggtgacctgctaccattgaaccgccggaaaaagcgatgagcaatggtaataggtaagtgaccattggcgtgatcatttttgccagttgcgcatttggcagccagccacctttaaggaagatggcagtaatgaggccccaagcaataaaggcgccgatgttaggtaacaccatgccggaaagcttggtcccgaatgattgcatgccggccttcagattgaatttcttcttctctgttgccggcgtgtttgctgatttagcttccaaagcaaacactctcctttcgcttgtttacgaagattattgtaaccgctttatgtaatcgctgacaaaagctactttggcacagttagttgtgccaaatattcagcatcaatcccatcagcactatttgtgggtcaaaataatacgtatcagatagtaacagtattcgttatctgtttcacaagttatctaaacctcgacgctgttggtcgcctgcaattaagccatgtggattgctttttgaaaaagaaaaatcagtttctaccatataaataaggaacatctcagtgctatttcagctgccagcgttaatcataaagccacgctccttcgtgattcggtttacaatgtgacggcgatttagtcacagcgccggatttttaaaagaattcaaattaggtatagaccattgttgacaccgccattttatggtgttatattggactagaccagataagggggatatcaatcatggatgttaaagtttttgataatgatacagaagcaggaaaatacgcatttgacttgattaagcaaggcatggacaacggtgccaaggtgcttggtttggctactggcagcacaccggtcaccatgtatcaggcaatggtaaacagtgacgttgatttcagtaacatgacctcggttaacttggatgaatacgtgggtatgtcaccagacaatgaccaaagttaccattacttcatgaagagccatctttttgacaagaaaccgtttaaggaaaccttcgtgccaaatggtcttgccaaggatccagaagaagaaaccaagcgttataacaaagtgattgccgatcacccaattgacattcaagtcttgggtattggccgcaatggtcacattggcttcaacgaaccaggctcaccatttgatgccgaaacccggaaagtacctttaacccaaagcaccattgacgccaacgcccgcttctttgaaaacgaaaacgacgtaccgcgctatgcttactccatgggtattggctccatcatgaagagcaaaaagatcttgcttttggcatttggcgaaaataaggccgatgcggttcaaaagatgattgaaggccctgttaccaacgatgtgccagcatctattttgcaaaagcatccggatgttgtcgttatcttggacaaggctgccgcaagtaagttaagccacaaataatcagccattcagcaccatttaatggcgtgagcggccacattagtttgcgcaggtaaacattaaaaactcgaccctggaaaattttatctggggtcgaattttgtttctgcttcattaataggaagttgctgattctcagcgtcctaaatcaccgcgctgaatcgtctgtctgcgcggcttttgtgtaagcggtttgtttgtttacccgccacggctcacacctaggcagatccatggtagaatgaggccatcatcttaatttatatatggaggaaactatgtacaaagctgttgtcttttttgatttagacaaaaccctgctgaatgatgaaaaacaggtcccgccggaaaatgttgctgcactaaaagcgctcgaagccaaccatgtcttgcctgtcattgctactggccgcaactactacgaactcgatgacatcatggccgttaccggtgttcgaagcgccattgcagcaaatggtggtgatattttcctggaaggcgagcatattttccaaagcgtgatcggtgagccgcaactgacacggtttcttaatgctagtgctgcccgcaatattcaggtcgcgatgtatacaagtgaccagtcagccttaacgggacacaacgagttgaccactgataattacgctcaggtgcggcaaaccccgccgccgattaagcccgatttttacaaacatgaagccgtctgcatgctactaatgtttgtaccttggaccgatgccggcgatcaagtcgggcaacaattcattcaggattttccggaaatgaccttctaccgtaactcacattacacctttgatgtcgttaatcgcggcatttctaaaggtaccggcatgaacatcttgctaaatcaacccgcattgcgcgatattcctacctacgcattcggtgacgggtataacgacattccccttttgcaggcagccgataccgggatcgcgatgggcaatgcttatcctaaagttgctgccgctgctgactatcaaaccgatgactaccgtagtcatggcattcccaatgcactcgcgcatttcaacttgatttaattcggttttaacctcatcggccacatgcggtgaggttttttggttcttctcagccatcatttaaccaaatttcaggttgaccattcgaacaaatgttcccataataaaaactggtattcagtcgtgaaaatatttttatttttgacggcagatcattgatatatcagcatttctgcaacttcctataacgtgttcacggggtaaagtcaagaccgcaactgcgcgatttttctgctatactcaaagcatgttgcacgttatttgggcgtggtcgtatcaccgatcagtaacgctgcaacatcgataaatctgctgatggaggggtctcgttatgttagaacaatcgacaatgcatcctgtggtttggatcaatcaacatacttatatcagtatcgttaagaatgcggactacaatttagaagtttgggagattaccgccgaaaatcggcagcatcggatggcccggatgaactacaaatatcatcgcgataatttcgccgggtttatctatcggctctttccgcagatcgatctcattcaaattcacaatattcaaaagaagcttaatccctattttgatttagaagtttagaggtgttcacatggatagtctggttttgcaactgttaatcatggtcgtagtcgccttggtcatgacgttaacgattattattgcggaatggcgcactaagacgttcaaaacatggcagattagcgttcaatccgtggttgcggtgttgttattcgccatcggtatcagtttgctgacggttcgctgatttagaaaacctgattgcgatgctgccagatatggcattacgatctgcttggtatctatcaaatatcacaacgcccagtgatattttgacaacttagccgacctaccgactgccactgaaaagcacgcctaagaaagaaaccagcattaataagctatgtacatcctgctaagctaatcggctttcgagaagacgtatcttgtcactcgaaggtcgattttcatattcatgccctatttaggtgcttactttaaaaaatagtcgttatttgcggtaacatttaaacttctatgataaaattaagaaaaaatcacaggggcgtttgtatgcatcacttggaaatccctgcttcgcttgcacaacagttggttgacggtttaatgggcggctataaggattaccttgctgagcgtaagcagaaacagcagtctttgactattagcggtgcgtttgcctggacccggagcaatttcatcgactctaagattagcgaactagtcagtaaggaaccttcaattagtagtcaacctgataaggccggatacgcttgggaatacattcaatttatccacgaacaaagcaatcatcgctcattgatcattgttaaaaatgcgcggcagctaaagcgtcgattcaataatacgacgactgtagacaaaaataattatctttatcagttagccggcatcaataatgagttgagtgcagccggcttactaagcagtcggcaaactaatggcgtcattcagctggaactagctttgcctggtaccaacaatgctgttgtaagtctcatgaatcaaacagctcaaaaatcatcaccgttctcaaagttctacattgtgacttacgcggtagataacgacagcaagatgattaagcatattgaactaacgatgccgaatcaaaccgaaatgactttgaaacccattcaagacttaacccctttaatcaaacaaagtccattccagatcagccttgaggaagttgagccgattcagtctgatcaggtgccagatgcagcatatgaacaaaataccctgtttggctacgaaattaatgctgatcctgaaacagaaatggaggcggacgctgaatagcggcaattaatatgtttattggttcaaaactccaggccctacgagaattaaacggctatacacgtaaagaattaagtgatgtcattggcgtcacccagcaagctgtctggcaatacgaaaacgacaatgtcatgccgaaaatagaaattctaaacacatttcaaaaaatttttaacgtcgaaatgctctttttaataagcgggagcgccccgaaacacgttgtccatgaagaaaaaatagccttcagaacatctgaccattcaagtcgcaaaaagactaaattagaagcacgctacttagactttgccgatgacctgacaagttattttgaacagttcgtccgcaccagccccaccggatttgatcagcttcaaaaactggtccatcagttggtactaaatcagcatgagccttcaccgattcgcaaagtggcaaaagtagcacgaaattttttaaaacttcaggataatcatgacttaatggccaagcttgaacaaataggcatttatattgttgaaaaagatctcggtagtgatattgatgcctattcaacgattgctgacagcggccgtgcctggattgtattgggttccatcaagaaatcagcagttcggcgtaattttgatcttgcccacgaattaggtcatttactgctccacacgacgcttgatttcgatgaattaaccacctccaaatataagcaaattgagcacgaagcccacacatttgccgctgaattacttctgccacttgaagactttacacatgatttcaaggcgctgtatcgccgttcaaatcctgattattaccttgacttaaaacgtaaatatcaggtttcaattgttgcgatggccatgcacgcctatgatcttgggctgatgagttatcaagaacaacgctatttctttgggcaacgcaacaaaaaaggataccggttaatggaacctctagatgatcagttgatcccagtacgccccggaaaattgcgtgctttgatcacactgttgtttaatcagcacatactaacgctcaatgatttttatcaaagactacatgtccgacctacatttgtcacccgcctttttgctctggatagtaacttttttgagaaatatcagccacagcatcagtatgtgaatcaccataatgttattgcgttcccgcagtctttcaatagaaattcaagcatttaatctgccatgtttgggttactgtcatcatccctaaccaattgaaaacgagtgagtctctggagaataaaaaacggagattcactcgtttttggtttcacgtggaactttttcaaaaaatcttaacatccggtttttggtcaaatctgttatttcaaccatcaacttgacgccaagactcaattggcatagtcgaactggtggcagtgtttgcccctgtatattcttatgattttataaacgtttttatcattacgagctagtttcttaatcaaccaaacatcatgaacttcacaaagtttatggttggacgttaaccaattcaatccgtatactgacaccaacagcacggtgacgaaatacgttttcacggaggcagcatgatgaaaaacagacagaacaagcataaaggcatctcacaacgactggtcattatcggaatcggcgttttggcagtcatcgttgttacgattatctttttcgtaactcagcagaagcaaacaaaaccgacaactgcgccagctaccctcacgacttatcaggtgaaacgccatgaattgcggttatccggccaggtacaagctgtccgttcgcaaaagatcgatattccagaaggcaccgtccaaaatctcaccgtcaaaaacggggacacagtcgcggaaggtcaacagttattgacggtctatcatcccgatgtccagcaaaagattaccactgccacgcaatcacttgcaaaacagcaacgcagccaaaagcaattggatgaccaaattaaccaactgaaaacatcgctgaatcaactggctgcagacgatccacaaaaatccgagattcagtcacaactcacggaagcccaaaacagtcgccaggatgcggctgcaagtgttgatcaagccacacaggagctgaatcaattgcaacaggatctaaacaccgtcgttaaagcgccttttgccggccgcttatatatcgactatcaatcaaatggcagtcaaagcatcacggaaacctcttcagacatggaggcagtcggcgaagtgtccgaatttgattacaatgatgtcaaagtgggacaaagcgctaccgtccaggcactttcaacgaagacgaaacaaacaacggcgattgattttattagtagtgatcccgccaaatccagtaagccaaatctggctaaatatgaagtgacggctaaactggatcaaggcttcctcaacggtcagtccgtcagcatcatcttgccattaggcggcctcgagatccctaaaaccgctgtccgccaaggttctgtctataaagtcgtcaatggtcgtgctgtccggactaagatcacttataccaaaaaagacaacatgtatgaagtgactgaaggtctcgacagcggcgatcgcatcctccaaagtccgaccaaatcaatcaaaaacggagcgaaggtgactgtcgatgattgaccttcaaaatgtcaataagagctacggccaaggtgataccgcttttcacgttctcaaggacattaatctgcacatcgaccaaggcgagtttgtcgcgatcatggggccttccggatccggaaagacgacactgatcaacatcattggatttcttgatacggcatttgagggcaaatatctttttgaagacgaaaatgtcgccaacttcaatgccacaaccgcttcacatatgcgcaatcgtaatgtcggctttgttttccaaaacttcagtctgatccataatctgaatatatttgaaaatgtcctcattcctctaagttatggtggtaagcgccgatcagaggttaaaggacgaatcgccgagctgctcgattcggttggccttccgggagtcgaagataagctgccgcgcaatttatccggtggccagcagcaacgtgtggccattgcccgagcgctggcgaattcgccgcaatttctgattgccgatgaaccgaccggcgctttagacagccatacttcagaagatattatgcaacttttcaaaaaactgcaccgacaaggcggtacgatcattatggtcacccatgatgaacatgtggcgctggaaagtgaccgtatgatcaaggtcctggatggccagatcatcagtgacacggaggtggcccatgcgactaactgagctgattcgaatttcttttcgcgcattggcagctaacaagcggcgcagtttcctgaccatgctggggattatcatcggtattgcctcagtggtgaccatcctgtcgttaggtaacggcattaaagcggcgacggttaaaaacctgcaagcagatacgcagggacaacaaactgccgaaatcaccttcaatcccaacagcagcggtgacgccgatgcaggctttaaggaaagcgatgtcgcccttgccaagcaaaccgcaccggataaaatccaaaaagtcgtcatcaaacatgaaaaagaacgtctgcaagtcatggggcaattagcgaatgccgacactaccatgtcagtgactttagtgaataaaaccaaacctaacatttcgcttatcgccggatccggttttaatcaggattccttacaagcagacggtcaggacgccttgatttccaagaatctggccaaaaagattttccatggtaattctgccgctttacactcttcactaattctaggcactaaaagctacaatatcgctggcgttttcagcccacccaagtctaattattcggcattagacgtcgaagttctggttccggaaaaagcctatcgcgccggtcagctttcacaagaaggacgcaaacttgccatcacctacaaacgcggcagtgatgtcggccaactgaccaaaaatgtcgtgaagcagttaaagaaatccggcagtgaacatcgcagcggcagctatgaatacttcgattacggcgaactgcttaagggaatcggtaacgtcatcagcggcttaaccttgtttgtcagcgccattgccggaatttcccttttgattgccggtgtcggcgtcatgaacatgatgtacatctcggcctcagaacgttcgcaggaaatcgggatcagaatggcagtcggtgccacaccggccgaaattatgaaacagtttctgctagagtctgtgatgttaacactgactggtggcatcatcggtctacttgtcggagccatggatgcgtggctcatcgccatgttcctacccttcaaaccggttgtcacggttggctcgattgtcggaacctttgcaatttccagcatcgtcgggatcgtcttcggcttgctaccggcaaaaagtgcggctaacaagaatttgattgatattttgaaatcgtagtgtttgggtggccgctagaaacttacgaaacaaaatgaagactgcataacgaaaccgtcgcgcaaaagtcgcgacggtttttgctatcgtaacccagatagcccgcggcggataacgatgtgggttataatcagaacacgtccaacctaaaggagatatccatggcgctttatctttttctcagcttattaattatcgtgttactgattctgacattgctacagtatctcaacaccaaccgcatcgttgatcaacagctcacacagcacaaaatgatgtttcccaatcaaattcgcagggctcgcagtgtttacatgcgcggtatttttcgcgctaaccatcgacagcgcaacttacgcactactgccatcgtctcggatatcctcgctgccatctgcttagtcaacgccgtcgttgttcactttcaacctgattcaacggttagcttgggaaactcgttacttcgcggtcaagcgctccatgtttcttcacagctcaatacaaccattcaaaacacttctttgttgatcggcatgttactggcactggtgagtcgagtcgtttggttgtacctgtcacggtggcgttaccagaaactagttaaagcagacagcgaacacgccagcggccccactgaccttttctggacgcccgctgcgttacttcgaaatcagtatcatttacagctcggtattcaagctgtgctcatcgtcggtgccatctttcttgccttaaccggtctattcgactggcttccaacgccaaacaatgcaacatcacaaccacagtctcaatcggttcctacatcccccagctcaagtcgtacctcggccccatcagtaaacaccgagtcaaatacaagcaatgcaagctccggttcaacaccgcaaaccacgcagccaacctacccgattgatgacatgaaaaaggcaccacttgccccggctgccgcattggcaaacctgaccgatgccgaccgagctgccctacttttcacgatgtactggaccatgaacgggttacagacttatcaagtggctgaatatgccaacagcaccgatgaaacatacagctatcatctggtatctggcgccagtggacaattaatcgtcttttccgagacgattccgtctgtgaatcaatccgattatatgttctacgcctttattcagggtgaaaccgttaaactctacaacatgtatcagtccaagcaagctatcaccagtctcgccagccagtacaatcttactgtgacaggcacaagcattacgccaaacatgccggagattcaggatagtaacatcaatatgcggcaactcatcagtgctttcctaacagacccggcttttgccaaaatcaaatcagggttaacccaaggcgcagcggtaccactgtaagcttttgcgcctagtttttgccataacaaaagatcccaccacatgagcagaactcatcgtgataggatctttttaatcactacatttctaacaaaacgtttaacggtgcgctttccgtttccggccagctaatccgaataagccgctcatcgttgccagcaacaatcccatgaggcttagtgtttgtgactgggtatcgcctgtttgtggaagtcgatgtttcgttccattatgcgtggaaatctcggactgttgggtgccagtacctgtattcggcaagtgatgatccggcgtatccggcgttgttccggtcccgggatcaggacttggcaaggcaacaatctcaaaaatagcctgctgcgtgttaacatttttcaacagattatttggcaacgacgccttgattcgttgcaggccagatgtgctgagagctaccgcatagcttcccggattaacaggagcttgaccgtctacaaagatcagatcgccggcttgaagctgaatttcagttccgtcacccaaaactaaccgataatagtcgtcattcaaagcgcctggctggccatcgtaagttttcttttgaagaccactgagcgttgcagatataggcgctggtgtaatggtgatggtgccgctgaacgtttgatcagtaacctgataattaggaccaatcgctacggccaatttagccagcccgcttgctgtcaaatgatacgtgtacgtcccgacattgacgctgtcgttttcaactgcaatatctgtgttcgtcaaggcgatcttttgagacttttctggcagttggacagttatcgctaatccgcctgcttgacttgcacgagtgacaccgttgtattggaactgaccatgattaactgtggcattcaccgtcagcggcgtaatcgtaatggtgccggtcaatcccgccaattcatcttgatctaactcgtagttcttgccaacagccttctgtaacttggcgataccggtttggctcaaccgataacgatacgtacctgctgctgtgccgtcatttgtcacaaggatatcttcccgtgtcagttgtatcgttgctttggcctcggcttgcggcaggtaaagacttgcctgtaatcccgcggcagcacttgctttagtatgaccatcataaacaaaagatgtgtcattaactgtcaccgcaccggtaaccggtttgattgtaatcgtaccagtcaatcccgccaagactttggcatcaaattggtaattatcacctgatgcctgacgtaatttagcgatcccgttagcatccaatttgtattggtactgacctacgcccacaccatcatcggttacaagaatgtctgtggcgttcagatgtaccgaaacaaccttagtaccaagtttgatgttggcagttaagtcgtgtgcctgactcgccttagtttgtccatcataactaaatgaaacatcattcagatcagctaatgccgtagctggcgtgatcgtgaccgtgccgccaagtttggttaagtcctcctttttgaattgataattagttcctgttgcctggcgtagctttgtcataccagcagcacttaacttatagtcgtactggccagcattgaccccgtcattgacgacaacaatgtcagccgcggttagcgcaacggtttttccattttcgcctagtttgactgtggcttgaatgccccgagcttcactggccttggtcttgccgttatattcaaatgaaacgttattgctatctgctgtggcaacggctggggtaatcgtgatggttccagtgatcttggccaaatcgtctgcagttagttgatagttatttccggttgcggcttgcaacttagccttaccagcatcacttagctgatagctgtaatgaccagcgtttacatcatcgttggctacaacaatgtcagctgacgtcaggtcaaccgttttttcagtttcgcctagtttgactataacttgaatacccttagcttcactggccttggtcttgccgtcatattcgaatgaaacgtcattgctatctgctgtggtaacggctggcgtgatcgtgatggttcccgtgactttagccagatcgtctgcagttagctggtagttatttccagttgcggcttgtaacttagccttaccagcatcacttagctgatagctgtactgaccagcgtttacgtcatcgttggcaacaacaatgtcagctgacgtcaggtcaaccgttttttcagtttcgcctagtttgactgtaacttgaatacccttagcttcaccggccttggtcttgccgtcatattcgaatgaaacgtcattgctatcaactgtggtggtagctggcgtgatcgtgatggttcccgtgactttatctaaatcgtctgccgtgagctggtagttatttccggttgcggcttgtagcttagctttaccagcatcactcagctgatagctgtacttgcctgcatctacaccatcattcacaacaacaacatcagccgatgttagagcaacaacttgtccagactcacccagcataaccgtggcttgaataccttcagcttcactggccttggtcttgccattatattcaaatgaaacgtcattactatctgctgtggcaatggctggcgtgatcgtgatagttcccgtgacttcagccaagtcgtctgcggttagctgatggtcgctccctgcttccctctgtaacttagatttaccagcatcgctcagtcgataactgtacttgcctgcatctacgccatcctccgcaacaacaatgtcagccgcggtcaggtcaacagtcttttcagtcccgtcaatggtcaaaatcgcttgaatgcctttagcttcactggctttcgtttttccatcgtactcaaagtgagcatccttgcctgttgcgattgctccagcaggggtgattgtaatgcttcctgaaaccttatccaaaacttctgtcgttaactgataattacttcctgttgccgcctgtaatttagatttgccgctgtcgctcagactgtaagtgtatttgccaacgattactccgtcattggcaacgataatgtcagctgacgataggtcaaccgttttttcaatttcgcctaatttgattgtggcttgaatacccttggcttcactggccttggtcttaccatcgtattcaaatgaaacgtcattgctatccgctgtagtggtagctggcgtgattgtgattgttccagcaaccttagccaaaccgtctgcagtcaactgatagttatttccagttgcagcttgcagcttagccttaccagcatcacttagctgatagctgtactgaccggcgtttacgtcatcgttggcaacaacaatgtcagctgacgtcaggtcaaccgttttttcagtctcgcctagttttaccatggcttgaatacctttggcttcactggctttcgttttaccatcatattcgaacgaaaggtcattgctgtctgctgtgacagcggctggcgtgatcgtgatggttcccatgactttagctaaatcgtctgccgtgagttggtagttatttccggttgcggcttgtaacttagccttaccagcatcacttagttgatagctgtactgaccagcgtttacgtcatcgttggtaacgataatatcggccgcggtcaagtctacaactttaccagtgtccagcttgattgtagcttgaatacccttggcttcactggccttggtcttgccgtcatattcgaatgatacgtcactactatcaactgtggtaacggctggcgtgatcgtgatagttccagcaaccttggccaaatcgtctgcagtcaactgatagttatttccagttgcggcttgtaacttagccttaccagcatcacttagttgatagctgtactgaccagcgtttacgtcatcattggtaacgataatatcggccgcggtcaagtctacaactttaccagtgtcgagcttgattgtggcttgaatacctgcagcttcactggccttggtcttaccatcgtattcaaatgaaacgtcattgctatcaactgaggtggtagctggcgtaatcgtgatagctcccgtgactttagccagatcgtctgcagtcaactgatagttatttccagttgcggcttgcaatttagctttaccagcgtcactcagctcatagctgtacttgcctgcatctacaccatcattctcaacaacaatgtcagctgacgtcaggtcaatcgtttttccagtttcgcctagtttgactgtagcttgaatacctttagcctcactggccttggttttgccatcatattcaaaatccgtactattactattaactgtagccggtgctggcgtaatggtgatttttccggaattttgattgatggcagtttgatcaatcgtcacggtatcacctagtaacgcttgtaaacgagcgaaaccaacgctgtttaacaaataatggtacgtgccaacgttagctgaatctttttcaactaatgagaagtcttctgaggtcaggttcatttctttctgagtgccatcactcaatgtcaccgtgaccgccaaatctttagactgactggctgttgttttgccgtcataaacaaaaccgctatcgctcaaatgacctgtagccgttagaccgatgattaattgtgccgtacttgttccggtaaaatcataacccgcagcagactggccttcatcatttgttaatttggcgatccgtgcccacgcagcttctgataattccacactgtagacgccagttttaatcagagcatctgcggctaccggcttaccatcggcatcaaagaaattaagatcacttaattctaatttccccgcatcaaaaccgtcacccaaactcagtgcaaattgggagacatcgacggtaatcggacttcctgttgcggtgacggtctgagtaccagtcaaagcatatgaagccgctaaccgttgcttgtaattgattttagcagaaccgctttctgcaccataggtataggtgaccacataagtcgttggctggctattatccacatgaccggtgacaaccccatttttatccttagatgctaccacattgcctttttcatccgtcactgaccaagtcaactcactcaatggaacctcagtaccgtcgcttttaatcgcgttttcaaaattcagttccggcttccatacctggccagtaaataggctgatgtcatgggcacgaatcactggatcatcgagatgaacaatgtagtggcctgtgtaggtaacaccgtcttgccctttcaaagaccaatcgaaattaaatccctgcgtcttagctggcattttaaacgacttacttgccgtatcaaaagttaccgtagcgccattaactcctttgatgtttgaaacaacgatgttttggtgggtcactccggaaatggccacatcaaagaaatcacttagacttacgtgcgccgagtctgtataggcatcggcattctgctccaaagcatccggggttgtcggcttggctgtcgctgctttcagcacagtgatccggttattcgaaaaagcatcattgccaatggttggcgtgccctcaacaacaactttaggaatcaaattagccttaaatgccttggcgccaatactcgtaacactgcttggtatcgtttgcgcatttaaaataacattggcttcaaatgcttcctggccaatcgttttcagtccatttcctaacgttaaattactgatagagttgtaaacaaatgcatacttaccgatgtcggtcacgctgtcaggaacatcgagtgcgtcctggatctggttatagccaaaagcagtgtcaccgattgtctttaaccgatcatccagaaccagttttggaattttattcccgacaaaggccgcatttccgatcgttaatagcttaggtggtaacgtgatcgcattgttaatcgtattgtaggcaaacgcactatcaccaattgtttcgagcgccgtggcccgagtaaagtcaacattttccaacgggccaaattcagtaaaggccagattaccaattgattgcaatttgggtccaaacgctactttcacaagcttcccgccataaaacgcctgatcaccaatctgctccagcgaatcgggtaagttaatcgccgtagcagtggaaaatgcaaacgcctgaaatccgagagttgtcaattgactgttttctgcaactgcgatcgttttaactttcgaaccataaaaagccgagccgctgattgttttgacattagctggcaggttcaacactgctatttgaacgtccgtagtatcattttcagcgttactctctgtttttttggtattttgaataaactgaaaagcgccatctgtaatatctcgaacatcaggaccaagggttagttggtcagtataaagatgataaaatgcctcatgatcaagggtggctacattgactgttacgtgatccgccgtggcaaatccaaacgcggtcttatcgaaagtggtttgggcgccatcaatcgtgattgtcgccgcctgaatcccataaaaggcaatttcaccaatggcaggtgagccgctcaccgtgacatctccggttactttgtcataagcgaatgcggacttgccaatagtttttgcgccattaattgtaagattaccagtgaatacagcaccaccaaaggcaccttcatcaagcgtcgttagattgtccaacgtcaacgaatgcgcctttaaagtggcgaatgcattttttccgatcgtctttgcacgattaacggtgacatccccagcaatattggcagattcaaaagcagactcgccaatatcggcttgaccatcaatttttaaagatgaagctgtaagactaaagaatgcctgtgcctctatagtctgagcgtctgcaatcgttatatctttcacgttagcaaaataaaaggcgcgctctgaaatgttagccgtcttcttcagcgtgactgaccctgccttaattccggcaaatgcggctttgccgagactttctgcattttcaattgtaatgttgcccgtaaactgactgtatgcaaaagcattttcgccaatggacgtgacagtatcagccacgttaacattacccaaattattaagcgttgcaaaagcgccattgttaatcgccgtcactttaaaagtttggccattataggtaacagacgcgccaatgttaatatcggtgacattggcgttggcgcggccggtaaccgttgctgtaccgtttgccgtatcaagactgtaggtatagtcgccaatggtctgcgtattttcagcagctgttgcattggccggagcttgcgtgttgacctgagttgttgttgccgattgtgctgctaaggatgcttgtgacgatgcagatgaagccgccgatgatgctgcggccgaagttgtctgaacagctgcggatgcaagtgagcggtcttcttgggtcaccgtttgcggtttgactgctgctgaatctgtcgctagcgatttcgaatcggttgcatcactcgtgcttgctgctgaatcgccggttgacgctacagctgaactagcggtgcttgatgcagatgactgggttgcagaactagcagcattgacagccgcactacttgaagcagccgctgtattttgcgttgctgtaccggctggctgtgggttaccagtcgctgtttttgcagtcgtttctgctgtggcaccggactgactggtaacggctgtcgtttgtggggatttgctgtcagcgtgaacctcctgccccggttgaaaaaacgcgggcatcaataataatgccgtgcctgcaattagccagcgcttcttggccttgtacattcgaaaccgtacatgtacggttttttctgcttgttgaatggactgtacccgtttagaactatgtttcacgatcaagaatcccccttatgatctacaacatctgcaggctaagaatttcaaaaacccaacccgttaccactataggtcattataattaatcttattgaattttataacagaataattattttttccaacaataataatcggcttattcagggatttcgtcaataaagttatcattttcacaatcgttatcaaaagcctctcaagaatgcccctcatcattctaaatgcccagtaactaaaaaacgctacgcaattcattagttcgaatcgagtagcgtaccttttaaaataaccccaaccttccaatccgttccgccgcttcctgcaacctctgcggactcgtaagtaagccgattcggacgtagccttctccatggcgaccgaatccgttaccagccgcaaccgccacatccgcctgatcgagcaataactcggtgaacgtctgactggtatatccagctggtaccggcatccatgcgtaaaaagtccccggtgaacttttaccatgccaaccaatcgcggtggtggcagaaaaccagacatcgcgccgttgttgatacaagtcgaccagtgccgggactgacgtttgatcaccgagcagtgcttcaatccctgcttcctgaatcgccggaaaaaccgagacgaacagatgatcctgaatcagattaatcgcttcaatcatgtcagcattgccagcagcaaaggccaaccgccatcccgccatattgtatgtcttggacagcgtgtatagctcaatgccgacatctttggcaccaggctgctgcaggaagctcaccggacgctggccatcaaatccaagcgcaccgtaagcaaaatcactgacaatcccaatctgatgggccttggcaaaggcgatcgtctcgtcataaaattccggggtagccaccgcggttgtcggattattaggataattcagatacagcagtttagcagccgcggccacttccggtttaattttcgtataatcaggcaaccaattattttcggcggtcaacgtcattaaggctaatttcacgcgcgctaacgtcactcccgatagataatccgggtagcccgggtccggcaagagaattgtttccccgggattcatgagtgcaagcggtaattcgaccaagccgattttggaaccgcccaaaaccgctatctccttctccggatccaatgtcacgccatattcccgcgcatagaactcggccgctgcttgcttaaatgtcggcagtccgcgaaaaagcgaatatttatggttcccgggccgcgctactgcctgttgcgtcgcgtgaacaatattttcgggtgtcggctgatccggattgccttgacccaaattaatcacgtcatgaccagccgcaatccgttcattgacatgtttgactaaactggcaaaaaattgcttcggcagtgcctgaagcacctctgattctgaaaatgtcactggataagcccctttttaataaattagcatgaacgattgcccaacgatgcgacctttactgacggcttaataaagttccggccggcgatccgtgaaaaccgggatctgctggcgtgcggccccaatgcgatcaaggtcaattgtcacaatccccacctgtggctgatcgtctaacttcaacagccgttcaccaaaaggatcaaccacctggctttgtccgccaaatgcattgttcggatcgttaccgacacgattcaccgcgaccacatatgcctgattttcaatggcgcgtgctgctagcaaggcattaaattgcggcaatcttggtgttggccattctgccgggagaaagaacagctgggtcccatcgctggccatgcgccggaaccactcgggaaagcgcaagtcataacaaattgccacactggccggaacaccgagggtaaaatgatctgccgttgctccggctgtgataaacttttcttcattcattaagcgaaaccgatgcaccttatcgtacttggcaagctgccggccatgatgatcaaccgtcaaactccggttataaaagcgcccactttcggctgctgcaactgacccgccaacaattgccagatgatactgctgggcgagcgcactcaagaacgccttcgtccgcaacccatccggatccgccgtggtggccagatgttcgagatcatagccggtattccacatttccggcaatacaacgacctcagccccttgttgtgccgcttcagcaacggcagtggcaaccgtctgaaaattcttctccggttgaccaaatgcaatgtctatttgggctaatgcgattgttaattgcgccatttcaatccctcttttggttgattgcttcactaaaatgccgggacaatggagcccttaaatttcttagcgatgtaatctttaatcgtttgactttgataatattttttgatttgcttaatcactttgtcgttacgatgtttggtctggacaacaaaataatttggataagggttgttcgtcgtcttttcatggtaaattgcatcttgattgattgtgagaccggcatcaaatgcaaaattcgtattgattgcagcagcggccacatcctgtaagtgggtcggcaactgtgatgcttccagttcttcaattttcagccccaacggattggagacgacatcggccttagttgccttctgactgataccggccttgagcttaataacaccagcagcttcgaaaagttgcagcgctcgtaactcgttagacgggtcgtttggtaccgcaatcgaatcgccttttttgagtgccttcaaatccttaatcttcttggaataaacgcccatcggaaacgcaacggtcttgaaaacctgcgtaatcttaaagttcttggacttaatctgttcctttaaaaaaggtagggtctgatagctgtttgcgcctaaatcgccatcgtttaacgccacattcggactgttatagtcggtaaactgcttcaacttgatcgtcaaaccgtctttttgagccaattttgcgacctgtttcataatcagttcgtgcgggccggctgtgacacccaccgtaattgttttgtccgacaattgatcagtggcagacttgctgctagcttgacttgtgccacatgccgttagaatcaccacaagactgagcgcaacgaccgctgaaaaccctaacttcaaccatttcttcattaaaaatgcctccttgttgtcatgcgttttatatgcgcatgggtgtgtttgcgttactgataagagtgatggacgggatgagcgggttaagaaaacgaaaaagataacatggtcactagggtcggctggtgctcaagccataacgccttcctccctgcgcagaagtctgcgtgtaaggacctcagtcgtaatgaccaaacccgggtcatcacgactgaggccgcttacactccgacttctaagcgctcctgctcacgcttaacaaaaaagggccctgctgaatcaaaaaattgattcagcagggccgacagtgtcggggtaccaccctggttcgttaccgtgtaacctctacgatgcctgttgacaccgagaccgtttaacgcaggcctaatgcgtacccgactcatcgccgaatccattccgcggtcattttcatcagacgcctgcatcgatttccacctgccatcgactctctaaagctgcgttgctgattactctccacttcatgatgtttcatcattttatcagttatttttaaagttgaaagcagtttatctgcgtcgctgggaaatgtcaagcattttgttttttccgccatactttctttccttacgtcacgggatttgccaacttttaaaaattaaggttgacttcattgataacatcgcgtatgttaacaattatcacattaaatgagatttacatgagaggggttttgtcgatgaagctggatttagaattgcgtcccggcgctaatcggtttgtcagtgagacgggggcactcgcctacttggatacgatcttaaaggattttaccaaaccagtcgtcattactggcgagaaaagtttcgcggccttcaccaaagcttatcctggcaagttgaacttaccggtttatcattatgatggctctgccagtgacgagaacggtcatgccttggctgccgaaatcggtcaagccgatgccgtggtgggtattggtgccggccgcttgatcgacaccgcgaaagtcgcggctgaaactttgggggctgaactcgtcagcatccctaccctcgcctctaactgtgcacccttcacgcccttggccgccatttatcatgcgcagggccacaccttcagttacgtagaatattttaaaaagtcagcctacatcaccttggtcgattacaacctactgcttagcacaccgcacgactttttcgttgccgggattggcgacacgcttgccaagtggtacgaaatggacggcatcacccgccacaaagtcgatcaactgaatgcttacggtcaattgagtcgcgcctccgccaagaccattcaggcaattctgtttaaaaacgccgagcaagccttagctgatcttgatgccggtcgtgatacaccagcgtttgaagcagttgctgacaccatcatcggtcttgctggtgaagtcggtggctttggcggtattgacggccgtgctgcaggtgcccacgcgacgcataacggactttcatatttgccggaaacccacgctgttttacatggctccaaagtggcttatggtatcttggttcagctggccgaaaccggtgatgatgacgagatccgatcattattgcctttctatgaaaaaattggtctgccgacaaaccttgaagatttacacgttaccgaaaatgttgctgaaaaaatccttcaagtagccgaatttgcagccaagccagaagaaaccttcatcttggtcgacaaatctttgacgccgcaaaaagttgcggctgcaatggaaaaagtcgaagcagttacgagtgaagcggctgcataatcaaacgatatgttcaacaggttagttaatttgaaaagccttagtgaggaaatgctcactaaggcttttttaatcctccgtataacatctgcggctagatttgttttgttcgtttcactactgagagtctggctcaaagacctgaaatctcgaccgtacagtacatcatcacatgcttgaatttttccttaaattaacgtagagaaaactcgatttaacgtttatttgttccaaaaaatgacgattattccggaaaacccaacgttaaaatatttttgtcccgttaccgatctgttgttctatattaggcgtaaggaaaccggcgctttaatgacaagaaagcaacgtcatgtattgatcaacgagggaaacgtacatgaagaacgctactattgtgaaggcagccaaacgacaaaccattaaccacattggtgcgcaaaagtacctcaccggtgccagtgtcgcaggatcaggtgcaaaatccaaaaatccggaagttattgagagattggatcatttggatggtgtcggaggcgcagcttttgatgtttagcaaacctgtttttaagcttgtcttttgggtgattcttgccttggccaatattggtctcggaatgctgcttggtgcgacattgatgcaatctcttttaaatatattaacaatagtcccaataatttggatagttgttacaataatagaaatattgaccaagcgattcgcagacgaagaccagaaatcatgaataggataagcgaagggaacaaaatgaacttgaattgcagtatttggcaaacaattccaacttaaaaagaatcgcagcaaagtgcttcgattcttttttctagtccaaactaatctccttagcagctcgccgcataactttatcccgtattatctcataatgtcaaaggcatcagccgcttgcaactaattttttgccactactgtacggttttattttgatccaaataccccaatgtcgcagcagctacagccttggccgcgattagaatggcatcttcgtccagcataaagtcaggactgtggtggggatggtttgagccatcaggcagctgacagccgatgtagaagaagctgctcggaaccttctgcgcaaaataagcaaaatcttcagacggatcctggacgccggtatccttgatcgccgtgatttggggaatcttggctgctttgatcgctgccatggcctgattcgtcaacgtcgcatcattgatcaaaaccggataattgtcgtcataatccagcttggtttgtaccccaaacatggcttctaacccgtgattcatcgtcacaatttgctgatgaattatctgccgggtactttccttcatcacgcgcacgtcgccttttaacaccaccgcctgtttgatggcgttaaatgagccaaccccgtcaaacgaaccgatcgtgacgctggccgtatcaaaaggatcgattcgccgcgatacgatggtttggagcgccgtgaccaaataactgccagccacaatcgcatcgttgctcaaatgcggcatggaagcgtggccgcctttgccgataatcgtatcggtaaaattggcccggccagtttgggttgcgccggtatgatagccgatgagtcccgttggcattgacgacatcacatgaaccccgatgacattcgtaaccccctctaagaccccagctgcaatcatgccttttgccccaccaggcgatacttcttctgcaggttgatgaatgatccgaattgaacctgacagttgggttttaattttgttcaattccttggccaataccaataagtaagccgtgtgcgcatcatggccgcaagcgtgcatgaccccgggattttgcgatttaaacgggagctcattatcttcctgaatcgccaacgcatcaaagtccgcccgtaacgccaatttcggccccggctgcccgccttcaatatcgacgtacatgccataaccgtcaccacatggcacgactggcatatccaacgcagcgtaataggctttgatataagcagccgtttgtttctcgtgaaacgatacttccggatgtgcatgcagctgccggcgaatcgcaatcatttcctgttcatcgtcatccagcgcctgtaacaaggttgccaataaactcatgctgattttcccctccgtgattttgtctgaactttaggtaacttagcaatgaagcgaatcaaaaatgggcgcatggctttgaaaataacctccgccacgacaaacccgactgccaaggccatggcaatcaagatgacattataaatctgctgggctgcactcgcggcttttcccatggtaaaactacgcgcgcctagatacgcaatgccgcctgggacaagtgagactaagcttggtatgtaaatggtattgaccggcacccgatgacggatggcaaaataattacctaacaagccaatcaccacggttgcggtaaagttaggcaacactaggctatgatcctgaagactaatcagccaatacgcacaccacgacacgccacccgtaatgcctgccggtagcaatgcccgtttaggaatattggtgatcacgccaaaaccaatgcttgataaaacactcacgataaactcaaccagtaatcgcacgttaccgtccccctatgacttgggtcaacacaatggcaatgacaacgccagaaccaatcgccccggcaacaaaaaccgcatcaactgttcggacaatgccgctaataatctgacgcgacaagatttcccgaatcgcattggtaatcgccacccctggcaccaacggcatcaaggcactgataatgatgttccccgaactggcaccccagccaatattagccagcaactccgctaaaatagccaccacaaacgcacctgttgcttccttaaagtagggtgtcgtcgttttccgggcaaccaactcagccgcaagataaccaaagatcccgacaaaaaaagcccaggccaagtcgccattggtcgctttaaaaagcagcatcggcgccaccgacacccagccggcaccaagtatccgcgcccaccaaggaaaattaatcacttgccgctcaatccgggccacttcttgtttcagagcatcaaacgtaatctgatgagccacaaactcacgggaaagctgattcaattcatcgactttctgtaaattaaacccacccaaagaggatttgatcaatcgcgtgcggctttcattctccaaactgacaaaaacagctgtaatagttgcataacaagccaccttggcaccggcagcatggccaatatattcaaccgtcgtctcaatgcgggacgtctccgcgcccgcattgagcatgatctccccgaccttgccgcatacctctaagatttcctctgtatcaggctggctcatgatcccttgctccttaccgcgttatcgcatggcgttttactaattgtcggcttttttcgcgtcagtagcaagcaacccgccatgttttttattgaaacgtactaacaaagtcgaaaattagtttcattggtttctttcattaaccaatgaaaaaagtgcccgcctaagcaaacactttttctcagcatatgttatgttcatccaactaaggcgtattaactgcaaacaataaaatgcctaaaatgacataaaatgctgccagcatcagcacgacgatcaacagcgtcagcgcgcatttcaacaggagcgaaaactggcttttcttccaaatagcaaacagccagagtaccaacataacaaccatcagtagcatgagcccagacaacaagatccggggtaaaaaagcgatcatatcggtatacctcacaaatttgtgcctgcgattggtcgccattcatcgcgaatatcgctgaccgctctcaggataccaaggttttgcctctagcacaaaaaccctgcctcacaggttatcggcgacacacgaatgaagcttaccgcgggacgaagaagaacgcgattaaaagcagtgcgaccacgtaacatccctgagtaacaagcgcccctttgatccatcccttcatcggctgcaagttagctgcatgttgactggttaccaagagataaacaccgggtaaaatgccgaaaataggcacaaaagctaggatcaacaggaaaacaaaccacacggactggactagactttgcttcatcaaattggacaactccttttaattacgggcacgaacgacacttgaaaattgactaggtggtatagctaatactgcttccagcataatataaatttatttgttttcacagggcaacttctgctcgtttaatccctagttcagcaatttgttcgcggttcatcttgacaatctcaaaaaaaggggttgactggtaactaatatctttaggagtcgttttcgtccatatactgatacactcccttcgattttgcgactccgctttagcaacggtttttgatagcgtgcaaggagtaattaaaatgaatacatacagaaaaatcaatttgcgttgggtgtcgcatcaattacccgccttattaaaagtcaaacttgtttgtttcgcgcttgccagtgctttccagcaacttttgtcaggcttggttttgggccagcttgttgaacttgacttttcggataacctgaagctagctgaattcattttctttgctgttggttcctttgcgatcactgccgttgcagaatattactttgtcaaagccggacaacgagccattaggttacttaaccaagcactaaagaaggactattttgatgatgccctttcgaagtcactttccgagtcatctgaagtatccgacgtcattaaccgtgttgacggtgtagccaaacaagttgaacaaagctactttgagtcgttgctaacagtccttcaaagcagtattactttgattggatcagtgattgtcctactcaaactcaatttcgttttaagtttaatttatctactgttttcattaatatcgctattgcccagcgcttttggcagaaataaactgacgcgccaaaccgagaaatggacacatgccaatgctgatttgatgctcatcattaaggacttatttcgcggcagatttgacatcattaattttggggccggacccgccttttatgctcgctttaacaacaagcttaaccatgaagaagcagagtatgaacgaatgaatacgtatcagtactggattcaatttgtatcgtggtcgtttgccatttttgcctatttatcccctatctttattggcattatctttttaagaaatgggtggttcggtgtcactaaaggcattattgtgacgttaactttaaccgcagactccgtaatcagtggtattcgccaactcacgcagattcaaaccaagattgtcagcactgaaaagttacgacgcgtgcctattgtcaaaaatgtctttcttacgcctaacgccaaggaatctcagcccgccgccaaagaaccgaaaacattagcaattaataacttatcggttcagcgtgaccagcacgttatattcaaccatctaaacctaactctggctccaggtgaaaaaatcattgtaaccggtccctctggtattggtaagtcaacgctgttaaagaccattaccggacgaataaaaccgacaaacggctcgattcgcttccaggggcgcccgattactacaggtgattttgttctggtttcccaagacgtatggttgtttaatgcaactttgcgtgaaaatattacgttgtatcaaaattactcggatgaaacgcttcatcatattttaaatttagtcggcttaggtcgcgaactaggcaacaatgcgttggaaacacacatccgcgacaatggctccaatttatcaggcgggcaggcgcaaagaatcgcgattgctcgtggattattaagacaaagccccatcttcttattcgatgaaatctcggcaaacctagatgacgcgaatgcttataagatcagaaaattaatgtactcactcccttcaattgtcatcgaagtcgctcaccattatgatagcgcgttagccaaagaaaacgggattcacgtaaagaagaacttactgggtgcatcgcttactagctaatcgccatggtgttttgcataggtgtaacgaatctaccgggagcagctctgggttcaaaaaaaccgcgatcacactgaccgcggtttttttaatacaaatattcttagtaccttctccagcaacccgttactgtgccaccttactaattcgtccctgctcaatatacacggacaaaatagcgacatcagccggattaacgccactgattcggcttgcttgggcaatggtttccggttgaatcttaaccagcttttgccgtgcctcggttgctaagccattgattgcttcgtagttgatacgtgccggaatctttttgccttcaagccgcttcaacttggccacactggcttcttctttggcaatgtagccggcgtatttgatttggatctcaacctgttcaatcacccgatgatccaaggttgggttttccggtaagaactgttctagcgtctgataattgatttccggacgctttaagaagtcgctggctaagaccccatctttaagaggggcaaaatgatgagcttcaagccacgggttgacatccttgggcttcaggcgggtgtgctcaaggcgcgctaattcatcggtaatggcttgacgcttagccaaaaagtcagcatagcgttgatcactaatcaggccaagttcatgtcccattggcgttaagcgcagatccgcattgtcatgacgcagtaacaaccgatactcggcgcggctggttaacaaacgatacggttcattcgttccttttgtcacgagatcatctatcatcacgccaatataagcatctgaacgcttcaacgtgaagggacctttgccttgagcgcggcgggcagcattaatcccggccacaattccctgaccggctgcttcttcataaccactggtaccgttcatttgtccggcggtatacaaattctccacaaccttagtttccaacgttgctttcaactgccacggttcaatgacatcatactcgatggcataaccggcgcgcatgagttcggcatgctccaatcccgccacactatgcagcattttcaactggatttcttcgggcatggacgttgaaaagtcccccacataatattccgaggtgtcgcggccttcaggttccaagaataattgatgccgcggcttatcggcgaagcgaacaattttatcttcaatggatggacagtaacgcgggccaactcccttaatcacaccggaaaacatcggcgcgcgatccagattctcccgaataatctgatgggtcgtcgcgttggtgtaagtcatccaacaactcaactgatctttgagataaaccgaatccggcgttgtaaaactaaaatgattcggtgttttatcgcctggctgttcttcggttttggaaaagtcaatcgtattgccgttaacacgcggcggggttccggttttgaagcggcgcagtttaaagcccagctgctccaggttttcagaaagcttaatgcttggcagactgttattagggccggaactatacatgagttcgccgataataattttaccgcgggaactggtgccagccgttaacacaatacttttggcgcgataaatcgccccggtagccgccacgatgccgactgccttaccatcttcgaccagcacttcggtagcgagtccctgccgtaaatccaaatgcggcgtgtcttcaatgacgtgtttcatactgcggtgataagccgctttatccgcttgggcacgtaatgcgcgcactgccggacctttacccgtgttgagcatgcgcatctggatgtacgtccgatcaatattcttccccatttcaccgccgagggcatcaatttcacgaactacaattcctttggccggaccgcctaagctgggattacatggcataaatgccaacatttccaggctgattgtcagtaataatgtcttttcgcccatacgtgccgcagccaaggccgcttcacaaccagcgtgaccagcaccgacaacgatgacatcataagtgccggcttcaaatttctttacttcaggcatctgttttcctccaagcatctgtttttcacacgcccatgcgctacttacccagacagaactgactgaatagctgggtaattaattcatctggggcactttcgccagtaatttcgccaagcttgtcccaggccgcggtcatatcaatttgcactaaatcaatcggcatcccggcatgaatcccggccatgaccgcgtccaggcttttgctagcttgccgcaataggccgatttggcgcgcgttggagaccatgactgttccctgactattttcaatgccgccaaagaagagtttggcaattcgctcatccagtgcatccatgccatcactagttggaatggcggttttgatgatttcatcggcatcaaccaattgcagcaacgccgccgtgtctaaacgcgcaggcaaatcctgtttgttcaacacgatgatccgtttcttatcagccgttgccgcaagcagctgcttgtcttccgttgtcagcggctcgctttgatccaagaccagtaaaatcagatctgcctgcgtaattgcctgccgggaacgttccacgccgattttttcgactttatcggtggtgtcgtgaattccggctgtatcaacaagcttcaacggaaccccgcgaacattgacgtattcttcaaggacatcgcgcgtcgtaccggcaacgtccgtcacaatcgccttgtcttcgtgcaacatgtgattcagtaacgagctttttccaacatttggccggccgacaatggcagtggccaagccttcgcgcaacacttttccctgactggcggtagttaggagctgctcgatcgcctttttgacggtttgggccttttccaaaagcattttagttgtcatttcgtccgtatcgtactccggatagtcgatattaacttcgacttgagccaacacttcaagaatttcctgccgcagctgtttgattaaatggtgcaggttcccatcaagctgattgacggccacctgcatggcgcgatccgtttttgctcgaatcagatccatcaccgattccgcctcggtcaagtcaatgcggccgtttaaaaaggcgcgcttcgtgaattcccccggctcagccatacgcgccccttcgccaagcaataattgcagaatccgattggtcgccacgatcccgccatgacaattaatttccacaacatcttcacgcgtgaacgtctttggcgccagcataacgctgaccatgacttcatcaatcaaatcaccggtttcgggatcgacaatatgaccgtaatgaatggtatgacttttaacttgggtgagatctttgcctttaaaaaccttattggcagtggcaacagccgtttcgccacttaaacgaacaatactaatcgctccttcgccaggcggtgtcgagatggctgcaattgtgtcataagccgtaatagatgtcgccatatgcaaaaactccttttgatgatgtgagaatcgctgtgttggttggaaaatgagtggatgctttggtgtaagacgtttgaatcctacgctgggtcgcgctcgatcataacgcgctccctggcgcagaagtctgcgtgtaaggaccttggtcgcaatggccaagacccggccatcacgaccaaggccgcttacactccggtccctaaccgcgccgggtcgcgctcacaaaaaaagcgcagaacccagtctttccttatcgttgggaaaggctggataaagcactttgactacttcatcgtgattaaactgtgatcatcatacttaaatgttgcttacttgtcaaaagttagttacgggcgtttgggggtgacgacgacatagcgccggggatcgacgccttcggaatgggtgtcgacgtattgattgtccgccagtgttgtatggatcgccttgcgttcaaacgatggcattgggtctaagtaaatggctttgccggttgccagaacttcgcgcgcggttcgttcagctaagcgggtcacggttgcttggcggcgttcgcgatagtcgccgacgtccagcatgatggtccacttgcttttaccatagtggttaaactcggtttgcgctaagtattgaatcgcattgataatcttgccatgtttgccgattagcaagccttcctcattggttttgagttgaaaggtaacggtattaccttggcgctcgctgctgacttgggttttgatccccatgccgctagtaatatcttccaaataactttgcaccatggccagcgccgtttgattatcgcgctttttagtggtgatgtcgttaaatgcgctggcaatctttttaccggcgctatcggttaacgccaccgctagtttgctagcgcttgatttcccggtggcaggttctttcgctttaggatcaggcgcgggatctgccggtggttcgagtggtttcaagttaacaatcgctggcttgcgcatgaatccaaggaagccattcttattttcctgaaccacttggacactcacggcatcacgcggtaagccaagttgtttgagtccggcctcgatggctctttgaatcgtactgccttgaaaggttggcatcttgcttcctcccgttgttatttacgccgtttggtcgcttttttatacgcttttctaagtgcgcgttctttttccttctcggcccgtgctttttcttcacgttcacgccgaatcttaaacggattttgaatcaacaattgctgaaccattgaaaaggcgttggtaacaacccagtaaatggccagcgcacttggcaacgtaacggagaatacaaaaatcatagccggtgaaatgatcatcatcacccagctgcttgaattgcgggtcggttgggccatcatcgataaaatactggttcccaaagtaaataaggttgccagaatctgcataatccacaatgggtcaggttgtgacaggttcatccatagaaaagtcccggattgcaatgaagaagttcgtaaaatcgcttgatatagtgcgatcaggaacggcatctggatcacaatcggcaaacagcccatcaccgggttaacgccagctgacgcataaagcttttgcgtctcgtcgcggagtttggtttgggtttcggtgtcttttgaactgtattttttctgtagttcttttaactgcggggcgatttcctgctgcttggccatgctcttgatggacagatagctcaacgggaaaatcaaaatccggataattaaggtaaaggcgatgatcccgacaccaggattcccaccaaacaaattggccagccagataacaaattgaccggcagtataaaccacatagcgatcccagaatccggtactgttttctgacaccggtgccgttccacaggcagtcagaagaaagaccagactcagcatgctcacaatgacgagcaggcgtttgaattgacgatttttcacaaataatccctctcttaatctcaacatggtcaaatgacctcgatatcttcgttcaggatgcccgccaaccgcatgacatgtatcaggttcttctttgtctcagccatatcaagctgattagcggacttacgcgcgataaccaaaaaatcagtctggggatcaatctcaggctttagctccaacagactctggcgaatatagcgttttatctgattacgcatgacggcagtgtggccgacttttttgcctacagagatgcccacccgaaaatgcggttgatcgcgtttcatgtgatagatcacaaaattacgattggcaaccgaatcaccatggtcaaacacattttgaaattcaacttcttttttgatccgatatgacttgcgcaatgatgctccctcacaatctggttctaagtatacaagatgacaagatgttttcctatatgtatcagcggctaacgacaggtttcttttcagcccgctaaacagcctcataaacgcaaatgaacgacaacgaccaacaatcgggtcattgccgttcattggttgtgacgtgtcagcgcatgggttaaccgcggtgccgggtcattcatgaaaaaatgcgggcaagcgttttcggtgactgcctttgctgtgctaattagtcgcttggtgatggtgcgagtggttcaagaacgtaccgattgattgcagaagatgcgcgctcttagcagggctgccttttgcaactgttgacggctccgaaacgcgctctccagcgcagaaacctgcgtataaggacctctgaaccccaatggccaaaacccggccgaccaattacggctccgaaacgcgctctccagcgcagaaacctgcgtataaggacctcagaccccaatggccaaaacccagccattggggtctgaggccacttatactccggtttctaaccgcgctggttcgcgctctgctctaaaaaaaaccactgacgcggtcagtggcttaggcagataatactttacgtcctttagcgcgacggcgtgctaaaactttgcggccgttctttgtgctcatccgcttcatgaaaccatgaacacgttcgcggtgacgtttctttggttggaaagtccgcttggttgtcattgacgacacctcctagttaaaaccgatttatcttattaagatgacttgcattatcagacatcatccgagtttacacgaggaagcaagccgcgtcaaggctttttcactgacatcgtacatctttgtcgatcgcaagcgatattgtcttaagtaagcagttagccaaagtgtcacaaaatctgtaacctcttagaagaatacatctaggaggaatcacatgaagaaggttgtcttaacgatgagagaagaagaacgttaccgagttatcaaagcagtggttaatggtaaaacctcaattcaacgcgcagcagtcaggctcaaacgttcagagcgaaccatttaccgtttaatccaactatacaagcatcagggcaaagacggttttatccatggcaacgctggtcgtgagcctgccaacaaacgcaatgcgcaacttgagcgccaaatcattcatctgtacacaaataaatatgccgggttcaacatcgcccatttccatgaatttttaaccaccgacgagcaaatcactatctccgaatcttcactccgactcttattcagaaaaaaacagattctttctcctaaagcgcacaaggccaccaagcgtcgtgtcaaacgcgagctaaaagccaaagagaaaaaggtggagctactttcgaaacgtgacgaagctaccctgtcagctatcgaagccgttgaaaacatcaaagcccacccagaacgtcctcggaaacgttacgctggcgaactggttcaaatggacgcttcatgtgaacactggtttggcactcaaaaagccaccttacacgccgctattgatgatcaatccggaaatgttgtcggcggctactttgcccaacaagagaccctgagcggttactatcatgtttttgcccaaatccttcgcaattatggcgctccagctgaatttctaactgaccggcgaaccgtgtttaacagcaataaaaaagagggctcaccttcgaccgagaaccctctcacacgcttcggttatgcctgccaaacgcttggaacagaacttttggtcaccagtgttccacaaggtaaaggccgtatagaacggcttctggagacttttcaagatcggctcacaagtgaactaaggctgcataacgtcaacacaatcgcagatgccaatcggtttttggtcggctttattaagcgccacaacaaccgtttcgcatcgcccattaaaagtaacatgtcagtatttgagaagcaactaaccccaaaggaaattgacaatatcttgattattgccaatgaacgcagcatcggccatggccactgcatccgctttgaaaacaagcgctatctgccacatcgaaatggcgagcttatctatttaccgccacacaccaaagtactagtcatcaagagctttactggcaagctttatatgacgacagacgacgatcaggtttatgacctcttttgcgtgccaagggagtatgccttctccgctaaattcgatctaacaccgcctgaacccgccacccctaaaaaagctaggaaagtccccgctataacgcatccatggcgtcgagcaaactatcgagattatcttgattctctaggcctcgacagcgaacaaatcaaatggctggttaatgatcgttatccagttcgaaattcacaaacaagccacgtctaatcaggatcatttcgcgtccaattttcggacgcatgttttatggaatttactgtcaaagtcgaaaatcgcttgacaggctttttcactgacatcgtacatctttttaggatttgaactgggtcagttgcagcaatcgggtttgtggataacttgtgtgttgttaaaatacaaagcttatttcatgcacaggctgcgcacaagtaatttgcaagttcacatccatgtttatagagttatccacaggctgtaaatcgcctgttcatatcttgtgaaacacttacggctacaaggttttggttccacagacaaattgtgtataacttgcaatttggggattttggctttaatcatcctcagccttggggataatttgttcgcaccctgtttctttttcacttttttgtttgtggaaaactgtgatttctgtggaaaactcctttctgcaatgctaaacttatttttgcagaacatttttggccctaaccgaaaatccatgatctagctaagctgattcgcctaaatgatgccgttatctcgcttattgcggcgtttgggtaactgattggctttacctaaatcgaaactagtgtacacttatccacctgtcgacaacttttgcggttgccttggctttttgtgcgctaatcattatgtttgactaccatcaatgttggctatcggttttgggacgccgatgccaaccgttattagaggaggggcgttt

SEQ ID NO: 3 - DNA, 3327 bp, Thermomicrobium roseum
atgagtacgggaacactcggtcaacgctttctgcgatcggtacagatcgagcgtgactggcagagccgtgacgtaatcgcgcactacgtgccgacgttacaggttcgacaagtcctaaggcgactgggtgacgcgctcgcaaacggggcgacggatcgtgcctggacccttaccggtccctacgggacgggaaaatcggtgtttgccgcgttcacgctccagctcttatccgcagtcgatgccgctcagagtgaggcgtggcgtattctacgcctgcacgattccgagttagcctttttcctccaagaacgactcaatggacggcggttgttcccaataccagtggtaggacgacggacctcgctgccaggatgtctcatcaagagtctggcggggcaactggcgatactgccggcgactgcagagcgtgagagattgcaggcctacgctgcagaaatcctcaacacggagacggatcgtccgctcgatccggcggacatccttaacctgctagacgatgtgaagatgctcgtgaagcattccggttatcacggcatcgtggtagtgatcgacgaactgggtaggattctcgagtacgctgcttccgacccagtacgaggtgacatttcgctcctgcaagaattggccgagttcgcgagccacagcgggcaggatcctgtgttggtgctaggtatactgcaccaagcctttgaccagtatgcccgctatgtagatactgcgatgcgacgcgagtgggcaaaggtgcaaggacgtttcgtcgatatcgcattcatcgagcctcccgagcagctcatgcgattggcagtagatgcgcttgccgagagtcatgcagtgccgaggcctgataccgaggccatcgcggctgttgctgagatagcagcaggggaggacctcgggctccggccgcgcctcctcgagactgcacttttcagggatcttgtccagcgggcagcaccgctgcatcctgtctcactcgtggtgctgccatacttgtttcgtcgcctggcgcagaacgagcggtcactcttcacttaccttttcgcccacgaaccgttcggatttcaggataaagtccggcaacatcccggagcatgggttcggctccctgatcttttcgactacgtggcagtcaatctcggcaacagcctgtcccgtcatccacttttccaaagatggttggaagtggtgcaaaaaatggatgagcaccccgagctgagttgtgtggaagtgggcattctcaagacgatcggggtactggatgtgctcgccgaaggaagtcaccttcggccaacaccggaactcatcagcttcgctctcgcggacacgccaggagatgccgaaattcgaaccagcttggagggactgcacaggcggtcactaatcgtcttccgtcggttcaaccgtagctaccgtgtctgggaaggcagtgacgtcgatatcccgatgcgactcgaggaagcgcgcaggaggacagccggacagtaccgcttgggagcaacactcggacgctacctgaaagcacgcgcccaggtcgcccgacgccatagcttcgagaccggtacgttacggtttttcgaggtgcgttatctcgacgagcctctcccggctgagcaactgagaccacaaagtggggacgggattatcgcgtgttgcctgccccgtaacgatgtcgaggcacaagcgttccgtgagtgggcatgtgggcaggagatcgcctcacgtagcgacctcatcgttgcgctgccggaacagatcagcacactcctggaagcagcggctgaactcgtcgcactgcactgggtgagagagaacacacccaacctgcgggacgaccgagtagcccgccgcgaactcgacacgcggaccgcggaggtcgagcaggagatcaagcggctgctggaccgactcctcgatccacggccagctccggtcggtagccgctgcagctggtactggttgggtgagaagcaaccgatcgaccatccacgtggagtagcagcattgctttccagggcgatggaccaacactactcgctcagcccccggatttggaatgaactgatcaaccgtcgggttctctcgactgcggcagcagctgcgcggcgcaacctgatcgagcgaatgctcactgccggcaaccaacctcgcctgggtctgactggctttccgccggaacgggcaatctacgagtcggtgctgttcgcaacggggcttcaccgaccaaacgagcatggggagtggggattccatccacctcgcccagataaggatccggcacgcctcacccccctgtgggaaacgatggaacgcgaaatcttggcggcgaccgagcagcgaataggattgcagcagctgtttaatgaattagccgagccgcccttcggagcagctgagggcgtgttgcccattttgttctgcgcatttttcctcgtgtatcggaaagaagtcagtctgtatcggaacggagtgttcgttccggaacccagcgttgcggacttcgagatcctgttgcgtcgtccagaccgtttcgaagtcggtggggctcgcgtcgtgggtgggcgcaagttggtaatcgagcggttagcccgctggttggggaccgagcctgcgctcttgccggttgtgcgtgcgctcttggcagcagtccgcgcgctcccggagcacgcgtggcggacccagcgtctaccgcgggcggtgatcgaactgcgggagacctgcgcacgagcatcctcaccggagcgcttgcttttcttcgacttgcccaccgcgctgggcgaaatgccgttcggcacagaggaggtcgaccccgcccggatcgatcggtttttggagcgactgagcgaagcactcactgccctcggccaagcaaccccgcgggtgatcgaagaggcgcgggaccgattgttggaagcctgcggactcccgcacggcatggaagggtggaaggcgttgcgtgcgctcgcgcagcgcttggagcgggcggcttttccacccgatctggccggactgctcgtgcgactgcgccaagaacaagacgacgaggcaagtgtcgagagtgtcttggcgtatctggccacgcggccgcctcgattgtggacggacgacgatgtcgagcgagcgtgcacgcaagcccgcatcatcggcaagcgcttacggacagtcgctgcgacgtgggattgcctgacgccgcaagacgaggcgctgagcgaagaaatcgccagacgcgtcagggagatcctgccagtgaacgtaccgcgccacgttctccgggcagccctgctgcgcttgctgcaggagacagactaa

SEQ ID NO: 4 - DNA, 3520 bp, Rhodobacter sphaeroides
atgacgattgcagtgcgtgagatttttgagaagcccgtcgaccgcgccattgatggcgtcatcaaggcggatgacgaggcgagcctccgcgtcgaactcgacgagtacgtgattaccggcgagatcggacagcggcttgagcaattcctcgacgcctacaacaactacaagaccgctaacggcgtctggatttccgggttcttcggctcgggaaaatcgcacctgctgaagatgctggcgctactgctggaaaaccgcgaagtcgatgggatcaaggcgttcgatatcttcgctgaaaagctgaaggatgagccaatgctcttgggcgctctgcggaaagccgtatcgatcccatcgaagtcgattctgttcaatatcgaccagaaggcagacgtaatttcgaagaacgacgtcgacgcgctgctttcggttttccagaaggtcttcgacgagatgtgcggctattacggcaagcagccaccacatcgcacagttcgaacgacaactcgacgagcgtggtcagttcgaggcgtacaaggtggcattcttggagttctccgggaagccttgggagacgcgtggccgcgaagaggctctgctggaggggcgcaacatcgctgcggcattcgcgcgggcaactgattcagatctggccgatgccaaggatatcctctcacagtaccgaaaagatacgcgggtttcgatcgaagacttcgccaacacggtaaagacctggatcgatcggcaggtaccgaacttccggctgaactttttcgtcgacgaggtcggccagtacattgccgataacgtcaagctgatgacgaaccttcagaccatcgccgaaagcctcaacacgaagtgcaagggtcaggcgtggatcatagtgacggcgcagcaggccattacagaagtcgtcggggacatgactgcccggcaggaaaacgacttctcgaaaatccaggcaagatttgccaaccgcatgcccttgaactcggcggatgtagccgaggtcattcaacgccgcctgctgtccaagaccgacgccgctcagatcatgctgggcaatttgcatgacaaggaggagaacaatcttaagactttgttcgatttcgcagatggctcgatccggctgaagaactaccgcgaccgcgagcatttcgtcgcgagctatccgttcccgccctatcagtacacgctcttccagatggcgatcacgtcgctctcgcagcacaacgctttcgagggcaagcacagctccgtgggcgaacgctcgatgctgggcgtcttccaggaggtggccaaaaccctcgccgatcgtcctgtcggaggtcttgcaaccttcgacttgatgttcgaggggatccgcaccgcgttgaagtcctccgttcaacagtccgtccagatcgcagagcgaaacctcgacgatcccttcgcagttcgcgttctgaaggcgctgtttctcgtcaagtatgtcaaggagttcaaacctaccgtccgcaacatcagtattcttctgctgtcggaattcgaggcggaccaggcgggacaacgtcgcaagatcgaggaggccttggcgcgtctcgagcgcgaaacctacatccagcgaaatggtgaggtctacgagttcctgaccaacgaagagaaggatgtcgaggcggagatcaaggcgctggatgtcgatccaaccgagatcagcaaggagctggaaacgctcgccttcgacaccatccttcggcaccggaagatcaagcacctgacaacaggatatgagtattccttcagtcggaaactcgacgaccatctgctgggtcgggagtacgagctctcgatcaacatcatcagtccgttcaatgacgatgccgcggcacctgacgccgtgcgtatgcggaacatggggcgcgaagagctagcgatcgtgctgcagccggatgtccggttcatccgagacctgaccctgttccggcagaccgacaagttcatccggcaatcgcgcagcggctcgcctcagcctggtagagaccggattatcctggaaaagggcgagcagaacagccgtcgtgccaaggatctggagcttcggctgcggaaactcatggcggcggcacggctcttcgtacgcggcgatgaactggacatcggcggtgacgatccccaggaccgcatcgtcaaggcgttccaggcgcttgtcgacaaggtctacgtgaacctgccaatgctgagaggcgtgaactacgtcgaggcggacatcgccaaggccgccagcccgacgtccaccctctttggcgaagccggtaccggcctgacggaagccgaacaggatgtgctgaaccacattcagagccaggcccgcaacggcgtgaaggtctcggccaagtatctgaccgaacgcttcggggcgaagccctacggctggccgacggtcgccaccctgtgcctgaccgccagcctttccggcaaaggcaagtgcgaggcccgctcggacggcacgccgctggaaggcgccgaactggcccgggcgctgaacaacagccacatgctgggcaatatcctcctcaccccgcagttggagttcacctcatcccagatccgcgcggcgaaggatctctacaaggaactgttcggcctgccttccgacggttccgatgcgcgggttctcggcggcgagtgggcggagagtgtccgcaagctggcggacgaactgaaccggctcgtcaccaacaactataagtacccgttcatggcggcgctggagccgttgcgggaccaggtcaacgcaatgatcggcaaacctgccgcttggtacatcaccgaaccggtcaagcaggaggacgcgctcctgaaggccaaggaggacatcctcgacaagatccgcagcttcatgggcggggcccagcgggaaatctatgacgacgtccgcgacttccttcaggcgcaggaggccaacatcagctatgtcgatgccgccgccggggaaaagctgcgcgcggccctgagcgatcccgactgctacaagggcaccgcgatccaggcgctgaagtccgatctctacgccctgaaggacaaggtcgagctcgatgtcctgaaagagcgcaaggcggtcatcgcggcggtcgacgaatgcgccgagaaggtcgcccagacagccgagttccaggccctcacccccgagcagcaggacaagatctgccgcagcgtggcctcgcacaaggcggggctcgatgccgtgaccatgatcccgatcctgcgcgaccgggcgaatggcgcgcgctccagcctgatgcagcagatattggcagacatcgccagcatggcggcacctgcgcccgcaccatcgacgcccggcttgagcgaccgcgcttcaccgccgcctacgccgccatcatacatcaacgcttctgaaatcaggccgaaatatgccaagccctatctggcagaagaaagtgacgttgaaacttatgtggaggaaatgaagcagagcctgctcgctcacatccggtccggaaagcgagtaatcgtctga

SEQ ID NO: 5 - DNA, 3681 bp, Pelotomaculum thermopropionicum
gtgaaatacgctgacctgatccattttgaaccggtcgaaaccatagtgcagttgcgggaagctgatgccaaaagcagggccggtgagctggtaaaaacctatgtgatctcggaacggatggccgagcagattacggaagttgtctttccgcaactccaatatgaccatccccaggataataagggacttttgatcgtcggcaactacggtaccggcaaatcgcatttaatgtcggtactatccgctatagccgaatatccagacctggccacggagatacggcatcctgccgtggctaaaaaatctgaggttatcgccggcaagttcaaggttatcaggaccgagataggttccactacgatgtccctcaggaacatcatttgtgctgagctggaagagcagctggctaatctcggggtgcaataccgttttcctgaagccgataaagttaccaacaacaaagacccttttattgaggtgatgaccgcttttcaggaagtttacccggaccacgggctcttgctggttgtcgatgaactcctggactacctgcgtacgcggaaggaccaggaattaatcctcgacctaaacttcctgcgagaaatcggggaggtttgccggctcacccggtttcgcttcatggccggtgtgcaggaagccatttttgacagcccgcgctttcagtttgtggctgaaaccctgcgccgggtcaaagaccgctttgagcagatacgcattgtccgtgaagacatagcctatgtagttgctcagcgcctgctgcgcaaggatgaccggcagaaggctctcataagggaacacctgcagcgtttcaccagactgtacggcaccctggccgagcgcatggacgaattcgtcgcccttttccccgtgcatccggcataccttgaaacttttgaaagggtctatgtagccgaaaagcgcgaggtgctgaaaaccatcagtgcggccatgaaaaaactcctggacaaagaagttccggaaactgctcccggcctcatcgcctatgactcttactggcaaaacttaaaagacaatccttctttccgcagtgacccggacattcgcgaagtgattgagaagagccaggtgctggaaaaccgtgtccagcaggcttttacaaggccgcagtataaacctgtggccttccgcatcattcacgctttaagcgttcaccggctgacaacaggagatatttacgctcccataggggtcacggctcaggaactccgcgacgacctctgcctttacctgcccttgccggaagaggatgccgagtttcttaaaaccactatcgaatcaatcttgcgcgagatcttaaggacggtgagcggccagtttatttctttcaaccaggacaacgggcagtactaccttgacctgaaaaaagatattgattttgattcgctaattgagcagaaagccgagacacttaccccgaaccagttggaccgctattattttaaggccctggcccgggccatggagtgccccgaagccacgtatgttcccaatttccagatttgggagcacgaaattgagtggcgcgagaaaaaggctacccggttagggtatttattcttcggcgctcccaacgaacgttctaccgcccacccgcccagggacttttacctctactttctgcagccctttgacccgccggcctttgaagacgaaaaaaagcccgatgaggtgtttttccggctggtgcagcgcgacgaggactttgaccgtgccctgaagctcttcgccagcgccagcgagatggccagcacggcttcgaaaggaacgcggcaggtttatgaaaataaggctaacgatcagctaaaaaagatagtcgaatggctgcggaacaacatcgccactgcttatgaagttacctaccggggagcaaccaaaaaattcgtcgagtgggttaaacacagtgccaatccccatgcctcggttcgggatctggtgaacctggtgggttcctcatgtctagctccttacttccgggaactggcgcccgaatacccgatcttcgccattctggttaccataaagaaccggcctcaggctgcccaggaggcgataaagtggatcctcggcagcataaggaccaggccgggggcagccgtcctcgatgccctggagcttctggacggagataagttaaggccgcaaaattcccgttatgccaaacacatcctgggacagctggacaaaaaggggccgggtcaggtcctcaaccggggtgaaataattgccgattttcgcggtgtagagttcgagccccgtttcagactggagccggagtgggtggtcgtcatcctggcgagcttgatctacagcggcgatgttactttaagcatgccggggaagaagatagatgcttccaacctggaggagctgggcaaagttcccctggaggaacttatcaagttcaaacacatcgagcgtcccaaggatctccccctcggtcccctgcaggctctgtttgaattcttggggctgccgcccgggctcatcgtcaatcaatctactcgtgaagaaggggtaaggcagcttcaggaagcagtggataagctcctggaacgcaccgcccaggcccagcaggcgatccagcaagagttatccttatggggtatttctctattcgatcagaagaagaaaaccggtttaagggatgaattggccagtttcaaagggtttctggagtcactccgggtttttaacacccccggtaagttgaaaaacttccgctactccgagcgggatataaataagcagaaggcgtaccttgccaccctgaagagggttgaagaactggccggcctggccaaggagattatgcctctgctctcctacctcagtaccgccgaagccgtgcttcctgcggatgccggttggacgacaaaagcccgggagcggcgtgaagagcttaaaggaaaactatccggcctggacgaagcatccgtccctgaccttcgccgggagctcgtgcaggtgctcttagagctcaagaattcttacattgaggcttaccttgaggcccataccaaagccaggttaaatgcgtctttggaccagaagaaatccgggcttctcaaagatgagcggttgagcaaactcagcaggctggccggtatcgagttgatgccccgggcccagcttactgacttccaaaaccgtctggcggagctgaaaacgtgcttcagcctcaccagagaaaatttgggaaaaacgcccatctgtcctcactgcaactatcgtccggcacaggagcagattaagctttcggctgaagcggcgctcaggcagctggaggaagacctggaaaggctgtaccaggactgggaaaagacactggtcgccaacctggaagacccgacggtgaaggaaaacatctatcttttgaagccggagcagcagaaagcgctggagcaggtgatcaaagaacagcagctgccatatacggtggacgcatcgtttgtaaaggccgttcaggaagctctctccggcatggaaaaggtttcggttaccgcagccgacttaaagaaagctttggctcaaggtggaacgccctgcacagtctctgagttaaagcagcgcttcgaggattatatccagtctctcacgcgcggcagggatccgcagaaggtgagaatcgttctggaatag

SEQ ID NO: 6 - DNA, 3813 bp, Halorubrum lacusprofundi
atgagtatccgaaatctattccgtagcgacccgacccgacagctcgaagaagtccagaaggtcaacgcccgtgagcgggcggagaccgacgttgtcgagttctacgagacgaagagtgcagagcgtgttctcaccgaactcggtgaggtcaccgagacgcatccaggagaggccgctcgcttcctctatctccacgcgacgttcgggtccgggaagacgcacttgctgaagctcatcggcctcgtcgccgacagcgaatccgagttcgcccacttgggtaccgaactcgccgagcagtggcctgggttcgacaacttggcccaatcgatcgacgcctcacacgtcgaacgtctcaagccggtcttcttgaacctccttgaccgcgacgcctcgaaggaaccgccgcttccgttcctcatcttcgaggcgattggtcgcgagctggggtatccgaccgaccccaactggctgctcgagtgggcctggaccgtcgacatggagtacgagggcgtctgggacgcactccgaaccacagcgtacgacgggcagtcgttcgacgacgtcctcgaagagcgagcctcgctgcgccggtggctctacgaggcgctccccgcgctggcggagacgacgggaaccgaacttgacagccgcgagggcgtgaaagcgtctatcgagcgagccgaagaggaggtcgatcccggatcgttcgaccccgatgagttggtcgaacgcgtcgagactgtcaccgagtccctgaatgagaaaggaccgaacaccgaactcctgctggggctcgacgaggttgcgctgttcgtcggtgacagtcggcatcggtatcgcgagttcgaggagacgatggaagcgctccagcacggtccaaacccagtcgtcgtgacgaccggacagtactcacttcctgcgacgagagagagccttatcggaaagccttccgaggatcactggacacaccagcaggtgccgctcgaaggcgctgacacggagattatcgtccggaaacgctggctgcagaaggattctgcgggtagttcacgggtgtcctcactcctctcgtcgatgcccgacctctcgctggagacgtattcaccagtcgggagtgccgaccccgacccggtcgagtcatacccgttccgcgagtacgacttgaccctgttgcggacggtgatgcaggagctgattacccagggtcgggcgaccgaccgagattacatacagggacgagcactgctcgtgctggtccggtcgttgttcactaaattcggctgggcgtcggcggaggaaggcgacctcgtcacgtgggacgagctgttcgacctgctcgtcgaggagacgacctacgtgccgctgtgggttcaggagatgctcgacaacacgctgattccgaccttcgacggcaacgaagatgcgtgggaagtgcgcgtgtcgaaagcgctgtacctgttgaaccagacgccggcagttccagcgacgcccgagaatctgggacggctgatgctcgacgacgtgaacgcgtcggtcgacgaggccgttgcggacgttcagtcggcgctcaacacgctcgtcgacaagcgaaaggtgctcacggagaccaacgaccagggcgacgaagtgtacacgctggtctctgaagagcaagagagcatcctcactcgggcgcagacgaaagccgagcagatctccccgcaccagctctctgcgtggctggagacgcggctccgcgagaacgacgacttcttccggagcgacagcagtctgcacgaggccgacgtgggcgacgagcggctcgttccgctccgctatgagtactcgactcttgattcggttgaccgagcacccacgaccgagtacgatgcaatccgaattcgcgttcttgctgacgacccggacaccgtccccgaccaggtggagacgtggcaggacgtgaacgatgggcgtgacggcggtgaacatatcctcatcgcgatcgacgtccccgagacgacgctcgacaggatccgcaacgtcatcgggatgggacaggtgctggaagcggagacagagagccacgatgaactcgaacgggaacaacggacggataaacgccgtctggagtcgtcggtaagcgacctcctcaagaatgcagccgtccacacggtccacgactaccgcggtgagcgaccgagcgtcctcgaggacgtcgtcgaagaccaggtccaggccgtcttcggttcgacgcggaaggtactctcgcgaccgctcgtcgaagtcgacgacgcgaaggggctggcgaaattcttccggggaagtggtgactggccgcttgcagacagtgacgcagtgatgctgggtgtggatacgtcgagcacagagattgcggacactgggtggtgtcgagcgttcatcgacacgtacgagtcacagaccgcagtggacgtcgagacgctgctccagcagacacgaacggcaaatggggactaccgaggcaccccgcaagaatcgatcgcggcgttgctcatcacgctcgcgacgtccaacgagaaggttgcgctcaagcaggataccgactacgtgaccgacccgacggcaatcggtcggcacgtacggacgaagggaggcctcacgtcgctgcaggttcggttcggcgtcgatacagtcaaccccaaagagattcgaaaggtcgtgtcgacggtccttggccacgatcccgacggtagcgaccctgacgcgtgggtggccgagcttgcctcgtgggtcgagaacaacagcgtgctggtcaagcggacgttcaagggcgtctcccgagagttcgacgtctccctggacgcgctggagggcgtactggaaccggcgtacagcggcggtgacaccaccacatcggagctggtggaggacagcgtccagtccgaagcggagacgttcgcagatgcacgcaaactctttgctgtcgacgggggagcgaaggcgctctgggaacagttcaccgataccctcgatctgctggaggaactctaccccagtgcgaccattacctcacggatgcagacgaccgcggagagtggatccgtaccgacaaagacgacagtgagctcacggctggcggatgcgactggacaccgcgtcgacgaactcacgtcgcagtaccgtcgggtgaccggagagaggtgtgacgtctctgaccccgaggaaatctgtgtggtgctgaccgaatggatccgcgagaacgagtcggtggtacaggctctactcgacgatgccaccgccacgttcgacggcatctcgttagatgatctcgaagcggtgttcgagatggcgtggaacgacggcgagatcggtgagggtgaactcgttgccgccgccgtgcgtcagcaggccgaagcgtacgagaaggttcgagacctccttgggggcgagaaaaacccgtgggagcagttgcagtcggcatacgacggtctccaggcagagcaaccggactcaccgacgacggaatcagttgagactgtgctcggctcgtcgcggctcccgtcgattcagcgtgttcggcagctgatcgaggaagcgaagaatccgaaactgccgggggccgacgacgacgcgtgggcagaactacagcgcgttgccgaagagctcaggcgggagcttccgaacgccgacgttaccgatgacgtgacggcggcagtcgacgcagacgaccggcccaccgacgagcgagcgacagagcttcttggcgaagcagagaaactgctgagtaggattcgtgcagtcagagacgctctggacgacgttgacgagggaagtatcgtgttgatcgaggagtag

SEQ ID NO: 7 - DNA, 3639 bp, Clostridium sticklandii
atgtatattaaaaatatgtttgcaaaggatatagatagagatataaaaggtgtaatcaaagtaggacaaaaagatgatgaaaatataaagcaagagctagaagaatatgtcgtaaccaaggaactgcaaaaacattttgcagatttttttgcgagctatactaaatccatctcaggacaaacagacaagatgggggtatggatatcgggcttctttggaagtggtaagtcccactttctaaaaatcctttcctacctactagaaaacaaagtagtggataataaacctgcactagactatttcctagatgacaataaaatagtagatgaatttgtaatagcaaatatgaaaaaagcggcgaatatttctactgatgtcatactttttaacatagattccaaaagtggcatggcagacagccaaaacaacaaagaagctatactttcagtctttctaaaagtattcaaccaaaaactaggctactatggagctaatccttttctagcagatttagaaagacatctttcagatgaaggaaaatacgaggaattcaagcaagcctttgcaaaaataagaggaaaagaatggatagatactaggcatatgtttagattcatccaggactctgtatgccaggctctagttgacataggatacatgagtatggatgctgcaaaaaactggtgtgatacatccacaggagtatataacatagatgtgactacctttgcctccatggtcaattcctacatagagaaaaaaggagctaaccatcatgtaatatttctagtagatgaaatcggtcagtacatcggtgatgattccaagctcatgctcaaccttcagacagtaacagaagacctcagcacccattgtcatggcaaagcttgggtagtagttactagtcagcaagacatagatagcataactaaaacaaaaggcaatgacttttcaaaaatccaaggtagatttgacactaggctatctctatcatctgccaatgtagatgaagtaatcagaaagagaatcctagaaaaaacagaaacagcaaatgataccctaggactgctatatgatgagaaagaaaccataatcaaaaacctcataatatttaacgatggtatagaaaaaaagctctactcaaatcgttacaactttgcagaagtctatccatttgtgccatatcagttcgacctgctaggcagtgtgcttacatctatcaggactcatggagcaagtggaaagcatctagcagaaggtgaacgctctatgctagcactgttcaaagaatcagcagtaaaactcatggacaaatcagaaggagctatagttccatttaatatgttctatgatgcactagagcagttcctagaccacagccacaaaggcgtaataataagagcctacaacaatgaactcataaatccagacaaatcagaggattgctttgatgtagatgtactcaagaccctctttatgatcaaatatgtcaaagaagtagtggcaaacctagagaacataactagcctcatggtatctcatatagatgatgacagaatagagctaaaaacaaaagtagaagaagcccttaaaaaactagtgcgtcagaccctagtacaaaaaacaggggacatctatgtatttctaacagatgaagagcaagagataaacagagaaatagatagtcaggcagtagagatatcagaagtcataggcaaggtatcagagatgatatttgacggaatctatgacgagaaaaaatataaatatccagcctttggtggtagatatacctttggattcaaccagctagtagatgatagaccatacaaagcaaaccaaaacaacgatatctcacttagaatcctaacaccaaactacgaaaacggcacagatgaaacaactatgagaatgcaaagtggacagtcaaaaagcgtactagtggtactgccagatgacaaagccttcctagatgaaatcagaaatgccctcaaaatagaaaaatacctaagactaagtaatagcaatacagtcacaaaatacgagcaaataaaagatgcaaagcgttcggagatgagagaaagaagcaacaatgccagaatattcctagagcaatccctaaaaaatgcaagcatctatgcaaatggtgacaaaatccagtcatcagcaaaagaaatctcgtcaaaaataaatgaggctctgggcaaactagtagcaacaacctaccacaaaataacatatataaataaggcaatgggagaagcagacataaaagcagtcctaaaaggaagctctagcagtcagatatccctagatgagacatcctcagttcctaaccacctagcactagctgatgtactagactttatcagtctaaactcacagcgacatgccaaaacctcaatgaaaaccataatggatagatttacaaaagctccatatggcttcatagagtacgatgtgcagtggatagtggcaaaactattcaaagacggagatatagctttttatgtaaacaatgatgtagtaagcctcatcacaaaatcagaagatgaaatctacaaatacatcacaagaaaagaatacctagaaaagctacttacagaaaaaagagaaaaagcaaacgacaagcaaaagaaaatagtaagagaagtgatgaaggaactatttaatgctatgccacctagtgatgaagatgacactatgctagctagctttcatcagttcgcaggcaaactaaaatcagagctagaaaaactagaaatccactatgcatctagcccgcttcataaatacccaggacaaaccatagtaaaagaaggtaaaaatcagctcataaacatactatcaatcaaagctacaccagagtttttcaaaaccatagaaaaatcccaagatgacctactagacatggcagaagactatgaaccagtcaaagccttctttggctcagagcaaaaaacaatctgggacaaaaccatagacaaactaaaaatctaccaagaaagtaagaccttcatagcaaaaaaagaaatagaagaaatagtagcagacatacagaccatcatagataaaccaaaaccctaccaagacatcaagaagctcccagaactactacagagctatctagatatgtacggagacttgctagaggaaatggaaggcccagtatatacagtaatatcagagtgcaaagctagagtactagaagaactaaaagatgaagagctaaaccaaaaattcctagcgaaaataaacgcaaaattctcagcactagaagaaaaaaccaaaacctgtaacaatgtagccactctacaaaatataaaaatagaagcagatacactaaaagtaagacttctagaagagataagagaagaatatcagaaaatactagcaaaacgattgaaagaacaaaatgaaacaggattagttgttgatgctggtggaaattcaaccccacctacctatgtagcaccaccaaaaactaaaaaacatcatattatcagtatcaaagacatcaactcagaaagtacatggatactagaatcagaggcagacatagataaatatatagacacactcagacagaaactaaagcaaaacctaaaagaagacctaatactaaacatagagttctaa

SEQ ID NO: 8 - DNA, 3642 bp, Salmonella enterica
atgaatattgaacagatctttgagaaacgtctggaccgaaatattaatggcgttgtgaaagccgaacagacggacgatgccagtgcctggattgagcttgatgaatacgtcatcacccgggaactggaagggcatcttcgccacttctttgaatcttatgttccggcaaccggtccggatcgcatacgcatggaaaacaaaattggcgtatgggtgtcagggttctttggctcaggtaaatcacactttatcaagattctgtcgtatctgttgtctaaccgcaaagtcagccataacggtacagaacgtcatgcttactccttctttgaagacaaaatcaaagatgctctgttcctcgctgatatcaacaaagcggtccatcatccgacggaagtgattctgttcaatattgattctcgtgctaacgtcgatgacaaagaagacgccatccttaaagtcttcctgaaggtatttaacgaacgggttggctactgtgctgattttccgcacatcgcccatctggagcgtgagctggctaaacgcggccaatacgacgcgtttaagaccgcattcgccactatcactgactcaagctgggaaaaagagcgcgattcctactatttcatcagcgatgaaatggcagaagccctaagccaggccaccggtcaaagcgttgacgcttcgcgtcaatgggtggaacagctggataagaatttcccattagatatcaataatttttgccagtgggtcaaagagtggctggatgaaaacggcaaaaatatcctcttcatggtggatgaagtcggccagttcatcggtaaaaatacgcagatgatgttgaagctgcagactatcactgaaaatctgggtgttatctgtggtggacgcgcatgggttattgttacttcccaggcggatattaatgcggccattggtgggatgagcagccgtgacggacaagatttctctaaaattcaaggccgtttctctacccgtttgcagctttcaagctccaacacctccgaagttatccaaaaacgtttgctggtgaaaaccgatgccgcaaaacccgcgctggcgaaagtctggcaggaaaaaggcgacattctacgtaaccagcttgcttttgatcccacaaccaccgcttctttgcgcccctacaccagcgaagaagaatttattgataactacccgtttgtcccgtggcactaccagattctgcagaaggtttttgagtctatccggaccaaaggtgccgccggtaaacagttagccatgggtgaacgctcacagttagaagccttccagactgcggcacagcagatctccccgcagggtctggattctctggttcccttctggcgtttttatgccgcgattgaaagcttcctggagccggccgtcagccgcaccatcactcaggcctgccagaatggcattcttgatgagttcgatggcaacttactgaaaacactgttcctgatccgctacgtcgatgtgctgaaaagtacattagataacctggttaccctttcgatagacaaaatcgataccgataaagtcgaactacgccgtcgcgttgaaaaaagcctgaataagctggaacgagaaatgttgattgcacgtgttgaagacaaatacgtgtttctgaccaacgaagaaaaagagatcgagaacgagatccgtaacgtcgaagtcgacttctccgcgatcaacaagaaactggcctcgatcatctttgatgacattctgaaaaaccggaagtatcgctatccggcaaataagcaggactttgatatcagccgcttcctgaacgggcacccgttagacggcgcaatgcttaacgatctggtggtaaagatcctcacgccaaaagatccgacctatgatttctatgacaacgacgcggcatgccgcccatacacctctgagggagacggctgcattttaattcgtttacctgccgatgcccggacctggaccgatattgatttggtcgtccaaacggaaaaattcctcagggacaacgcaggtcagcgaccggaacaagccagtctgctttcagaaaaagcccgtgagaacagcgttcgcgagaaaatgctccgcgttcagctggagtcgcttattgccgaagctgacgtctgggcgattggcgagcgcttaccgaagaaatcttcgacgccatccagcatcgtggatgaagcttgccgctatgtgattgaaaacacgtttgccaagctgaaaatgctgcgcccgttcaacggtgatatcgcacgtgaaatccatgcactactcacggtggagaatgatgcggagctggatctgggcgaactggaggaatccaaccccgacgcgatgcgcgaagtagaaacctgggtcagcatgaatatcgagttcaataagccggtttatttacgcgatattctgaaccactttgcccgccgtccttatggatggccggaagaagaagtgaagctgctggttgcccgtctggcgcgcaaaggcaaattcagcttcagccagcagaataacaatatcgagcgtaagcaggtgtgggagctgtttaataacagccgtcgccacagcgagctgcgtctgcacaaaattcgccgtcacgacgaatcgcaaattcgtaaggccgcacaaactatggcggaaattgcccaacagccgtttagcgaacgtgaagaaccggccctggttgaacatatccgccaggtcttcaatgactggaagcaagagctgaatgtcttcaaagcgaaagcggaaggtggaaacaatccaggtaaagatgagattgagtcaggcctgcgcctgctgaattccattctgagtgaaaaagaagattttgccctgattgagaaggtcaccagccaggtcaatgagcttctggatttcagtgaagatcgtgaaaatttggtcgatttctaccgcaagcagtttgctacctggcaaaaactaggcgcggcgctgaacggcagctttaaatccaaccgcagcgcgctggaaaaagacgccgtggcggtaaaagcactgggcgagctggaaaacatctggcagatgccggaaccttataagcatctcaatcgcatcacaccactgattgaacaggtccagaacgtcaatcatcagttagtggaacagcaccgccagcacgcccttgaacgcattgacgcccgcattgaggaaagccgtcaacgcttgcaggaagcgcatgccacgtcagagctgcaaaacagcgttctgctgccgatgcaaaaagccagaaaacgtgccgaggtcagccagtcaattccggaaattctggcggaacagcaagaaacaatggcactgcaaacggatgccgagaagaagattaaccagtggatcgacgagctgcgtaaaaagcaggaagcccagttacgagcagcgaatgaagctaaacgcgcggccgagtcacaacagacttatgttgtggtagagaaacccgttatccaaccggtaccgaaaaaaacgcatctggtgaatgtcgccagcgagatgcgcaaagccaccggtggcgaagtgctggaaaccgccgaacaggtggaaaaagcgctggatacgcttcgtacttcgctgctggcagctattgaggcaggtgaccggattcgtcttcagtaa

SEQ ID NO: 9 - DNA, 3651 bp, Photorhabdus asymbiotica
gtgatgaatattgaacaaatctttaccaaacctctaacccgaaatattaacggggtggtgaaagccgaacaaattgacaatgaaagtgcttacattgaattggatgaatatgtcattacacgtgagcttgatcgtcatttccgtgctttttttgccgcttatttacccgctgttggtccagaacggggttgtgttaagaataatatcggtgtttgggtttctggcttctttggttcaggtaaatcacatttcatcaaaatcttatcttacttgctggcaaaccggcaggttatccacaatggtgacagacgtagtgcgttgtctttttttgaagacaaggtagaggatgcgttgttattagcggatattcgcaaagcggtgcaatatccggctgaagtgcttttgttcaatattgattcccgtgctaatgctgatgatcgtgaagatgcgatcctgaaagtctttctaaaagtgtttaacgaacgcgtaggttactgtgcagacttcccacatatcgcgcatttagaacgtgaacttgaccgccgtggacagtatcaagcgtttaaagacgcttttgccgctatcagtggttcatcgtgggaaactgagcgagatgcttacgactttttccgtgatgaaatggcacaggcattgagtatagccagcgggcaaagtgaggaatcatcgcgccaatgggcggaacagtttgatgcaaattttcctttagatatcactaacttttgcaagtgggttgaagagtacctggatagccgtgagaacggcaacatcttgtttatggtcgatgaagtcggtcagtttattggcaaaaatacccagatgatgctgaagctacagacgattactgagaatcttggcacgatctgtagtggccgagcgtgggttattgtgacgtcgcaagcggatatcgatgcggctattggtggcatagagcatcgtgatggcctggatttctctaagattcagggacgattcacgacgcgtttacagctttccagctcaaacacctgcgaggttattcaaaaacgcttattaactaaaaccgaatcagcggttgaagcattgcgaaccatttttgcccagaagggtgacattttacgtaatcagttaggttttgatgcaacgaccaaagcgaccctgaaaccctatacgcaatcagctgaatttgttgataactacccgtttgtaccctggcatttccaattggtacaaaaagtgtttgagtctattcgtaccaaaggggcaacgggcaaacatttagcaatgggggagcgttccttgctggcggcgtttcagtcggcggcacagcaggttcagtcggatgatttaaatacgttgatccctttctggcgtttctatgaacctattgagggctttcttgagcccgcagttaagagaactatcgagcaagcagagggattagggctccatgaacaggatatccaactgcttaagacactattcttgattcgttatgttaatctgctaaaaagcaccttagataatctggtgacgttgactatcgaccggattgatacggataagatcacattacgtcgtcagcttgagaacagcctccaatgccttgaaaatcaaagattgattgcccgtagcggtgatgaatatttgttcttaactaatgaagaaaaagagattgagaatgaaattcgtaatgtggaagtagaatacaccacgattaatcgtcgtctctcaaacctcatttttgatgacttgctcaaaaaccgtaaatatcgttatccggtgaataagcaggatttcccgataagtcgcttctgtaatggacatcctttggacggcgctaatctggaagatttagtggtgaaaatattaaccccgctggatacttgctataaccattatcgtgatgatattacctgtattccttattccgcagagggtaacggttgtatcttgatccgactggccgatgaattgctggtgtggaaagatttgcaaataatggtgcagacagacagtttccttaacaaacaatgtggacagcgaccagaacaggatgtgctgttgaaggaaaaggatcgcgaaaaccagagtcgtgaaaaaacattacgtgtacgtattgaacaactgctcgctgaagcgacggtttatgctattggtgtccgtttaccgaaaaaatctgcctcgccaacagccatcgtggatgaagcttgtcgatatgtgattgaaaatagtttcgctaaactgaaattgctgcgtccaacaagtcgtgatatcaatcgcgaaattcattcgctcctgaccatagaagattctgcacaaatcaatcttgatatgtgctctgaggaatgtaatccagaagctatgcgagaagttgaagcctggattagtatgagtgtcgattatcataagcctgtttacctgcgggatgtacttaatcactttggacgccgcccttttggctggccagaggatgaggtcaaattgttggtcgcgcgtttggctcgttcaggcaaaatcaattttaccctgcaaaacaatcaaattagcttgaaacaggcgtgggatgttttctcgaatacgcgtcggcatagcgagttacgtttgctgaaagtccgtcagcatgatgaagaacaactgcgcaaggcggcacatattatgaacaaggttgcgcaggagtctttcaacgaacgcgaagagcaaggattggcaaagcatattcgtaccactttggaaagttgggaacgtgagtatgttggctatcaaatcaccgcccaaacagggcagttccctggagaaaaagcggttcaggaagggcttcaactgattaaatcgcttttggcgcagaaggaagctttttctctggtggagaaagtgatcgatgaatctaacgcattggaagactttgctgaaacacgcgatgatctcagtgatttttatggcaatcagctccagtcttggcagcagttggcaatggtgctaaatggtagctttaaggctaatcgtagcgcgttagaaaaagacgaaaatgctcatcaagccttgactaaactgtgccacatttaccaaatggcaaaaccctattctcagctctgctgtattgttccgctcattgaacaggtgcaggaggtgaatcagcgtttgttaactgaagcccgtgagtacggtttacagcgtattgatacccgcattgaagaagttaaaaaacagatgcagcagagtcagattcctgattcattactgaatcgagcgttgtatccaatgcagcaaagtcgtgagcgtgtagtcaatacacagtcgatacctgaaatctatcatgagcaaagtgaggtccaattacagcaaggacaggctgaacagttaatgaacggctggattgatgagcagttgaaaaaacgtcagatgatagagaaatcggttagtaacgatggacagagatcgccagtgacgtcgataccggtatctgacccgcctaccgtacaacctatacccgttttgaaaaagacgcttgcgatccacgctacgcgcgaaatgaaaaaagccgttgatggggacgtattagaaacgatcgagcagatggaaaaggcgcttgagcagctacgtaagacgttattcgatgcccttaaagccggtgaccgtgttcgccttcagtga

SEQ ID NO: 10 - DNA, 3567 bp, Tepidanaerobacter acetatoxydans
atgaaaatcaaggatatgttttataaagatattaccagagatattaaaggtgtcatcaaaattggtcaaaatgacgatgaaaacatatatcaagaattagaagaatatgtagtaactcaagaactgtcaaaacactttgacgattttttcaaaaactataaaaaaagcatactgggttatacggataaaatgggtgtctggatttcaggtttttttggtagcggtaaatctcactttttaaaaatattatcatatttgctggaaaacaaagaagttgaaggtaaaaaagctattacatattttaatgataaaatacaagacccaatggtcttggcagacatgaaacttgccggagaaactcctacagatgttatcttatttaatattgattctaagagcgactctgattcaaaggcaaataaggatgccattgtaaaagtatttatgcgagttttttatgatatgcagggtttttgcggttccattccatgggtagccgatttggaacgacaaatgactttagatgggacttatgataacttcaaagcagcttttaaagaaatatcaggcagagaatgggttgatgcaagagaagatttttattatgaagaggacgcaataatcgaggcacttgcaaaatcaaccaaaatgagtaaagaagcagccagaaactggtacaacaaagctgaagaaaactacactttaagtgttgataaatttgccaaaagagttagagaatatattgaaagtaaaggtaacaatcatcatgtggtatttctcgtagatgaaatgggccaatatataggtgatgattctgaccttatgttaaatctacagactgtagtggaagatttgggaaccgaatgtgggggaaaggcctgggttatagtaacaagtcaacaggatatcgattctatgacaaatatgaaaggcacaaaacgcaatgacttctccaaaattcagggcagatttgatactcgactttcactttccagtgccaatgtagatgaagttataaaacgaaggattttattaaaaaacgatgttgggaaagacactctaaaactattatatgagaataaaagttcagtaataaaaaatctcatcacattttcagcaaatacacctgagaagaagatatatacagatgcacaagattttacagaggtttatccttttattccctatcaatttaaattgatgcaggaggttcttacttcggttcgtatccacggttcatcggggaaacacctatcagaaggtgagcgttccatgttaagtgcttttcaggagtcctgtatccgctttgctgacgaagaagcaggagcccttatacccttttatgctttttatgatacgattgaaacctttttagattcgggaataaaaacggtaatataccatgctcaaaaaaatgaaagattaaaaccctttgatgtggaattattgaaagtgcttttcatgacaaggtatgtaaaagaaattcccaccaatattgaaaatcttacaactcttatgattagccacatagatgatgacaaattggaactaaaaaaggaagttgagaattcactaaaacgtttaataagagaaacccttgttcaaaaaagcggggatgaatatatatttctgacatacgaagaacaggatattaatagggaaatcaaaagcatcaatgttgaaatggccgaaacaattagaaagatatcggaaataatctttgaagatatttttcctgagaaaaaatataaatactctcagcaatataattttccttttaatcaaaatgtcgatgacagattatacagaggaagtcaggctaatgatattggcgtaaaaatcataacgccttactatgaaacacaagtagagctgacgagtcaagcacttaagctcatgtcatccggagaaaataatttaataataaaactacctcaagatactacttttcttgaagaaatggaagaagtattaaggattgaaacttttctccgtcaaacagggggaagcacatcaacggcagaaattgaagacatcaaagatagaaagagaagagaggcagccgacggtctgactagagtgcgagagctcattgaagaagcactgaaatccgcagagatgtatgctaattcacagaaactcgatatcagagaaaaaaatcccatcgacagaataaatgaaggcttaaaaatcttggtagaaagcatatatcataaacttcattatatagataattttatagattctcccagagatattgaaaatatactgacacataatatagtccaagtgtccttagaagaagagagagataacaaattagccctaaatgaagtggcaaatcatgtagaaagaaatacattaagaaatatacccgtaaccatgcgctccatattaaatcatttttcgaaagctccttatggttggaatgaattagacatcgaaggtcttgttgcaaaactcttcaaagaacaagagattaaacttcaacttaacagtaaatatctaaacattgaagacaagaacctgataaattatttaactaaaagggactacgctgaacgtttgttgatagaaaaaagaataaaggttcctccttttcagataaccaatgcgaaaaatttatgtcagcaactttttggcataatagctcttccaaatgatgaagatggcattatgcgagaacttgataaacttattgaaacagaaagctacaaaattgaaagactccttgaagaatataatactgcaccttatccaggtgaagatatattaaaaaaaggcttaacattatttaaaaaattattatctatagatgatgccaaggaatttttcgacactctatatcaagacaaggatgatctgctggaatatgcggattattctccggaagtcaaaaacttctttaacaaagatggaaaacaaagagagatttttgatgatgctcttgctaaaataaaaatttatgaaaaaaacaaagattatctaacaaatcccgttatagcaaaatatatacaggatataaagtccatagtaaacatgaaagaaccctataatgacatacccagactaccggatttaattgaaaaatttaatactgagtttgctaaattattggagaaagagagcaagcctatcaaaacttctatagaagaaagtcgcgacaaagttatagaagaacttgctttatgcgattttgggtataaatatactgcaaaattcaaaaatagttttgatgatttattaaataccttagaacattctaacaaccttgcagagatttatgggctgacacaattaagtgaaacactaaaaattcgatgcctcaatacaatacaaaaagagcttgaatcaagaaagaccgaaccaacacattctggaccgctctgcggtggagaaggagggacgccatacaaagttagaaagactgtaaacgttagccttgccagtatactgccgagaactaggactattgaatcccaaagagatatagataatttattggctgaaataaaggaaaaactagaaagcaaattagacgaagagactataatcaaattggtttaa

SEQ ID NO: 11 - DNA, 3684 bp, Halopiger xanaduensis
atgactgacgagagctggttcgccgccgatgttgggagcgatttcgaggaatctgttcgcatcgaccgcgaggatgacggtcgcgatcaccgtctggaatcgatcgacacctaccacgtgacggaggagtctgaggacttcatgtccgacttcttctcgcgcctgctcggccgttccgaggatatgcggtcgggcgcgaactactggctctacgggtactacgggagcgggaagagccacctcctcagcgtgctccgcggcctgctagatagcgaatggcttcgagagcgcgaggatgtctgggagcagctaaccgacggtcgtgagctggacacgctcgaaaccacgtggtcatcgatccacgatgagtacgaggtcatcccgatctcggtgaacctcctgaagcatcagggtcagaagaaattgagcttcagcgagatcgttctccgcagtgctcacacgtcggaacggctcaccggtgccgagggagggctctcgtcgcaactcgacgtcgccttcttcgaggactggtatcggacgaccgacgcgtgggaggatcggactgccaacacccaaacggcactacggagtacggttgatagtcccgagaagtacgactgggaagacgttcagcagtacaacgctctcgcggacaccgttcttcccacactcttcgagcaggagaccggcacggcggatggtttagacgatctgataccgtccgatctcgacccccaagcgatggtcgagcgcctcgaacagttgcggagcgatcgcgaagaggaactcggccgcccagtcaagctcgtactactgctggacgaggtcagtctcttcatcgggacggacttcgaccgcctcaccgagttacagacccttgcggagagcgtcgacgagaccggtgacggtgacatccaacttgtggcgacggcacaggccaaaatcgaggacgtccagccgcagttcgcggctcgcggggccgacttcagtatcgtcaaggatcggttcccgcaccgatttggccttccgagccgacacgtcggcgaaatatcgacccagcggttgctcaaaaagacggtggacgggaaggaggatacggaacgcgtcctcaatcgaaccagcaacgagcccgagacgttactcgtgtactcgggcatcgaacagaacaccgaaccaccgctcgacgacatcgaccgcgagcgcctcatcgagttctatccgttccttccgtatcagccaccgctgttcctcgagatcctctcgaacctccggcaggaagcacacgatcccgcgaagtcgatcttctcgggaaccgcacgggcgattctggccctcgttcacggactcctccaagagtggatagaggccggcgaggagaccaacgttatttcgctggtcgacttctacgacctcatcgaaccggaactcgatgacatcacgccacaggacgtgggggtcatcgaggagatcgaggaacagcacaaggcaggcgaactggaggaaatcgacgtggatgtcgcgaaggccgtgttgctcctccagcacattccggatacgattccgatgtctgagcggaatctcgcagtcgccgtgttgagtgacctcgacggcccgactcagttccagatggagaaccgcgtcgaggactcgctccaacggcttcgaaagttcatccggccgacgcacgatgaaaccgggccgaagtacgcgttcactcatccagaggagcgcgaaatcatcgaagcctctgaggaaaacctcgacaacccgaactggcagtccatcatcgaagccgtggacgggtatctctgggaagacatcgtgcgcgacctctcactcccgacatcggctgagtacccagataccggcgagcagtatccggttcgctacgaattcagtatcgacggaatcgaactcgatacgaccgtcgacgctgaggacgccctcgatgtcgaagtcgccgtcgaagggctttctcccgccgcagaagacatcagctacgacggcgacccgctcgaatggacgatcggacaggacggactcgacgatctccgagatagcctcatcgagtggtggtcgctcagagatgctgtcggagaccacacgctcccacagtccgtcgagcgtgacctctccgatcgcgcagcacgcgtccagagcaaactcgtcgaggcgctcaagagcggggcgttcgacgtcaaggatcgcggcgatcagatcgggggcatggtctcgggagtcgaggaatatctcgacgtcaactatcccgacgacttccaccccgtaatgctgcaggtcggcgacgagcacttacaggaactccggggactctcagcacaagacccactacctacgtgggcccagcagatcgatgtcgcgacggaagacccagaaacgcacggtgggtcgatccagaacaacgttcgcgccttcaccggccgacagttgaagcaacgcggcgggaacctcgcgatggcaacaatcatcgacggcatcgtgaagaagaagccgatctacgaggacgctcgccccgcgctgtgtgcgattatctggggcctctgccggaagggagatttcctgcccgtcgacgaaacgggcgactccctcgaactcgacgccgtcatcgatctgaacaaactgacgacgacgcgtctcaagatcgcggggagtggcggcgtccgaagtatccttcgggagggcggattcatcgactcgacagagaccatcccggacggaatcgtcaggctccagtccgcgaacgacacgctcgcgggtcgactcggtagtctcgtcgaagacgtcaggctggtcgccgagagtgacatccaaacgcgcgccgttcgcaacctcctcgagtcgttcgttgaggagctcgaagccaagcagcagagcgcgatcaaccgacgagaggccgtcaaatcacgcgacaccgactgggaggacgtcgtcgaagcaaccaacaacgctcaggattggtacgacgacgccgaggaagtgtggagtttgcgcctccccgcgctcacacgaatcgactcgcagttgactctcgcccagcagtcgtacgactggctgaccgaggagtgcgaagcagccagccagacgcttcgcgagagcatcgacggctacgagggagaatggtggacacacgatggctgggatcggttcaacgacgcccaaaccacctcgccggcgctcgacgaggcgatcgagaccgcgtgggactcgttccgggcggaaactgagatcgatgcgttcgtcgacgggttacaggagcatccgtggattcggcccgcgagcgagttcgggtcgaacgttcggccggccttcgagagcgaatacatcacacccctccgtcgcgccgcatcgtggtacgaggacgtctcggacgcggtatcgacggtgaccggcggaacgaccaacaccgaggctgacgacttcatccgagcgacgaacacactcctcgacagcgaacccctcgctgtggttgccggtagcgacatcgaggagttacgagatacgttcgaggagctacagacactcgttggggatcagtctcccacagacatcacggcgatcggggttctcccgtcggatcgcgaatcgctggactccgaactggaacggctcgtcgaacgccacgacctcaatatcgagcggactgagacgggggtgatcatccgatga

SEQ ID NO: 12 - DNA, 3843 bp, Halopiger xanaduensis
atgagcgacacacacattcacgacatcttccagcagtcaccgacccgcgaactcgaggaagtccagaaggtcaacgccagagcgcaagccgaaaacgacgttcgcgagttctacgagaccgacagcgctcgcgacgtgctcaccacgctcgggaacctcgtcgacaagtatccacacgaggaaccgcgcttcctctacatctccgcgacgttcgggtcagggaagacgcaccttctgaagctcatcgggttcgctgccgacaccgaatcggagttcgccgacctcggcgaagagttggcgaacagatggccgggcttccagtcgttccgacagagcgtcgccaactctcacgtcgaccgcctgaaacccgtcttcttgaacctcctcaaccgagacgcgtcacaggaaccgccacttccctacctcatttacgaggcgatcggccgcgaactcgggtatcccaccgacccgaattggctgctcgagtgggcgtggcagctcgacatgaaccacggtgactgctgggagcaactacaggaagtcgagcacgacggacagacgttcgaggacgtgtacgacgagcgggcgtcgctacggagctggctctacgacgccgttccgacactcgatgactcaccgtacgcgtctcgggaggaagtcaaacaatcgatcgacgacgccatcgaggaagtcgatcccgatgagttcgaccccgacgaactcgtcgaccgcatcgaagcggctcaagagtcgctgagcacgccggagaccgagacagagttgctgatcgggcttgacgaggtggcgctgttcatcggcgatggccgccatcgctacagggagttccaagagacgatggaagcgctgacggagctgggtgtcggccccaatccaccagttatcgggactggacagtatccgatcgagcgtatccacagtgagttcgacaataccgaagtcacggagcagccgtggtacggtgcccaagaaccgctcgagggtgccgacaccgagatcatcgtccgaaagcggtggctacagaaggataccgagggtggacaggcagtcgagtccgcgctccgggagatgcccgacctgacgctcgacgcatactccgatattgccggcgccgacccggacgcggtcgagtcgtacccgttccgcgagtacgatctcgggttgcttcggacggtgattcagcaactgatgccacgaggacgcgtgaccgaagaggagtacgtgcagggccgggcgctgctcatcctcgtccgctcgctgttcacgcggttcgagtggggagacaagcaggtcggagcgctcgtcacgtgggatgagttgtatgacctgctggtggaggaaacgacctacatcccgctatgggtgcaggagatggtcgagaacaaactcgtcccctcggctggcggcgacgaagatgcgttctccgtccgcgttgcgaaggcgctgtatctgctgaatcaggttcgttccgaggtaccgtcgacgccagcgaacctcgcccggctgatggtcaagtcgactgacgagtcgttcgaatccgtccgggatgatgtcgaatcggcgctgaccgacctcctcgaggatcggaagatactgacggagacgaacgaccgcggcgacgaggagtacctattggtctccgaagaacaggaagacattctgacgcgggcaaagactcgcgcacagcagattccgtcacatcgactttcggccaagttggagaactctcttcgggagggaagcaaccttctgctctctgagggcagtcgacacgaggtggatctcgagggggagcgcaaagtcccgctccgtttcggctactctgttctcgaccctatcgagcaagcaccgacgccggagtttgacgccgttcgtgtgcggctggtcgcgggccgcgacgaggagattagcgatcaggttgatgcatggcagtcgacgaacgaagggcgcgacgggggcgagcacgtcctcgtcgccgtcgagctacagggatcgacgatcgaccgcctgcgggacgcgatgggtatgcaggaggtactctcggaggagacggaaacgtatccagacttggagtccgaccaccgcgacgaacagcgggcgctcgaatcgacgattcgggagcaactcgaagaagcggacatctacgtccgaacaggtgggacgaaagggcgatacggagacgtattcgagcaggtcgtggaaacgcaagtacggtctgtgttcagcgggacgcgcttcgttctgaccaacggaatcacggaagtcgaggacgccaagcagatggcgcggttcttccgcggcgtcgacgactggccgctctcgagcgaggacgccgtcacgctcggtgtggataccgatcgcgcagaactcgccgacggctggtgtcaggaattcctcgacgagtacgaggacacccagtcgcttcgtgccgaggacttgcttacccagactgtccagcgcggaggcacgtatcgtgggacaccgcaggaatcgatctcagcactgctgatcacgcttgcaacggccaacaaaatcgcgctacggcgagacgacgagtacattaccgaaccggacgagatcggccgagcggtcagaaacaagacgaacctgaccgacgtacagattcgcttcgagtcactagacggaatcgatcccgaccagattcggggaaccgtcgagacgctgatcggcgaggagccggacggaaccgatcccgacgcgtggctctcggagatggctaactgggtagacgagaacagcgtgctggtgaagcgtgtcttgcgaggcgtcagcagagagttcagcgaaggcgcttcactggacgaactcgaaacggctctccagcccgcactcgggggcgaatctctcgaaacagacgactttgcgtccgacgagatcgcacggcagtccgagcgcttcgctcgggcaagaggactattccagtcgatagaggatggcgactcactctgggagcagttcagccagcgaacgacggagatgcagcggctctaccccggtgcggaaatcacgggggagatgcaagcgatcgtcggcggagacgaagtgccagatgccgaccggcttcgagcaacgatcgacgaagccgacgatcacagacgaaccgtcgtccgcgagcagtacgaacgaatcgcgggagagtcgccgccgaacgaagagcccgagagcgtggtttccagtcttgcgacatggctctacgctcacgatgggagcagcaaggaaactgccgaccgcgtcgccgtcgaattcgacggtgtaaccatcgacgacctctacgagctcttcgagacggcgtggaatggtgactcgttctcggagaaagatctcgtcgacccgacggtcgttcagcaagccaagcggtacgaacgggcacggcagctcctcgaagcttccggtagcgaggcctcgctctggtcgcaacttcgcgacgcgtcgagacgactcgaggaagaacgtccgaaccatccggtcacgaccgacgtgagcgagatgctcagtcggtctcagccgccgagcgtcgacgatgtagagcaacttctcgacgaggcagagaaccccttcgaggtcgacgagcgactcgaagaactcgccagcgaactgcagtctgagtatcccgaccacgatctcacccaagaggtcgtcgatgcagtagagggaaccagcccaccgagtgaggaacgcgtaggtgaattgatcgaagaggccgagcagttgctcgacggtgttgacgagcaactgcggcggattcgggagactatggatgaacttgaggacggttccgtagtgctggttgagccactcgactga

SEQ ID NO: 13 - DNA, 3720 bp, Halorubrum lacusprofundi
atggtcgacacgagctggttcgacgaccttccggaggatttcgaggagtccgtccgtatcgaccgcgacgagcaagatcaccgccaacgggcgattcggtcctatcatatgaccgccgactcccgccgatttatcgaggacttcgtcgaccgcatgctgggccagtcagacgacatgcgaacgggatcaaactactggctctatggctactacggaagtgggaagagccacctgctgaccgtcctcgatgggctgctggacaccgactggctcgatggacaacaggacgccgtctggtcagatctggtccagatctccggggacagcgagttcgagcaactcggcgaccactggcgaacgattcacgacgagtactacgtcatcccgatctcggtcaaccttctgaagtaccagggccaaaagcagcgtagcttcagcgaaattgttctcagacacgcccatcaggacgcagatttgaccggcgtcgacgatggcatctccgaagggctgtcatctcagcttgatgttgcctacttcgagaagtggtttcggacgacggatgcatggtctgatcggcaggctcgtgctgaagctgctctcgatggcgtgacaactgaagccagcgactacgagtggcaatcagacggcctctggaaagacatccagaaatatggtgcgttggcagatgtcgtgcttcccaagctcttcgaggaggtcaacgagactcgcgatgggtatacagatctgcagccgtccgacatcgacccagaggaagtagtgggtaggctggaggagttacgaactgagcgggaggaagagctggggaaaccagtcaagctcgtgttgctccttgatgaggtgagtctcttcatcggaactgacttcgagcgactgaccgagcttcagacactcgccgagaacgtcgacgacatcggcgatggcgacattcagttggtcgcgactgcacaggcgaagatcgaagacgttcaaccgaaattcgccgcacacggcgcggacttcagcatcgtcaaggatcgcttcccgcaccgttaccagcttccgagtaagcacgtcggagatatcgccaagcggcgactcttcgagaaatctgaaaagggggatgtagccgttcgagaggtacttgacgaagcatcggtgaagccgaccgaatcgctggtctacaacgagatcaagcagaacacgaaaccaccgctcgacagtatcgacgacgaggagctcgtcgagttctatccgttcctcccgtaccacgctccgctgttcctcgagatactgttcaatcttcgtcaggaggcaagtgacccggcgaagtcaattttctcgggcacagcacgggcgattctcgcgctcatgcacaacctcctccagacgtgggtagatgagggggaggccgaccaggtcatcacactcgtggagttctacgagttggtcaagccggagctccgagagatactcacgcaggatatgcgagtcatcgaaggctcggaggcgaaccgaggaatcgcagacgaagtcgaggacggtgatcttgaggagttcgatctcgacgttgcaaaagccgtgctgctgctccagcacgtccacgacatcgtcccgctcaacgaggggaatattgcggtttcagtgatgtcggatctcaacggacgctcttggatcagtacgcagaatcgagtcgaggaatcgctcggtcgtctccagaagttcatccgaccgatggcggacgagacgggggcgcggtaccgatttgcgacgcaggaagaacgaattatctacgacgatacggaggcgaacgaagatgaccctgattgggatgccgttctgcacgcgctggacgagcatctctggggacggattacgcaggacctctcactcccggagtcggttccgtacggtgactctggtgacgagtatcccgttatgtatgggttcggcctcgacggcactggtttcgagaccacggtcgacgttgagggcggactcgacgtaccaatcgaagtgcaaggtgttcgtcccgaccatacttcagagaacagcgatgaggagacgctctactggtcgattgacacggacgggctggatgacctccgaaagcatctcgtcaagtggtgggcactccgtgacgcgatctcgacacacaacgcaccgactgctgtcgaacaagatctcgaccgacgagccgacgctgtccggagtaagctcgtcagtgcgatgcagagtggttcgtacacagtgaaagatcgaacagacatcagtgggctctctacggccgtccagactgccgtcgacgtggggtatcccgacgacttccacccgatgatgttgcaggtgaccgacgatcgcctgcaggagttggtggagctctcgacagaggatccactccctgcgtgggcgcacacgattcaggtgccatcgtctgacccgtctgcaagccaggggaagaagtcgattcagcgcaacgtgatgtctctcacgggtcggcagctgaaggaccgtgatgatggcctcaacatgaacacagttctcgacgggattacctcgaagaagccgttctatgacgaagcccgtccagcactctgtgcgatcatctggggattctgtcgggagggccggttagtcccagtcgacgaagacggaaacacactggaaaactcggctgtcctcgaccaggaccacctctcgacgacgagattgaaactgcttccccgcgagccgatcgggaagctcctcgaatcggggggtttcaagcagacgactgaaaccgtcacagacgggctcatcaacctccaggaagcgaaccagcagctacggtcctcgcttactggacttcaggaagacgtccagttggttctggatacggacgttcactcgggggcagtctccgggctcctcgaagcatttatcgaggaactgaccgaccgaacctcgacgaccaccgagcgactatccgttgtgagatcgcagggtaacggtctcgcggatgcaatcgaacagacgaacgacgtgcaagagtggttcgatgaagtgagtgacgtctggaatcgtcgactcgcgtcactctaccggttcgacgcgcaactcacggcgggtaacgatcgattcgagtgggtcgacgacgatgcacaatcggcagtcaccgcccaacgcgatgccctcaaaaacttcgatggggggtggtggacgacagatggctggaaggcgttagtcgaagacacgaccacgggactgggtacagagcttcagcgctcctgggaggcgcacctcgaccagcaggagatctccgagttcgtcgagcggatcgccgaccacccgtgggtgataccggcgacggacctcccgacaggtgtacaggtggcgatggagcatgagtatatcactccgctgcgcgagttacggcggtggtacgaaacggtcgatggagcgattgcgtcgctctcttcggatgacgaagacgcgcttctgtcggctgctgatgacttcgctgacgtcgagccactctccgaggccgtcgactacgacgtagaagaactggaggggagactcgaccgactcgccgaaatcgttggtgatcgtgggccggacgagatcgatcagatcggcgtgcttcctgacgaccggcagaacatcgaccgacggctggaacgcctcgtcgagagtagagagttagacatcgaaacgacggactcgggggtgattatccgatga

SEQ ID NO: 14 - DNA, 3543 bp, Acidiphilium multivorum
atggccaatgaaccgatcaaaagcctttttgcgaacgacattcatcgtcgtatcgaagaagtcatcaaggtcgatcagaccagcgatgatattctgcgcgacgagatcaatgagtacgtagtcactgacgcgatcaggtcccactacacgagtatttttgacgcctatagcgagacgccgaacaaaccgcacgaaggcattgccatttgggtttcgggcttttttggttctggtaaatccagctttgcgaagatgctcgggttgtcgatcgagaaccgcccagtggccggaattccggcgggcgatcggttcgggcagaggacgggagacaacaaacttcaggttcttctgaaggcaataaacgaaaagatacccacgcatgccgtgattttcgatgtctcaacggatagaggaatcagaagcggcaatcagtctctgactgagatcatgtacggtctttttctccagagccttggttatgcgaaggacctcgatctttcggaattggagatcgccctggaggaaaaggggcaactcgaaggtttcgaggccgagtacgagcgtttattcaagaaggaatggtccgtcgagaaaggcaaagtcgcattcgccctcagcgaggccagccgggttctgcatagctttgatccagaaacttatcccatggcagattcatgggtgaaggccgtaaagaacaaggctgatatctcgcccgggaagctggcggaacgcgcaaatgaattgatgaagcgtcggcggcctggtcaggcgcttatgttcgtcgtggacgaagtcggccagtttgtcgctcgagatgtccagaagatgctggacctccaggctgtcgttcagagtctcggcgtcaaggggcgcggcaagcactggattgtcgtcacctcgcaggaaaagcttggcgagctcgtcagcgggctcgatgacaaaaagatcgagcttgcccggctcatggaccgttttccgctccaggtccatttggagccgtccgacatttcagaggttacaagccgacgtgtcctctccaaaaacgcacccgcgcaaaaagccctgggcgagcttttcgatcagcaccgtgggcggttcactgagcacacgcgtctgaccgcagacattaagctgcccgaacttacccgcgacagcttcatcgatctctatccgctgctgccttatcagatcgatcttattatccaggtggtgtcagggctgcgcacgcaaggcggtgctagcaagcacgtcggcggggcgaaccggacgatcatcaagctggcgcagcagctcctaatcaatccggccgtcaatctcgcggaccagccgattggctccgtcgcaaggctcgaccaggtttacgacctcgtcgagggcaatatcggttccgaggttcgcgcgaagatttccgctatctccaaggagctagaccatccgctcgcgcagccagtcgcgaaggtgatctgcctcctgcaatacgtgaagagtgtccaccgtacagccgaaaatatatcggccgccctccatcccggagttggtggagactcccagctcgccgcggtgaaagatgcactccgccagctcgaagcggcgaacaaagttcgcctcggcgatgacggataccgtatcccgacacccgcggaggacgactgggagcgcattcgtaacggtataaatccgaagcccggtgacgcgcatcgcatctattccgaggtgttggccggattctggcagccgcaaccaacccacaccctattcgacacgaagaccttcaaggccggcctcgcgatccacggacgtgagattgtcgatggcgacatgatgtttcatgtccatctcgctgaggatggggcagcgtttcaggcactcgccgcggagcttcgtgcccgtagtcaacaggagcgtaagagcgtcttctgggcggtcgccctcaatgacgcgatcgatcgtgagacggttgagctatttcgttccaaggagatgttggcgcggaaggagcgcgaagcgaagaccgcagacgaaactgcgctcattggcgaagagaagattcggcaaaggcgacaccaggatgagctgcgtcggctcgtaagagctgcctgcctcgctggcagcgtcagcttccgcggtaacgatcgcagcccgggcgatcgggcagtcgacatgggcaagagcgccgccgaaattctgagcgacgtgctgccagaggtgttcgatcgattcagggaagctgccgcgaagcctgccgatgtcaagaagggcctcgatgccctgttcaccgcagagaaccttcagggcctcccgtccgtgttcggaagccttggccttttacgcgacgaaaagggcaagacggtcttccgggttgaaagcggcgcactggccgaggtgctttcacgtatcgaggaacgcgccaactacggcgataccgcgagtggtcgctatctcgccgatgagctggcgaaggagccgttcggctgggacttcgaagtcgtccgcttgctggtgctctcgctgctgagagcaggaaaaatccaagccaccagcaaaggtcagacgatcgactccgcgacggggatcgaagcccgcgatactttttcaaacaacaacttcttccgccaagcgtcgttcaggccgaagaagggcatcgaattcgaggagctggtgaaggcgtccgaggccttccgtgacacgttcggtagcgaggtcaaagagctcaacgccggcgcgatcgtctcggaactccgcaaggagatcgcccgccatgaagacccggtctcgtccgcgcatgcccagctgatcgcctaccggcttccgggggctgcagtcctcgacggcgccattggacaaatgaaggctgtcctgcgcggatccgaggacaatgcgatcgcgactttcaatgcgtcgcatcgcgccattaaggacgccatcaagcgcgctaccgagcttgagcaggccctttcagaaccaaagctgcgcgatctcgatcgggcacgagaagcccttcgatcggcctggccgttcctcagcggcgaagcggatgtagctgacgacctgcgtgccgatgccaccgagcttgaggatctcctggcgcgggagactttctaccgcgagctgccgcttatcgagcagcacgcgtcggctatcgatgccgagtacgcacgtcgtttcgacgaagcgttggacgctcgcattgacgcctacacgcatgcgcttgaacggctggcgcagactcccggctgggatggcatcgatcaggaccagcaggagaagcttgcggctccgttgctgcgagggaaaacgcgggatcaggtgcgcgtaccaattcctcagctccgctcggaactggacgcctgtgaggctcggcttcaggacgcgatcgcagaactccaccgcattgtcgacggcgatcgcgtcgcgaccgtgcggttgggtggatacttctccggtggggtcgaaaccgaagaacagctcgatgccgctctcgccggcattcgggaggagtgttcgcgcctgatcggcaccggcaagaaggtgatcgtccagtga

SEQ ID NO: 15 - DNA, 3540 bp, Acidithiobacillus ferrivorans
atgaaactcaacggaattttcaaaagtccggtcagtcgccccattgaaggcgtcataaaagccgacgatgaatccagtctctataacgaactgagcgaatacgtcctcaccgatgaggtggccaagcgtttggagcactttctggacgcctacaccgactaccacggggccaacggcgtctgggtatccggtttcttcggctctggtaagtcccacctgctgaaaatgctcgcgctgatgctggaaaatcgtcagattgatggcagtagcgctctcgacattttcctgcccaagatccgggaagatgacgagctgctgcgtgccgaattgaaaaaagccgtggcaataccctccaagagtattctctttaatatcgatcagaaggccgacatcatcagcaagacgcaggccgacgccttgctctcggttttcgtcaaggtcttcaatgaaatgtgcggctattatggcaaacagggctacatcgctcagttcgagcgggatctcgacagccgcaaactgttccagccctttaaagaagcctatcagcacatcgcaaaaaagccctgggagcgtggacgggaacaagccgtgctggaatcgggcaatatcgccagggcctatgccgaaatcaccggagaagactccacgctggccaggaatattcttgaccggtatcacgctcagtacagcgtttccattgaagacttcagcaagcaggtcaaggactggctggatctgcaacctgcccatttccgcctgaatttctttgtggacgaagccggacagtacatcgccgataataccaagctcatgactaacctgcagacggtggccgaaagcctcgccaccaaatgtcagggacgggcctggatcatcgtcaccgcccaggaagacatgagctcggtgatcggcgacatgagcaaacagcagggcaatgacttcaccaagattcaggcgcgctttgccaaccgcctcaaactcaccagcgctgacgtcgccgaggtgatccagaaacgcctgctcaccaagaatgacggcggtgccgaactactgaaaacggtctacgaccagcaagtcaacaacttcaagacgctctttgactttgccgacggcggccagcactaccagaacttccgcgacctggagcatttcacctactgctatcccttcgttccctaccagtttcctctgtttcagtcggccattcgtggcctttctctgcataacggttttgagggcaaggccaattccgtgggtgagcgttccatgctgggcgtattccgcgaagtggccatggccatcgacaacgagccggttggccagcttgccaccttcgatcgcatgtttgagggcatccggggtgccctcaagagcgccatccagagtgccatcaacaacgccgaacgccacctcggcgatccctatgccgtgcgcgtgctcaaggccctcttcctcgtcaaatatgtcaaggaattcaaggctacgccccgcaacctcagcatcctgatgctggagcactttggcgatgacgccgccacccaacgccaaaaactggagaccgcactccatctgctggagcaacagacctacattcagcgcaatggcgacctctacgagtatctgaccgacgaagaaaaggacatcgaagaagaaatcaaaaacaccgatgtcgagtctagcgccgtcatggaggagctggagaaactgattttcgacggcgttatcaagcagcgcaagattcgctatgacaatggtcaggattatccctacacccgcaaaatggatgaccgcgccttcagccgtgaatccgaactcgccattcatctcattacgccactcagcgacaacttcgacaatctcatgttacagcgcatgcagagcatgggccgcgacgaactgcgggtcgtactccccgccgatgcgcgcttcatgcaagacctcaccatgtacaagcgcaccgagaaatacatccgccaaaatagcaacacccagcaggaagcggtcaagcggattctcgacgccaaaggctttcagaacaccgagcgcatgggcgaactgcaagaacgcgccaaacagttgctggggcaggcccaattgatcatcaacggcggggacgtcgatttggacaagggcgatggccagacccgcattattaagggtttcttccagctcatcgagcacacttaccccaacctgcgcatgttgcgcgatatcagctatagcgaaaacgacgtcggcaaatacctgcgcaaggctcaggacagcctgctgggcaacgaagccaccagcctgaccgagccggagcaggagctgctggcctttatccagaacaacagccgcagtggcgtgcgcaccaccgtcaaaagtctgctggaacgcttcgagcgcaaaagctacggttggtattacgccgccattctctgcaatctcgcactcctctatgcacgcggcaaagtggaagtgcgtcaggacagtaatacactggaaggcgacgctctggagcgcagcctgcgcaacaccagcgctcacgccaccttggtactggagccgcagatcgagttcagcgcctcccaggtgcggaccctcaaggacttcttcgccgacttttttgaccgcccgccgggcagcaacgaagcccgcgcattggcccaggaaaccatcagtgccctcaaagagttggaaatggagcttactgacctgcaccggcagaagacccagtatcccttcctgagtgtcctcgatggcgtgcttgccacgctcaaggaactttccggcaagcagatcccttggttcctgactgacctctcccgcgccgacgacacactgctcgacaccaaagaacagaccatcgacgccctccgtcgcttcatgagcagtccccagaaggcgatctacgaccaggcccgccagttgctggaagaggaagaagacaacttcgcctatgtcaccgccgccgaagtggatgcgctcatggcacttcttgccgacagcaaaccgtggcagggcaaccgtctgcaacaaaccaggccgcaactggaggccctgcagcaagccatagccacccagttggcccaggaaaaaaataccgccagccataatctggatgaactgcagcaacgactgcagaattacgcgggatacagccaccttgacgacgcacaaaaagccccgttttccaaggcctttatagaggcccgtcagagcctgcaggggcagaaacgcatcgctatgatccgcgaccatctgcgccgcttcgaagacgatcagtacccgcaattgttgctgaagctggagcagttggcacaaccggcaaatccgatacccgcctatgcgccaacccagccagctaccggtaacgcgccagaacccgtgacaccaccttcctgggtcgccgagccgcgcatcgttccggcccgcagtatccgcgtcagctaccccaggccctggctggccaacgaggcagaactggacgattatctgcaaaagcagcgcgaagcctggctgaaggaaattcaggccggtaaccgcgtgcaaatctga

SEQ ID NO: 16 - DNA, 3690 bp, Acinetobacter baumannii
ttgattgagatgaatattaaagagcttttttacaagccattagatcgtgcaattaacggggtcgtaaaagcagaccagaatgacaataccacggtttatcaggaactcgatgagtatgtggtcaccaatgaactggaaaagcattttcgggactttttccagtcttatggcacagacctgagcgatccttcgattgctaaccgtgtcggcgtatggatttcaggcttctttggttcaggtaaatcacatttcctgaaaaccttgtcgtatattctggccaataaagtggcacgcgatgcgcaaggtaacgaacgcagtgctgcagaattctttgatgaaagcaaaattcgtgatgcgtttatccgtgcggatattggcaaggccgtcagccatcatgccgatgtcatcctgtttaacatcgacagtaaagccagctccaatgatgatggcaatccgatcctgaatgtgtttttacgcgtgtttaacgagtatcagggttttagtgctgaccatccacatattgcccatatggaacgtcacctgagccagaaaggtgtctacgaacgctttaaacaggcgtttgaggaatccagcggtatgtcctggctagaggagcgtgacggctatcagttctatcaggatgatgtcgaaaccgcgatttcccaagccctcaacttatctgctgaagctgcgcataaatggtttgaggattctgagcagacctttagtgtttcggtcgaaaacttctgtcagtgggtgaaagaatacttagatagcaaaggaccacagcaacggatattgttcctggtggatgaagtggggcagtttattggcagcgatacccgcttgatgctgactttacagaccattactgaaaaccttggtacgatctgtaaaggccgtgcttggattgtcgtcacctcacaggcggacatcgacgcggttctaggtgagatgtcttcttccaaagccaatgatttctccaagattgctgggcgttttaaaacccgtttatcactgtccagttccaataccgatgaagtcatccagaaacgtttattacgtaaaaccccggaagcagaagcattgctcagatcggtgtttgagcaaaagggcgatattttaaaaaaccagattacctttgaccgttcaggcccaacactcaacaactatgagggtccagacagctttatccataactatccttttgcgccgtaccatttccagttggtgcaaaaagtatttgaagaaatccgtaaagtcggtgcgaccggtgcacacttggcctatggtgaacggtccatgctggatgcgttccagatggccgcgaatgcgattgctacagatgaagtcggtgcactggttcctttccaccgcttctatacctcagtggaaggatttctggatactgcagtgaagcgcaccatcgaccaggcagggcagaatcaaaccctagatagttttgacgtacagatgctgcgcacgctgtttatgatccgctatgtcgatatcatcaaagggaccttggataacctggtgactttgtcgattgagaaaattgacgaagacaagctggcattacgcaagcgtattgaagaaagcctgctgcgtctggaaaaagagagcctgattacccgcaatggtgatgagttcctgttcctcaccaatgaagagcgcgatatcacccgcaaaattaaagccactgatctggctgcttcagaagaaaataaagagttagccaatctgatctttaaagatttactgcgcgatcagaacaaataccgccatcaagccaacaagatggactatcagattggtcgtttcctagatagccatagcctggatgggaagtatgagagcgatttgaaagttgaaattatttctccgcttgatacggaatacaacctctacactgaagcttactgtattggtaaaagtactcaggacgaaggacaagtgctgtttaaactggcagacgataaacagttctttaatgaactgcgcacctggctgaaaaccaataaattcatccgcttaaatgatgatggcacccaatcggatatcagccgtatcctggcagaccgtggccgtgagaatcaggagcgtaaaaaacgcctgcgtgcccgggttgaagaaatgctgctagatgcggaaagttatgccttgggtcaacatctacaactttcatcttctagcccttccaccaagctggatgaggcgtgtcgttatctgcttgaaaatacctataccaaactgagctatttgcaagtctatcagcaggatgcctggcgtgaactgaacgccgtcttgactgtcgatgatatggcgcagctcggattgtctctggatggtggtcaaacgaatccgaaagccctacaagaagtggaacagtacatctcgctgcgggcaacaggtacagaacgtattctggtatcggatgtggtggatcgttttgctaaacgcccttatggctggccagatgccgagattttattgctggtaggtcagctggcggcaatggggcggatttcactgcagttaaatggtggcagcttgcagttaaaagatgcctttgagcctttacaaaacagccgccgtcgacgcgatgtgtcgatcattaaaaagcgccagactgatgatcaggtgttgaaacaggcacgccaactgacccaagatctattctcggctatgggaccagcgacagagaaagagctatttgaattctatacccaacattttaaaaactggttagccaactttaagtcgtacaaaagcaaaacagatgtcggacagttcccaggcaagaaagtgattgaaaagttgattctgactttggaacgtctgctggcgaatagcgacagcttcgatttctttaaggccgtggttgatcacaaggacgactatttggatctggaagaagattatcgtgacattcatgaattctttagtaatcagatgccaagctggcaacaactgcaacaggccttacgtcattttgagaaaaacaaacaggcgctgggcagtgatgagttcgctaaaaaagccctctccgaattacatcatatttcaacccttgaatcgccctacggcctgttaaataaaatcgctgatttagttcgcacagttgaaagcgtcaatgagcgactgttgagtgagaagcgtagccatgcggtagagcaaattgatgacaagatcaaacagttagaagccgagattaaaaacagtggcatcgctaccgctgagctgagtaacaagctattacgcccactacaactgctgaaaacggatattgaagtggaaactagcctgtccaccatctatatgctgcaaacccaaaccgccgtggagcgttttgatgaagccttatatgagctggagagcgaagttcaggcggaaatccagcgtcaggccaaagcggcacaactggctcagagcaaagccgagagtgtaaccaacactgcaaccacctccagcccagttacatcaacacctgctgcgagtccggtacagcctgtgacagccgtagtgccaccgaaaccggtagtcgaagttgatgttgctagcatttacagcaaaagctccagcagtgtctatctggaaacagaagagtcagtggatcagtttgtagacgcactcaaagctgaactgaaaaaaatcgtgagtgataaaaagcgtgtgcgtatccgctaa

SEQ ID NO: 17 - DNA, 3474 bp, Alteromonas macleodii
atgttaaataaagatatctttgttaacaatccagtagaaagcagattggccaacaatggtgttgctcaagttaaggatgacacatctcaaggagcacttgaaacactcgaatatgagttaagaacattcgtttgtgatggtgcttacgctaaaggtatggatagaatcttatccaactacttatcagcgcttaaaacaaaaagtgaacaaccaggtgtttggatcagtggcttttttggctcaggtaaatctcaccttgcgaaaatgcttcggacattatggacaaaccaaacgcttaatgacggctctcatgctcgttccgtcgcggatttacctcaagatattgcagctctatttgacgaacttactactcaatcggtatctaatggtggtctgcatgctgcatctggaacacttggtgctggcgctggagacaaagtacgacttgcgtttctaggtataatatttaaatctactggcttacccgagcaataccacctagcgcgttttgttatgtggttaaaatctgaaggtgtattcgagaaagtaaaggcatttgtcgaatctaaagccaaagcaaaagaaggcattgatacttggactaaagagctcaagaacttgcacgtttcaccgattatggcagacgcaattcttcaatctattcctggtattggggctgatattaaagaagtgcgagaaatgcttcgtgctcaatacaagattgttgatgatgtaacaaacgatgaaatggttaccgctatcgtggatgccatttcaaacgatggtgagctcccattaacattagtcgtactcgacgaagtgcagcagtacattggcgataatgttcaaaaagctttcgatgttcaggaagttgttgagacatgcagtggtgctggtgcacttaaatcaaagctacttttcgtagcaacaggtcaaagcgcattatcaggcatggccaatttgcagcgcttgatggggcgtttccaagttccagtgcaactagaagataccgatgtagattctgtaattcgtaaagttatcttacagaaaaaagaaacggctaaaccattagttaaaacagtcgtagacgacaaccttggtgaaatctctcgacatttacgtggcagtaccatcgaacataaccaagatgacgaaaagtggatggtgccagactatccattattaccagttcgtcgcaggttctgggaacgaattttacccgcattagacagaacgggaacgggctctcagctacgaaatcagcttcgcgttgtgcatgaagcactaaagactactgcggaaaaagaactaggttatgtggtacctgctgactacctgtacgatcaaatttcaacaaatctacttcaaacgggtgttatttcaaaagacatttatgaaactatcagccgtaaacgtggtggtaatgaagacgaacagcttcaaggtcgcttattggcgctaattcttctaattagtaaattgcctgctgaaatggagtatggcattcacgctacagtcgactcactctcagatttgcttctcgaagacttacaaaacgataaagataaacttcgtgcactagtaccgaaaatgttagcaatgttggaagacgagcatctgataatggctcgcgattcagaaaatggccgagaattcagcttacaaacagttgaaagccaggcctggtatgacgaatttagacgtcaagaaaacgatttgatggggaaccctcaaacccttgagtctttccgagcaaaagaaattcaaagctttatccgtaaacaagttgctcaagctagaattactcaaggtgaggtggcagaacccagacctattacggtttacttcgaaccagagctaccagcggaggcgaaaaacagaattagtgcatgggcacctgaggttacggagaagcagttcaacgatcagtcgcgcggtgatgacccagataatgcaaccatctatatctacgttccttctagccacagaagtgagttacaaaaagcaattgtagaatataaagcagcggaaaatactctagaagtacgaggcagagctactaccgaggctggtaaagacgctatgcaagccatggaaacgcgtttaaacgaagccgaaagagccagaaagaatctacttaacgacattttctctggtattcaagttcgcttagcgggaggccaagaagttgaaggcgacacgcttgctgaacaaattcaaaatggtggtgagctagcctgccaacgcttattccacaagtttaaaatggcagacaacagaggttgggcaaaagtttatgacgcagcaagccgtatagctgaccccaatgcacttgaaaaagtagaatacaatggtgaagcagacaagcacccagtatgtgctgaaattcaccgctacattggtgcaatgaagctagggaaggatatacgtgataacttcaaaggtgcgccatacggttggagtaatgatgttatagacggggcgctatatgcaatgctcgcagctggggtactaaaagcgtctgatacccaagaacgcgcaatagatgccaaaagcttagatcgaagctcagtaacacaaactaagttcagacctgaaaaggtcactttatcaaaagtacagcttattaaagtacgtggtgttatttctacgttattggaagatgcgtgtaactcaggtgaggaggtaacaaagcttcctctagccatcattaacgctaaacaaatagctaatctagcgggtggtagcgcgccactaccaatagcgcctagtacaaaattgctatctgaactagaaatgtatacgggtaacgaccagctacaaaaagcatttgagaataaggatcagttactcgctgattttgaaagttggaagcgactcgccgacaaagctcaacatagaagtaagctatggcaaaaactgctaagcgcaattgactactgtagaggcctagcggtatttaatgacctagaaagagagcaagaagctattctttccaatcgcagtttgttggacgatccatgtccagttgaaccattaatcaaaaaagcaaccaatgcgttgagagatggtattaccgctcacagagcaaattacgaagaagaataccaggtgtgtatgtctgagctgttagatgatgaaaactggcagctgctcgatgaagccaaacgtgatgcgtttctcgctaatcgaaaccttgcagatatccctagtatcaatgtaagtgaattagacgaggtactgaactcattagacgagataagctttaaccaatggaatgataaaacggccgcattacctggcattttcagccaagtattgaaagatgcaatttcagagcttcagcccaaaacgcaatactgtcgtttaaataagccaattataaaaacagaacaggacttacaagactggttgaaatatgtggagtctgaactacgtactcagatggaaaatggacctgtaatgccgtcttaa

SEQ ID NO: 18 - DNA, 3462 bp, Anaeromyxobacter dehalogenans
atgaagatcaaggacgtccttcagcgagacccttccacctacccgctggtcaaccagggccaggctcgaatcgccgacaggtcgaacgagaaggtcctcgacgagcttcgcggcgagctgtcgacgttcgtgtgcgagggccagtacgccgaaggcatcatcaagatcctcaagtccttccttgcgaacctgacctcgacgagccagaaggccgcatgggttagcggcttctttggcagcggcaagtcgcacctgctgaagatggcctgtcatctctggcaggacaccaagttccccgacggcgccaccgcgcgcagcctcgtgccgtcgatgcccgacgagctgcgagagctgctccgcgagctcgacactgccggcaagcgcgggggcgggctgctcgccgcggccggcgcgctcccgagcggcaccaccgatcacgtccgcttgaccatcctcgcggtgctcctgcgaggagtcggcctgcccgaccagtacccccaggcacagttctgcctctggcttcacgatcaaggttggttcgacaaggtgaagggtgccatcgaaggcgccggcaagcagtggcagtccgagctgaacaacctgtacgtcagcaagaacatcgcaaacgcgctcctcgcgtgcgaccccgggttcgcgtcgaccgaggccgaggcgcgcaacacgctcaaggcgcagttcccgccgcgcaacacggacatcacgaccgaagagttcctcaccgcagtgaaacgcgtgctgaagctcgtcgggcgcgacggccgcacgccattgatgcttctcgtgctcgacgaggtacagcagtacatcggtgattcgaacgaccgctcgacgctggtcaccgaggtcaccgaggccctgtcgaagcagctcgacagcaacgtactcgtcgtcgcctcgggccagagcgcgctcacctcggtgccgaggcttcacaaactgatggatcgatacacgatccgcgtgcagctctccgaccaggatgtcgaggctgtcgttcgcaaggtgctccttcagaagaaggctgcttcgatctcgacggtgaagggcgtcttggagaagcacggaggcgagatctcgcgccagctccagggcacgcgcatcggcgagagtgctcaggaccgcgaggtcatggtcgacgactacccgctcctgccggtgcgccgtcgattctgggagcactgctttcgggccgttgatgccgagggcacgcacagccagctgcggtcgcagctgcgcatcatccatgacgcggtcgcaaagatctccgatcgtgcccttggggccaccgtgccgggcgacgagctgttcgaggcgcttgcgccggagatggtcaacacgggcgtcctcctgcgcgaactcaacgagcgaatcatcaacctgtcgaaggacggcaccgaaagagggaagctcgcgcggcgcatctgcgggctcgtcttcctcatcacgaagctgcccgagaaggacaagcccggctacctcggcgtgcaggcctctaaggagcacatcgcggacctcctcgtcgaagacctcctggctgacaacgggaagctgcgcagtgcggttgaaaccgtgctggaagagctgacttcgagcggtgcgctgatgagagtcggcgacgagtaccgcctgcagacgaaggaaggcgccgagtgggacgccgaattccgccgccggcagggcaagctcgccaacgacgacgccgacatccagatccgccgtgatcagcagatctacgccgaagctgaccgcgtcatccgcacggtgaaggtcgtgcagggcgccgccaaggaggcgcgtcaggtcgtcgtctcgcgcgaccagacgccacctgccggcaacggcgagagcgtcccgctgtggattcgcgacggctggtcggcaagcgagaaggagcttctcgacgctgcgcgcgcggctggcaccgacagcccgacggtgttcatcttcctgccgcgccaggcagccgatgagctgcggaagctgatcgtcgatgccgaggccgcccagcaaacgatcgatgccaagggcacgcccacgacccgcgaaggcgaagaggcgaagcacagcatggagagccgtcgcaacgccgccatccgccaacgcgacgagctcatcaagcagatcgtcgccaatgcaaaggtgttccagggcggtggttccgagttgctgcaggcgaccctcgaagatcgcgtccgcgaggccatcaacgctgcgctcgtacggctcttcccgcggttcaaggaggccgaccacgcggcgtgggagacggtcatcaagcgcgcgaaggagggcgccgaccaaccgctccagccggtgggccacacggtcgcgacggaagaacacgccgtctgcaaggcggtgctctcgacgatcggctccggcaaggtcggcgtggaggttcgcaaggcgcttcgcgcgagcccgtacggctggccgcaggacgccatcgacgccgcgctcctggcgcttcatcgcacgcagcacgtttccgccacgttgaacggcatggcgcttgcgccggggcagctcgaccagaacaggatttcgaaggccgagttccgcgtcgagaagatcacgctctccgtgaccgaaaagctcgccatccggaaggtgttccaggcgctcggcgtgggctgtaaggctggcgaggagctggccaaagcgcccgccttcctcgagcagctcgccgctcttggccgatcgactggcggtgacgcgccgctgcccgcgcctccctcggtcatcgacatcgaggacatccgcgcccgtgtcggcaacgaccagctcgcgggcattcgcgacaacgcgcagctcttcgggaagcgcatcacggagtggacgaacaccaagaaggtcgtagatgcgcggttgcccacatgggcgctcgtcgagcggctcgcactgcacgcacacgggctcgctgccgcggaggacctgctcaagcaggtcgaggctgtacgcgcacagcggcttctgctcgagcccaccgatccggtggcgccgcttcggtctggcctggccgacgcgctccggaaagcgttgctcgcggcccacggtgcgtacgagacggagttcggcaagggcatggcctcgctggaggctagttcgctgtggcggaagctccctagctcggatcgttcgtcgatcctcgcgagcgttggcctcgcgcccgccgccccgttgtcggtgccgagcgacgaagcgcttgcgtcggcgctcgacgcgaagtcgctgtcgtcgcggagcgcagaggcggacgcggtttcgggccgcgtgcagaaggctctcgagcacgccgcgaagctgctcgagccgaaggtgcgaccggtgaccctcgagcgctcaaccctgacgaccgaagcggacgtcgatgcctggctcgaacggcagaagaagtcccttgtcgcggccatcaaggatggccccgtcctggtgagctga

SEQ ID NO: 19 - DNA, 3612 bp, Aromatoleum aromaticum
atgcagatcagggaactcttcaccaaagccatcgaccgtccgatcaacggcgtgatcaaggccgaccagaaagacgccgaaagcatttggcaggaactggacgaatacgtcgtcaccaagcagctcaccgaccacttccgccgtttcttcgatgcctatcttgcggcggcagacaaccccaacgacccggtgctgggggcacgcatgggcgtatgggtgtccggcttcttcggctcgggcaagtcgcacttcatcaagatcctctcctatttgctggagagcctccaagcgaccaacccagccaccggtgaaaggaaacgggccgccgcattcttcgatgagcgcaagatcaaggatccgatgctgctcgccgacattcagcgcgcggtgcgcggcagtgcggacgtgatcctcttcaatatcgacgccaaggccgacagcaaagacgagcgcgacgtcatcctgcaggtcttcctgcgggtattcaacgagaaactcggttttagcgcggacgcaccccacatcgcacacatggagcgctacctcgtagagaaggacgcctacgacacgttcaaatctgccttcgcgcaaagcaatggctccacgtgggaagctgaacgcgatgcagtcgattttctgcgcgatgacgtcgttcatgcccttgccgtagccctcaaacaaagcgacgaatcggccggccagtggttcgaccgcgcccgcgacgaataccgcatcaacatcgaatccttcgccaggttggtgcgcgactatctggataccaggcctgccggccatcgcatcatcttcctggtggacgaagtcggtcagttcatcggcgacaacacccagctcatgctcacgctgcaaaccatcaccgagcagctcggcacggccacgcagggcagggcatgggtgatcgtcaccagtcaggaagacatcgacgccgccctgggcgaggcaaacaaggcgaaatcgcaggatttctccaagatccaggggcgtttccatacccggctgtcgctggccagttcgaacaccgacgaggtgatcggcgaacgcctgctggccaagaccgaggccgcccatggcgcgttgcgtgacaccttcgaaaagtccggcgacatcatcaacaaccaactcgcctttgtcggcaactcggtcaacctgcgcagctacaaggatgcggccgaattcgtcggcgtctatccctacgccccctaccagttcacgctgctgcagaaggtgttcgaatccatccgcaaggtcggcgccaccggcaagcacctgtctcgcggcgaacggtctctgctcgacgccttccagtcagcggccgtgcgcaatgccgaccatcccgtcggtttgctgattccgctttacgacttctatccgtcgatcgaaagcttcatcgacaccgtcgccaagcgttccatcgacgaggcaccacaaaacggcgcactcgaagcctatgacgtgcttctgctcaaggcgctgttcctgatccgctacatcggcgatatcgtcaaacccaacgtcgacaacctcgccaccttgtgcgtggatcgcatcgacaccgacaaactcgccctcaaacgcaagatccaggaaagcctcgcccgcctcgaggcgcagcggctggtcagccgcaacggcgacttgtggttcttcctcaccaacgaagaacgcgacgtcgcccgcgaaatcggcaatgtcgaagtcccctcggccgaaaaggcccggctgctgtgtgaattgctgttcgacgacatcctgcagggcgccacccgcatccgtcaccgtgacaccaagggcgattacgacttcaaccgcctgctcgacggcgttccttacaagaatgccacccacgaactcagtgtcgaaatcgtctcgcccctcggcgacgactacgaaaccctgtccgatgccagggccgtcctgcgcagcagcgaaggtcacgggcgcgccctgatcaagctcgcggaaggcgagcgcttcgacatcgagctgaacctctaccggcagatcgagaagtacatcgacagccccaaggccagcaacgccacgccgtcgctgcgcaccatcctcctcaaccgcaaggacgaaaaccgcgaacggcgcacccgtctgcgggaacagttgtccgccatgctgctggagggcgattgctacgccttgggccagcgcgtcgaactcaaggccggtaacgccagcagcctgctggacgagcttggcaactacctcatcaccaacacctataccaagctcggctacctgaagcatcgcaatcccgaccccaccgccgagatcaaggcggtgttgttggccgacgacatcagccagaagaagcttgccctgggcggagacgagggtaatccgctggcgctggccgaaatgcgcgaatacctgcagctcaaggccagcgccagtcgcgtgatgctcgatgaggtcgtcgcccgctttaccggcattccctggggctggaagcccgagtgggaagtcgtgctgctggtggcacggctcttcatggcgggagaaatcaagctcgtcatggacagcgccgacctcgtaccccgcgcggccatcgaacctctcaccaagtcggcgcgcttcaagcaggtttccatcctgaagcgcaaggtcgccgacgtggaaagcatcaagaaggcgcgcaagctgcatcaggagctgttctccagtctgccgcccgaggacgaagacggctttgtggccgccatgcgcacccggctcgcgggctggcacagcgagctcaagggctatgccccgctggccgccaccaagcaccatccgggcaagaccatcatcgataccgtcgtcgcccgcatcggcaaacaactggccatcgcagacagcttcgagttcgtcgagtcactggtgaaggatcgggacgcctggctggatcttgccgatgatgctcacgacgttaccagcttctacaagactcagcgccccacctggcaacgcctgctcgatgcgctggagcgctacgccgacaaccacgacgcgctggacaagaacatccatgccgcagccgcattgggcactctggaaagcctccgcgacaactccgcgccctggggcatggtgagccagatcgaaccgctcatcgccaccgtcgatgcgatcaatgaagagctggcccaaggcaggcgcgagcacgccctgttgtccgtcgacgccaagatcgcagaagtcgaacaggctctggatgcggtccatgccgacgccgccctgcgcaatcgcgccctgctcaagttgcaggagctcaagaccaaggtcgccgggctgaccagtatcccgatgatcttctactgccaggatcaggccggcgacgccctcgatgcggcgatggcgatgatcgaagccgccacgccgaaaacagcgcccggcaccgcggccgagcatggcaaccagaacactgccaccaagaccggcccgacggtcgctccgcccaagccgagcaaggtcgtccgcgtggctgatcttgccggcaagacctatctggaaaccgaagccgaggtcgacgcttaccttgtccgcctcaagtcggagctgctcaagatcattcaagccggccagcgtgcccggctgcaatga

SEQ ID NO: 20 - DNA, 3501 bp, Arthrobacter sp.
gtgcagctcaacgagattttcgccaaggacgttcaacgccccatcgagggcgtcgtcaaggccgacgacgtcgtcaacctcggagtcgaggtcgatgagtatgtcctcaccaacgacgcggccaagggagtggccccacttctggaggaatacaccaactacaccaacgccaacggcgtgtggatctccggattcttcggatccggtaagtcacacctcttgaagctgctcgctcacctgctgggagacgtcgaaggtcaggacttccagcgggaccaggtcaccgccagcttcgtgggcaagaccgacgacgccatgctcaaagcctcgctgaccaaggcggcttcgatcccggccacgagccttctgttcaacattgatcagaaggcgacgctgatcgccaaggaccagcgcgacgcgctcctgcgagtgtttgccaaggttttcgacgagtctcgtggctacttcggcgaccagggccatgtcgctcgcttcgaacggcaactggacgaagagggtcagtggcaggccttccaggacgccttcaaggacctcgcaggaaacgattggaagacgcgaaggtccagtttcgggcttcccaaggtccgtgagcaggtcaaccgggcctatgcgcaggtcgccggcgtcgacatcgagagcgtgggtgacatcctctccacatatcaagcgacctacaagctctcaatcgaggacttcgccgatgaggtgaaggcgtggctggatacgaagggccccaactaccgcctgagcttcttcgtcgacgaggttggccagttcatagcggacaacgagcagctgatgctcgacctccagacgatcgctgagaccctggacaccaagtgcaggggaaggtcttgggtcttcgtcacctcgcaggaggacatggagaaggtcatcggtgaccagaccaagcggcaaggtaacgacttctccaagatccaggctcgcttcaagacgcgtgtgaagctcaccagtgcggacgtcgaggaggtcatccgcaagcggcttcttgagaagaacgatgccggtgacgctgagcttcagtcgatctacgccacggaacacgctaacttcaagacgctcttcgattttgccgatggtgccaagacctaccgcaacttcgtggatgagtctcacttcgttgggtcgtacccgttcgtcagctatcagttcccgatgttccaggcggcgatcgagggtctgtcggaccacaacgtgtttgagggcaggaacagttcggtaggtgagcgctcgatgcttggggtggtccagcaggtcgccaaggacatcggcaatgtagaggtcggccgcctcgctacctttgaccacatgttcgccggcatcagcgcatcactgaaggctgccgctcagagcgccattctgcgcgctgagcgcgatctgcccgaccctgactccgacctcacgaagctggccgtccggctcctcaaggcgctcttcctggtgaagtacgtcgacaacttcaccgcgactccccggaacctgacggtgctcgtatacgaccacttcgggatcgatctgcctgctctctcgaagcgagtcgacgaggccctcgctcttctcgaagcgcagacctacatccagcgcaacggcaccgcatacgagtacctcaccaatgaggaacaggagatcgagaaggagatcaagaacgtcgacctcgatgcctctgagctctcaaaccggctcttcaagatcctgaacggcgacatcctcaaggcgaccaagctgaagtacgccaagaacgggcaggacttcccgtttggctacaagcttgacgaccaggcccacggccagcagaaggatctgacgatccacttcatctcaccctcgactgcatactcgtccgaggagatccggatgcagagcgccggtaaggacgagctccgcgtcgtgctcgaagctgatgatcgagtgatcggcgatctccgactgctcctgcagaccgagaagtacaccaagcagaagcagaccacggcactgacctcctcggtgagttcgatcctccagtcaaaggcgatccagaactcggagcgggagaaggaactcatcgagcgcgtcaagcgtgccgttggacacagcaagctgatcatcaatgcggccgacatcccgtctgcctcgcatgacgctgtcacccgagtgacggatggtttccaggagttggtggctcgcacctacacgagcctcagcctgctcggcgggatgagatacagcgagagccagatcgcaggtgccgccaaccccgagggtggcatgttcgacgccggtggcctgtccgcattcgccacgcccggcatggagattttgaactgggtgaccctccgtacgaaccaaggtgagcaggtcaccgtcaagaagatctcagacgcgttccagtcaaagtcctacggctgggacttggcctcgatcgaggtgatcatcgcctggctcgttgggtcgtcaaagttggcgctcacgctcgactccaacctcgtgaagcgatccgagatcgccatggttcttcgcaacacgcagaagcaccaacaccaggttgtatccccacagaagtcctacgatgctggcaaggtcacggccttccgcacgttctgcatcgacttcttcgatgagggcaaccctccgactgacgctctggagctggcacgccacggatctgacaagctcaaggggaagctggacgagttgaaggctctccagacggcaacggcctacccgttcatcgcccagctggagcagccgatcgatctgttggagcaggtcgtcggtaagcccgacgagtggtatctggccgagttcgccctcgccgacgaactgatcgaggcaaagaccgacgtcgttgaccctattcatgctttcctcaacggacagcagcgctggatctacgacggcgctgcagctctgcttgccacgaacttgggcaacattgcctacctgccgcaagacagtgacgcaacggtcaaggggctgctcggcgatgagaacggcttccgcggcaacaagatgaaccagctcaagcaggcaactaacgcgcttgcgaatcagatcgacctggtagtcgcctccaaccgcacgaatgcctcgagggctgtcgatggtaggaaggaggagatcctcgccagcgcgtacttcgcttcggcaacggatgacgctcgggccagtgtcctcagcaaggttgaccaacaccttgccaagatcaacgctgagcctcagatcgctatgatccgcgagttggcccacagcttcgaggagacgatctacccagccctgatcgaccagttggcctcgtcgtcgaagaagtccgatgacgaggatgcgccgccacccaagcagacagtggcggtctccacgatcaaggccgacggtgctcccaacatcctcgaaaccgcgggagacgtggagaagtacctcgccgcgctgcaggtggcgctcgtcgccaccatcgatgacggaaagcggatttcgatctaa

SEQ ID NO: 21 - DNA, 3447 bp, Azospirillum lipoferum
atgaagctgaaggatgttctgctgcgcgatccgggccagacgcgtcttgccaacaacggtcaggctcgcctggtcgacgaccgcgacactgagaaagccatgctggagctgcgggaggagctgaagagcttcgtctgcgagggccagtacgccgacgggatgatcaagatcctccgcgcctttctcaatggcggcaccagccttcccggggcctgggtttccggtttctacggcagcggcaagtcgcacctgctgaagatgctctgtcatctgtggcaaaacacggcatttcctgacggcgccaccgcccgcgccctcgtccccagcctgccggacgaagtgaaggagctcctcaaggaactggacactcaggggaagagggccggcgggctgctcgccgccgccggggccatgcccaatgggggcacggatgcggtccgcctgaccatcctgtccgtcatcctgcgcgcggtcggtctgccggagcagtatgcgcccgcccgtttctgcctctggctggaagagcaaggcaagctcgatcacatacgcgacgcggtgaaagcggccggcaaggacttcaatgccgaactcaacagcctctatgtcagcccgctgatcgccaatgcactgatgtcggccatcccggacctggccaccggccccggtcaggtccggcttctgctccgcgagcagtttccgcagaagctcaccgacatcacgacgacggaattcctggatgccgcgcgggctgccctcaggctccgcggccacgacggccagattccgttgaccctgctggtcctggatgaggttcaacagtacatcggcacggtccatgaccggtcggtgctggtctccgaagtagcggaggcggtgtcgaagcagatgaacggccgcgtcatgatcgtcggcgccggccagagcgcgctgagctcggccccccaccttcagcgtctgatggaccggttcaccgtccgggtgccgctgtccgacattgatgtggagaccgtcactcggaaggtcctgcttcagaagaagcccgccgcactggggaatgtgcgcagcacgctggacacccatgccggcgaggtctcccgccaattgagcggcacccgcatccaggagggcccggaagaccgcgccgtcatcgtggatgactacccgatcctgccggtccgccgccgctttttcgaggaatgctttcgccagctggatgcggggggcacccagagccaactgcgctcgcagctccgcatcgtccatgacgccctgcacaagcgggcggaccggaatctggggaccctgattccggccgacgagctctatgaggcgctcgcgccggagctggtcaacaccggcatcctgctgcgcgagatcaacgagcgcatcctccaggttcggaaggatgtgggcgatctggccgcgcgcatctgcggcgtggtgttcctgatcaaccggctgaagcgcgaggccggtatggacaccggcatccgctcgaccaaggagcacatcgccgacctgctggtcgatgatctgaccgcggacaacggcaggctccgggcggacgtcgacgagatgttgaagcgactggtcgaccggggcgacctgatgccggtggacgaggagtaccggcttcagacccgcgagggtaccgagtgggaccgggaattccgggctcagcagaaccgggccgccgcagacacctccaccgtctatttccgccgcgaacagttgatcggagcggagttcgaaagcgcgatcaagggcgtgcagctgctccagggcgacgcgaaggaactccgcaagctcgccatccaccgtggcgacacgccgccgccggccgagaccagcgtcattcaggtctggatgcgggacggctggacgagcacggaaaagcaggcccaggacgccgcgcgcgccgccggcaacgaaagcccgaccatcttcgtcttcatcccacgggcgcatccggacgccttgagggacggcatccgggacatgatcgccgccaaggccacgctggatgccaagggcattccctccaccaaggaaggcgaagaggccaagctcagtatggacagccggctgagcatcgcgaccaaggccgtccagaccctggttaaggagatcgtcggccagaccaaggtgtatcagggcggcggaaacgaggtcatgcgcctgaccgtggccgaccagatcgaagcggccgcagaggattcgcttgtccgcctgttcccccgcttcaaggaggccgacagcggtcactgggagaccgtcttcaagcgggcgcgggagggagccgacaatccgttccaggtggtcggccatgccggcgccctggaaacgcacccggtctgccagcaggtgctgaccaccatcggcgccggccggagcggctccgatatccgcaaggagcttcaggcaccgccgctcggctggccgaaggaggccatcgatgcggcgctggtcgccctgcacagcgccggggtggtcacggccgtggccaacggggaggtgatcgccccgaaacacctcgaccacaaccgcatccccaaggccgacttccggaaggagggcttcacgctcagcgccacgcagaagctggccctgcggaagctctatcagctgctcggcgtccccaatgcagcggaacagctggcggcgaatgcgccggaattcctctccaagctcaagggcctcggcgcggaggcgggcggcgctgcccccctgcccgcatcgccggacaccaaggacatcgccgacatcgagcatctggccggcaacgagcggctgaacgcgatccacgcgaaggccgcggacttcacggccaggatcgaggcatggaccgcgctgaaggagctgaaggacaagcgcctgccggcctggacggtgctggatcgcctgtccggccacgcccgcggcctggacggtgccaaggacccgctggagcaggtggagacgatccgggacaagcggctgctgctggacgggaccgaccacgtcacgccggtgcgggccgccctggccgccctcctgcgggaggaggtcgggacgctccatgccgcgcacctgaaggcgcatcgggcggcggaggcggaactcgccgggaacgtcctgtggggccggctcgccgccgaccagcaggcctccatcctcgcggatgtcgggctgacggcgccggcggaccccaacctgtcctcggacgagacgctgttgcagcatctcgaccgcaagcccctgcccaccgcccgcgccgaaatcgacgcggtcgccggccgggttcagcgggcgctggagaaggcggccaagctgctggagcccaaggtccgcatggtcatgctggagcgcaccacgctgaagacgccggaggaagtcgaggcgtggctggcgaaggcgcgcgcgaccctgaccgacgccctcggcgacggtccggtgatggtgagctga

SEQ ID NO: 22 - DNA, 3639 bp, Bifidobacterium animalis
atggacgacacgatcgcactcaaaggcatcttcgcgaaggacatcgaccggcgcatcaacggcgtgatcaaggcgcacgacgacagggtcctcggtcaggagatcgacgaatacgtgctgacgaacgagatccagcgtaacctcgagaagttcctggacgcctacgacgaccccgacaaccacgtggacaacggcgcatggatctcgggcttcttcggctcgggcaaatcgcacctgctcaagatgctctccttcatcctcggcaccgtgccgcacgccctcatcgacaagaacggcgtcccgtcgatcccttcacgcgagcgcatcgtgcgcacgatgatggacaaggcgcacgatcaggacaacctcgagctcgagggcctgctcgaccgttcgctgcgcatccccgccacgtcgatgctgttcaacatcgaccagaaggcggacaaaagcaagcaggcgccgctgctgttcacgttcatcgacgtcttcaacgccgcatgcggctacagcggaggcaaccgcagtgtggcgcgcttcgaacgcgacctcgacgccaacggcaagtacaaggcgttcaagcaggcgttcgaggcccgtgccggcaagtcgtggcaggaggggcgcgacgaggccatcctgtgggatccggagatcgggcaggcctatgcggacgtgacgggcggcgaaccgcaggccgacatcatcggacggtacgagaacggcttctcggcgagtgtcgactcgttcactaacgacgtcgtcgactggctcgaccgccagtcccccgaccaccgcgtcctgttcatggtcgacgaggtcggccagttcatcggcgacgacacgcaccgcatgctcgatctgcagtcgattgccgaggacctgaacgcgaagacgaacgggcgcgcatggatcgtcgtcacctcccaggagaacctcgacacgatcatctccaaccagagccatcgacagggcaacgacttctcgaagatccagggccgtttctcgatcaagctcaagctcgacagcgccgacacgatggaggtgatccagaagcgcctgctcgccaagaaacccgaatacgtccccgaactcgaggacctgtgggagctcaagcacgacgacatgcgcacactgttcgagttcaacgccgacacgcacgtccaggacaacaaggccgggacggaaccggacttcgtcgcctcctatccgttcctcaactacgagttcggtctgctgcagtccgcgttccatgcgatgagcgacttcggcatgttcagcggcaggcactcctcggtcggcgaacgttcgatgctgtccgcatggagcgcgacgttgcaggccacggccgacgaacgcctcggctatctcgtccccttcgaccgcctcttcgacggcatcaaggacatcctgcaaagcacgcagacgcatcgcatcaccgaagccgaccaacgcctcgacccggatgtgcacgacctcggcgtgcgcctgctcaaggtgctgctcatggtcaagcacgtcagggacttcaaggcgacgccccacaacctgcgcatcctgctgactgacggcttcgacgtggacatcaccgaccttgaacgacgcatccgcgacacgctcaccgtgctggagaaccacacgtacgtgcagcgcatcgacaatgtctacacctacctgaccaacgaggaacaggacatcgagcaggaaatcaagaacaccgacatcgacgacggcgccgtgacgaaatacctcagggagaccttcgtcgacacggtcaagacgctcaggatcgtctacggcaagcagcagacgccgttcagttacacgctcagcatcgacggcatcgcccaaggacgcgccgaaccgatcggactggacctgcggacgcacgctgacgatgtctccgacctcatgcttcagacaagcggcgacaggagcacgatctcgctgctgctcgaccagagcgacgctaacctgttcaacgacatccgcatgatcgtcaagaccgacacgttcctcaaacgcaacctcgacgccacggacaggacctcaacgcgtcaaaccatcatcatggcgaaacaggcgcggaaggaagcgcaggagcacgccgtacgcgaccgcgtgcggcaggcgatcgcgaagggctcgttctactacgacggcgccgcggcggacgtgcccggatccgacgcggcgaccaggatcacgacggcgatgagcgacgtgatcaggaaccactactccaactatgcgatgctcggcgatctcgtctaccatgacaacgagatcgacgcctaccgtgcagccggggcggacgaggaaggccgcaaactcgtcggtatcgacagccagatccaacgcatcgcgccgattaccggcgacatcgtagacacgctcacacttaaaaccaatcaaaggacgacggtgagcgtcaaggacctcatcggcatctatcatgaggcgccctacggatggccagacgacatcatgctgtgcatgctcgcctacctgtacggggcgcaccgcgtcgaactgggcatcgacgcgcatccgatcacgaacacgcagctcgtagcattgctgcgcaacgcaaggaaacgcgaatcgatcatcgtcacgctcccgaagcgggttgaccctacacacgtcaagcggctggaggagttcgcgagcaccttcctcgacggcctgcgccgcgggccgggcgtcgacgcgcagcagttcgcccagcaggtgttcgagggcatcgagaaccgactggacgagatcagggatctgcggacgtcccaccgcgaggacaaggcgatcgtcgaccagctcgacggccccgtcaccatgctgtactacgtcgtgcgccagcagtctccctggctgctggaggggttcactgacgcggacagcgactacggatacgaggcggtgctcgaggcggacgaggacgtcattcgcccgatcctcgagttcttcagcggcaagcagttccgcatgttcagggacagccggcgatggctgcaggacaaccatccgaacatcaccgtatgcgccaccgatgagaccggacagctgcaagcgcaggcgcaggcgctgctcgacgacccagacgtctaccgcggctccaaaacgcggcggctcaaggagctcgtcgaccggctgcgcgcaatcgtcgacgaacaggtgaatcatgagcgcaccatggcgctgacgaagcttgacgcaatcgtctctgaattgaaggattccccccagtaccgcgaggccaccgaggacgcgcagcatatggctgaacgcagactggagggcgaacgcacatggttcgaaaacgcatccgatatcagcgccatgcatgtacgcgtcgaacaggtgtccgtgaagctgcgtccgagcctgtacaacgaactggccgcgcatcctcgaacgccagcagtgcaagagccggcacatgccgagacgacgcccgcgccggaccatgcaccggccgtaatcaaaccgacacggcgtcatgtcatcacgatggactccgtctccaagccgtcggggttcagctcgctgaggacgaaggatgatgtcgacgagtacctcgacgagtaccgccggcatctgatcgaggccattgagaacggaaacgagatcctgctatga

SEQ ID NO: 23 - DNA, 3585 bp, Bordetella parapertussis
atgaacgagggaagcgtgatgactcttaagaccatttttaacaagccagttgaccgcccgattgaaggggtcatcaaagctgacgatgaagccagtcttcgcctggaaattgaagaatacgtactgaccaacgaagtcgagaagcggcttgaatcctttctggacgcctacaacaactatgaaggtgccaatggcgtttgggtttctggcttcttcgggtcaggcaaatcccacctgctgaagatgctggcgctcttgctcgaaaacaggcagatcgacggagcctcagctcttgacctgttcttgccgaagtgtggcgataacgaaattcttcgcggtgatctcaaacgagccgtcgccattccgtcgaaaagcattctgttcaacatcgaccagaaagcggacgtcatcagcaagacccagatcgatgcgctcctcgctgtcttcgtcaaagtctttgacgagatgtgcggctactacggcaagcaaggccacatcgcccagtttgagcgcgacctcgacagccgtggcctgtacgaccagttcaaatcggcttatgagtcctcagcgggcagaacatggcaaaaaggccgcgagcaggctctgctggaggcgaaaaatattgccaaagcttatgcccaggtaaccggtggtgacgaagcatcggccatggggatactcgataaataccgcagccaataccgtgtctctatcgaagattttgccgaacaggtgcatgcatttatcgagcggcaatcgcccgatttccgcctgaacttctttgtcgatgaggtcggtcagtacatcgctgaaaacgtcaagttgatgaccaacctccagaccatcgccgagagcatggcaaccaaatgccgcggccgcgcatgggtcatcgtgaccgcccaggaggacatggggacggttgtcggcgagatgggcaaacagcaaggcaacgacttctcgaaaatccaggcccggttcgccaaccgcatgaagttgaccagcgccgacgtggcggaggtcatccagaagcgtctgctcatgaaaaccgaagaaggcgtccgccttctgtcggacacttaccacgcgcagtccaacaacttcaagaccctgttcgactttgccgacggctcgcaaacctaccggaattatcaggatcgggatcacttcattcacagctatccgttcattccgtaccagttcgcgctgttccagtcggccattcagaatctgtcgcagcataacgcgtttgagggcaaacacagctcggtgggcgaacgctccatgctgggtgtgttccagcaggtggcgatccagatcggggatcatgaaatcggtcagttggcgaccttcgacttgatgttcgaggggattcgcaccgcgctgaaatctaatatccagcgagccatcatccaggcagaaaaccaccttgatggccctttcgcgatccggctgttgaaaacgctcttcctggtcaaatacgtcaaggagttcaagccgactcttcgcaacctgtgcgtcctgatgctggacggcttcaatcaggatctgcccgcgctgcggaaaagggtcgaagaagccctcagcctccttgaacagcagacctacgtgcagcgcaatggcgagctctacgaatacctgaccgacgaggaaaaagacgtcgagcaggaaatcaagaacaccgaggtggagtcatcggatgttgccgccgaacttgagaagatcgttttcgaccacgtcatcaagcatcggaagattcgttacgacgcctcttcatcaaaagatcagggccaggactacccgttctccagaaagctcgatgatcggctgcacgggcgcgagcacgagctggccatccatgtcatcagccccttccatgagcacgcagaaaatgagcaaatgctgcgcacaagctcaacttataagtctgatgaactgtttttgatcctgcccgcggacgaacgcttgatccgcgacattctgatgtacaagcggacggagaaatacatccgccagaacatctcaatcacgcaacaagaggcggtcaaacgcatcctgaccgacaagggtttccagaaccgggaacggtatgccgagctgcagcagcgcgtccagagcctgatgagcaaggccaagctgttcgtggcaggtgccgacatcgaaatcggttccgaggatgcgcagacccgggtgctgcgcggattccacgagctcatctcccgcgcctatccgaaccttcgcatgctgcgcggcatcagctacacggaagagatgatcaaaaccatcctcagtaacaaggatggaactctgtttggaagtggcgccacctccctggccgaatccgagcaggagctgttggcgttcatccagagtaacaaccggggtggcgtgcgtaccacgctgaaaaacctgctggagaaattcgagcgcaaaccctacggctggtactacgccgccgtgctttgcacgctggccaacctgtgcgctcgcggcaaggtcgaggtccgcaccgacggcaacctgctggaagaggacgagctggaacgggcgttgcgtaactcccatggccacggcaatgtggtgctggagccccaggtcgaatttagcgcttcacaggtccgcaccctcaaggagttctttgaggacttcttcgatactccgcccggagccggtgaggctaaagcactcggcaaggaaaccggcaccgcgttccaggaactcacgcatcagctcaccccgctggcggcccaggcatcccaatatccgttcctgaatgcgctgacaccggtgcttgagaagctcaaggagctgaccggcaagccctacacctggtatctgaccgaactcacccgccaggaagatgcgctgctcgatatgaaagaaagcgtcatcgaccctgtccgcaagttcatgagcgggccgcagaaaggcatcttcgataacgcccgcaagttcgttcaaaaccaagagcccaacttcgcctacatcgaaggcgacgaaaccgctcgggtggttgccagcttgaccgatccggaatgtttcaagggcaaccgcatgcagcaggtgaagacgcaagtcgaaaccctgcaggagaaggtcacggcccagatcgaggccgagattgccaaagccaaggagacggtcgccgcccttaaaggccgcctctgcggcatgactgaattcagcgcactgaacggcgagcagcaggagcagatcacccgtccgttcaacgaattcaacgcggccattgagcgccagaaactgattgccgtcatccgcgacaccctgcgccggtttgaggaaagcgactaccagcggttgctttcgcagatgacatcctgggcgcaaccggcgccaacacccgagcctgcgccgaaacctggtcagaccgccacgccggacgaaggtacgaagcccacgtcacccgcaaagccggaaccgcgcattgagtacgtgcctagccgctcggtgaaggtctctttcgacaaagcttggctggccgacgaggccgacgtggaacgctacctggaatccatgcgcgaggcgctactggatgaaatccgcaagggaaaaaggattcaaatctaa

SEQ ID NO: 24 - DNA, 3462 bp, Burkholderia sp.
atgctgaacagggacatttatagcaagcctcccaaggaaaatcgcctcgttaataacggtgttgcggaggtttctgaagaccattctgacgctgctcgggctatcttgcgctacgagctggagaccttcgtctgtgatggtcagtatgagaaggggcttgagactattctcgacaaattcctgctcaacctggacgccggtaccgaacagccgggcgtctggatttcaggtttttatggtagcggtaaatcgcatctagccaagatgctgcgcacgctctggaccgactacgagttcgctgatggcgctactgctcgcagcctcgctagtgtgcccaccggcgtgttcgaccaactaaaagagcttagtacccaaggcaaacgctacggcagcttgcacgctgcagctggcaagctcggcgctggtgctggcgacaaggtgcgactggctctgctcggcatcgtattcaaatccaaggggctgccggagcaatacaaccaggctcaacttgttttgtggatgcagcgcgagggcgtattgccgaccgtcgaggcagaactccaggcggcgggtcgctcgctggctcaggagctgccgcacatgtacgtgtccggccacctggccaaggcactgctcaaagcccggcctgacctcgcgcacaccgaagccgatgcccgcaagcttctcaaggaacagttccctcaggtaactgacgttaccagcgagcagatgaccaccgcgattgccgacgcgctgtctgtcgagggcaagttcccgctgacgctggttgttctggatgaggtgcagcaatacatcggcaccgacgccgagaaggctttccaggtccaggaggttaccgaaaccctgtccaagcacttcaacggcaagcttctcttcgtcggtactggtcagtctgcactctccagcatgcccaatctacagcggttgatgggccgtttcccggtgcaggtgatgctcggcgactgggacgtcgagaacgtcacacgtcaaatcattctggccaagaagccgaccgcacagccggaggtggaaaacgtctggcgtgccaaccttggtgagatttcgcggcatctgcgcggcaccaaactcgagtacgtcactgacgacgaggacgtcatgacctccgactacccgctgctgccggtgcgtcgtcgattttgggagcgtgttctccgaacaatcgacacgaccggcacagtgtcgcaactgcgcagtcagttgcgcgtggtgcacgaggctgtgctcgcctctgccgatgcacctctgggtcacgtggtttccggcgactttctctacgaccagattgccgcgaacctggtttctactgctcagttgccgaaggaggtgttcgagaacgtccagcgctttgccactggcgatgccgacagccagctcaaggcaaggctactcaaggtcgtctatctcatcaacaagcttccggccgatgccgctctggacatcggcctcaaggcgaccgaagacgcactggctgacctgctggtaaccgacctcgcggccggctccgcagagctgcgcaagaaattgcccgctctgttggacgaacttcagaacaaggaccgtcttgtcatggcactggtgggcagcagtggaaccgaataccggctgcagactcgagaatccagcgcctggtatgacgagtttcgtgcccaggaggctgaactgaaagcagcgccgcagcgcgtagagcaaaagcgttcaacgttgctgaaggagcgttttggtgaagtgctaaagaaggtgcgtgttgtgcagggtaaagacaacgttgagcgtcgcctcacgcccacctatgacgatacactgcccaaggaccacgcccagaacatctatctgtggatacaggatggctggcaggccgaggagaagtcggtcatcgctgaagctaaggcgaagccggccgataaccccacattgttcgccttcctgcccgcacagcataaaaccgaactcgccaacgccattgtggcgctggaagctgcgcgcacgacgctgcagaagaagggcagtcccgctaccgaagagggacgcgacgcgcaacgctcaatggagagtcgtcaacgcactgcggagaaggagttaagtgaacttctggaccagctcctcgggggcgtgcgcgtattccaggccggcggccaggaagcgcaggacggcaacgaccttgctgaccgcatcaaccgcgcagcaaaagcttccgcaattcgcctgtacagccagttcgacgctgccgaccacgaccagtggagcaaggtgctggacgaggctcgcaaaggtaatctggaagccctgaaagccgtggggcacagccaggaagctgacaagcacccggtctgccagaagctgctcgcctatattggccccggcaagaagggggccgagattcgcgataactttgatgcgtcaccgtatggctggccgcgcgatgcgattgacggtgccctgtacgcattacttgccgctggtcatatcaaggcgacggatgcatcgtccaaggctgtcgatgcgaaaagccttgaccgtgccaagctgacgcaaacgactttccagcgcgaaagcgtcaatatcacgccgccgcagcttatcaagattcggtcgttgttcagcacggtgggcgtgccatgccagccgaaggaagagttggctaaggtgcccccgctattggccaggctccgtgagcaggctgccaaagcgggcggctccgcacccgcgccgcagacgcccaagccagcgttcatcgaaaccatcgaaggccaaacgggcaatgcgcagctactggctctctttgagggttttgatgaaatcgtcggtcagttcaagtcctgggttcaaacagatgacgctattgccaagcgcctaccagtctggcatcagctgaccgaactgttgcaccacgccaaaggccttggcccttacgcggaactgaaggccgagacggatgcaatcgagacccagcgcagcctgctggccgagcccgacccggtgcgcccgctgctcgacaaggctgtagacctgctgcgccaggcgctgggggcgaaactcaatgcgtttgagcatgttttcgcgcagcagcaggcgcaattgcaggccgatgccgattgggcaaagctcacggatgcacagcgcagcgaattgactcaggcccatcatttaaacacgccgactacgattgctctgggcacgcccgaccagttgcaggatgcgctcgacgaatgcgacctcgaccattgggtgacaagaacccaggcgctgacgagccgctttgaggccgctcgtcaagctgcggtgcaattgctcaagccgaacgtggtgcacgtgactattccgcgtcgaaccttgaatgatgaggccgagctgaagacctggttggcggaggttgaggccctgttggcagaaaaactcaagcaagggccagtggcgctttga

SEQ ID NO: 25 - DNA, 3672 bp, Burkholderia gladioli
atgaaaattcgagagctgtttgttaagccaatcgatcggcccatcaacggggttgtcaaagccgaccagcgcgatgacgagagcatttggcaggagctggacgaatacgtcgccacgaaggaagtgaccgaatacttgcggcgcttcttcgacgcctatcttgccaccgtcgaccaccccaacgatccgacgatctccgcgcggatgggcgtctgggtgtcgggtttcttcggctcgggcaagtcgcacttcatcaaaatcctgtcctatctgttatcgaatctcgaggcgacccagccgaaagacggagcgaagcggcacgcggttgagtttttcaattcgaaggtcaaggacccgctgctgctgggcgacattcgccgcgccgtcacgagcaacaccgacgtggtcttgttcaacatcgacgcgaaggcagattcgaagagcggccgcgacgccatcttgcaggtgttcctgcgcgtcttcaacgagatgcaggggctctcgggcgacgcgccgcatgtcgcggaaatggagcgctatctcatttccaagggcgcctacgagacgttcaagcacgccttcaaggcggccaatggcaacgactgggagcgcgagcgcgacgcggtcgacttcctgcgcgacgatgtgattgccgggctcagccaagcgctcgacatgtcgccggactcggcggcgaagtggttcgacaacgcgcgcgacgcctacaagatcaacatcgaaggcttcgcgacgctcgttcgcaaatacctcgacgccaaagggccgcgccatcgcatcgtgtttctggtcgatgaggtgggacagttcatcgggaagaacacccagctgatgctcaacttgcagacgatcaccgaggagctcggcacccaatgcaagggccgcgcgtgggtgatcgtcaccagccaggaggacatcgacgcgacgctcggcgaagtcaaccaggctcgcaccaacgacttttcgaaaatcacggggcgctttcacacgcgcctgtcgctctcgagctcgaacaccgacgaagtgatttcgcaccggctgctcgaaaagacaccggccgcgcgcgacgcgctcgagtccctttgggcgtccaaaggcgacatcatcaacaatcagctttcgtttgccgatcatgcgatcgcgttccggcgctatcgcgacgcggcggactttgtcgcgcactatccgttcgcgccttatcagtttcagctgcttcaaaaagtgttcgaatccatccgcaaggtgggcgcgacgggtcggcacctcgcgcgcggcgagcgctccatgctggacgcgttccagacggcggccaaacacaacggcaaagaggacgtcaacgcgctcgtgccgctctacgacttctacccggcgatcgaaagctttctcgattcctcggtgaagcgcgccatcgatcaggcggccacgaacccggcgctcgaagagtgggatctgcaactgctgcgcgcgttgtttctcattcgctacgctgatgcggtgaagggcaccatcgacaacctcgcgacgttgtgcctcgaccaggtcgacgcggacaagctcgcgttgaaaaagaagatcgaagcggccctgttgcggttggagcggcagaacctggtgagccgaaatggcgagctgtggtttttcttgaccaacgaagagcgcgacgtctcgcaggaggtcaagtccgtcagcatttccgagggcgagatttcgcgccttgtcgccgagctggtttttgacgagatcctcggcggacagacgaaggtgcggcatcgcgagaccaagagagactacgaattcaatcgcctgctcgacggcgtgccctacaagcaggcgaaccaggccttgacctttgaggtgctctcgcccgtgggccccgaatacgaaatgatgcacgaggcgcggtgcattggtcgaagcgccgaggggacggccggtcgagccctgctcaaaatggccaacgacgcgcgcgtctacgtcgagctcaagacgtatctgcaaatcgagaaatacatcgcgcccaaggtcgacacggccagcccgtcgctcaaacggattctctacgatcgaaaggacgagaaccgcgatcggcggacgcgaatcgtgtcccagctgacggaaatgatcagtgcgggcgacttctacgcgatggggcagcgcctgacgtgcaaaccgcagtcgccgccggcgctgctcgacgagatgctcaactacctcgtcacgaacacctacttcaagcttggctacctgaaagtccggcaggccgatccgatcgcggagattcgggccgtgctgtcggcggacacgatcggccagcagtccatcgcgctcgaaggcgaggccggcaacgcgttggcgctgggcgaaatgcgccagtttctggacatgagcgcgcaaaacagccgcgtgcttctgtcggatgtggtggagcgctttgcgggggtgccgtggggctggcgaccggaatgggagtcggtgctcctcgtcgcgcgcctcttcatggccggcgagatcaagctcgtcatggacggcgccgacctcgaccccttggcggcgattgagccgttgacgaaagcggcccgcttgaagagcgtgtcgatcttgaagcgcaagacgtcggacgcccaaacgcgagcgaaggtgcgcgagctgcaccgcgacatgttctcgacgatgccgccggacgaggaggatccgctcgtcgccgaattccgcgcgaacctgacgcgattgaaggccgatctcgaacgcgcgcgcggcaaagccgaactgaaagactatccgggcagctcggaaatcgcggaggcgctgggcgcgatcgaccggcaattggcgcgacgcgacgcctttgagttcctggaagccttggcgaaccagcgcaacgagtggcgcagtcgagccgacgacgtccacgacgtgctgagcttctatcaaaaccaggcgcccgtgtgggcgcgcctgctcgaagcgctcggcagctttgccgacaaccgcgagccgctgctcaacgacgcgacggcggcggccgccttggcggagttggagcgcatccgcacgaatcccgcgccctacggccaggtgaaccgaatcgagcagttggtggcgaccgtcgagcgggtcaacgacgcgttggcgggcgagcggcgcgagcgcgcgctgcgatcggtcgacgcgaagatcgccgaggcgacgcacgcgctcgatggcgcgaacgcggacgccgaccttcgcaatcgcgcgttgaagccgctccaggacttgaaggcgcaattggcctcgttggtgagcatcccgcgcattctctttttgcaggggcgcgcgggcgacttgctcgacgcggcgatggaccaaattgcgcgagcggcgcgctcgcgcgcgacgacggccccggcggccaatcccggcgcgagcgcgtcgaagtccacggctccgagcccgagccctggcgcagccggcgcgccgtcggatggcgggtccgccgcgccggctgcggccgcatcggcgccgaccgcgcgcccggtcaaggtgattcgaaccagcgacctgagcgcgaagacgtatctggacaccgcgcaagacgtcgacgactacctcgcgaagcttcgcgaggagctgatcgcggcgatcgaatcgggccatcgagctcgtctgcaataa

SEQ ID NO: 26 - DNA, 3633 bp, Burkholderia vietnamiensis
atgaaaatccaagaactctttgtaaagccgattaaccggccgattaatggcgtcatcaaagcggatcaacgtgacgacgctagcgtctggcaggagctggacgaatatgtgaccaccaaagaggtcacggaatacttgcgcagtttcttcgacgcttacctcgcgacagcggctcacccgaatgacccgagcattattgcgaggatgggagtctgggtgtcggggttctttgggtcgggcaagtcgcacttcatcaagattttgtcgtatctgctctcgaatctcgaagcgagccgcccgggcgacgagactactcgtcgagcggttgagttctttgattcaaaaatcaaagatcccatgctcgtgagcgacatccggcgcgccgtcacgggcgacacggacgtgatcttgttcaacattgatgcgaaggccgattcgaaaggggatcgcgacgccatcttgcaggtgtttctgcgcgttttcaacgaaatgcaagggctttcgggggatgcgccgcacgtggccgagatggagcgctatctcatctccaagggcgcttatgacgtctttaaacaggcgttcaaggctgccaacggcaacgactgggagcacgaacgggacgcagtggactttctgcgcgacgatgtgatcgcggggctcagccaggcattggatatgtcgccggagtctgcggcgaaatggttcgataatgcgcgcgagtcctacaagatcaatatcgaggggttcgctgcgctggtgcgcaagtatttggacgcgaaggggccgaagcatcgcatcgtctttttagtcgatgaagtggggcagttcatcggtaagaacacccagttgatgttgaacttgcagaccatcgtcgaagagctcggcacggagtgcaaggggcgtgcgtgggtgatcgttacgagccaagaggacatcgacgcgaccttgggcgaagcgaatcaggcgcggaccaatgacttctcgaagattaccggtcgcttccacacgcgactgtctctgtcgagctcaaacacggatgaggttatttcgcatcgcttgctcgaaaagaagcccgaggcgcgggccgagcttgaagcgctctggaaggagaagggggacatcatcaacaaccaggtctcgtttgcggatcacgcggtggcgtttaggcgctttcgtgacgcgacggacttcgccactcactacccattcgccccttaccagtttcagttgctgcagaaagtcttcgagtcgattcgcaaggtcggggcgacgggccggcacctggcgcggggcgagcgctcaatgctcgacgcatttcaaacggcggcaaatcgcaacagcgatcgagacacggatgcgcttgtgccgctttacgacttctatcctgcgatcgagagctttctcgattcctccgtcaagcgcgctatcgatcaagctgagtccaatccggcgctcgagaagttcgatgggcagctccttcgaaccttgttcctgatccgctacgcggacgcggtgaagggcacgatcgacaacctcgcgacgctttgcttgaatcgcgtcgacgcggacaagcttgccctcaagcaggacattgaagcttcgcttttgcgattggagcgacaaaacttggtgagccgcaatggcgacctgtggtttttcctcacaaacgaagagcgtgatgtttcgcaagaggtcaagtccgtcaacgtgtcggaagcggaaatctcccgcttggtcgcggagcttgtgtttgacgagattcttgcgggccagacgaaggttcgacatcgcgaaacgaagagcgattacgagttcaaccgcctgctcgatagcgtcccttataagttggcgaatgcagcgctcaccttcgaggtgatctcacccatcggggccgactacgaaatgatgagtgaggcacgctgcatcggccggagcgcggagggctccggtcgggcgatgctgcgcatgagcaacgacccccgggtctatatcgagctcaaaacgtatttgcagatcgagaaatatatcgcgccgaaggcggacacggcgacggcttcgctcaaacggattctttacgaccgaaaggacgagaaccgcgaccggcgatcacgcctcgtcgggcaattgactgaaatgatgagcgccggagacttttacgccctggggcaacgactgtccgtcaagccccagtcgccgccggctgtgctcgacgaaatgctgaactacctggtctccaacacctattcaaagctcggctacatcaaggttcgtcaagccgatccgattgcggagttgcgcgccattctcacggccgacacggtcggccagcaacgcatggcgcttggtggcgaggacgggaacgccttggcgttggcggaaatgcgtcaatacctcgacgttgtcgccaagagcagccgtgtgctcctttctgacgtaatcgaccgcttcaccggcgtgccttggggctggaagccagaatgggaaattgtgctgctcgtcgctcgactgttcatggcgggcgagatcaagctcgtgatggatggagctgatctcgaccccttgggggcggtcgagccactgaccaaacctacccgttttaaaaccgtatcgatcttgaagcgcaagacgtcggatgctccgacgcgaactgctgcgcgcgaattgcatcgcgacatgttcgcgaccatgccgccggaggaagaagacgcgctcgtcacggaatttcgcagccatctgacccagctcaaaaccgacctcgagagagcgaagggcaaggccgagcacaaggattacccaggcggcacgcagatcgtgcgtgcattgatcgcgatcgatcgacaactcgcgctgcgcgattcctttgaatttttggacgctctcgtgcagggtcgcaacgactggcgagacttggccgacgacgtgcacgatgtcctagggttctacaagaaccaggttcccgtctggtctcgcctgctcgatgcccttacgagcttttccgacaacaaggaggcattgctcaatgtgcaggaggcggccaacgccctcgccgaactggagatgatccaccacaaccccgagccatacgggatgatcaaccggattgaggggttggttgcggcggtggagaaggtgaacgatgcgattgcaggcgagcggcgcgagcgcgcgcttcggtcaattgacgagaggattgatgaggcgcagcaggcgcttgatgccgcacaggcggacccaagtctgcgcaatgcggcgctcagccctcttcaggcgttgaaggcacagttggcgggtttggtcagcatcccgcgcattctgttcttgcaggggcgtgcgggcgaccttctcgatgaggcgatggacaagatcgctcgcgcggccaagctcagcgagtcaagcaaggctgcggtcaagccgcaggctgatggcaccggagcgggagggagcgaccaaacgaatggcgcgaatggcgccaacgcgacggtgtcgctgcgtccgatcaaagttgtgcgtccgagcgagctgagcggcaaaacctacctcgaaagcaccgatgacgttgagaaatttatcgacactcttcgccacgagctcctcgcagccatcgcggcgggccaccgcgcgcgtttgcaataa

SEQ ID NO: 27 - DNA, 3486 bp, Calditerrivibrio nitroreducens
atgatcataaagaatatttttgaaaaagatattgaaagaccaattaatggagtggtaaaggttggccaggatgatctaaacatcattaagacggaagtggaagaatacatagtaacttcagaaataaagaagtatcttgacgatttttttacccattatgttgaaactttggggatgcaaactgataaaataggtatctggatctctggtttttttggttctggtaagtcacacctattaaaaatgcttgcatatattatagaaaatcccactattggtgataatttgactgcaggggagatcatacgagaaaaagttaaagacgatgctttattatctgcaaatataaagaaggcatatcaaacaccatcagatgtaatactttttaatatagatagcatgagtgatactgctgatggtggtgaagaatcaattcctaaagtttttcgtagggtattttacgacaaattgggttatttcggcagattccctttcatagctgagatagaaagaaatttagacaaaaaagggtgttatgaaaaatttaaagataagtttaaagaattgacaggttttaactggatcgatgaaagaaaaaattttgctctacatgagaaaaagatctttgaagctctggcctattgtaataatgtgacaattgaagaagcagaaaattattataacaaaacagaagattatttcaaatcgataagcatttcagattttgctgagatggtaaaagaatatgttgaccaaaagaataaagagttaaaaactaataactatagactgttatttatggtggatgaggtagggcagtttatagcacaggataccaataagatgttgaatcttcaaactatagttgaagagttgggggtcaaatgtaagggttctgtttgggtggtggtcacttcacaggaggacgtggagtctataatcggagatttgccaaaaacaagcaaaaatgaattttcaaaaatcttaggaaggttcaagagattttcactttccggctcaaacactgatgaggtgattaaaaagaggattctggccaagaatgtggaagcagcggaagaactaaaaaaactctacgataaatactcgagtattctaaaaaaccagtttacttttacagctgatactgctacttttgagaaatataaagatgaaaatgactttataaacacatacccttttataccttatcaatttaagctgctacaaaaagtctttgaagcaatccgtaccaaggggattgcaggcaagcatctgtcacatggtgaaagaagtatgttgaatgcttttcaggaagcctgcaaaaatataaaagactccgaattaggctacatatccccattttatctattttacgacacaattgaaggttttatggattcctacgtattacttactatcaaaaatgcagaaacaaatagtagcttaaattcatttgatgtaaacctgcttaaattattatttttaattcgctatgttgggcaaataaaatcaaatattgataatattgtaattttaatgttggaaaaaatagaccaggataaacaatcattgaaagaaaaaattaaggaaagcttgtcaaaattggagcatgaggtacttattaataaaagtggcgatacatacaatttcttgacaaatgaagaaagagatataaggcaagagataaagagaataccgatagattctgatgcaagatcaaattttatctacgagatagtttttaatgagatttatttggacacaaaacataaatatactcattacaacaacaactacgacttaataagaacagttgataatatttccaaaggcaatggtaaattagaaatcaaggttgttacccaacattattatgaaacgagcgattccaaccttgcaatggaaagtcagcagagaagaatagtcatcaggttaaacagcagtaatgatctggaaagagagttgaaagcttatttacaaacagatgagtatataagaaagcatcaagtctccaccaaagagtcattttcaaatattattcgtgatactcagaaagaaaatgacgagaggagaaaaaggataaagagcataatcgaaaatttgttggagaatgctgactactttggtcttggcaacaagctaaatcttctaaaaccagtaaactttagaaatgttttaagagatcagctggatgaaatagtagggcatatctaccataaaatgtaccttattactcaaaattcgattaaaactgccagtgaaataaaggaggcattgaataaaaaaagaagtatagtcatagacattaccactaatgattcggctgaaaatgagataattaactttattcgtgatattagtcatttggaaggtaatgttacattgaaaaagatatacgatagattcacagaagaaccctatgggtggaagttgctggatatccaatatgttattgcaattctggtggccaatgagaagatacacctattgtatcaaaacgaaaaaatatccagccaatttcattcgaaactcgaagagcttataactaaatcatcatatcaatcagtagtttatgttacattgccacaaacggcaaatgaagatgaaataaataaagcaaagcagatttttcaggaagtcagtgataatatacctgaagaaaattcagatgattttctcaaacagtttaaaaaatatatcaatgatctcgtcgaagacatcaaagccaatctgggtagtttgtcatctgattttataccaaaagtgatcgcagaggaatatttagaggagctggtgaaaattgccaaacaaagcgataaagtggatataataaaagggatcataaataatgaaaaaaatctacccacatggatagaatatcttggaaaggttaaaaacttcctctctaatcaaatagatagatataaagaaataagggaatttataaacacatataaagatggaatagtgcactacgatcacaagacagccaatgatctcctaagcaaatgtaatgaatacataaaaagcgagtcaccttttcatctaactattgcactggcaaatgaaatagacaatgtcagcaacgaattgaagaaaaagttagaatcaaaaaaagaagcctgtatcgatgagataagaaaaagatatgaatatgcattacaaatttctaaggaaaacaatgaaaaaatcgatgaaaaattagaccctttagataaaatgatagaacagataaaaaatgaattaaagattgaaaatgtgatagcaaaacattctacatttacccaaaaaattgataaaatcatagagattataaagaataaaccaaaagataaaaacacaccaaaacgtgttaagatatcatcaatcatttatccaaaaattataagcagcaaggaagagattgatagttttgtaaacgaattaaaggaaaagctatataaagagctgcaaaacaatgaaaaaattgagatttcaggggattga

SEQ ID NO: 28 - DNA, 3564 bp, Carboxydothermus hydrogenoformans
atgcgaattagggatatgttttacaaaaaaattgacagggatatcaaaggtgtcataaaaattggtcaagaagatgaggaaaatgcatatcaagaactggaagagtatgtggtaaccagagagctaaaaaaatatttcagtgaattttttgaagcgtataaaaaagggattatcggatatacggacaaaatgggagtatggatatcaggcttttttggcagcggtaaatcccactttttaaaaatcctttcttacttgcttgaaaacagagtagttaaagggaaaaaggccgtggaatattttcgcgataaaatagatgatcccatggttcttgcagatatagaaatggctggaaacatatcggcggatgttatactttttaatatcgagtcaaaagctgatgctgattcaaaaactcaaaaagacgctattgttaaagtatttaatcgagtttttaatgacatgcaaggtttttgcggttctataccctggcttgcggatcttgaaagacagatgtctaaagacgggacttatgaggatttcaaaaaggaatttgaaagaatttcggggaggaaatgggaagaagccagagaggacttctattatgaagaagacgcaatagtaaaagcgcttgcttctgcaaccaaaatgagcgagcaggcggcacgtaattggtataacaaagcggaagagaattatactctcaccgttgataaatttgcaaagagagtcagggaatatatcgagagtaaagggggaaatcatcacgtagtattttgtgttgatgaaattggccagtacataggagataattctggtcttatgctaaatcttcagacactggtagaagatttgggtaccgaatgcggtgggaaagcatgggttattgttaccagccaggaagatatcgattcgattacgagggtaaaaggcaacgatttctccaagatccagggtaggtttaataccagaatcagcctatccagcgccaatgtggatgaagtaatcaaaaagaggttactgaagaaaacccaagttgctaccgatactttaaaattgctgtatgaaaataaaagttctatccttaaaaacctcataactttctctgccgatacgccagaaaaaaagttttatacggacagcaatgactttgcggaagtttatccttttatcccttaccagtttaatctattgcagcaggtgtttacctcaataagaattcatggggcgtcaggaaaacatctttccgaaggtgagcgttccatgatcagttccttccaggaggccgctatacgctatgctgactgcgaggaaggaacgctgatacccttttcggctttttacgacactattgaaacatttcttgattcaaatatcagaacggttattattcacgctcaggaaaacagcaacttaaacgactttgatgtggaacttttgaaggtcctttttatgatcaaatatttaacaaaagagattccgcctaatattgaaaacctggctaccctgatggttagccacatcgatgaggataagattgcgcttaagaagaaaattgaagagtcgttaaaacgcctgataaaagagaaccttgttcaaaaggatggggattggtatattttcttaacccatgaagaacaggatattaacagggagatcaaaaatattcagatagatactgctgaaattatacaaaaagtttcggagattatcttcgaagatatttatccagacaaaaagttcaaatattctacccgctaccatttcccatttaaccagattgttgacgacagatttttcagagggaatcagggcagtgagattggcgtaaaaataatcactccatattacgactcaggcagcgaaatgacccagcttgaatttaaagaaatgtcgcagcgggaaaacaatcttattgtgaaactgcctccagataccaccttccttgaggaaatggaagaagtattgaaaattgaggcatatcttaggaaaaacggtggtattgcctcaaccccgaccatggaagaaattaaaaacagaaaaagaaacgaagcaagcaaaaggaaagaaagggtaaaatcccttattatcgatgctttgaaagctgcagaactatacgtaaacgcccaaaagctggacataagggagaaagatcccgttgaaaggataaatgaaggtttaagggtgctcattgattccctttacaccaaactggggtatataaaagcatttatagattcccccagcgatatcaataacattctcacacaggaagctgtgcagatgtcactggctgaagaccccaacaaactggcacttgaggaagtttcttcctacatcgaaagaaatacagcaagaaacatacctgtaaccatgagaacggttataaatgtattccaaaaagctccttacggctggaacgaggaagacatcgaaggtctgattgcaaaattatttaaggcacaggaggtcaagcttcagttaaacggggaatatctggacataaatgatagagaccttgtgaaataccttacaaaacgtgactatgccgaaaagctgcttatagagaagagaattaaaatatcgccagtattaataaataccgcaaaagaaatagtaaaagaggtttttgggagaactgcgctacccaacgatgaagacggattgatgcgcaagatcaaagagtatatgcaagatgagtgcaatcatatagaccaactgcttcagaactacaagtatgccaaatatccaggaaaagatgttttggaggaaggtaaaaagctctttacagcgttgctgaaaatcagggatgctaaggagttttttgaagaaatacaaaataagaaggaagaattgcttgattacggggattatgcccatgatgtcaagaaattctttgatcccgaaggaaagcaaaaagagatcttcgacaaagggatgcgtatggtagagttatatgaaaaaaacaaaacttatgtcttggataaggcagctatagaactctatgaacagattgccaggattataaacagcaaggagccttacagtgaaatttacagattaccagatcttattgataagttcacaaaaagatttgctgaactgcttgaggaagaagccaagcccattaaacaagtagtcgaaagcgataaaaagaaagtcctggatgagttgtcttcatatgattttaaagataagtattatgaaaaattcagaaaaggttttgatgacctgctttacagattagatcatgcaaacaacttttatgaagtaattgccatgaaggaagaaagcgacaggcttaagcagcgctattttgaagaaatagctaatgaagttgaaaaacaaaagtattctcatggaggagcatcaattgttgccgaaacccctgaaggggtaataaaaccgccaaagcagaaaaaaattgtgaatataagtctttcacatctcctccacgggataagaaatatcgaatcaaaagaggatatagaaaaacttcttgacgaaatcagagcaaagcttgaaagtgaattagatgaaaataccataattaagattgtttaa

SEQ ID NO: 29 - DNA, 3612 bp, Chlorobium phaeobacteroides
atgactcttaagaccatttttaacaagccagttgaccgcccgattgaaggggtcatcaaagctgacgatgaagcaagccttcgcctcgaaattgaagaatacgtgctgaccaatgaagtcgagaagcggcttgagtctttcctggatgcttacaacaactacgaaggtgccaacggcgtttgggtttccggtttctttgggtccggtaaatcccacctgttgaagatgctggcgctcttgctcgaaaaccggcaaatcgacggggcctcctcacttgacctgttcctgccgaagtgtggtgacaacgaaatccttcgcggcgatctcaagcgagcggtcgccatcccgtcgaaaagtattctgttcaatatcgaccagaaagcggatgtcatcagcaagacccagatcgatgcgctccttgctgtttttgtcaaagtctttgacgagatgtgcggttactacggcaagcagggacacattgcccagttcgagcgcgacctcgacagccgtggcctctacgaacagttcaaatccgcctatgaatccatggcaggcagaacatggcaaaaaggccgcgaacaggccctgctggaggcgaaaaacatcgccaaagcctatgcccaggcaacgggtggcgacgagccgtcagctatgggaatactggataagtaccgcagccaataccgggtctccatcgaagattttgctgaacagataaacgcctatattgaacggcaatcgacccaggaaaatcaaaaagaattccgcttgaatttctttgtcgacgaggtcggtcagtatatcgccgaaaacgtcaagctcatgaccaacctccagaccattgccgaaagcctggccaccaaatgtcgaggccgcgcatgggtcgtcgtgaccgcccaggaagatatggggacagtcgtgggtgagatgggcaaacaacagggtaacgacttttcaaaaattcaggcacgatttgctaaccgcatgaagcttaccagcgccgatgtggcagaggtcattcaaaagcgcctgctgacgaaaaacgaagaaggcgttcgtctgctgtcggacatttatcacgcgcagtcgaacaactttaagaccctattcgattttgcggatgggtcccaaacctaccggaactttcaggatcgggatcacttcattcacagctacccgtttaccccgtaccaattctcactgttccagtcggccattcagaatctgtcgcagcataacgccttcgagggcaagcacagctcggtgggcgaacgatccatgctgggtgtgttccagcaggtggcgatccagatcggggatcatgaaattggccagttggcgacctttgacctgatgttcgaggggattcgcaccgcgctgaaatccaatatccagcgagccatcattcaggcggaaaaccatcttgacggtcccttcgcgatccgtctgttgaaaacgctcttcctggtcaaatacgtcaaggagttcaagccgactcttcggaatctgtgcgtcctgatgctggacggcttcaatcaggacttgcctgcactgcgaaagcgtgtcgaagaagccctcagccttctggaacagcagacctatgtgcagcgcaatggcgagatctacgaatacctcaccgacgaggaaaaagacgtcgaacaggaaatcaagaacaccgaggtggagtcgtcagacgtttccgccgagcttgagaagctcgtttttgaccacgtcatcaaacatcggaagattcgttacgacgagaacggccaggactacccgttctccagaaagctcgatgatcggttgcacgggcgggagtacgagctggctatccatgtcatcagcccgttccatgaaaacgccgaaagtgagtccatcctacggatgcagagcatgggccgggacgagctgctggtcctgatgcctgcggatgaacgcctggttcgcgacatcttgatgtacaagcggactgaaaaatacatccgccagaacatttcgatcacacagcaggaggcagtgaaacgcatcctgaccgacaaggacttccagaaccgggaacggtatgccgagctccagcagcgcgttcaaagcctgatgggtaagtccaagttattcatggcaggtgccgacatcgaaatcggttccgaagatgcgcagacccgggtgctgcgcgggttccatgaactcgtctctcgtgcatattcgaaccttcgtatgctgcgcggcatcacctacaccgagaacgacatcgccaaatgcctcaagcactcacagcaaggattgtttggcaacgatgccacctcccttgccgagtccgagcaggagcttttggccttcatccagagcaataaccggggcggcgtgcgtaccacgctgaaaaacctgctggagaaattcgagcgcaaaccttacggctggtactacgccgccgtgctttgcacgctggccaatctgtgcgctcgcggcaaggtcgaggttcgcaccgacggcaacctgcttgaagaagacgagctggaaaggacactgcgcaatacccatggccacggcaatgtagtgctggagccccaggtcgagttcaccgcgtcgcaggttcgagctctcaaggagttctttgaggacttcttcgatgccccgccccgcgccagtgaagcgaaggcgctcggcaaggaaaccggcaccgcgctccaggatctgacgcatcagctcaccccgcttgcagcacaggcatcccaatatccattcctgaatgcgctgacaccggtgcttgagaagctcaaggagctgaccggcaagccctatacctggtatctgaccgaactcacccgccaggaagtcgcgctgctcgacatgaaggaaagcgtcatcgatcctgtccgcaagttcatgagcggcccgcagaaaggcattttcgataacgcccgcaagttcgttcaaacccaggagcccaacttcgcctacatcgaagaagaggtgggaagtgggaagtgggaagtgagagaaggcgatcctgacgatgtttcttcgggggtcttgatagcgatattgaccgatccggaatgtttcaagggcaaccgcatgcagcaggttaagacgcaagtcgaaacgctgcaggaaaaagtcaacgcccagattgaggccgaaattgccaaagccaaggagacggttgccgccctcaaaggccgcctctgcggcatggatgaatttggcgcattgaatggcgatcagcaggagcagatcacccgtccgttcaacgaattcaacacggccattgagcgccagaagctgattgccgttatccgcgacaccctgcgccggtttgaggaaagcgactaccagcgccagctctcacagatgacaacctgggcgcaaccggcaccaacacccgaacctgccccggaacccggggaaaccggcacgccggatgaaggtacgaaacctacgccacccgtcaagctggaaccgcgcatcgagtatgtgcccagccgctcggtgaaggtctctttcgataaagcctggctggccgacgagaccgacgtggaacgctacctggaatccatgcgcgaggcgctgctggaagagatccgcaaaggaaaaaggattcaaatatga

SEQ ID NO: 30 - DNA, 3561 bp, Clostridium clariflavum
atgttaataaaagatatgtttaaaaaacctattgatagagatatcaagggtgttattaaggtaggacaggacgatgacagcaatgtacagcaggaacttgaagaatatgttgtcacgagggaactggcaaagcattttgacactttctttgaagcatacaaaaaaggaatagtaggtactactgacaaaatgggagtgtggatttccggtttctttggaagcggtaaatcccattttcttaaaatactttcctatcttcttgagaacagagaagttgaaggaaaaagagcaattgaatatttcaacgacaagatacaagacaaggtggttcttgctgatatgaaactggccggggacacttcagccgatgtaatcctatttaacatagattccaagagtgattctgattcaaaagccaacaaagatgccatagtaaaagtatttaataaagtattcaatgaaatgcagggtttttgtggctctatgccctggatagcagacttggaaagacagatggtaatagatggggtatatgaggattttaaaaagacctttaaagatatatcaggaagggaatgggtagatgcaagggaggatttctactatgaagaagatgccattgtagaagccctgtctaaaagtaccaagatgagtcctgaggcagcaaggaattggtatgcaaaagcagaagaaagttatactttaagcgttgaaaagtttgcaagacgagtaagagaatacatagaaagaaaaggcaagaaccaccacgttattttcctcgtagatgaaataggacaatatatcggagataattctcaactgatgctgaatcttcaaaccgttgtagaagatttgggaactgaatgcggtggcaaagcctgggttattgttacaagccagcaggatattgattctgttacaagagtaaaaggcaatgatttttccaagattcagggcaggtttaatacccgccttagcctttccagcgccaatgttgacgaagtaatcagaaaaagaatacttctaaaagatgatgtagtaaaggatacattaaaactcctttatgagaataaaaattccatacttaaaaatcttattactttctcagcagatacgccggagaaaaaggtatataaggatagtgaggattttgcagaatgctatccttttataccgtatcaattcaatcttcttcagcaagtgctgacttctataaggatacacggggcatccggtaagcatctggcagaaggggagcgctccatgattagttccttccaggagtctgccataaaatatatgaacagtgaagaaggaacattaatacccttttcagccttttatgataccattgaagccttccttgattccaatatcaggacggttattattcatgcccaggaaaatggcaatttgaatgattttgacgtagaattgttgaaagttctctttatgattaaatatgttaaggagatacctgcaaacatagaaaatctggctactctaatggtatctcatatagacgaggataagatagacctcaaaaagaaaatagaagaatctctaaagaggctggtaaaggaaacccttgtccaaaaaaatggagaccaatatatcttccttacccatgaagagcaggatattaatagggaaataaagaacattagtgtggatttgggagaggtaattcaaaaaatttccgaaatcgtctttgaggaaatctatccagataagaaatataaatattcttcaaggtacaactttagttttaaccaggttgtagacgatagatttttcagaggcaatcagggaaatgatattggtcttaaaattattaccccctattatgatactggagtagaacttacggataatgaactaaaactaatgactatgagggaaaataatttaattgttaaacttcccaatgatactactttccttgacgaaatggaagaagtattgaaaattgaaactttcctgcgtaggaaaggaggaacttcccttactcagaagattgaagaaatcaaggatagaaaaagaagggaacttgttgagcgcaaggaaagggtaaaattccttttgacggaggccatcaagaatgcggacatgtatgccaattcccaaaggcttgagattaagtcaaagcaccctgttgacaggataaatgatggtttcaaggtgcttattgaaggaatttatacgaaacttggctatattactcactttactactaccaaagacttatacgatatatttgcagataatgaacagattacattaaatggtgttgaagccccaaataaactggctcttgatgaaatggcaggttatattgagagaaatacaacaagaagtattcctgtaaccatgaaaacaatccttggcatatatggaaaagccccttatggatggcttgaggaggatattgaatggctggttgccaaactgtttaaggcacaggaaataaaactgcaattaaacagccagtaccttgatgttcaggatagggagattgtcaaatatcttaccaagagggattatgctgacaggcttcttattgaaaagaggataaaggtacctgcacaccagattagcaatgcgagggaactatgcaaagaactgttcaatattactgctgttccatctgacgaagatggacttatgagaagatttaaagaactagcaagggatgaaattgcaaaaatcaatgaattgctggtttattacaaacagtccaaatatcctggacaggatattttagaggaaggaaagaaaacattagaaaaggtctgcaaaatcaatgatgcaaaagaattttatgatgaacttcaaagagagaaagacatactactggattatgccgatgattccgtagatgttaaaagattttttgacagcaaccagaaggacttctttgacaaggcggttcacaagataaatgtatacaacagcaacaagacctatgtattggataaagaagtcatagacctggtagcacaaatgcagaaaattgttgaaagccgtgaaccatattccgatattcataaattgcccggccttattgacaagtttgtgtccaggtttacagaactgctggaagaggagtgcaaacctgtaagacaggtgattgagagtgattacagcaaggttcttgaggaattggataagtacgaattaaaacctgtactttttgacaggttcaaagccagattcgatgacctcttaaacaggttggagcgtgccaacaacttctatgaagccatagcaatgaaagaggaaagtgacaggcttaaactaaggtgttttgatgaaattgctgaggaacttgcaaaaaggaagcctgttgaacctccaacaacacctgaagaaccggacaagccaacagtaaaaaacgacccgccgaggaagtataaaaagacagtaaacatcagtattgccaacatcctgcatggcgcaaaaagtattgagagtgaagcggacatagaggatgttgtaaatgaaataaggaacaggctaaaaagagagttgaaagacgacgtcattattaaacttgtatga

SEQ ID NO: 31 - DNA, 3561 bp, Clostridium clariflavum
atgttcataaaggatatgtttaaaaagccgattgacagagacatcaagggtgtaatcaaagtgggtcaggatgatgatagcaatgtgaaacaggaacttgatgagtatgtagttacgagggaattgtcaaagcattttgacagtttctttgaggcatatagaaaagggatagcaggtactaccgataaaatgggagtctggatttccgggttctttggaagcggtaaatcccatttcctgaaaatactttcttatcttctcgaaaacagggaagttgaaggaaagagagccattgaatatttcaatgataaaatacaggatagtatggtatgggccaatatgaaactggccggagacacttcagccgatgttattctgtttaatatagattctaaaagtgactcggattctaaagccaacaaagactccattgtaaaagtttttaacaaggtatttaatgaaatgcagggcttttgcgggtccatgccctggatagcggaattggaaaggcaaatggtagttgacggtgtttatgaagatttcaaaaagacgtttaaagatatatcgggaagggaatggacggaggcaagggaggatttctactacgaagaggatgctattgtggaagcactggccaggagtaccaagatgagccatgaggcagcacggaattggtatgcaaaggcggaagagaattataccttaagtgttgataggtttgcaaaacgtgtaagggaatacatagaaagaaaaggcaacaaccaccatgtagtttttttggtggacgaaatagggcagtatatcggggataattcacagttgatgttaaatttgcagaccgtggtggaggacttaggaacggaatgcggcggtaaagcctgggttattgttacaagccaacaggatattgattcggttacaaaggtaaaaggaaatgatttctccaagattcagggcaggttcaacacacgtcttagtctctccagtgccaatgtggacgaggtaatccgaaagaggatacttttgaaggatgatgtggcaagggatacattgaaactcctctatgaagataaaagtgccatacttaaaaatcttattaccttttctgccgatacgccggagaaaaaggtatataaggatggtgaggattttgccgagtgttatccttttattccttatcaattcaatctccttcagcaggtattgacttccataaggatacatggagcttcaggaaaacatctggcagaaggggaacgctccatgatcagttccttccaggaatccgcaataaaatatatgaactgtgaagaaggaacattaatacccttttcagccttttacgataccgttgaagctttcctggattccaatatcagaactgttatcatccatgcgcaggaaaatgaaaatttaaatgactttgatgtggaacttttaaaggttctattcatgattaagtatgtcaaggagatacctgcaaacatagagaatctggctacccttatggtaagtcacatagacgaggataagatagatcttaaaaagaaaattgaagattccttgaggcgactggtaaaggaaacccttgtacaaaagaacggtgatcaatatatctttcttacccacgaagagcaggatatcaaccgggagatcaagagcatcagcgtggatttgggagaggttatacagaaggtttctgaaatagtctttgaggaaatctaccctgacaagaaatatagatattcatcaaagtacaacttcagttttaaccaggtagtggacgacagatttttcagaggcaatcagggaaatgacataggccttaaaattattactccctactatgataccggagaggaacttaccgataatgaactgaaattgatgtccatgagagagaacaatttaattgttaagcttcccaatgataccactttccttgacgagatggaggaagtactgaaaattgaaaccttcttaaggagaaaaggaggaacttccctgactcaaaagattgaagaaattaaggacagaaagagaagggaacttgtagaacgcaaagacagggtaaaaaggcttttgacagaggcaattgaaaatgcggacatgtatgccaattctcaaaggcttgagattaataaaaaagacccggttgaaaaaataaatgacggtttcaaggtgctaatagaaggaatttatacaaaactcggatatattaatttttttacctctgcaaaggatctttatgacatattcagtgataatgagcagattacattgaccggtgttgaagcaccgaacaagcttgccgttgaggaaatggcaggttacattgagagaaatacggcgagaaatattcctgttaccatgaaaacaatccttggcatatatgaaaaagctccttacggatggcttgaagaggatatagaatgggtgataggcaagttgtttaaagcccaggagataaagctgcagttaaacagccagtacctggatgttcaagaccgggatattgtcaagtatcttaccaagagggattatgccgacagacttcttgttgaaaagaggataaaggtacctgctcatcaaatcagcagtgccaaagaattgtgtaaggagttgttcaatatcactgctgttccttctgatgaggacgggcttatgaagaaatttaaggaactggcaaaggatgaaatttcaaaaatcgacaaattgctggtctattataaacagattaaatatcccggtaaggatattttagaagaaggaaagaataccttggaaaaagtttgcaaaatacaggatccgaaagaattctatgaagagcttcaaaaagagaaagatatactgttggattatgccgatgattctatagacgttaagaaatttttcgacagcaaccaaagagagttctttgacaaggctgttcacaaaataaatgtatacaacagtaacaagacttatgtgttggataaggaagttatagatctggtagaacagatgaaaaaaattgtggagagcagagagccttattccgatattcataaactgcccagtcttgttgacaggtttgtagttagatttactgaacttcttgaagtggaatgcaagcctgtaaggcaggtaatagaaaatgattacaggaaagtcattgatgagctgaataagtatgaatttaaagacgtgctttataataaatttaaaggtagatttgacgatctcttggacagactggaccatgccaataacttttatgaggcaatagccatgaaagaggaaagtgacaggcttaaattaagatgttttgatgatatttccgcagaaattgcaaaaataaaagcaccgacacagccaacggaacatcaggaccttggaagcccggaaatagtgaataatcctccgaagatatacaagaagactataaatatcagcattgccaacattctgcacggagcaaaaacaattgaaagtgaagcggacatagagaatgttgtaaatgaaatcaaaaacagattgaaaagtgaattgaaagacgacataataataaaacttgtttaa

SEQ ID NO: 32 - DNA, 3567 bp, Clostridium ljungdahlii
atggaacttaagaagatgttcttaaaggatatagaaagggatataaaaggagttattaaagtaggacaggatgatgactccgatatttttcaagaactagatgaatatgtagttacaaatgaattactaggacattttggtgacttctttgaagcatataaaaagggtatattagatcatacagataaaatgggagtttggatatcaggtttctttggttctggtaaatcacattttctaaaaatattatcatatttgcttgagaacagggtggtaaatggcaaaaaatctattgaatactttgataataaagtttacgatccaatggttgtggcagatatgaaacaggcaggggatattacagcagatgttattttatttaatattgattcaaagagtgaatcagattctaaggcagacaaagattccatattaaaagtatttaataaggtgtttaatgaaatgcaaggcttttgtggttctataccatgggttgcagatttagaaagacaaatggttaaagatgaagtgtatgaagattttaaggcagagtttgaaaagatatcagggagcagttgggaagattcaagagaagattttttctatgaggaagattctattgtagaggcattatctaaaactactaaaatgagtgaagaaacagcaagagattggtacaacaaagcagaagaaaattatagtttaagtatagagaagtttgctcaaagggttaaagaatatattgaaacaaaaggtaaaaatcatcatgtactttttttagtggatgagattggacaatacataggcagcgattctcagttaatgctaaatttgcaaacagtcgttgaagatttaggaacatactgtggtggtaaagcatgggttatcgttactagtcagcaagatatagactctgtaacaaaggtaaaaggaaacgattttagtaaaattcaaggcagatttaatactagattgtcactatcatctgcaaatgtagatgaagtaattaaaaagcgtatactacaaaaaaaaccaggagcagcagattcattgaaattgctgtatgaagataagtgttctatattaaaaaatttaataactttttcaaatgatacggctgaaatgaaagtatatgaaaacgaaaatgattttgccgaagtgtatccatttataccttatcagtttaatttacttcaatcggtatttacaggaattagaatacatggtgcatctggtaagcatttagctgaaggtgaaaggtcactacttagcgcatttcaagagtcatcaattaaatatgaaaatgaagaaatgggcgtattaataccattttcagcattttatgataccatagaatcatttttagatgctaatataaaaaccgtcataattcacgcaaaaaacaactcgaagcttaacgaggaagatgtagaagtattaaaacttttatttatgattaagtatgtaaaagaaataccttcaaatcttgaaaacatatctacattattagttaagcatatagatgatgataaattagagattaaaaagaaagtagaagaatcattaaagaaattagtaagacaaacccttattcaaaaaaatggagaagaatatatattcctaactcacgaagagcaggatgttaatagggaaattaagagtataacaattgatatgggagaagtcatacaaaaagttggtggaacaatatttgaagaaatttatactgaaaagaaatatagatattcttcaaaatatgatttcccatataatgcaatgatagatgacataccaagaggacagcaaaataatgaaattgggttaaaagtaattacaccttattttgaaacaggtatagatcttacccatcaagaattaaaattgatgtctgcaagagagaataatgtaattataaaattaccaaatgatacaacattcctagaagaaatggaagaaatattaaaaattcaagcatatctaagagtaaaaagtggtactgcatcaacacaggtcatagaggatataaaaactagaaaatcaagagaagtttctgaaagaaaagatagagttaaaaatctattaattgaagggttaaaaactgctgaaatgtttgcaaattcggagcttttggatattaaagaaaagaacccagttgaacgtataaatgatgcatttaagacattaatagatacgctatatagcaaactaaattatattaaggaatatatagatagttcaagagagttacaagatattctattaaacaataatgttcagggaagttttattgaagaaaaaaataagttagcaatagatgaagtaaatagttatattgaaagaaatacatcaagaaacattcctatgaccatgaaagggattataggattatattcaaaagccccctatggatgggtagaacttgatattgcagcaataataataaaattatttaaggctcaggaaataaagatagaatataatagtcagtatttaactactgatgatagggatgtagtaaaatatttaacaaagagggattatttagataaagtattagtcaagaagagagcaaaaactccagtaaaatatataactaatgttaaagaattatgtaaggaattatttaattattctgctgtgccggctgatgaagatggacttatgagtaggtttaaagacttaacacagggagaaatagcaagtataagagaactcctagtatattataagcaagcaaattatccaggtaaagatatacttgaggaaggaaagagaatttttgatgaagtaataagtataaaagatactatggagttttatgaaaaatgttatgagttaaaggatgactttttagattatgcagattattctgaggatgtaaaaaaattctttaagaatcaaaagaaattctttgatgatgctttagaaaaaattgaaatctataataaaaataagacttatgttttagatgaacaggctatagatttaatacaaaagattaatgagatagttagaagtaaagaaccatattctaagatacctcaattaccaggattgattgaagaattttcaaatagatttactgatttactagaagtagaatgtgagccagtaagaaaggtaattcaattagactgcgagaaagtattaaatgaacttagtttatatgaatttaaagatgaattaagtgccaagtttcaaaagagatttgatgatttgattagtagactagatagggctaacaatttctatgaagcaatagcaatgaaagaagaaagcgatagattaaaaatgcgttcttttgaagaaatatcaaaagaagtagaaagaagaaagccaccagtagtgccaaatccagaaccagttgtaggcggcggtgctgatataataaggggagaaaagcctccggtatataagataaagaaaacaaagaatataagcatagccaacatacttcatggagccaaaactatagaaactgaagctgatattgatgagttattaaaggatataaaagcaaagttaaagcaggaattaaatgaggataccagaataaaacttgtttaa

SEQ ID NO: 33 - DNA, 3624 bp, Clostridium saccharolyticum
atgtatgtaaagaatatgtttgcaaaagcgattgacagagatatcaaaggtgttattaaagttggacaaggcgatgatgaaaacgtaaggcaggagcttgaagaatatgttgttaccagagaactacagaagcattttgctgattttttctcgagctataagaaggggataacaggcaatacagataagatgggagtatggatttctggcttcttcggaagcggtaaatctcacttcttaaaaatactgtcttaccttttggaaaacagagttgtcgatgggaagactgctctcgattatttcattgaagatcgaaaaattaaggatgaaatggtgcttgcagatatgaaattagctgcaaatgtatcaagcgatatcatcctgtttaatatagactccaaaagcggcatggctgatgcgcagaataacaaagaggcgattctttccgtgttccttaaagtgtttaatcagcatctagggttctatggagcaaacccttttctggcagatcttgaaaggcatctgtccgatgaaggcaaatacgtggagttcaaaagtgtatttgctgaaatcagagggaaggaatgggaagcctcaaggcatcagttcagattcgtacaggatcaggtttgcaaaaccttagtacatattggctatatgagcatggaggctgctaaaaattggtgtgaaagctctacaggagcttataacattgatgtagcaacctttgcaaatatggtgaagcattatatcgacaagaagggtaacaaccatcatgtggttttccttgtggatgaaatcggtcagtatatcggtgaagactcaaagctgatgttaaatcttcaaacagtcactgaggatttaggttcagcatgtggtggtaaggcttgggtagtagtaacgagccagcaagacatcgatagtatcacaaaaacgaaagggaatgacttttcaaagattcagggcaggtttgacacaaggctatctctttcttctgcaaacgttgatgaagtaatccgaaaaagaattctcgagaaaactgagagtggaagacaaacactgggcctcctctatgatgaaaaagatacgataatcaaaaacctgattatatttaatgacggcattgaaaagaagctctactccgatagagttaatttctctgctgtttacccatttgttccgtatcagttcaaccttcttgccagtgtgcttacatcgattagaacacatggtgccagcggcaaacacttagctgagggtgaacgttctatgctggcattgttcaaagaatctgctgtgagaatcatggacaagtcagaaggaaccattgtgcccttcaatatgttttatgacgctcttgagcagttcttggatcatagtcacaagggtgttattatccgtgcctacgataatgagtatttaaatcctgataaagcagaggattgcttcgatgtaaatgtactaaagactttgtttatgattaagtatgtcaaagaagttgttgctaaccttgagaacatcacaagtttgatggtctcaagtattgatgaggatagaattgctctgaagagcaaagttgaagaggcattaaagcgacttgtaagacaaacgttgattcagaaaaatggagaaatctatgtgttccttacggatgaggaacaagaaatcaacagagaaattgaaagtcagaatgtagaaatctcagaagttgttggtaaggtatcagaattgatttttgatgggctttatgacgaaaagaaataccgttatccagcatttaacgggcggtatacttttgggttcaatcaattggttgatgataggccatataaggcaaatcaaaactttgatatttccttgaaaatactgactccaaattatgagatgggaacagatgaaacgactcttcgactgatgagtggacaaagtaaaagtgttctggtagttctccccgatgataaagcatttattgatgagattagaagtgcattgaaaattgaaaaatacttaagacttaatacatcaaatacagtatcaaagtacgagcagatcaaggaagcgaagagagtggagatgcgtgagagaagtggaaatgcacgaatctttcttgaacaatctcttagaagtgctgacatttatacgaatggagataaactgactattggtgcaaaggatattactgctcgcatcaatgaagctatgggcaagttagtcaacacgacattccataaactgtcatacatcgatgcggcaatgggtgaggctaacgttcgagcggttctgaaaggcacgaacaatagccaaatttcacttgaaggcacagtgcaaactcctaaccggcttgcactcaatgatgtgcttgatttcatcagtatgaattcaataagacatgcaaagacttcaatgaaggctattatggagcgttttacaaaaccaccgtacggattcattgaagacgatgttcaatggttggtagccaagctatttaaagatggtgatgttgctttctttgtgaataatgatgtggttactcttattacgaaaactgaggatgaagtataccgctacctaagccgtaaggagtatcttgaaaagctgctcacagaaaaaagagaaagagcaaacgataagcagaaaaaggccgtaagagatgttatgaaggaactcttcaatatcacgccttcaagcgatgaagatgatgcaatcctgaagagcttccagcagtatgcttcacacctgaagaatgatttagaaaaacttgaaatccactataaaaacgaaccaacctatccgggtaagaatgtcgttaaagaaggaaaatcattgcttttaaacttactggacatccagtattcatcagagttctttaaaacagtggatgaaaagcaggatgtgctcttagactttgctgaagactatgaaccaattaaaggcttctttaaaggggatcaaattgatatttggaaccgaagccttaaactcattaagatttacgatgatagtaaaactttcattgttaatgctgagatcgaatctgtcgtagaagaagttaaaagcatcatgaaaaaatctactccattcggtgaaatcagaaagattcccgagctgctggatcgctatacggatctatatagcagtatgttgaccgagatggagaagccgatttttgcttccataaaagaagctcgccagagagtaattgaggatctagattcaaaagaatgcaaagaatccttctcaaagaaggttgctgaacgttttgatgagctatataaaaaggctgaatcttgcaataacgtggcaacgctgcagaatattaaagtcgaagctgatgcactaaaagtacgtctgctaaatgagataggtgaagaagaagctcgacttatagctgcgagaaaaccgataactcttgtggttcctcctactggtggtgtaagtgatccgcctggaacatacgatttacctaaagttaaaaaacaaaagacggtgagtattaaaacaatcaataccgaagcaacatggagaatcgagactgaagcagatgtagagcgatatgtagacgcactcaaagccaaattgaagcagcggatccaagacgatattattctcaatgtagaattttag

SEQ ID NO: 34 - DNA, 3654 bp, Clostridium saccharolyticum
atgcagatcaaggacatgttccgaaagaaaattgaccgtgagatacagggcgttatcattgtcggtcagggtgaagaaacgaatgtagcgcaggagctggaagagtatgttgtgacccgtgagcttcagcgtcattttgcagatttctttgcagcatataaaaaaggtattcagggaaccacaccgaaaatgggtgtctggatttccggcttctttggaagtggtaaatctcatttcctgaaaattctgtcctatctgcttcagaataaacaggtcggagacaaacatgccatcgactactttatcgaagatcagaagattaccaatcagatggtgctggcagatatgcagctggcagcaaacaccccatcggacgtaattcttttcaacattgattccaaaagcgattctaatggcaaggaaaataaagatgccattgtgaacgtattcctgaaggttttcaatgagatgcagggcttctgcggttccatgccgcaccttgctgacctggagcgcaggctttccgaggaaggtcgttttgaagagtttaaggaaaagtttgaagaagagtatggcgatccgtgggaaagctctcgtcaggacttcgatttcattcaggattctgttgtcgatgttctttctgacatggatttcatgagcgaatcagctgcccgtaactggtgcgagaaagcaaccgagagctaccagatcagcattgaggattttgctaagcgtgtaaagtcttatattgataaaaaaggcaataaccaccatgttgttttccttgtggatgagatcggtcagtacattggcgatgattccaagctgatgctgaaccttcagacagtgacggaagaactgggcaaggagtgcatgggtaaggcttgggtaatcgtaacgagccagcaggatatcgactccattaccaaggtgaagggtaacgacttctccaagattcagggacgtttcgatacacgcctttctctgtcctctgccaatgtggacgctgttatcaaaaagcgtattctggataagacagagaccgcagcccagagcctgcgtctgctctatgaccagaaagcaaccatcatcaaaaatctgattgtcttcaacgacggtgtggagaaaaaactgtacgccaacgcagaagattttgctgaggtttatccttttgttccataccagtttaatttgcttgccagcgtgctgaccagtatccgtacccacggtgcatccggtaagcacctgtccgagggtgaacgttccatgctggctctgttcaaagagtctgccatgcagctgatggacgacgagatgggggcaatcgtgccgttctatcggttctatgatgcattggagaacttcctcgaccacagccacagcagcgtgatcatccgcgcttatgataacagctacatcaacccggaaaaaaaggaaaaagatgtctttgctatcaatgtgctgaagacccttttcctgattaaatatgttctggagatcgaagccaatgtggacaacatcgtcagcctgatgattatcagcattgacgatgatcgtatctctttgaaagcacaggtggaggacgcactgaaagtgctgatgcgccagatgctgattcagaagaatggctccatctatgtattcctgaccgatgaggaacaggaaattaacaacgaaatcgaaaaagaaaatgtggagatgccggaggtcatcacgaagatcgcggagatgatctatgaggacattttctccagtaagaagtatcagtaccccagctttggtggacggtatgcgttctccttcaatcagacagtggatgaccgcccctataaggcaaatcagaattacgatatcggcctccgtgtgctgaccccgtggtatgagggcggcaccgatgatggtacgctgcgcttgctctctggccagggcaaggaagttcttgtggttctgccgaatgatgatgcgttcctgacggaaatgcgggcatacttgaaaattgagcgattcctgcgcaagaatacttctgtgcagcttgccaagtatgagaccattaaggaagcaaagcgcgtagagatgcgggaacgcaacgggaacgccaagctttacctgacggaagctctgaaagaggctaccatctatgtcaatggcgatgtgctgcacacctccggcaaggaagtgaccagccgcatcaacgaggctatcggcagactggtgcagacggtttaccacaagctgtcctacatcgacgcagcgatgggcgaagcagacatccggaagatgttcaagaccagcaatcagctgtcgctggcactgggagataccggagaatccaatgtccatgcactggatgatgtactgcaattcgtggcaggtaactcccggatgcacatgaaaacttctatgaaaacgatcaaggatcgctttatgaaagcaccctatggctttgtggaagatgacatccattggctggtggcacggctctttaagcgtggagacctgtcctttacggtcaacggtgagagcatcaatctgaacaaccgttccgaagaggaaatcatcggctatatcacgaagaagcagttcgtggataagctgttgacggaagtgcgcgtccgtgtgccggaaaatcagaaaaaggccgtccgcaccgtgatgaaagagctgttcaaggtggcaccgcctgccgatgacgaagataccatcatgaagaacttccagcattactgcgagaatcgaatcaccgagattgagcggctggaaccgaaatatgagaattacgcctatcctggaaaagaaattctggaaaagggcaagaagcggctttctgcactggtacagattcaggcaccgctggaattctttaagaccgtatttgacgagcaggacgatctgatggattttggcgaggactatgagcctatccgtgatttcttcggcagtgagcagctgaccatcttcactcgtgcgctggatatgctgaatatctacgaggacagcaagacctacatcgtggatgcagaactggaagacgtggtggccaagatgcgcaccattgtccggatgccgaagccctacaaggagattccgaagctgccggagctgcgcgagaagtttatgaactgctatatgcgcattctggaagagcaggcagagccggtcaaggattccatcaatcaggatcggaaccgtgtctttgaagtgctgaacaccaagtcctataaggatgcgaagttcaaccgttatctggaactgtttaaggagatcatggatggtgcggagcactgcaataatgtttccactctgcgcagttatgcagataaggcggaggcactgaagctgcgcctgctcaacgagatgaacgcagaggacattcgccttgcgaaggaggcagcggcaaaggccgaggcagagcgcaagcgtcaggaagaagaggcaaaaaaacgcggcgagaccgtgaaaccggcagaaaaagtggcagaaccgcagccggtatataaggtgcgcaccacgaagaatgtttccatcaagacggttgctaagactgcatcgtggcggctggagagcaaggatgatgttgataaataccttgctgcattgcgtgaaaacctgctgaaagagatggacgaagatacaatcgtcaacattgaactataa

SEQ ID NO: 35 - DNA, 3645 bp, Clostridium sp.
atgcttgtaaaagatatgtttgccaagaagatcgaccgtgagattcagggtgtcatcattgttggccagggtgaagaaacaaacgtatcccaggaactggatgagtacgtagtcacacgagaattacagaagcattttgcagacttcttctccgcatataagaaaggaatcctcggaaccaccccgaagatgggcgtatggatctccggtttctttggaagtggtaaatctcacttcctgaagattctgtcctaccttctggagaacaaacaggttggagataaaaaggcgctcgatttctttgtggatgacaagaagatcgtcgacccgatggtgctggcagatatgaagctggcggcagaaacaccgacggatgtggttctctttaatatcgattccaagagtgataccggtagcaaacagaataaggatgccatcgttaatgttttcctgcgtgtcttcaacgagatgcagggattctgcggatcgcttccgcatctggcagatctggaacagcagcttactgaagccggacgtatggatgaattcaaagaggtatttgcggacgaatatggcaagccctgggaagagaaccgtcataagttcgacttcattcaggataccgtggttgacgttctcgttgatatggatttcatgagtgaatcggcagcgcggaactggtgcgagaaagcgtctgagccgtatcagatcagcattgaggatttcgctaagagagtaaaggcctacatcaatgcaaagggcaacaatcatcatgttgtcttcctggttgatgagatcggtcagtatatcggcgaggacagcaagctgatgttaaacctccagaccgtaacagaggaactggggaaagaatgccagggcaaggcctgggtcattgtgaccagccagcaggatattgattctgtcataaaggtcaagggcaatgacttttccaagattcagggacgctttgatacaagactgtccctgtcatctgcaaacgtagatgccgttattaaaaagagaattctggataagaccgatacagcggcgcagacattgcggctgctctatgatcagaaagcaaccatcatcaaaaacctgatcgtattcaatgatggtgtggaaaagaaattatatgcaaacggcagcgacttctctgaagtctatccgttcgtaccatatcagttcaaccttctggccagtgtgctgacctcgatccgtacacacggagcatccggcaaacatctgtctgaaggagaacgttctatgctggcgcttttcaaagagtcggcagccaaactgaaagacgaagagatgggcgtcatcgtaccgttccatctgttctatgatgcgctggagaacttcctggaccacagccaccggggcgtcattatccgtgcctatgacaacaccaagatcaatccggagcataaggagtccggtgtctttgccataaacgttctgaagacactgttcatgatcaaatatgtcctggagatcgaggcgaatatcgacaacatcacttccctgatgattagcaacatcgatgatgaccggattgagctgaagggaaaagtggaagaggctttgaagatcctgatgcagcagatgcttgtgcagaagaacggcagcctctatgtcttcctgacggatgaagagcaggagatcaatcgtgcgatcgacagccagaatgtcgagatggcggaagtgatcaataaagtctccgagatgatctttgaggatatcttcactgacaagaagtatcgttatccgtccttcaacggcagatattccttctccttcaatcaggcagtcgatgaccgtccgtataaggcgaaccagaactacgatatcggcctgcgaattctgacgccgtggtatgagggtggaaatgatgacgcgacgctgcgtatgatgtccggccagggcaaggaagtgctggtggttcttccaaatgatgcggcgttcctggatgagatccgacagtatctcaagatcgagaagtttctgcgccttaatacgtccacgcagctgaccaagtacgaaacgatcaaggaagcaaagcgcgtggagatgcgggagcgcaatgccaacgcaaagctgtatctgacagaagggctgaaggatgcgaccatctatgtcaatgccgatacggtcaagacgaatgcaaaggaagtcacaagccggatcaatgaagccatcggcagactggtgcagacggtttatcataagctgtcttatatcgacgcggtctttggtgaagctgatatctgcaagatgttccggacatccaaccagatgacacttgggctggaaggtggaacagacgcgaaccagcatgcgcttgacgatgttctggctttcattgccggaaacagccatatgcacatgaagacctctatgaaaacggtgaaagatcgtttcatgaaagcgccctatggatttgtggaagatgatgttcattggctggtagcgcggctctttaagcgcggagatctggcattcacggtgaatggagcaagcgtcaatctgaacaataagagcgatgaagagatcatcagctttattacaaagaaagcgttcgtagaaaagctcctcatggaagagcgtatccgtgtcgctgacaaggataagaaagaggtccgtgatgtcatgaaggaagtcttcggaaccggctctgtggccgaggacgaagacaccatcatgaagaatttccaacgatatgcagagaatacgatccatgagatccagcgtctcgaaccccagtatcagagatttgcatatccgggcaagaaggtgatggaatccggcaagaagctgatgcagtccgtgatccagatccagtctccgctggaattctttcagtacgtttcaaagatgcgggagaccttctatgactttgcagaagattatgagcctgtgaaatccttctttggaagtgaacagcaggagattttcacgcgggcactggagatgctggcgatctatgacgacagcaagacctatatcgtagacacggagttggaagagattgttcatgagatgcggtctattaccagacaggataagccgtatggtaacatcccgaagcttccgaacctgcgggaacagttcatgacttcttacatgaaggtactggacaaagaggaaaagccggttctggacgcaattgaacaggcgagagcgcgtgtcatcgaggtgttggaaccaaaagaatacaaagatacctatctcggccgttacaatacgctgttcaaagaaatccgggatggggccgaacattgtaacaatgtttcttcgctccgcagttacgccgataaggcagaagcactgaagatccgtcttctaaatgagatggataccagagatgagcagatcctcaaaataaaagcagaagaagcaaggcgtgcagcagaggaagctgccagaatagcaaaagagcagggcaagcctgcctgccgtatcgcagagcctcctgctccataccatacgaagaaaaccaagaatgtgaccattaagcatgtgacacacacatcttcgtggagattagagagcaaagacgatgtagataaatacttgaatgcactccgcaaatcactccttgcggaactggatgaaaatgacattgtaaacgtggagttttaa

SEQ ID NO: 36 - DNA, 3645 bp, Cupriavidus necator
atgaccatccgctcactcttcgacccaagcaaggacatctaccggaccatcgagaaggtcatcacctacggcgtctcgcaggaaggccgcctcaaggctgagatctccgagtatgtggtcaccgaaagcatcgaggagcagttccgcaagctgcttgatcggatgcagctggcgatggaatcgggtggcgagaacgaagttggagtctgggtctctggcttctacggatcaggtaagagctcgttcaccaagtatctcggattggccttcgatgatcagcgcaccatcgatggcacgccgttcattaagtacctgcaggaccgcctgcataagccgcaaaccaaggccctgctgaacaccgtagcgcagcggttcccggcggccgtggtcatgctggacctggcgagcgaaatgctcgcaggcgccacgatggaagacgtctccaccgtcctctatttcaaagtgctccagtgggccggttactcgcgaaacctcaaggttgccgcctttgagcgcatggttgaaaaggatggtcgcacccctgagctacatgatcgcatcgcccaggccctgccgggtgcgacctgggcaagggttcaaaacaacccgctcgccatcgacgggctaatccctaagatcgcccatgagatgtatctggggcttttcccggaggccaaatcgttctcctccagtaccgaaggcttcttccagttcgaagaccagcgcgtgcaagaaatgatcgacattgtccgcgagaagagcggcaagcagaacatcatcttcatcgtcgacgaagtcggacagtacgtggcctcgcgtgacaacctgatcctcaacctcgatggcctggccaagaatctcaagcgcttgggcgacggcaaggcctggatcgtctccactgcgcagcaaacgctcactgaagacgacccacgcgcggcgctgaactcggacaagctctacaagctcaaggatcgcttcccgattcagatcgaccttgaatcgagcgatatcaaagagatctgctaccgccgtctgctcggcaaatcgccagctggcgagaccgagctgggcaagctgttcgatgcccacggccaagcgctgcggcataacaccaagctgcaggacgctaagtattatgacgcggacttcagcaaggagagctttaccaatctctacccgttcctgccggctcacttcgacattcttctgcacctactgggcgccttggccaagtccaccggcggcatcggcctacgctctgccatcaaggtgatccaggacgtcctcaagggcgagggcggcggctccaaggcaatggccgatcagcccgtgggttggctcgcgacgaccgtcacgttgtatgacgagctggaaaaggacatccgccgggcattcccgtcgatccatcaggctgtcggcaaagttcagattcgcttctccgactcgactctgcatcaggacatcgctaagacggttgccgtactgcaaattctgggcaacttgccggtatcggtacaaaacgttgccagcttgatgcacccgttggtcactgcatcctcgcagctcgacacggtgaagaaagctgtggaagacatgctcagtgacgtgcatgtgcccctcggcgagaaagatggcagcctcggcttcctcagcgagaaactgcgcgacatcgcgcaagagcgtggtgccattgcactgcgtaccgtcgatgtgaagcgcatcttcaacgatgcattgcgcgaatcctttgacccgctaccccgcgtcagcctccacggcacgatggccgttgcgacaggcttgaaggtccaagccggcagcgccatcaccagcctggctgctgatcagagcaccattcaaaccgtcgtagaactggtaccggctagtgaatacgagaccgccaagaaccgcatattggacgactcccgcagccgcgcgggccgcaacgtcatcgggctattggcccgctccaacaccgagctggacgatctggccaacgaaatctatcgctgccagcgcatcgccgaactgcaccgaaacgagcccgaccaggaggtcaaagattactgtaccggccagcttgaacgtgcagccaaactcgcgacccaactccagagcaagatcaaacaaagcctgcaggccggctcgtttgtgttccgtggccaggccacggcggtctcagcgctggatgccgacctgctggaagcggccaagaagctgctcgccgatgtggctgaccaggtgttcgaccgctatgtggaagcaccggtgcgcgcaggcaccgacacggccgagaaattcctgaaagtcgccaaccccgccgcaatcggcagcagccttgacccgctcggcctggttcagacggtcgccggccgcgcctcgttcaagaccgatcacaaggcgatgatcagcatccgcgactacatcgacaagcgcggaacggtcgatggcaagcgcctgctcgacgatttcagcagcgatccgttcggctggtcacccgatacgacacgctacatcgtggccgccatgctcatggccggtgaaatcaagctcaaggtatctggccgagaagtgactgctgcaggccagcaggcgatcgatgccctgaagaccaacaactccttcaagcagatcggtgttgcgctgcgcgacgagcgtccttccatcgaaacccttggtcgggcagcggagcggctcaccgaactggtcggtgacatggtcttcccgcttgagcaagagatcagcaaagcggcggcaaagtacttcccgcgctttcagcatgactatggttctctcgccgaaaagctcgccggacttgggctggcgggagcggagcgcgttcgcaccttgaatcaggatatcgccgacgtcctgttcaccgatgcctcggacgccccccagcgcctgggcgccgaaacctctgccatctacgacaacctgaagtgggcgctagatgtcaagcgcgcactcgacaacgggctcgacgtcaccttgcgggatttgcaagcccatcgccgcgacatcgagtcgctgcccgacaccggcgtgccgggagagctgcgtcgcgaactcgcagaagacctgggagcccttgcggagcgcctgggcaaagaggacttctacaagcacaccgccgacttcaactcgcagctcacccacctgaagggccgcgtgcgtgatgcggtcatttcactatccgaccagcaaaagctgcgcctgaaggaaggcgttgaagatctccagcgctttcctgagtgggaagaactcacccaagaagaacgcggcaacgctgtgaaccagctggatggcctcatcttggccaccacccaagatctggcgggtcttaaaaagctgctggcccgcgattacgacatcaacagcacactggaggacttgaaacgttccatccaacgccagggccaagaacgcttgcgccagcgaatagaagaagagcgtgccaagacgggcgagaaaggtccggcgaagctcaccaaatcgatcgctgtgccggtgaagatgacatcggcagctgacattgatgcactgatccagcagctccatgaaatcaaggcacagctcggcctctatgccgaaatcgaagtgtcgttcgtcgtcggcgctcagcctggaacggatggagcctga

SEQ ID NO: 37 - DNA, 3507 bp, Cyanothece sp.
atgcagttacatgagatttttaagaaacaagttgatcgtcctattgaaggtgtaatcaaagcggatgcaaatgatgaggttagtctgcacgttgaactcgaagaatatgttctcacccatgaggttgaaaaacgcttagaggagtttttgtcagcttataacaattatacaggggttaatggggtttggatatcgggcttttttggctctggtaagtcccacttattaaaaatcttggcactattgttagaagatcgcagggtagaaaatagccaagtaattgacaaatttttgcccaaatgtcagaacaacgaaattctcaaaggagacttgagacgagcagttacaattccctctaaaagtattttgtttaatattgatcaaaaggcagatgtcaccagtaaaacagaatttgatgctttattatcggtttttgtcaaggttttcaatgaagcgcgtggttattatggaaaacagggctatattgctcagtttgaaaaagaattagatgagcgggggttatatgtcgcttttaaaacagagtatgaatccgttgccggaaaaccttgggaacgaggacgagaacaagtcattttagaaaagagaaatattgcgatcgcctatgaaaaagtgacgggtgcatctgtggaagattctatgaatattctagatttatatcgtcaagattataaactttctattgatgatttttcccaagatgtaaaagcgtttattgaacagcaatcttctaattttagactgaatttttttgtagatgaggtcggacaatatattgcagataatgttaaattaatgactaatttacaaacaattacggagagtttagcgacgaaatgtcaaggtcgttcttgggtgattgtcactgcgcaagaagacatggaaatggtattaggagaaatgggaaatcatcaaactaaggatttttctaaaattcaagatcgttttgccaatcgcatgaaattaaccagtcgggatgtggctgaagttattcagaaacgtctactgatgaaaaatgaggcgggagttagacatcttgccgatatttttgagcaacaacagcataatttacctactttgcttcgtttttctgatggctcaaaggagtacagtaatttccaagatcaagaccattttatccagtgttatccttttattccctatcagtttacccttttccagtctgctattcggggactctctcaacataatgcgtttgaaggaaaacatagttcagtgggagaacgatctatgttggcggttttccaaaaggtggccatggaaattcagactcaggaaattggttgtctagctacctttgatttaatgtttcaagggatttgttcgaccttaaaatctaatattcagagtggtattattctcgcggaagataatcttaataatccttttgctgtccgtcttctcaaggcattatttctggttaaatatgtagacggatttaaggctaatttacataatttatcgatcctcatgttagaggaatttgagcaggatatttccgacttacgaaatcgagttcaagaatcgttaaacttgctagaacagcaaacctatattcagcgaacaggggacttatatgaatatttaacggacaaggaaaaagatgttgagcaggagattaaaaatacggaagtagaagtagctaaggttttagaagcgttaaatactttaatttttgatgagattattaaaaccgcaaaaattcgcaatggggaagggacacaagattatccttactctcgtaagattgatgggacgctttataaacgggaatatgagttaggtattcaagtcattacgcctttttcggggcaacatgagcaagaaaaggccttacagatggagaatatgggacgggatgagttattaattattattccttctgatgaccgtttggtgagtgatttaatgatgtataaaagaacggaaaaatatgttcaacagaatatttcagtgactcaacaggaagcagttaaaagtattttaacgcaaaaaaatcaaagtaatcagcaacgttatggcgagattaaaaatagggttaaaagtttattaggaaaagccaagttatttgtggcaggaacagagttggaaattagtagtaatgacgctcaaaatcgtattattttagggtttcaggagttaattacccgtgtctatccccattttaaaatgttagcgggggtgaattataaagcagaacaagttcagcattttctggaacagtctcaagatagtttatttagtaacgatgtaacggttgtaagtgaaccggaaaaagaggttttgagctttgctcaaatgaatcagaaacgggggttgcgtacttctatgaagtctctgagtgataattttcaacgtaaaccctatgggtggagtgagggggcgattttatgtatggtagctaaactttgtgctagagggaagttagaagtgcaaacggagggtaatttgttagaaggggaggcattagttgaggctatttctaactctcgtaatcatagtaatgttttattacagccacagcaagaatttacgccgtcacaggtacgaaaacttaaggatttttatggggaattttttgctcaaccttgtggagataatgaacccaaagctatttatcagaaaacaaaagaaggatttaaggaactgagtcaatttattaaagaacggttattagaaagggaaaaatatccttttttatcggctttagaatctgtcctgcaaaccctcaatgatgtatttaataagccttatgattggtatcttacagatttaactgatcaagaggatgagttattggatcttaaggagtatgtaatagatcccattcggagttttatgcaggggggacaaaaacagatttatgatcaggctaaacagttattagagtctcaaaagcccaattttagttatattaatggtgataatgtatctcaaatgagaacggttctcgcagatccccaatgcttcaagggaaaccagatgcagcaggttaaggggttagtggagtcgataaccgcagaaatctctagtcaagttaagacagaagtggaacaagcacagggagagattaagggtttacaagcgcgaatgagtaatatggcggagttttcccaactttctgcggcacaacagcaagaaatccttcaattttttcagcattgttatgattctattgctcaagaacatttgatcgctgtaattcgcagtacccgtcagcagtttgaaacggatacctatcctcagttactctcaaaaatgacgaatttgacgggggtttatggggtttcatcgggaggaaaaagtcgggttaaggagtcagaaacccaatatgtaccgagtcaagggattaaggttaattttgggaaggcatggctggcagatgaggcagatgtggaggattatttagtagcgatgcgtgaggctttaatggcagaaattaaacaaggtaaacggattcaaatttga

SEQ ID NO: 38 - DNA, 3687 bp, Dehalococcoides sp.
atgagcgaaaccattagacaattattctctccacggcgaccaatcgaccggacaatcgagaaagtcatcgactattacgcacaagaagatgatcgcttagctcgtgaggttgcagagtatgaggtcacagataacatcgagtcatgcttccgtaagtttcttgatgttttcagtgaaggagtccaaggcgggcaggtgaccgaggtcgggatatgggtgtctggtttctacggaagtggaaaaagttcgtttaccaaatatttgggtgcgtctctcgacccaacacggacagttcaaggcaaacctttcttcgagctgctatgtgatcgttttcctcggaatgaaatcccggccgctctaaggactgtgtccaaaaaacatccagctgcggttgtgtttcttgatcttggcgccgagcaacttgccgaaagtgccgcggccccggtctccaccgttctttattggaaggtattgcagtgggctggcttttctaaggaaaaaaagacagcgcaacttgagttcacgctcgaccgtcgtggaaagtatgatgagttcaagaagaaatacggggtacgatacaaagggaaatgggaggacatccataacgatccactgatcggcgtagccagggcatccgagatcgtaccggaggtgcttcctgatgacttccctacacctgatagtttccgtggtcttcggttcgaggaagcccgagacatacgagacctaacgcgtgagattattgatatttgtagacgcaagaccgggcatgaaaacatagtgcttctaattgacgaggctggccagtacgtcgctctgcgtggcgagctgattctcaacctcgacggattagcacgtaacctcaaagaacttggcaggggtaaagtctggatcgccgctacgggccagcagaccttaagtgaaatcgttgaaaaggccgcccataattctgcagaactaactaagctgagagatcgtttcccgatttccatccatttggacgcgagcgatatacgagaaatcacccaccgtcggctgctggacaaatcagaggagggacgtaaaatactcgacgccctgttcaaggaacacggtcaatcagctgttacgcatacacgtctcagcggtaccgcattgttcaagggcgatcctgattcccagacttttacacgtctctatccgtttctgccacaacattttgatctcctgttggaacttattcatgcccttgcccgatccactggtggcattggcctgcgctcggccatccgcgtcattcaggacgttctggtagacaagagccgagttctaggtgccgacactgtcaagctcgccgatcgtgaaataggcactttggcctgcgtggacgatttttatgacaccctgcgtgctgacatcgcaaaggtcttacctcacgttatcgtcgatgttgataagacgataaagattttcggcgcaaattctcttgaaacgcgtgtcgccaaagccgtagcggccctgcagccggtggagaacttcccccgcacgcccgagaacatcgccgctctgctttataggaaaataggatctcctcccttgctcgaccaagttcgcgaatctcttcgtacgctcatctctgagaaggaatgtggactaatcgaagatccacaggccggcggatatgtcttcttgagtgatgccgtcaagccgatccgcgacaagcgcaacggctacgtgcccacttccggggagtgtgctcgtgctatgattgacgtactaaagcagggtactgctgaccacgcgatgttcagggttcagcccacggcgagattggaaaacattaaggaagtccgatcatcggtgaaactcggacgtacgcttgtggtcggtggttccgaggatgtcgagctccgtctggagttcgttgatcccggcctttgggacggtagacggagcgaattcctggtttccaccaacactcagattgagttgaagaatacggtagtcttactcgtccggaatgatgatacagtggatgaactcctaccggagattgtgcgctcggaaaaagttctcggcgaagttgacgaacggggtgccgaccaagtcgtggcccagtaccttagagccgagcgtcgggcggctgaacgtagtcgcgaacgggttgccaccgccatggagaaagccatgttgggaagcatattcatcttccgtggcaaaccaactcccgtacgggaaactggtgagacgttggactcatcagtccgtgccgttctctctggcgcagttaaggaaatctttccccacttccatctagcgcccgtccgaccttccaccgacgaggccgccaacttccttggcgtggagcgcatggatcgtattactaaggacctcgatccgctcggtcttgtagttaaaagcaaaggcgcgccaagggtggataccgaagccccggttctcgccgaggtgctacgtgttttccgttccaaggccacagagtcaggttcagggagactccaaggaggctaccttcaagacttgttctcggcgccaccctatggctggaccaaagacacgatacgatacctattcgctgccttgttgcgtgctggtgaaatcgaattccacgttccaggggcaggcggtgcagtacgtaccgctggtccccaggccgttgaggcagttaaaagcacggtatcgtttaaccggatcggagtatcatcccgtgatgcgaaacttccacctgaggctcttgatagagctgctcgacgactcgaaaccctcttcggtgatgaagttctgccactggaagaccacataagccgttccgttcgaagccatgttcccgacttactagaaaggataggagcactgcctgaccgcttacgtttgctaggtcttcccggtgaaagcaggtcgcagcggttgctggcagacgcggccgacctgctgaagggcgatgctggtggcgccgctgcggttttaggcggcgtcgaatgtgtcttaccagccgaaattacctgggcaaaggctatctttgatgccctacaatccggtgcagaagctgatgttcgaaacgcgaggtcagtcttggactccacatcagatttggaacaactctttcctggttccacgaatgaactattgaatccaatggacagggcggtggccgaggatgttctttcgtccgatcgctttcatgaacgactgcctgaactgcgcggtgtgatccgtgcaacattggatcgtacggaaaatagatacgccaccgacctggcggagtacagggatgatcttaatcaagccctcactttgcttgaggccgaaccagattggattaggcttcttgatgaagaccgggcggatattgccgctaagcttgcgtgcgatctccccacgaccgttgaaaacggtgattgtgtgagacagctgcaaacattgcttgtgcggaggcggacgctgccggggctagttgaggatttgaaaactgaaataaaacacagacggccagccgaaccggaacccgagcccgaaccgggaaagaaaggcaaaaaatcgcctgtagatgaaattgttgaagccggttctctgatgcagccggcggtgatcgcctcagcggaggaactggattcatggctggctggtattcgtgagaagctggtcgctctattaaaatcgaacaagcggataaggatcaaggggcgctga

SEQ ID NO: 39 - DNA, 3627 bp, Dehalogenimonas lykanthroporepellens
atgtcaattcaaattaaagaactgtttgatccggccaaggatatctaccggacaatcgaaaaagtcatcacttatagcgcgtctcaagaggcgcggcttaagtctgaaatcaccgaatacatcgtcaccgatagcatcgaagagcagttcgaacggctgctgacacgcatgcaggcggcaatggagatgggtggcgagaatgaggtcggtgtttgggtctcagggttctatggctcgggtaaaagttcattcacgaaatacctggggcttgcccttgacgaaagcgtagcgattgagggcacgccgtttctcaagtatctccaggacaggctcaataagtctcagacccgggcgcaattggcggcgctggccagcaggcattctgcagctgtcgtgcttcttgatctggccagtgaaatgctggccggggccaccatggaggacgtatcgaccgtcctttattacaaggtgttgcagtgggctggttattcccgaaatctcaaggttgcggcatttgagcggcgacttcagaaggacagtcgttatgaagagttcacgaaccgcattcagaatgaattagagacgccgtggaaggaagtgcaaaacgatccgctggtgatcgacagcctgattcctgagattgcccatgagatgtacccgcagctttttaaatcatcgacggctttcagtacggaaacgaccgatttcgtaaggtttgagaatgagcgcgtcaaggaaatgctcgatattgttcgcgagacaacgggcaaggaatttgttgtgttcatcatcgacgaggttggtcagtacgtcggttcacggcaaaatctcattctcaaccttgacggcctggccaagaatctgaaagccattggcgaagggaatgcgtggatcatcggtacggctcagcagaccctgactgaggacgatccgcgtgcggccctcaactctcccgagctgtacaaactcaaagaccgctttcccattcaaatcgaccttgaatccagcgatatcaaggaaatttgctatcgtcgtcttctcggcaaatccccgggcggtcagcaggaactcgaagggcttttcgataagtttggccaggcattgcgccacaataccaaactgcaggacgcccgctattacgactcagatttcgacaagaccaccttcgtcaacctgtatccattcttgcctgcccatttcgacatcctgttgcacctcttgggtgcgctggccaagtccaccggcggtatcggcctgcgctcagccatcaaggtcattcaggatattctggttgaaggcccggacgatcaggaaccggttgccaataggcccgttggttggctggcgaccacggtcacgctctacgatgcccttgaaaaagacattcgtcgcgcttttccatccgttcataaggcggtcgggaaggttaaaatccgcttcaccggttcgcaactccatctggaagtcgccaagacagtggctgtgctgcaggtgctcggcaacatgccggtaacggcccaaaatgtcgccagcctcatgcatgccggtatcgatgcaccctcgcaacgcgacaaggtggatgccgccattgcagaacttatcaacgatgccatcgtgccgttcggagaaaaggatggaaacctctgcttcttcagtgagaagttgaacgatatcgaccaggagcgagcccagatccctttgcggtctatcgagacgcggcgcattcataacgaagcgctccgtgacgccttcagccctctaccttcgacgcgactgcacggatcactggccgttaccaccgggctcaaggccatggtgggttcgatggtgtcacctcttgcaggcgagcgagaaaccatccagacactggtggagtttgtcgccccccaagactatgacacggcccgaacccggcttattgaagaatcccgtcagcgcagtgcccaaaacaccatctacctgcttggtagaacctcttcggatatcgatgacaagatcgctgaaatttatcggtgccgagaaatccatcagcgctatcgaaacgacccggacgccgaagtcaaggagtactgcgcggcccagaccgaccgtgccaccaagttgaccggcgagcttgaacacttgctgaaacgttgcttgtcgcaggggtcatttgtttttcgtggtcaaacgacagccgtcgatagtgtcaatccggatgtgatcgatgccaccaaaaagcatctaagcaatgtcgccgagcaagtttttgaccgctatggcgaagctcctgtccgggcggagacggcattggccgaaaagtttctccgggttggaaacctcaaagccgtcagttcagcggttgatcctttggggctcgttcaggtttccggagggacgccacatatcaaaaccgaccataaggcagtagtcagcattcgcgattacattgaccgtctgggcacggtcgaaggaaagcgaatgctcgagcactttactgatgcgccgttcggctggtcgcaggataccttgcgctacctcgtcgccgccatgctggttgccggagaaatcaaaataaaggtctccgggcgagaggtgacggtcaatggccaacaggccatcgatgcgctccgtaccaacaattcgtttaaggtcgttggcgtatcactgcgcgacgagcggccatcaaacgaagtcctggcccgggccgcaacgcgcctgaccgacctggttggcgatacggttattcctttagaggacgaaatcagcaagaccgcgacgaagcaatttcccaagtttcagcatcagttcggaccactggcggaaaaattggatgccctgggcctgccgggtggcgatgtgatccgttctcttaaccaggacctggcggatgtactgttgacggacgcgtctgatgcaccgcaacggttgggcagtgaagagtcacctctttatgacgggttgaagtgggccaccgaggtcgaccgggcgttaaaaaacggcctggagcaaaccgtgcgggagcttcagcaacatcgtcgcgacatcgaagctctgcccgatacgggagttcccgggaagctccgccaggatttagccgatgaactgacccaggtgggagagcgcctttcgcgagacgattttcattcccacttagcggatctgagcacctctcttacggcaatcaaggggtgtgcacgggatgccgccattgaaatggcaaaaacacagcgaaccgccattaaagatgcggcggatgagcttcagcgtttacctcagtggtcagaattgggtcgcgatgaacagtcgcaggttcttaatcaaattgacggcatcaccgttgaaagcaccgaggaccttgccggaatcaaaaagctgctcaatcagtcattcgttgttcgctcgcagattgacgacattcgcgacggaatcatcaaaaccgcccacgaacggcagatgtcccggcttgaagaagagcgcaaagaggccaaaaaggccgggcaaaccaagctctcccgaagtgtgaacatccctgcgaccattagtagtgctgccgatctggaagagctgatccgttctcttcaggccctcaaagccgagctggcagtctacagcgatatcgaagtcaccatcaagattgagagttag

SEQ ID NO: 40 - DNA, 3519 bp, Desulfitobacterium hafniense
atgaagattcagaatatgttccaaaaggacattaatcgcgatattaatggcgtgatcaaagtggcccaggatgacgagcaaagcctggtacaggaactcggcgagtatatcatcaccaaggaactccgccgccacttcaatacttttttcgataactactccaaagctatcgatcaccccactgacaaaattggggtctggatttcgggcttctttggcagcggtaaatcccacttcctaaaaatgctatcctaccttctgtcgaacgctaaagttggcgacagaacggccgtggatttcttcaaagacaagttcgatgaccccatgatgtacgccacagtcgtccgctgcacgaatatccccacggagtctatcctctttaacatcgacatcgagggacccattaacaaagataaaacggcagtcttaagggttttcgccaaggtgttctacaaccatcttggcttctacggcgaggatttgaaaatagcgaaacttgaacgcttcgttgacaagcagggcaaaaccgaggccttccgcagagcatttgaagaggttaacagcgcaacctggttggagagccgctcttcatatgcgttcttcgaagatgacatcgtgtccgtcctgcaaagtgtcctcggcatgagcgaaattgcagcccgcaactggtttaacggtgaagaaaatactgatatgagcattaagcagttggttgaggaaatcaaatcctatgttgatggcaagggtaaggacttccgtcttcttttttgcgtggatgaggttggacaatacatcggtgacgacggtgacctgatgatcaacttgcaatctattgtcgaggaagtcggcagcaagtgccgaggcaaagtatgggtcatggtcacgagccaggaagctatcgattccgtggtgaaaatcagcggcgacgatttctcaaagattcaggggcgtttcaacacccgcctgtccctgtcttctgcttcggtggacgaggttataaaaaaaaggatcctcgaaaaaactgaagatgccgataggcttctgcgtcttgtatatgacaaagaacacgccgtcctgaaaaatctctttacctttaataactcagtcatggacatcaaaggttacgcggacagcgcggagttttcctctacatacccatttgtgccttaccagttcatcattattcaaaaagttctcgctgagatacgcaagcacggcaatgccggaaaacatctctcgggcggcgagcgttctatgctatccgggttccaagaggcagcccagaaggtacagggccaagatgagaatactatcgtgcctttcgcgcagttctacgacacggtacataccttccttgaaagcccgatacgccgcgtcattgatcgctcccagaccgccgcggataaacatgacggcttagagcagcgtgacgtaagtgttttaaagctgctttatctggtacgctacatcgatgatattaaagcgaatattgacaatatcgccattctcatggtggatgacatccgcacggacaaaataaatcttcgccgtgaaatagcatcgtcgctggagcgtttggtagcgcagaattatgtcgcacgccatggcgacacctactcttttttaacggacgaggagcaggacatcgccatcgacatccgcaatacggctgttgacagcgggaccatcgttgcgagcatcgggcagacgatattttccgaaatataccctgccaagaaatacaagtacaataagtacgacttcccctacgaccaatatatcgatgagactcttgtcggtgcggccaccggcggtgttcgcctgcgcttcgtcaccgttgccagcgactattacaatgcccctgaagccaagctgatcatggattcccaggccaacaacgaagcgattgtcctgctgtcaagcgcggtgcaatacttcgaagaactcgaaacagctgccaagattcgtaaatacatcaagcagaagaacgtgtctcagttgtcggaaagcatacaggatattatccgcaaacgtcaggcacaggcccggatccttgaagaaagcgctaagaagcagatagaaaaggctatcgtggacggcatattctttgtctacggcgagaaggtcgatataaaatacggcgaggcaagaagtaagcttgacgaagccttgaaacaattgatagagagtgtctattccaagctaaaccttgtgaatgtgttcagggaaagcgatgctgatattctgcaagtccttaacggagagatggaacaagtgggctttgcaggtcatggagcaaataacgagtttgccctcaatgaggtaagccagtggctggaggaacgctatataagtcacgttcccgtttccatgggtgacgtacagcgacgttatcaggccataccctatggttggcgcgaggtcgacatcgccgccattatcgccagacttatcgtttcccaaaagattgaaatccgctatggcggcgccgttgtgagcaaggacgaccgaaaccttgtcggctatctgcgcaaaaaatcagaaatagataaggctaacgtgagccgcagaatcgcacccagcgaggaactgatgcgtaagagcatcactttcctgcgtaactggctcggacagatgggtatccccgaggacgaggacggtctcattaacttcgtgaaagacacacttgaaccgaaacttgctcactacgaaaaactcattgacgaatacaatcacgaccgttacccgcaaaaagacgtagtcaccactgcccgcgacctgattagggatatcctttcccagaagagggataatgttgctcttcttacacgtttgatggcaaggcaggatgacctttatgatagttccgaagatatggaggaagtcgagacgttctttaagtcccaacgagttatatttgacgcggccagacagctggaacgagatttgcaaaatgaaggtgagtactttgtcacagatgctgacgccaccgaaaagattaaggagatatcctctatccttgagatggcgaagccctacgctaggataaaggacctcaccgacctgatgcagggggtgaagaccgcctacggaatgctccttgcccagaagaaggaggaagtccttggcatcatcacccagtgtatgggcgatgtccacaccctggcaggagttaaagcgaacgctgaagtgagaaaatccgacgaccgcttcgttgaatacaagaagaaagtagctaatgccacaagcctcaccgtgcttgacgccatgattacccagctgctcaactacaaagaccaagtatgtaagcgaattgaaacgattctgcacgaaacccccgcaccctatggagcaggtggagaacaaccaaaaccgcagaaaatcgcgcaaatacgccgctacgatgtattcccggtcagacggctgacttcacgagaggacgtggaacagtatcttgatggtatccgcaaaaagctgtacgccactctagaggcaaatgacggcatccagattaactaa

SEQ ID NO: 41 - DNA, 3582 bp, Desulfobacula toluolica
atggcattaaaaaccatatttgaaaaaccggtagacagatccatagaaggtgtcattaaggcagatgatcaagcaagcctgcgtcttgaagttgaagaatatgttttaaccaatgaagttgaaaagcgcctggaatcctttcttgacgcatataacaactatgacggagcaaatggcgtatggatatccggtttctttgggtccggcaagtcccatctgctgaagatactggccttgctcatggaaaaccgtgaggttgaaggggcaaaagtactggacattatacttcccaaatgcggcgataatcagatccttaaaggtgacctgaaaaaagctgtcagcattccttcaaaaagcatcctgttcaatattgatcaaaaggcggatgtgatcagcaagactcaaatagatgcgctggtggcggtatttgtaaaagtatttgacgaatcctgcggatattatgggaaacaggcctatattgcccagtttgaaagagaacttgaccgggacaacctgctggataaatttaaagatgcctttaaaacagcgtcctcaaaagactgggaatggggaaggatgagggccaaacgtgtggcagcccatattgacgaagcataccagtgcgtaaccggtcaagaggtcacggctatacttgataaatatcgaagtgattacagtctgtccattgaagactttgccgaacaggttaacagctatattgaaacgcaggaaaccaatttccggttaaacttctttgtggatgaagtcggccaatatgttgcggacaatgtcaagctgatgaccaatcttcagaccatagcagaaagccttgcaaccaaaagccgtgggcgagcctggatcattgtgacggctcaggaggacatgaatacacttgtcggtgaaatgaacaagcagcagagcaacgacttttcaaaaatccaggccagatttgagaacaggatgaaactgaccagtgcggatgtggctgaagttatccggaagcggttgctgcaaaaaaatgataccgggattcataaactgtccaaagtgtatgatgatcaggttaataatttaaaaaccctgtttgattttgcagacggtgcccagctatacagaaattttaaagatcaggaccactttatccatacatatccttttataccgtatcagttcatcttatttcagacagccatccagaatctgtccatgcacaacgcctttgaaggaaagcacaggtctgttggagaacggtctatgctcggggtttttcagcaggtggcggttcacatttcagactatgaagtgggccggcttgccacatttgatctcatgtttgaaggaatcagaagtgccttaaaagcccagatccaaagatccatacagcttgctgaaagacatctggacaataaatttgcagtacaggttctcaaggcactgtttcttgtaaaatacattaaagaattcagggccacacaaagaaaccttacggttctgatgctggatgaatttaacaaggacatggggcatttgaacaagaacctgactgaagcattgaaccttcttgagcagcagacatatatccggagaaacggccaggtatttgaatttttgacagatgaagaaaaggatgttgaagaagaaataaaaaacacagacattgaagcctctgctgtagatgaccacctgtataaaatcgtttttgacaccatcataaaactgcgaaagatacgatatgaccaaaatggccaggactatccattttcaagaaagatggatgacaagctgtttggacgggaacatgaactgagcgtccatgtcataagcccctttaatgagaatgcagacaatgaacaagtcctgaaaatgcagtcggccggaagagatgagcttctggtgattatgcccccggatgaacgcatgatgcgtgatcttctgatgaatgaaagaaccaataaatatatccgccaaaacatctccaccacccagcaagaatccatcaaaagaatcttaacagacaaaactttacagaaccaggaacggtataacgatcttaaacagcatattgaaaaccttcttggtaaagcaaaattgtttatcaatgccaatctggttgatatcggcggtacagatccgcaggcaagaatcataaaaggattccatgacctgattgtcagaacttacccgaatctcaagatgcttaaagattttacctatactgaaagctatgtttccaaatgcctgaaggacagcgggaatctgtttggtgatgatgtaacgcttctcagtgaagcagaacaggagatgctgtcatttgttaaagccaacaaaaaaaacggtatcagaaccacggtcaaaagccttattgaacggtttgagaaaaaatcctacggctggtattatgccgctgttttgtgcatcgcagccaaactctgtgcagcaggaaaggtggagttgaattttgacagtaatatccttgaagatgaccagcttgaaaaagcattgttaaatacccatgtccattcaaacctgatcattgaacctttaaatgattttaccgcagcccagatccgcagcctgaaacaattttacgaagaattctttgacagcccgacatcctctacagaagcaaaagcgcttggcaaagaaacaacagaagccattaaagaaaaaattgagtcactgtcagggcttgttgccaaaagccataaatatccattcctggccgggttggagaaaattacagcaatactcaaagaactcaaggcaaaaccctatactttctttttaaccgatttgcacaaaattgaagacagcctgctggatatgaaagaagatgtagttgatcctattcaaaggttcatgaatggccccttgaaaacgatctatgatgatgccgtcaattttttaaagcgccaggagcataatttttcttatattgacggggatgaatccggccagattcttgccatattaaaggatagcagttgttacaaaaacaataagatgagtcgggttaaatccctggttgaaacagtgtctgataaattggatgaaaaacttaaaacaacccgacaggtggcaattgacaagatcaatagcctgctcaataaaatgatcggcatggaagattttatacgcttgtctgccagccttcaggatgagttgaaaaaaccttttgaaacacaacttgagacactgcaggatcagaccctgatcgccatgatcagtgacgccctgcgccggtttgaagatgatgaatacaataacatcttaagcaagctgagttaccttggccgaccgaaaccggcatcacctgattccaaaccgtccaaatcagatcaaacagactatgaaacttctattgaagacagttgccttggaaaaggaaaaataaaagaagggctggcaaagccaaaagaaaaagaaaatgaacctgtcaaagaagtggtgggtatcaaaaaaattgaagtgaattattccaaagcctggattgaaaatgaatttgaagtagaagactatttgtccgtactcaaaaaagccattatccgggaaataaacgctggaaaacgtgtacaggtttga

SEQ ID NO: 42 - DNA, 3429 bp, Desulfomicrobium baculatum
atgctcaacaaatacatttttctcaaagatcctgtatcgcgcaaactggccaaccagggcgtggcaagcgttaacgagtcggacgaaagcatccttcgctacgagcttgaaacctttgtgtgcagcggacagtacgaaaaaggattggtgcacattctgcggacgtatttggagaatctcaaacacccccaacagccaggcgtctggatcagcggttttttcgggtcaggcaaatcgcacttggttaaaattctggccgctctctggctggactatatcttttccgatggagccaccgcgcgaggcatcacgaccctcccacctgaagttcaggagctattcctagaattgaaaacagccggacagagacatggcggtttacacagcgtcagcggcaccttgaaggccaacgatgacagcaacagtgcccgcgccgccattttggccatgatcttcaaatccgtcggactgcccgcgaagtaccactttgcatcattcgtcatgtggctccaggaagaaggcatcttggatcaaattcgacaacatgtcgaaaatgcgggtaaaatttgggaccaggaagtcctgcgtctgcacgtctccacggtgctccgcgaagctctggtcaaaatcaggccgcaaatctttttcgatgaaaaaacctgcgccgatattctgcgaaaccagtttccatccggcaaagacgtttccagcgacgacatgataaaagctatcaagcaggccctgtccaaggatggcaaactgccgctgaccctgatcgtgctggacgaagtccaacaatacatcggcgaggacagtcaacggtcgatcgatgtgcaggaagttgtcgaggcctgttccaagaacatcggcggcaagctgctctttgtgggcaccgggcagaccgccgtgactgggacaagcaacctcaaaaaacttgaaggacggtttacggtccgagtcgagctttctgacgccgatgtggacgcggttattcggcaggtcatcctggccaaaaaacctgaggccatggctcccatcagttcaatggtccaggccaatttaggcgaaatctcccgccatctgacaggaaccaccatcgcgcaccgccaggcggacttggaatacatcgttcatgactaccccatcctgccggttcgccgccgtctttgggaaaatgccttacgtgtcctggatcagtctgggacggacagtcagctccgcaaccagctcagcctgattcacaaggtcatccaaaccaatgccgaacaacccatcgggcatgtcgcaccggcggactttattttctttgacctggcggaaaatctcctccgtaccagaatcctgccgcgcaaagtgtacgaaaaaaccgtggggtggaaatccgggtctaccgatgaacagctcatgtccagagcgtgcgcccttgtgtttttgatcaccaagctagccgctgcaaacactgaaatcggcctgaaaactacggtggacacgctcgcagacttactcgtggaggatttgtcccaaggctcaagcgtgctgcgcagcaagcttccgggcctgttgaactcctgcgaactgctgatgaaggttggcgacgagtaccgcatccagaccgaagaaagcgcggcttggaatgacgaatttttaagccaacgcacaagcttggccagcaccgcccatcgcatcgaaacagaacgtgacgaccgcatcagacgcaaggtcagtgagtctctgcgcaagatttctattcagcacggaatgtccaagacaccgcgtgatatctctacgatctttgattcccagctcccgtctgacgcctccggaaaaatctgcgtatggattcgtgacggctggagcacggatgaaaattccgttttagctgatgcccggcacgccggaaaccaatcccccacgatctttgtttttattcccaaacgctcggctgatgaccttcgtcatcaactgatggattacaaggcagccagcgccaccttggaaaaacgtggagtcccttcaaccccggaaggcaccgaagcccgagccgccatggaaacggcgaaatttaatgcggaagcacgcatagccgcacttctggatgatgcgttttcgggggccagagtgttccaaggaggcggtaacgaaattctgggcaatgagcttcaggacaaggtgacggaagcagccaaaaattcattggcccgcctgtttccacaattcgaccttgcagacaacaatggctggaccaaagtgcttgaacgcgcccaaaaaggcgctcctgacgccttgaaggccgttggctatgaaggtgagcctggagccaatgtcgtttgcaaagcgatcctgggctttatcgccggaggaaaaaaaggcgtcgacatccgtagtcactttgaaggccccgtatacggatggccgagggatgcagtggatggagccttgctcgtcatggtcaacgcgggtcttgttcgtgctctggatgacatgggcaaggccttggacgcgaagacgttagaccgaaggaatttcggcaaaacctcttttaaagttgaagcgaccaccatcagtgcggcccaaaaaatccagatccgcaaggttctgcaaaaaattggcattgccgccaaacagggtgaggaatccgcctcgatccccgagtttgtgcagagcatgaaaaacctggccgagcgagcgggcggcgatgcacccaagcctgcgataccggataccgcctgcctcgaagacatcagactgacaaccgggaacgaacagcttcttgcggtgtacaatctgcgcgatgagttagccgccttgattgattcctggacagaagttgcagatcaaatctccaagcgcggtcctgcctggaccaccctggtccgtctgaaaaaacacgccgcaaccttatcccaagccaagctgctgttcgatcagatttcgatcattgaacaggaacgccaactgttaaatgatcccgatctggtaagtcccctcgtatccagtctggcccaaattctgcgagcagaactgaaccgtcttgatcgtgagtattcgaccaaacacgaagagggcatggcccggcttaaacaggatgacaattggcaacagttggaaccggaacagcgtcatcaacttttgtcaggccaaatgctgcatgagtctgccagaccaaaagttgaagtccaagcaacggaagacgtgctgcgcacactggaagctttctcgctgagcatgtttgaggaccgcattgccgctatgccgggacgatttgacgcagtcctgcaagctgcggcagaactcatggaaccggaagcgaagttcgttcatctgccgcggcggactatcaagtctgcggatgagttggatgcttggctggtagaagtaaaaaaacaactcgtgactgcgctaaactctgggcctgtggttattcagtag

SEQ ID NO: 43 - DNA, 3612 bp, Desulfosporosinus meridiei
ttgaatatcaaagacatgtttgccaaaaagattgacagggacattaaaggtgtcattaaagtgggtcaaggtgacgatgcgaatatcaagcaggagcttgaagaatatgtcgtgactaaggaactgcaaaagcattttgccgatttctttgccagctataagaaagggattaacggtcacaccgacaaaatgggagtttggatatccggcttctttggaagtggtaagtctcacttcttgaaaatcctttcctatcttttggccaataaagaagtcgagggtaagaaagcccttgagtacttcatcgaggatgataagatcatcgatccgatggttctagcagatatgcagttggcagctagtgtgcccacggatgttgtcttgtttaatatcgactccaaaagcgaaatgaccggcaaacagacgaaagatgccatcgtctccgtatttctgaaggtcttcaatgaaatgcagggcttctgtggttctattccgttcctggctgacttggaaagacggctccaggaagttgggcgttataaagaattcatagaattatttgaggaagacttcggccagccgtgggaagcaacacgccacaagttcgattttattcaggatagcatcgtggaagtgttggatgacatgggctttatgagtgaagctgccgccaggaactggtgtgaaaaagcaacagaaccttataatattagcattgaaaattttgcgcagctcgtcaaagaatacctcaagcgtcaggaccgaaatcatcacatcgtgttcttagtggacgaaatcggccagtacataggtgacgattcaaaactgatgctcaatctgcaaaccgtaacggaggatttgggtacggcttgtcaggggaaggtttggatcattgtcacaagccagcaggatatagattccgtgacgaagacgaaaggtaacgatttttccaagattcaggggcgtttcgatacccgactgtcactttcctcggccaatgtcgatgaagtcatcaagaagagaattctcgcaaaaaccacaaccgccgaacaaactctaagattgctttatgaacaaaagacaaccatcattaaaaacctgatcgtcttcaatgatggggtggaaaaaaagttatatactgacgacagcgattttgctgccgtttatccctttgtgacttatcaatttaacctgctggctagtgtcctgacttcgatcagaactcatggtgcttccggtaagcatttatctgagggcgagcgttccatgattgccctgtttaaagaatcggcggtgaaactgatggatcgtcctgccggcacgctgattccgtttaatgtcttttatgatgcgctgcatcagtttctagatcacagtcacaaaggggttatcattcgggcgatggacaacagctatataaacccggataagctggaggagtgcttcgccgtcagtgttctcaaaacactgttcatgatcaagtatgttaaagagattacggccaacatcgataacatcaccagcctgatgatttctgatattgagacagatcgtattgaactgaagaagcaggtcgaagaagctctcaaagttcttgtacgccagatgcttgtccagaaaaatggcgacatatttgtctttctgaccgacgaagaacaggaaatcaaccgtgaaattgacagccagaatgtggagacgggtgaggtcatcaataaagtttccgagttgattttcgaggatatttttagctataaaaaatatagctaccccaaattcaatggccgatacaactttgccttgaatcagattgtggatgatcatccttataaggctaatcagaaccatgatattgggatcagagttcttaccccaaactccgaatatggcgaccaggaggcgaccctgcggatgatgtctggtcagggaaaagaagtccttgtcgccctgcccactgattctgcttttcttagtgaaattagaagcgcgctaaagattgaaaaatacctgcgcctgacaacatccagtacactcaccaagtttgaacagatcaaagaagccaaacgagttgaaatgcgcgaaagaagtggtaatgccaaactgtttttgatcgaatcgatgaagaatgccgttatctatgtgaatggtgataaagctcagattggcgctaaggatgtggcagctagaattaatgatgcctttggccgtttggtggccactgtttaccataagcttacctatattgatgcccccatgagcgaagcccacatccgggcattgtttaaagtttccaatcaattgaatcttaccttggaagatggcagcgaaccgaatatccatgcgctgaacgatatgctcagttttattgccggaaattcggcgatgcacatgaaaacatccatgaagagtctaatggatcgcttcatgaaggctccttatggcttcgtagaagatgatgtggaatggcttgtagctaagctgttcaagaacggcgatatcgcttttacggttaatgggacaagtgtgacactgctcaataaaaccgacgaggaaatcatccgttatattaccaagaaagagtatgtcgaaaagcttttaactgaaaaacgggaaaagcccaatgataagcagaaaaaggccgttcgtgaggtaatgaaggaattattcggcgtttccagtgttaacgaagacgaagatgccatgatgtgcagcttccagagctacagtaataacattgtttatgagctggagaaatttgaaattatgtatcagagcaagccactgccgggccaaaaaattgtgacctcaggcaaaacgttgctgcgtgctgtggtgcagattcagtccccaagcgaatttttcaaaaaaatctcgaccgaccgcgacgactaccttgattttgctgaagattatgaacccgtcaaagctttttttggcggtgatcaaaagaccatctttgaaaaagctttgcatctcatgggtatttacgatgacagcaagaccttcatcgtggatgaacaagtggaaactgtcgtaggcgaaattaaagccattctcaaaaaagactctccctatagcgatattccgaagctgccggaactgttaagccgctttaatgacctttatataaagctcttgacggatatggaagcaccggttattgccgctattgaggatgctaaaaccagggtgtttgatgttctggaggccaaggaatacaaaagtgagttggtagagcgcttccgtaagctgtttgcagaaatccttgaaaaggccaagacctgtaacaatgtcgcaacactgcagaatgttaaagtcgaagctgatgcattgaaagttcgtctgctcaatgagatgaccaagaaggatgagcagatcgcccgttccaaaactgaggaagaaaagaaaaaaacgggtgctggtggcgttaaggaaacaggagcgaagtttcagccgaaggttaagagacgaaagagcatcagtattaagtcagtcaacctcgcggcctcctggcagattgagacggcccaggacgtggataagtatatggctgctctcaaagaacggattctgaaagagttggatgaggacacaatcattaatattgagttctaa

SEQ ID NO: 44 - DNA, 3567 bp, Desulfovibrio magneticus
atgcagatcagaaacctcttttgcaaagatctttttcgtcccattaatggcgtcgtcaaggctgatcagcgcgatgaagccattgtttggcaagagctagacgaatatgtggtaacaaaggaattagatcagcattttagaaaattttttgaaacatacattaatgctatagtcaacaagcatgatcccaatctcaatagtcgaatcggcgtatgggtgtctggcttctttggatccggaaaatctcacttcatcaagattctttcttatcttctcaataaccgtgaagcccatgagtcaaaatcaaaacagatcaaaaaagccgtagagttctttgattcaaaaataaaagatcccttgctgctcgccgacatcaaaaaaatcactgttggcaacactgatgtggttctctttaatatcgatagccgtgccgactctaaagacggaaggggcacgctgctttcggttttttggaatgtgtttaatgaaattcaaggtttttcaaatgttttccctcacgttgcagaattagagcgccatctgacattccaaggaaaatatgatttattctgtaatatttacaaagaagtttcaggtgagaattggactgaacaacgagatgactaccgtttttatcgagatcatgttgtagccgcattcgctaagtgcctggagcaaagcgaaaaagccgctgaagattggtttgacaaggccgaagatgaccagggcatcacgatccaaaattttgcaaaacgtgtgaaggaatacctggaccggcaagggaaggaccacaggataatttttctggttgatgaggttgggcagttcattggaagtgatgggcaacttatgctcaatctccagaccatcactgaagatctcgggcgagtgtgccaaggaagggcttgggtcgtcgttacctcccaggaagacatcgatgccatcctcggtgacttgaaatcggcaaaggctaacgacttctccaagattcagggacgatttaatacgcgcctttcgctttccagctccaacacggacgaagtcattcaggcccgtctgctcgaaaagaagccggaagtcgcggagcaactcgccaatctttttgaatccaagggcgacatcctgaagagccaactgagtttctcatatgacagcgcgagcctgaagaccttcaaagacaaacaggacttcatcgctaattatccatttgttccttaccatttccaacttgttcaaaagatctttgaatccatcaggaaggcaggggcaacaggtctgcatctgagccgtggtgaacgttccatgctcgacgccttccagtccgcagccaaaaacatttctgaaaaggaaattggggcactcgttccattataccagttctacccagcaatagagagctttttggatactgctgtcaagcgaaccatcgaccaagctcatgagaatgacggcctcaaaaaacctttcgacatccaacttcttcaaaccctttttcttatccgctatgtagatatcatcaagcccaacgtggataacctcgttaccttgtttatcgatgaggttgacgcggacagactgaccctgaaacggaatatcgaggaagccctccaacgactggaaaagcagacacttattagccgcaatggtgacttgtatttcttcttgactaacgaggaacgcaacgtcacccgtgaaatcaaaaacgttgaaatcagcagcagcgaagaagtgaaactcctggctgaaataatctacgttgaaatcctcaaggatcaaaagcaacaccgctacaaacccaacagacgggattacccattcaaccgccttttggatgggcatccttatggggcaaaactggaccaagaaattggtattgaggtggttacacctctttcagatgagtacagctcattcgatgccctgcggtgtatcacgtactcttcggagcactatggtcgcgctgttatcaaactcaaagacagtaaagagttggggagagaagtccggatatggattcaaaccgataaatacattaaacaaaaggggacgtccgctaatactcatagctttgagaaaattcttgaagatcgtcaacgtgagaatagagaccgaagaagtcgaattatcatgttaatggagaaaatggtcctggacgcagatttctatgccatgggtcagacccttagctttaaggcggcaacacctcgcattgccgccgaagagaccctcgattacatcgtccaaaatctttacaataaattttgctacgttaagaccctgagcgatgatccaagcaaggaaattcgtgcggttctcctgtccaacgatgtgagccagcttgagcttgagaagggccttacggaagtcaatactgacgcgattagagaagtacgggagttcatcagccttttgattctcaagaaccacccggtgcttctgagtgagcttgtagagcatttcggatgtaaaccctacggttggcccgaatttgaaatcgtgctcctcgttgctcgcctgttcatggccggtgaaatcaaccttctctccgatggctcaaatctggagccaaaggatgctgttgagtccatgctcaaggtgggcaagtggaagtccgtcaagattatgaagcgcaaggtgccttccaaagagcaaatcgagaaagctcgcaagctctgtcaggatttgttcggcaagataggtccggagacactggacgacctggaacggaccattcgcggtgagttgggacgctggcaaaaggaattaaacaaataccaacaattagccctaactggaagttacccaggaggaaaagagatcacacgaggcttggccgtaattcagaaggtacttggcatacgagatacctttgagttcataagccggtttaatgagaagcgtaacgagttgcttgacacctgtgaagacattcatgaactgctagacttctacaccaatcagcgtcccacttgggagaagctgattaagtctttgggtgaatttggcaaaaaccaggcagcattgtacaaggatattaatgcaggaccagctttgaagcagctgcataccatcgctgaagtaccagcgccttatgggatgctcaaggatgttgacggtctcgtctcaactatttccgccattaatgaaaaacttgtggaagagcggcgagcaaaagcgctcctcgaacttgatgctaaaatcgtcaacgtgaccaagggattggacgccatgagggctgatgtagacttccggaaccatgtactcctccccctgcagaaggtaaaattacatgttgccgaggaaaccagcatcccggacatctcctaccagcttgaagagtttgatcaagcagtggaagacgctctagaccagattgaacggatgaaatcgtcccccgacccagaaaatccaaaaaagccctccaagacgacaaaagtcatcaagccaagtgccatcgcggcgaatagttaccttgaatcgcccgaggacgttaatgccttcgtagaggcccttagaaagaccctgcttgcggaattgaccggggacgtccggatcaagctccagtaa

SEQ ID NO: 45 - DNA, 3552 bp, Desulfovibrio vulgaris
gtgatgactcttaagaccatttttaacaagccagttgaccgcccgattgaaggggtcatcaaagctgacgatgaagccagccttcgcctcgaaattgaagaatacgtactgaccaacgaagtcgagaaacggcttgaatcctttcttgatgcctacaacaactatgaaggtgccaacggcgtttgggtttccggcttcttcggatcaggtaaatcccacctgttaaagatgctggcgctcttgctcgaaaaccggcagatcgacggggcctcggctcttgacctgttcctgcccaagtgtggcgacaacgaaatccttcgcggtgatctcaagcgagccgttgccatcccgtcgaaaagtattctgttcaacatcgaccagaaagcggatgtcatcagcaagacccagatcgatgcgctcctcgctgtcttcgtcaaggtctttgacgagatgtgcggttactacggcaagcaggggcacatcgcccaattcgagcgcgatctcgacagccgtggcctctatgacaagttcaagtcggcctatgaatccactgcggggagaacatggcaaaagggccgcgagcaagctctgctggaagggaaaagcattgctaaagcctatgcccatgcaaccggtggtgacgaagcatcggccatggggatactcgataaatatcgcagccagtaccgtgtctccatcgaagattttgccgagcaggtacatgcgtatatcgagcggcaatcacctgatttccgtctgaacttctttgttgatgaggtcggtcagtacatcgctgaaaacatcaagctgatgaccaacctccagaccatcgccgagagcatggccaccaaatgccgaggccgcgcatgggtcatcgtgaccgcccaggaggacatgggaacggttgtcggcgagatgggcaaacagcaaggcaacgacttctcgaagatccaagcgcggttcgccaaccgcatgaagctgaccagcgccgacgtggcggaggtcatccagaagcgtctgctgatgaaaaccgaagaaggcgttcgtctgctttcggatatttattacgcgcagtccaacaattttaagactctgttcgactttgccgacggctcgcaaacctaccggaactatcaggatcgggaccacttcattcacagctatccgttcattccgtaccagttcgcgctgttccagtcggctattcagaatctgtcacagcacaacgcctttgagggcaagcacagctcggtgggcgaacgttccatgcttggggtgttccagcaggttgcgattcagatcggggggcatgaaatcggtcagttggcgaccttcgacctgatgttcgaaggcatccgcagcgcgctgaaatccaatatccagcgggccatcatccaggcagaaaaccatctggatggtccctttgcgattcggctgttgaaaacacttttcctggtcaagtacgtcaaggagttcaagccaaccgttcgcaacctttgcgtcctgatgctcgacggtttcaatcaggatctgcccgcgctgaggaagcgagtcgaggaagctctcagcctcttggaacagcagacctacgtgcagcgcaatggcgatctctacgagtacctgaccgacgaggaaaaagacgtcgaacaggaaatcaagaacaccgaggtggagtcgtcagacgttgccgccgagcttgagaagatcgttttcgaccacgtcatcaagcatcggaagatccgctacgacgaaaatggtcaggactacccgttctccagaaaacttgatgatcgactgcacgggcgcgagtacgagctggccatccatgtcatcagcccgttccatgaaaatgccgaaagcgagtccatcctgcagttgcagaacacgggccgagacgaactgctggtcctgctgcctgcggacgaacgcctcgtccgcgacatcctcatgtacaagcggacggagaaatacatccgtcagaatatctcgatcacccagcaggaggcggtgaaacgcatcctgaccgacaagggcttccagaaccggcaacgctatgccgagttgctgcagcgcgttcacagcctgatgggcaaggccaagttgttcgtggcaggtgccgacatcgaaatcggttccgaggatgcgcagactcgggtgttgcgcggatttcatgagctcatctcccgcgcctatccgaaccttcgcatgttgcgtggcatcacctataccgagaacgacatcgccaaatgcctcaagcactcgcagcatgggctattcggtaacgacgtcacccacctggccgagtccgagcaagagctgttggcgttcattcagagtaataaccgggggggcgtgcgtagcacgctgaaaaacctgctggagaaattcgagcgcaaaccctacggctggtactacgccgccgtgctttgcactctggccaacctgtgcgctcgcggcaaggtcgaggttcgcgccgacggcaatctgctggaagaggacgagttggaacgggtgctgcgcaacacccatggccacggcaatgtggtgctggagccccaggtcgaatttaccgcatcgcaggtccgcgccctcaaggaattctttgaggacttcttcgatgccccgccccgcgccagtgaagcgaaggcgctcggcaaggagaccggcaccgcgctccaggatctcatgcatcagctcagcccgcttgctgcccaagcatcccagtatccattcctgaatacgctgactccggtgattgagaagctcaaggcgctgagcggtaagccctacacctggtacctgaccgaactcacccgccaggaagacgcgctgctgactatgaaggaaagcgtcatcgatcctgtccgcaagttcatgaacggcccgcagaaagacattttcgataacgcccgcaagttcgttcaaacccaggagcccaacttcgcctacctcgaaggcgacgaagccgcacaggtggtcgcttgtttgaccgatccggaatgcttcaagggcaactgcatgcagcaggtgaagacgcaagtcgaaaccttgcaggggaaggtcgctgcccagatcgaagccgagattgccaaggccaaggaagcggtcgccgccctcaaagcccgcctctgcggcatggctgagttcggcgcactgaacggcgagcagcaggagcagatcacccgtccgttcaacgaattcgactcaggtatagagcgccaaaaactgattgccgtcatccgcgataccctgcgccggtttgaggaaagcgactaccagcggctgctttcgcagatgacctcctgggcgcaaccggcaccggcaccagagcctgcgccggaacccggtaaaaccgccacgccggatgcaggattgagccccacgccacccgtcaagccggaaccgcgaatcgagtacgtgcccagccgctcggtgaaggtctctttcgacaaggcctggctggccgacgagaccgacgtggaacgctacctggaatccatgcgcgaggcgctgctggatgaaatccgcaaaggaaaaaggattcaaatatga

SEQ ID NO: 46 - DNA, 3549 bp, Desulfovibrio vulgaris
atgactcttaagaccatttttaacaagccagttgaccgcccgattgaaggggtcatcaaagctgacgatgaagccagccttcgcctcgaaattgaagaatacgtactgaccaacgaagtcgagaaacggcttgaatcctttcttgatgcctacaacaactatgaaggtgccaacggcgtttgggtttccggcttcttcggatcaggtaaatcccacctgttaaagatgctggcgctcttgctcgaaaaccggcagatcgacggggcctcggctcttgacctgttcctgcccaagtgtggcgacaacgaaatccttcgcggtgatctcaagcgagccgttgccatcccgtcgaaaagtattctgttcaacatcgaccagaaagcggatgtcatcagcaagacccagatcgatgcgctcctcgctgtcttcgtcaaggtctttgacgagatgtgcggttactacggcaagcaggggcacatcgcccaattcgagcgcgatctcgacagccgtggcctctatgacaagttcaagtcggcctatgaatccactgcggggagaacatggcaaaagggccgcgagcaagctctgctggaagggaaaagcattgctaaagcctatgcccatgcaaccggtggtgacgaagcatcggccatggggatactcgataaatatcgcagccagtaccgtgtctccatcgaagattttgccgagcaggtacatgcgtatatcgagcggcaatcacctgatttccgtctgaacttctttgttgatgaggtcggtcagtacatcgctgaaaacatcaagctgatgaccaacctccagaccatcgccgagagcatggccaccaaatgccgaggccgcgcatgggtcatcgtgaccgcccaggaggacatgggaacggttgtcggcgagatgggcaaacagcaaggcaacgacttctcgaagatccaagcgcggttcgccaaccgcatgaagctgaccagcgccgacgtggcggaggtcatccagaagcgtctgctgatgaaaaccgaagaaggcgttcgtctgctttcggatatttattacgcgcagtccaacaattttaagactctgttcgactttgccgacggctcgcaaacctaccggaactatcaggatcgggaccacttcattcacagctatccgttcattccgtaccagttcgcgctgttccagtcggctattcagaatctgtcacagcacaacgcctttgagggcaagcacagctcggtgggcgaacgttccatgcttggggtgttccagcaggttgcgattcagatcggggggcatgaaatcggtcagttggcgaccttcgacctgatgttcgaaggcatccgcagcgcgctgaaatccaatatccagcgggccatcatccaggcagaaaaccatctggatggtccctttgcgattcggctgttgaaaacacttttcctggtcaagtacgtcaaggagttcaagccaaccgttcgcaacctttgcgtcctgatgctcgacggtttcaatcaggatctgcccgcgctgaggaagcgagtcgaggaagctctcagcctcttggaacagcagacctacgtgcagcgcaatggcgatctctacgagtacctgaccgacgaggaaaaagacgtcgaacaggaaatcaagaacaccgaggtggagtcgtcagacgttgccgccgagcttgagaagatcgttttcgaccacgtcatcaagcatcggaagatccgctacgacgaaaatggtcaggactacccgttctccagaaaacttgatgatcgactgcacgggcgcgagtacgagctggccatccatgtcatcagcccgttccatgaaaatgccgaaagcgagtccatcctgcagttgcagaacacgggccgagacgaactgctggtcctgctgcctgcggacgaacgcctcgtccgcgacatcctcatgtacaagcggacggagaaatacatccgtcagaatatctcgatcacccagcaggaggcggtgaaacgcatcctgaccgacaagggcttccagaaccggcaacgctatgccgagttgctgcagcgcgttcacagcctgatgggcaaggccaagttgttcgtggcaggtgccgacatcgaaatcggttccgaggatgcgcagactcgggtgttgcgcggatttcatgagctcatctcccgcgcctatccgaaccttcgcatgttgcgtggcatcacctataccgagaacgacatcgccaaatgcctcaagcactcgcagcatgggctattcggtaacgacgtcacccacctggccgagtccgagcaagagctgttggcgttcattcagagtaataaccgggggggcgtgcgtagcacgctgaaaaacctgctggagaaattcgagcgcaaaccctacggctggtactacgccgccgtgctttgcactctggccaacctgtgcgctcgcggcaaggtcgaggttcgcgccgacggcaatctgctggaagaggacgagttggaacgggtgctgcgcaacacccatggccacggcaatgtggtgctggagccccaggtcgaatttaccgcatcgcaggtccgcgccctcaaggaattctttgaggacttcttcgatgccccgccccgcgccagtgaagcgaaggcgctcggcaaggagaccggcaccgcgctccaggatctcatgcatcagctcagcccgcttgctgcccaagcatcccagtatccattcctgaatacgctgactccggtgattgagaagctcaaggcgctgagcggtaagccctacacctggtacctgaccgaactcacccgccaggaagacgcgctgctgactatgaaggaaagcgtcatcgatcctgtccgcaagttcatgaacggcccgcagaaagacattttcgataacgcccgcaagttcgttcaaacccaggagcccaacttcgcctacctcgaaggcgacgaagccgcacaggtggtcgcttgtttgaccgatccggaatgcttcaagggcaactgcatgcagcaggtgaagacgcaagtcgaaaccttgcaggggaaggtcgctgcccagatcgaagccgagattgccaaggccaaggaagcggtcgccgccctcaaagcccgcctctgcggcatggctgagttcggcgcactgaacggcgagcagcaggagcagatcacccgtccgttcaacgaattcgactcaggtatagagcgccaaaaactgattgccgtcatccgcgataccctgcgccggtttgaggaaagcgactaccagcggctgctttcgcagatgacctcctgggcgcaaccggcaccggcaccagagcctgcgccggaacccggtaaaaccgccacgccggatgcaggattgagccccacgccacccgtcaagccggaaccgcgaatcgagtacgtgcccagccgctcggtgaaggtctctttcgacaaggcctggctggccgacgagaccgacgtggaacgctacctggaatccatgcgcgaggcgctgctggatgaaatccgcaaaggaaaaaggattcaaatatga

SEQ ID NO: 47 - DNA, 3438 bp, Desulfurivibrio alkaliphilus
atgaaaaaccgcgatatttaccagcaggatccaaccacccgcaagctggtcaacgaaggggtggccatggtcaacgacgagcagaccagccaggccctggaggttctccgctatgaactggaaaccttcgtctgcgacggccagtatgaaaagggattaagccacatcctggaaacctacctgaaaaatattgatcaggcccagcagccggcggtctgggtcagcggcttttatggttccggtaaatcccatctggtcaaaatgttgcgggctctgtgggtggatacggtttttgccgatggcgccactgcccgcggcatcgccaatttgccccagcatatcagagaccagctcaaggaattaagcacccaggccaaacgccatggcgggttgcgggccgcttccggtaccctgggcgccggcgccagcggcagcgtgcgcctggcgctgctccgggtagttttccggtccgtcggcctgcccgagcaatatccagtcgcccgttttgtcatgtggttgcaacacgaaggcgtccaccaacaggtgcgcgacctggtcgagcaacacgggctggactgggaagaggaactggataatttctatgtcgccgaaggtctgcaccaggccctggcccaggccaagccccagcttttcaccactcccgccgcctgcgttgaaaccctgaacaatctctacccgttcgtgcaggacgtgggcagctcggaaatgatcaaggccatccgccaggccctgaccctgggcgacaagtttcccctgaccctgatcgtgctggacgaagttcagcagttcatcggagaggaccccgaccggtccctggcggtgcaggagatggtggagtcgattaccaaggagattggcggcaagctcctctttatcggcaccggccagaccgcggttaccggcacctccaacctcgctcgcctccaggggcgcttcaccatccgggtggagctttccgataccgacgtcgacgcggtgatccgccaggtggtcctggccaagaagccggccgccaaggcccccatcgaagagatcatgacggccaacctgggagagatttcccgccatctggccggcacctccatcgcccatcgccagtcagacctgcctttttttccccaggattatccaatcctgccggttcggcgacggttctgggaaaataccctgcgggttctggaccagaccggcaccgacagccagcttcgcaaccagctcagcatggtgcacaaggtgatccaaaccaacctggagcgccccttgggtcatatggtgccggcggattacctttatttcgagtccgccgacaaactgttgcgaacccggattctgccccgggaagtatatgaacagaccgtagtctggagccggggcaatgaggaccagcaaatcctggcccgggcctgcggcctggtctttctgatcaacaagctggccggcagcaacaaagaaatcggtattcacgccaccgtcgataccgtagcggatctgttgctggaagacctggccgccggctccggcagtttgcggcgccggttgccggccctgctggatggatgtaagttgctgatgaaaatcggcaacgaataccgaatccagaccgcggaaagcacggcctggaacgatgaatttctgagccagtgctccagcctggccagcgaagcccaccggattgatgccgaacgaaacgaccggatgcgcaaaaagtttggcgagatggtgcgcaagctctccctgggccagggcacctccagggtcggccgggagattttcccgattttcgatgcccagttgcccaacgacgccgaccatcgggtctatgtctgggtgcgtgacggctggagcagcgacgagaactcgatccgggctgatgcccgtcaggcggggaatcagtcctccacggtcttcgttttcatccccaagcgctccgccgatgatctgcgccgttttctcatcgactgtaaagccgccgccgccaccctggagaaaaagggggtgcccggcaacccggaaggcgccgaagcccgagcagccatggaaactacccggcaaacggctgaagggcgaattagcgagttgctggccgaggctttctccggtgcccgggttttccaggcggggggcagtgaaaccctgggtaatgacctgcaggagatgatcaccgaagccgctgcaaacgccctccagcgcctttaccatcagttcagcctggccgaccatggtggttggggcaaagtatatgacaaggccaagtccggcgccccggatgccctgaaggcggtgggtgatgacggggagccggcccggaatccggtttgcaaggccatcctggctttcattgccggcggcaagaagggcgccgatattcgcgtccatttcggcggccccccttacggctggtcccgtgatgcggtggatggcggcctgcacgtgctgctgatcgccgggctggtgcgagcccaggacgaacgcggccaggccatcgacccgcgggagttggatcgcaatgccctcggcaaggtgatcttcaaggtggaatcgaccaccgtcagcaccgcccagcggattcagatccgcaagctcctgcagcaggccggcatcaatgcccggcagggtgaggagttgccccaggttcaacaatttctgcaaaagatgctggacttggccgcggaagccggcggcgatccgccccgaccgccccagccggacaccaccgccttgcatgaaatccgcctgaccgccggcaacgagcagttgctggccctttacaaccgccgcgacgaatttgcccagaattttgcggcctggaccgatctggcggcccgcattgccaagcgccagcccaactggctcaccctcaagcgcctgctggagcatgccgccggcctgccggatgccgaggtcatcatggctcaggtccagaccatcgagcaccaacgccaactgctggccgaaccagacccggtggcgccgctgctggcggctctaacccaactgctgcgcactgaactcaatcgtctggacgcggaatacgtcagtcgtcaccggcaaggcatggaacgattgcgctccgacagcaactggcagcaactcgaacccgagcagcgccaccaactgctggccaccgaacttctccacgatgccgcccggcccaaggtccagttgcaaagcacggccgatattctggccgcccttgataactgctccctggccatgtttgccgatcgggtggcagccatgccggcccgctttgacaacgtcgccgccgccgcggccgaactgtgcgagcccgaggtccagtttgtcaccatcccccgccccaccctgaaaaccgaagcggaaatcgacgcctggctggtggaggtaaaacaacaactccagaaagccctgccccaggggccaatcatcattcgctga

SEQ ID NO: 48 - DNA, 3702 bp, Enterobacter cloacae
atgcagataagagagctgtttaccaaacaactggatcgcccaatcaatggtgtggtgaaagccgagcagctggatgagcaaatcatctggactgagcttgacgagtatgtggtgacccgtgaacttgaccgccaccttcgtcacttttttgagacctacctgcctggtgtcagccatccagatgatcctagtgtggcgggtaaaattgggatttgggtatcgggttatttcggttccggtaaatctcactttataaagatcctctcttacctgctcggtaacaagaaagctgttaacaatggccaaacaaaagctgccatcgagtttttcaaagagaaaatcagcgatccccttctttacggtgatatccacgctgcagttaaccgcaatactgaagtaattctctttaatatcgacagccgcgcagatactgaagacaaagaagatgccattctcaaagttttcttgcgcgtcttcaatgagcgcctgggatattgcgctgaccatcctcatatcgcacacctggaacgtgagttagattcccgtggccaatacgagccattcaaagcaaaatttgctgaactcacgggctcaagctgggaagaacagcgtgatgcctatggtttctgtcgtgatgaaatggcaaaagcctgggcctatgctaccggccagtcagatgcctcatcggtgcagagtatggaaaatctcgaatccatgtttactctcgacattgccaacttctgtaaatgggtgcgggagtatctcgatcgtagcgatccatctggcgacagtaaacgcatggtctttctggtagatgaggtcggacagtttatcggcaacaacacccagatgatgctcaaactgcagacgataacagaaaatatcggtaccgcttgtggaggcagagcttgggtaatcgtcacttcacaagaagatatcgatgccgtactaggagatcttagcgctaaaaaaggccaagacttctccaagatccaagggcgttttcacacaaggatttccctctcctcgtccaataccaatgaggtaatacagaaacgtctgctcgaaaaaagtgaagacgctaaaaactgcctggcagaattgttcagtcaaaaaggcgacattcttcgcaaccagttgacctttgataccagcactacagctgagcttgctaactacagtgataatgttgaatttgttgatcactacccttttattccctatcagtatctgctggtacaaaaggtcttcgaagcaatccgcaaagtgggggctaccggtaaacatctctcccgtggtgaacgttctctgctggatgcattccagaatgccgcacgccagcagatgaacaaagatatcggtgtattggtgcctttctatgccttttatccggcaatcgaatctttcctcgataccaacgttaaacgcatcttcgaacaagcggctgagaaagcaagcctcgatccttacgacattaatattcttaaatcgctgtttttgatccgctatgtcgatctggtcaaatccaccattgataatctggtcacactctctattgaagaaatagataccgataaagtggcactgaaaagccgaatcgaagccagtctacagcgtcttgaaaaccagctattgattgtcagaaatggcgatgaatacgtattcctgactaacgaagaaaaagaagtcgagcaggagatcaaacacactcaggttgaagcaactgaagagaaccggcaactggcccggttggtgtttgaagaggtaatgggcaatcgccgtcagtatcgctatccggtaaacaagcaggattaccctctgactcgcttttgtaacggccactctatagacggcagccaacaaacagatctggtgctcaaagtcatttccccactggatgccaattttgacagttataacgaacaatcctacaaggcactgagccaagaagggaatggttgtattctggtacgcctgtcgagtgagaagcggatctgggctgaatttgatacttggttgaaaaccgagaaattcctggcagggatacgaggtaaacgacctgagcaagagaaattgctggcagaaaaagcactcgaaaacacccagcgtcgcagccgtctgaaattactattcgatgatctggtgaaacaagcacagatattcgcactcggtaatgagctgcaaagtaaatcggctagtgtcagcaatatgcttgatgaagcttgtgcctacgtaatcgaaaactcattccaaaagctctctttactacaaagctgtggtaacaacccggtgcaagagctgaagtcggtgatcatggccgatgacatggcacagctaaatgtaaatctcggtgaacaagaccccaatgctgctgcaaaaaaggagattgaactctttttaaatgtcgcagatgaaaaaaatcagccagtctaccttaaagaattgttagagcgattcagtgctcgtcccttcggctggaaccgtgacgaagtaatgctacaggtgactcatctggtcttgcttggtaaggctgcgctatctacaccgaatggtgatttgcccctcaaacgcagctacgaacattttacctcggtacgtagccacagcacactgcgtattcgtcgagtacgtcagcatacagaacagcaagtagctaaagcggctaaactggcgaaagatatttttaataaacccttcgagagcagcgaaaaagagctggcgaataagcttcttgacgtactaggcgagtggcagcggttaattaaagaatttgattttaaagctaaagatgggaattgccctggcaaaagcaccctgcttaccggcagtcgattgatcgccagcctgcttgagctgggcaacaacagttatgccctaatcgatggactctgccagcagagcaacgaatggcaggattttgccgaagattttgaagaagtcgaggagtttttcactcgtcagtttgatatctggcaacagttgcgtcgagccctcaacgatcaattcaaatccaatcgccatgcactggagcaaaacccagaagcggctaaagcattatctgcactgcaggctatctacgatgataaatccccgtatagcaaactgcgccaggtgggatcgttaattgatcaactcatcgccattaacctgcaactggtagaacagaaacgtgccgcggctttggaagcgatcaatgcaacccagcaaggtgttgcaccgctggttactgacttaccagctgagttacaaaaccaggcaatgcgtccctttaatctgttaaaagaacgggtcagtaacagcttatccttacatgagattgttagcctgcaacaagaggctgatgatgaagaagataaggtcttagaactgatcaaccgctacagcgccgaacttcaagctcgtctggaagcggagcaagccgcagcacggaaaaaagcggctgaaccgcctaatagcgatgcgggtactttgcgagaaccggatccatcaggctcgccaactactattgcgaataactctgctgcgacagtggttagccacaaaccaatacctaaacctatcgaactggtttcacccgcagaattactcggtgccagccatatctttatagaaacggagcaggatatcgacacctatctcgcgacacttcgcagccgtttacaacaggcaataggtcagggtaaacgagtgcggatcaaatag

SEQ ID NO: 49 - DNA, 3645 bp, Erwinia sp.
atgaatattgaacagatctttgataaacgccttgaccgaaatattaatggcgttgtaaaagccgaacagacggatgatgccagcgcctggattgagatggatgaatacgtcatcactcgggaactggaaggacatcttcgccatttctttgaatcttatgttccggcaaccggcccggagcgcatacgcatggaaaacaaaattggcgtatgggtttcagggttctttggctcaggtaaatcgcactttatcaagatcctgtcttatctgttgtctaaccgtaaagtcagccataacggtacggaacgtcatgcatacaccttctttgaagaaaaaatcaaaaaagatgcgctgttccttgctgatatcaataaagcggtccaccatccgacggaagtgattctgttcaatattgattctcgcgctaacgtcgacgacaaagaagacgccattcttaaagtcttccttaaagtgtttaacgaccgggttagttactgtgctgattttccacacatcgcccatcttgagcgcgaactggctaaacgcgggcaatatgagacttttaaaacggccttctcaagtattactgagaagaactgggaaaaagagcgcgactcctactatttcatcagcgatgaaatggcggaggccttaagccaggccacgggtcaaagcgttgaggcctcgcgtcagtgggtagaacagcttgataaaaatttccccctggatatcaataacttttgccaatgggttaaagagtggctggatgaaaacggcaaaaacatcctctttatggtggatgaagtcggccagtttattggtaaaaatacgcagatgatgttgaagctgcagaccatcactgaaaacctgggggttatctgcggtgggcgtgcatgggttattgtcacctctcaggcggatatcaatgcggccattggtggtatgagcagccgcgacggacaagacttctctaaaatccagggccgtttctctacccgtttgcagctttcaagcgccaatacctccgaagttattcaaaaacgtttgctggtaaaaaacgatgcggcaaaacctgcactcgctaaagtctggcaggaaaaaggcgacattctgcgtaaccagcttgcctttgatcccacaaccagcgcttcattacgcccttacaccagtgaagaagaatttattgataactacccgtttgtcccgtggcactaccagattctgcagaaggtttttgaatctattcgtactaaaggtgccgccggtaaacagttagcgatgggtgaacgttcacaactggaagccttccagactgcggcacagcaaatcgctccgcaaggcctggattctctggttccgttctggcgtttttatgctgcaattgagagcttcctggagccagccgtcagccgcaccatcactcaggcctgccagaatggcatccttgatgagttcgatggtaacttgctgaaaacgctgttcctgatccgctatgtcgatgtgctgaaaagcacattagacaacctggtcaccctttcgatagacaaaatcgataccgacaaagttgagctgcgccgttgcgttgaaaaaagcctgaacaagctggaacgggaaatgctgattgcacgtgttgaagacaaacacgttttcctgaccaatgaagaaaaagagatcgagaacgaaatccgcaacgttgaagtcgacttctccgcgatcaacaagaaactggcttcgatcatctttgatgatattttgaaaaaccgcaaatatcgctacccggcaaacaagcaggacttcgatatcagccgcttcctgaacgggcacccgttagacggtgcgatgcttaacgatctggtggtgaaaatcctcacgccaaaagatccgacctatgatttttataacaacgacgctgcgtgccgcccatacacctcagaaggtgatggctgcattttaattcgtttacctgccgatgcccggacctggaccgatatcgatttggtcgtccagactgaaaaattccttagagacaatgcaggtcagcgcccggaacaggccagcctgctttcagaaaaggcgcgcgagaacagcgtgcgcgagaaaatgcttcgcgtacagctggagtcactccttgccgaagcagacatctgggcgattggcgagcgcttaccgaagaaatcctcaacaccgtccagcattgtggatgaagcctgccgctatgtgattgaaaataccttcggcaaattaaagaagctgcgtccttacaatggcgaaatcgcgcgtgagattcatcaacagcttacgttagaaaacgacaccgaacttgatcttggcgacacagaagaatccaatcccgacgcgatgcgtgaggtggagacttgggtcagcatgaacattgaatacaacaagccggtctatttacgcgatatcctgaaccactttgctcgccgcccgtatggttggccggaagaggaagtgaagctgctggttgcccgactggcgcgcaaaggtaaattcagcttcagccagcagaataacaatatcgaacgtaagcaggcgtgggatctgtttaacaacagccgccgccacagcgagctgcgcctgcacaaaattcgccgtcacgacgaatcgcaaattcgcaaagccgcgcaaactatggcgcagattgcccagcagccgtttagcgagcgtgaagaacccgcactggttgaacatatccgtcaggtcttcgacgactggaaacaggaactgaatgtcttcagagcgaaagcggagggtggaaacaatccagggaaaaatgaaattgaatcaggtctgcgcctgctgaattccattcttagcgaaaaagaagattttgccctgattgagcgggtcacaactctggccaatgaactgctggagttcagcgaagatcgcgaagatttggtcgatttctaccgtaagcagtttgccacctggcaaaagctgggcgctgcgctgaatggcagctttaaatccaaccgcagcgcgctggaaaaagacaccgtgacggtgaaagcgctgggtgagctggaaagcatctggcagatgccggagccttataaacatctcaatcgcatcacgccgctgattgaacaggtgcagaacgtcaaccatcagttagtcgaacagcaccgtcaacatgctctggaacgcattgacgcgcgaattgaagagagccgtcaacgtttgcaggaagcgcatgctaccgcagagctgcaaaacagcgttctgctaccgatgcaaaaagccagaaaacgcgccgaggtcagccagtcgatcccggaaattctggcggaacagcaagagacgatggcgctgcaaacggatgcagagaagaaaataaaccagtggatcgacgagctgcgtaaaaagcaggaagcccagctacgggccgtaaaagagaccaaacaggccacagaaccacagcagtcttacgttgcagctgaaaaacccgttatccaaccggtaccgaaaaaaacgcatctggtgaatgttgccagtgagatgcgcaaagccgctggcagcgaagtactggaaaccactgagcaggtggaaaaagcgctggatacgcttcgcgcagcgctgctggcagccattgaggcaggtgacaggatccgtcttcagtaa

SEQ ID NO: 50 - DNA, 3645 bp, Erwinia pyrifoliae
atgaatattgaacagatctttgataaacgccttgaccgaaatattaatggcgttgtaaaagccgaacagacggacgatgccagcgcctggattgagatggatgaatacgtcatcactcgggaactggaagggcatcttcgccatttctttgaatcttatgttccggcaaccggcccggagcgcatacgcatggagaacaaaattggcgtatgggtttcagggttctttggctcaggtaaatcgcactttatcaagatcctgtcttatctgttgtctaaccgcaaagtcagccataacggtacggaacgtcatgcatacgccttctttgaagaaaaaatcaaaaaagatgcgctgttccttgctgatatcaaaaaagcggtccaccatccgacggaagtgattctgttcaatattgattctcgcgctaacgtcgacgacaaagaagacgccattcttaaagtcttccttaaagtgtttaacgaccgggttggttactgtgctgatttcccacacatcgcccatcttgagcgcgaactggctaaacgcgggcaatatgagacttttaaaacggccttctcaagtattactgagaagaactgggaaaaagagcgcgactcctactatttcatcagcgatgaaatggcggaggccttaagccaggccacgggtcaaagcgttgatgcctcgcgtcagtgggtagaacagcttgataaaaatttccccttggatatcaataacttttgccaatgggttaaagagtggctggatgaaaacggcaaaaacatcctctttatggtggatgaagtcggccagtttatcggtaaaaatacgcagatgatgttgaagctgcagaccatcactgaaaacctgggggttatctgcggtgggcgtgcatgggttattgtcacctctcaggcggatatcaatgcggccattggtggtatgagcagccgcgacggacaggacttctctaaaatccagggccgtttctctacccgtttgcagctttcaagctccaatacctccgaagttattcaaaaacgtttgctggtaaaaaacgatgcggcaaaacctgcactcgctaaagtctggcaggaaaaaggcgacattctgcgtaaccagcttgcctttgatcccacaaccagcgcttcattacgcccttacaccagtgaagaagaatttattgataactacccgtttgtcccgtggcactaccagattctgcagaaggtttttgaatctattcgtactaaaggtgccgccggtaaacagttagcgatgggtgaacgttcacaactggaagccttccagactgcggcacagcaaatcgctccgcaaggcctggattctctggttccgttctggcgtttttatgctgcaattgagagcttcctggagccagccgtcagccgcaccatcactcaggcctgccagaatggcatccttgatgagttcgatggtaacttgctgaaaacgctgttcctgatccgctatgtcgatgtgctgaaaagcacattagacaacctggtcaccctttcgatagacaaaatcgataccgacaaagttgagctgcgccgttgcgttgaaaaaagcctgaacaagctggaacgggaaatgctgattacacatgttgaagacaaacacgttttcctgaccaatgaagaaaaagagatcgagaacgaaatccgcaacgttgaagtcgacttctccgcgatcaacaagaaactggcttcgatcatctttgatgatattttgaaaaaccgcaaatatcgctacccggcaaacaagcaggacttcgatatcagccgcttcctgaacgggcacccgttagacggtgcgatgcttaacgatctggtggtgaaaatcctcacgccaaaagatccgacctatgatttttataacaacgatgctgcgtgccgcccatacacctcagaaggtgatggctgcattttaattcgtttacctgccgatgcccggacctggaccgatatcgatttggtcgtccagactgaaaaattccttagagacaatgcaggtcagcgcccggaacaggccagcctgctttcagaaaaggcgcgcgagaacagcgtgcgcgagaaaatgcttcgcgtacagctggagtcactccttgccgaagcagacatctgggcgattggcgagcgcttaccgaagaaatcctcaacaccgtccagcattgtggatgaagcctgccgctatgtgattgaaaataccttcggcaaattaaagaagctgcgtccttataatggcgaaatcgcgcgtgagattcatcaacagcttacgttagaaaacgacaccgaacttgatcttggcgacacagaagaatccaatcccgacgcgatgcgtgaggtggaaacctgggtcagcatgaacattgagtacaacaagccggtctatttacgcgatatcctgaaccactttgctcgccgcccgtatggatggccggaagaggaagtgaagctgctggttgcccgtctggcgcgcaaaggtaaattcagcttcagccagcagaataacaatatcgagcgtaatcaggcgtgggatctgtttaacaacagccgccgccacagcgagctgcgcctgcacaaaattcgccgtcacgacgaatcgcaaattcgcaaagccgcgcaaactatggcgcagattgcccagcagccgtttagcgagcgtgaagaacccgcactggttgaacatatccgtcaggtcttcgacgactggaaacaggaactaaatgtcttcagagcgaaagcggaaggtggaaacaatccagggaaagatgaaattgaatcaggtctgcgcctgctgaattccattcttagcgaaaaagaagattttgccctgattgagcgggtcacaactctggccaatgaactgctggaattcagcgaagatcgcgaagatttggtcgatttctaccgtaagcagtttgccacctggcaaaagctgggcgctgcgctgaatggcagctttaaatccaaccgcagcgcgctggaaaaaaacaccgtgacggtgaaagcgctgggtgaactggaaagcatctggcagatgccggagccttataaacatctcaatcgcatcacgccgctgattgaacaggtgcagaacgtcaaccatcagttagtcgaacagcaccgacaacatgctctggaacgcattgacgcgcgaattgaagagagccgtcaacgtttgcaggaagcgcatgctaccgcagagctgcaaaacagtgttttgcagccgatgcaaaaagccagaaaacgcgccgaggtcagccagtcgatcccggaaattctggcggaacagcaagagacgatggcgctgcaaacggatgcagagaagaaaataaaccagtggatcgacgagctgcgtaaaaagcaggaagcccagctacgggccgtaaaagagaccaaacaggccacagaaccacggcagtcttacgttgcagctgaaaaacccgttatccaaccggtaccgaaaaaaacgcatctggtgaatgttgccagtgagatgcgcaaagccgctggcagcgaagtactggaaaccactgagcaggtggaaaaagcgctggatacgcttcgcgcagcgctgctggcagccattgaggcaggtgacaggatccgtcttcagtaa

SEQ ID NO: 51 - DNA, 3645 bp, Erwinia pyrifoliae; identical to SEQ ID NO: 50

SEQ ID NO: 52 - DNA, 3519 bp, Erythrobacter litoralis
atggctcagctgctaaaagacatttttgaaaagccagttgatcgcgccatcgatggcgtcatcaaggctgatgatgaggctagcctccgcgtcgagctcgacgaatacgttattacgggtgaaattggccaacggctcgagcaattcctcgaagcctacaacaattatgacacctcaaacggcgtctggatctctggcttcttcggctcaggtaagtcgcacttgctaaagatgttggccttgttgctcgaaaaccgtgaggtcgacggaaaaactgctcacgagatcttcgctgcaaaactcaaagacgagccgatgctcgcaggagcacttaacaaggccgtttccatcccatcgaaatcaattttgttcaacatcgaccagaaggccgatgtcatctcgaagacggatgtcgatgcgcttctatccgtgtttcagaaagtcttcgatgaagcttgcggattctacggcaagcaacctcatatcgcgcaatttgaacgcgatctgcaaagccgtggccaatttgaggctttcaaagagactttccgtagcgctgctggaaaggactgggagcacggaagagaacaggcactgctcgaagccaagaatatcgcgaccgcgtttgccgcagcaactggtggcgacccatggggtgcgaaagacattttgagccaataccgaaaggacactcgcgtctcgattgaggacttcgcagacactgtgaaagcctggattgatgatcaaccaaaaggttttcgactgaacttcttcgttgacgaagtcggccaatatattgccgacaacgtaaaactgatgaccaatctgcagaccatcgcagaaagcctcaacaccaagtgcgagggccaggcatggattatcgtaacggcgcagcaggacatggcgtccgtgatcggcgatatgacacagcggcaagagaatgacttctccaaaattcaagctcgcttcggcaaccgcatgccgctgaattcggccgatgtcgcggaagtcatccagcgtcggcttctcgccaagacttctgaaggccaagtgacactcggcaacctgcatgatcgcgaagaaaacaatctcaagacacttttcgattttgcggacgggtcgcagaagctcaaaaactaccgtgatcgcgaccacttcatatcgagctatccgttccctccctatcagtacgatctctttcaaatggcgatcacgtcattgtcggagcacaacgcatttgaaggcaagcacagctctgttggtgagcggtcgatgctgggcgtcttccaagaggtagcaaagaagctgaaagaccaggaggttggtgggctagccacctttgacctcatgtttgaagggatacgcactgcgctgaagtcttcggtgcaacagagcattcagatcgctgaaaggaacctggacgacccgtttgccgttcgagtcctaaaatccttgttcctcgtcaaatatgtcaaaggcttcaaaccgtcggttcgcaacatcgcaattctgcttttgtcggagtttgaggcggaccagacggcaatgcgccgcaagattgaggaagcgctaagccgtttagagagagaaacctatatccagcgcaacggcgaggtctatgagttcctgacgaatgaagagaaggatgtcgaagccgaaatcaaggctctcgacatcgatccgtccgagctctcgaaagaactcgaaactctcgcattcgataccattctacgtcaccgtaagatcaaacatctcgcgacaaataacgaataccccttcacccgaaagctggatgatcacgctctaggacgcgaatacgaattggctatcaacctcgtttcacctttgagtgatgaggttgaaagctcagatggcattcgcatgaaaactatgtctcgcgaagagcttgcggtcgccatgaatccagatgcgaccttcgttcgtgacctgatcctgttcaagcaaaccgacaagttcattcgccagtcgcgcagcggctcaccgcagccaggccgcgaccgcattgtggcgggaaaaggggagcaaaacagtcgccgcctaaaagacatcgaaatgcagctccgcaaattgatgggaagcgctcgcctgttcgttagaggtgacgaactcgagatcggcggtgaagatgctcaagagcgcatagccaaggcgttccaatcgctggtcgacaaggtttacaccaacctcccgatgctgcgcggtgtcagctataccgaggccgatatcaacaaggcggtgcaagctgaaagcgggctctttggatctgacggcacacggatcaatgaggccgagcaagacgtcctcagctttatcaatgcgcaggcacgcaacggtgtaaaagtctccgtcaaatatctggctgatcgctttacgtcgaaaccttacggctggccaataaatgcggttctttgcctagcaagtagtctggtcgcgaggggcaagatcgaagcgcgactggacagcgctgtgaaggagggactggatctcgccaaggcgttgaacaacagccacgcgcttccgaacatattacttaccccacaaacggaattcactgcctccgaaattcgccgagctaaggagctctatcaggaactctttgcacacccctcctcgggaaccgacgcgcgcagtttgggtgcagaatggactgcaagcattgatgtgcttgaagccgaagtggacgaacttgttcgccaatcgcaccgctaccctttcctgacttcgctcgagccactcaatgagctgctgcggaccatgaagagcaaaccggcgaactggtatatttccgaggcgcctaagcgcgaggatgatcttctgaacgcgaaggaggatatcctcgacaaggtgaagtccttcatgggcggcgcacaaaaggacatctacgacgatgcccgcgatatgctcgccggccaatctgccaacatcgactatgtcgatcctgatgctggggcgaagttacgcgctgcattggaggatccgaactgtttcaaaggatcgacgatccagaacctcaagtccgatctttttgatctgaaaaacaaggtcgaactcaaggtgcttgaggagcgcaaagctgtcatcgcagaggtagaagacgtttcagccaagatcgcacaaatgccggacttccaagcgctcgatgccgatcaacagacgcggatcaccgcacgcatcgatagccacaaagaaggcctcgatacagtcactttgattcccgtattgcgggatcgcgccaatggtgcacgcaccaacctactatcagacgttgtcactgaactggatagtctcgcgcgcccagtaccggcgactcagccgcagccaggccaatccgacgggccagcgcccgcaccgcaggctcccacaacgatccttgcctctcagttgaaggtcgcagctccgaaaacgctgctgaccgatgaggccgacgttgatgagtaccttgatgcgatgaaaagtgccctgctgaacgaaatccgcgcgggtaagaaagttatcgtataa

SEQ ID NO: 53 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccttatggaaaacaagatcggcgtatgggtttcaggcttcttcggttcaggtaaatcgcactttattaagattctttcttatcttttatctaaccgcaaagttacacataacggtacggaacgtaatgcttactccttctttgaagagaaaatcaaagatgcattattccttgccgatattaacaaagcggtacattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgacatggcacaagcattaagccaggccacgcagcagagtcttgaagcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttctctacacggctgcaactttccagctctaacacatcagaagttatccagaaacgtttgttggtaaaaactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacagttggccatgggtgagcgttctcagctggaggcattccagactgcggcgcagcaaatctcagcgcaagggctggattctctggtgcctttctggcgtttctatgccgctattgagagcttcctggaacctgccgttagccgcaccatcactcaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggataacaagcaagactttgatatcagtcgcttcctgaacggacacccattagacggcgcagtgcttaacgatctggtggtgaagatcctgacccctaaagatccaacctattcgttctataacagcgatgcgacttgtcgcccttatacatcagaaggcgacggctgtattttgattcgtctgccggaagagggccgcacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcttccacaccatcgaacattgtcgatgaagcctgccgttacgtgattgaaaacaccttcggcaagctgaagatgctgcggccttttaacggcgacatctcccgtgaaattcatgcattactgacggttgagaacgacactgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgtatcacgccgttgattgaacaggtccagaacgtcaaccatcagttagtcgaacagcaccgccagcacgccctcgaacgcattgacgcccgcatcgaggaaagtcgtcaacgcttgctggaagcgcacgccacgtcagagctgcaaaacagcgttctgctgccgatgcaaaaagccagaaaacgcgctgaggtcagccagtcgattccggaaattttggcggaacagcaagagacgaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgccattaaagcaggcgatcgcattcgccttcagtaa

SEQ ID NO: 54 - DNA, 3642 bp, Escherichia coli; identical to SEQ ID NO: 53

SEQ ID NO: 55 - DNA, 3642 bp, Escherichia coli
atgaatattgaacagatttttaaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagagaaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgacatggcacaagcattaagccaggccacgcagcagagtcttgaagcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgacactacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgcttaaaacgctgttcctgatccgctatgtggaaacgctgaaaagcaccctggataacctggtcacattgtctatcgataggatcgatgccgataaagttgagttgcgccgccgggtcgaaaaaagtctcaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccgacttattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggctaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaacattgtcgatgaagcctgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgaacgaaaacaggcgtgggaattatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtttttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgctgttgattgaacaggtccagaacgtcaaccatcagttagtcgaacagcatcgccagcacgccctcgaacgcattgacgcccgcatcgaggaaagccgtcaacgcttgctcgaagcgcacgccacgtcagaactgcaaaacagcgttctgctgccgatgcaaaaagccagaaaacgcgctgaggtcagccagtctattccggaaattttggcggaacagcaagagacaaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctagaaacgaccgaacaggtggaaaaggcgctcgacacgttacgcacaacgctgctggccgccattaaagcaggcgatcgcattcgccttcagtaa

SEQ ID NO: 56 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcacgctgggaagacgagcgcgacgcttactacttcatcagcgatgacatggcacaagcattaagccaggccacgcagcagagtcttgaagcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttttcaacacgcctgcaactttccagctctaacacatcagaagttatccagaaacgtttgttggtaaagactgacgaagcaaaagcagcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggctatgggtgagcgttctcagctggaggcattccagactgcggcgcagcaaatctcagcgcaagggctggattctctggtgcctttctggcgcttctatgccgccattgagagcttcctggaacctgccgttagccgcaccatcacccaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggcgcagtgcttaacgatctggtggtgaagatcctgacccctaaagatccgacctattcgttctataacagcgatgcgacctgtcgcccttatacgtcagaaggcgacggctgtattttgattcgtctgccggaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaatattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaacaccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaagtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaatgagattgaatccggtctgcgcctgcttaatgccattcttaatgaaaaagaagattttgccctgatcgaaaaagtctcatcgctgaaagatgaacttctggatttcagtgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgcgtaaaaagcaagaggcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaggttctggaaaccaccgaacaggtggaaaaggcgctcgacacgttacgcacaacgctgctggccgccattaaagcaggcgatcgcattcgccttcagtaa

SEQ ID NO: 57 - DNA, 3678 bp, Escherichia fergusonii
atgaaaattgaacagattttttccaagaagttgacgcgtgacattaatggcgttgttaaagcggaacagaaagacaatgacagtgtgtatgtcgagcttgatgagtatgttgttacccgagagctagatcgtcactttcgtgcattttttgaggcttatgtaccctctgttgagaaaagccacggtgatatgtcaggtaaaattggcgtatggatttctggcttctttggctcgggtaaatcgcacttcctgaaaattttatcttatttgcttgagaataaatctgttgaaaaagatggccaaggccgacaagcgtttgagtttttcaaagacaaaatcaacgacgccatgctgttggcggacatccaaaaagcggttaccaaagacactgatgttattctttttaacatcgattcgcgagccaatacggacgaccgagaaaatgccattcttaaggtcttcctcaaagtctttaatgagcgtgtaggatactgcgctgactttcctcatattgcgcacttagaacgcgagcttgataaacgtaatcaatacgcatctttcaaggacaaatttgctgagttgactcaatcaacttgggaaaaggagcgtgacgcctatgacttctatcgagacgaactttcagaagcactcgctcatgccagtgagcaatcattagagtctgccaaagcgtgggttgagcaggttgaaaacaatttcccgctagatatccgaaacttctgtaagtgggttaatgaatacttagatcgcactggggatcgtaaccttcttttcttagtcgatgaagtcggtcagtttatcggtaagaacacacaaatgatgttgaagcttcagaccattactgaagatcttggcacatattgtggtggcagagcttgggtcgttgttacctctcaggcagacattgatgctgccattggtggtatggataagcgcgatggcgaggacttctctaaaattcaagggcgttttagtacccgcttacagctgtcgagctcgaatacctcggaagttattcaaaagcgattgttgtccaaaacggaagaagctcgtacacacctcatcgatgtctttgctgaaaagggcgacattcttcgtaaccagctgacatttgataaaacgacaaccgcgtctctaaagggctacaccgatgctccgtctttcgtggacaactatccgtttgtgccttaccactacacgctggttcaaaaagtgtttgagtcaattcgaacaaaaggcgcgacgggtaagcacttagccatgggtgagcgttcattacttgatgctttccaatcagctgcaaaacagatgaaggactctggccttgatgtgttaatcccgttttatagtttctacgcaccgattgaaagctttttggagccagcggttaagcgaacgattgaccaagcctgtgagttggattccttaacagaattcgatggcaagatcctaaaaacgcttttcttgatccgttatgtggacgttgtcaaaagcacactagacaaccttgtgacgctgtcaattgatcgaatcgatgccgataaaattgcgctgcgtaaacaaattgaagagagcttgaatcgtcttgaacgccaattgctgattgcgcgtaatggtgatgagtttatcttcctgaccaacgaagaaaaagagatcgaaaacgagatccgccacactgacgttgaaatgtcagaggtctcgagcaagctttcagccatcgtatttgacggtattttgaaaggtaatcgtgcctatcgatacccgattaataagcaagactttgcggtgagccgtttttgcaatggtcatccaaaagatggcaccacgctggaagacctagtcattaaagtcatttcacctttggattcgcactttgaaaattacgcccacgatcaagcgtgcatcaatcatacgcttgaggctgatgggtgcgtgctcgtcaagctgggcgaacataagcgtctttgggatgagctgacaacctttataaaaactgaccgattcttaaaacaaaattcaggacagcgaccagagcaagaacaccttctccgcgaaaagcagatggaaaatatggagcgtgaaaaacgcttaagaacggattttgaagctttgtttgccgaggctgacgtttacgctatcggcacaaaactgccgaagaaatcagcaacgccaagtgccatcgtcgaagaagcatacaaatacgttatcgaaaataccttcgctaaattgaacatgctcaaggcaacgcctggtgaagttttgcgtgagctacaggccgttcttgttgctgatgatattgctcagattggacgggatcttcaagcggatgaatgtaacccagaagctacgcgtgaggttgagcagtacgtaacgctaaaagtcgagcgtaatgagcctgtttacttacgtgacatcgttgcccacttcggcaagcgcccgtatggctggccagacaatgaaatcttattgctcactgcaaggctgggcttggctggaaagttatcttttagtacccaaggcacagatctggcgttgaaaaaagcttacgagccgtttaccagcgtgcgtaaacgcggtgagatccgtgtacataaaatcaggcaacatgacgagcgccaaatcaaaaaggctgctggtcttgttaaagagatcttttcaaaaacctttaccggctctggtgaaaaggagctctacgaattagtgcgcgatgaattactggcttggaatgaaaagcttaaatcattcagaaccaagtcacagacaggccatttcccaggtaaatctcaaattgacgatggtcttgcattggtcgcgggtattcttgagcaaacttcaagcttcgctcttatcacccgattcttagaagacgctgatgcccttgaagagtttgctgaggactttgaggatcttgatgacttctacaatagccaatttcaaacttggcaagcccttgctggcgcattgaacgagaagtttaaggccaatagacctgcgttagaaaaagacagtgaagcattaaaagcgctcactgaattagaacgcatttacaatatgccctcaccgtatgagcagctgcgccacattaatccgcttatcgagcaggtggcaaaagttaactcaacattggttgaagaaaaacgcactcatgccttagagcgtgttgatctgcgcatcggacgtgtaaaagaagcgctagctgaagctcatgcaccgtctgaattacagaaccaagcactgcgcccgttacaaatgtgcagacagcgcattgaagagacctcttcaataccacaaattatcagtgagcaaactgaagcggaaggttacgaggacgaagcttatgagttgctgaatggctttatcgaagatcaacgcaaaaaagctgaagctgagcaaagacgtcgtgaactcgaacagcagacacgcgaagaggaagcagcgaaagccggtaaagcagctccagcacctgagccagcctctgaaccagtgcagccacagccggttgcaaaacgtaccgtaacgattaactcaaccgatgccatggctaagtcagtaacaaccggattcattgaaagtgaagccgaagttgatgcctatcttgccgctttaagagagcagctgattgctgcggtcaaagctggcgaccgagtaagaattaagtaa

SEQ ID NO: 58 - DNA, 3579 bp, Exiguobacterium sibiricum
atgctactaaaagagatgttcttaaaggacattgaacgtgatatacgtggcgttattaaagtcgcacaaacgaatgaaaaggatatttatcaagaacttgatgaatatgtggtcactcaagagttgcacaaacatttctcgaagttctacgacaattaccaaaaaggaattaacggcaagacagataaaatgggtgtttggattagtggattcttcggatccggtaaatctcactttcttaaaattctcgcatacctattagagaatcagtctgttaaaggaaaacatccaatcgatttctttgaaaacaaagtacaagatacattagtctattccaacatgaaacgtactgctgatgtggacacagaagtaattttgtttaacatcgattctaaaagttctttaggtagcaaatcaaaagaagatgctattttgcgcgtttttatgaaagtattttacgatcatagaggctactatggggatattccaggggtcgctgaaatggagaaatacctggataaacgaggtttttatgaaacgtttaaacaagaattctatacgttagcaggtgagatgtgggatgaacgtcgtaacagcttctacttcgatgcagattatatcattggggcattaaccaaagcgacagatatgtcggaagaaactgcacgtgactggtttaatgaaggtgtaaacaattttgaaattagtattgaaaaattctcaagagacgtaaaagagtatatcgatgaaaaaggaccaaaatttcatttggtatttttagttgatgagattggtcaatacataggagacagtcgtgatttaatgcttaacttgcaaacactaacagaggatttagggacacatgcgcaaggaaaagtgtggatcatggtgacatcacaagaaagtattgattccatcgtaaaagttaaaggtgatgatttttctcgtattcaaggacgctttgatacaagactatcgttatcttcgatatcagtcgatgaagttattaaaaagcggattttggagaagcataagcacgttaatgacaaattaaaagtgctataccctgaaaaaagcgcaattttaaaaaacctcatcagttttactggtagtacagcggaccttagaggatacaataatgagcaagagtttgctgaagtttacccgttcgtcccgtaccaatttaagttattgcaaaatgtatttgaacaagtacgtaaacatggctcatcgggcaagcatttatctgaaggtgaacgctcgatgctttctgcttttaaagaagcaggactacggtataaagacgaagaggaaggctctctaatccctttttatgccttctacgatacaatcaaagaatttttaaacccgtcgatatcgagagttatcgaaggggcaacagagaattcggttttgaaagatgatcgatttaatcaggatttattgaaagtattgttcatgattaaatacattaaagaattgccagcaagcattgataatattgcaacacttatggttgcccatattgatgaagataagcttcaacttaaagaaaaaattaaagcttctttgagaaagctaatcgggcaaaccttgattcaaaaaaatggcgatcattatctctttttaacagatgatgaacaagatattaaccgtgaaattaaacaaatgaatattgatgaagacattattaaacgtgagttagccaactatatattccaagatttatacgaggataaacgattcacttataataaatttcactcctttagttttaatcaaaaaatggacgaaaaaaattatggagctcagacatctagtatcgggttgcatatcttatctccactatcagacaactatcaaaagtcagatcaggaaatgatgatgataacttcagacagtagtgaaatgataattaaattaggtggtagtgaagcatacattgaggaaatagaagaagcacttaaaatagaagaatttcgtaagaaaaagaacattacacagcttccagaaaatattcaaaacattttaaacaacaagcaagctgaagtacgtgaaagaagacgaagagtacgtgaactgttagatgatgcgattaaaaacgggtctttctttgtcaatggagacaaaatggatagtaaaggctcttccgtaaaagaaaaaattaactttgcctttaaacaattaatcgataatgtatatttcaaattaggatatataaaagagcatatagagaatgagcagcaattgatcgttattttagcttcaatcaatgatcagctgtctctagacgatagcattgtgacaaaaccaaatgaattagctaaacgagaagtctatgaatttatcgatatgcaaaatcaggcccaaaaacaaaattatgtgaaagcgatatatgagcgtttccaagataaaccctttggatggaagcagctagatattgctgggttgcttgtagagttattaaaagaacagcgtattcgtattcgctatcattcagagtacttagaacctgaggtagatacagataaattaataaaagtcttaggaaaagcaagcgaattaggaaaaggactaatctttaaacgggtgaaagttgacggtgcactcattcagacagctaaacgggtatgtagagaagtttttaatacaactgatttagcagatgatgaagatggtcttgtcaaagatattcgtgtactcattggcaaacaaatagacgaaattaatttatataaagtacgttacgaaggacggaaatatccaggaatgagtttgcttgataaagggctggagtattttactcaatttgagcaaaagattgataacgctacatttttcaccaaattaacagagcttgaagaagaattgattgactgggaagaagatattttttatgtgaaaagtttctttgacacaaaccagaaagaaatttttgatcaaggtttagctggattgaataagtacgaagaaaataaagcatatttgacagactcaatcgtaacagtggctatgacgagtctcgagtctattatccaaaatccaattccttatcgtaagattaaagaaattccagaattgatttacaaattagaaaagcaaatgacgtctcttttatctgagaaaaagaataacgttcaagaaaagctaaaagccgataatgatgaattgtctctacatgcaagacaatacggagtatctaacgaaacaacgcagcaaatcgaagaacgttatactagctttcaaactaatttagatgcatttaccgatatttataaagttgatgcaactattgcccaaagtacaagttttaaagaacgaagtatccttagcattaaacgagaaattgctgaatggcaacgtaagaaagaagaagagcatcaaggaggacatggcgatgaggttgttgatccaccaattagcccactagaaattcgtacagaaagtgtaaaagtaaaaaacttagttgatataaatacattaaagacagaacaagatgtagacaagtatattaatgccttatctcataagttaaaacaaatcattaaatcaaataaagagatcaaatttatagattaa

SEQ ID NO: 59 - DNA, 3600 bp, Flavobacterium branchiophilum
atgattacaattaaagatattcttaaattaaatttacaagaagatattaaaaacgtgattgaccttgaagatcaatcggaaaacgaaattcaatcggaattagaatcttatataattacggatggtttaggagagcatctatctactttcgtaaaacaatatacaagtaatattaaagaaaccggagtatggctttcaggattttatggttctggaaaatcatattttggtaaaattctaggttatttaattgaaaaccctaccataaacggaacacctgctagagatagatttatgccaagattggctggtgtaaagaatgaaagttttataaaaaatgatatccttagtttaaattctaaaaaaagtaacgttgtatttttagatattgctcaacaaaatactgataatggattgtctttcactttatttagtgcctttttaaaaaaacttggtttacgaaatgatgtttatggctacatggagtatgacttgtttattgaagataaactagattttgtaaatcaactttcattaaagttattcgataaaaattgggtggatataaaatttagtaatcgtgaaattgcaaaagcgtttagagcaatatacaaagagttaggttatagcgataaagagtttgatgaaacgaaagaagtttacataaaagcaattgaaaattttgaatcagacatttttaaaatagaattagaaaaatatattaagaaatacaatgacgaaaatatcgtatttatttttgatgaaacaagtgaagccattagccaagggaaattcaaaattttggatttacaggctataagccaaagcttatcaagtattagtcaaaaagtgtggactattgctattgcacaagaaaaattggacaatgtaatcatcaatgcaaatattaataaaagtcaattaactaaggtaacagaccgtttcaaaacaaaaatgaacttagaatctacagaagtagatgtcataatgaaaaatcgtttgctacttaaaaaagaggaagcctatcaaaaattggtcgattattacaagaaaaacgaaggactaattagcgatagtaccaatctgaaatcatcttttccaacgaaaacaacctcttctgatgaattcgcaacgtactatccatttcacaaataccagtttgatttattgcaaaagttcttgttcagttctaatgctttagtaaccactcaagtgggagctcgtgggatgattattaccaccttcgacgtgttgaaaaaaacattggcaaaccttgaattgtataaatttacaacagctcacgatttgtgcacgcaagcacaaactgcaccacctgctgatttagacaataaatataaaaatgctacgagaattctagacaatagcaacattgatataaatggcgaaaagcttttaaaaaccattcattttattaatgaagcagaatctattgcttcgccttcaattgaaaatattacgaaattatacaatcctgatattgaaaaatattatgaagtaaaacctcttgtagaagaagctttaaacctattagtagaagctaaaatagtgttggtttctaataacaaatataagattacatccaacttagaaggaaaattgttggaagaaatgaaagacttcgatgtagaattattcattaaaaagagagagttagtaaattacctcaaaaagagtaatattttccgtcctatcgcaacaattaacgaaagtaaagtagcctataactttaatgtactaaccgatttagatgatgaaataattggttcaaacaataaaaaattaaaactaaaggcttacagtttgtttaacattaatggggacagacaagattttattgaagctattagattagaaacccaatatacaaaagatgccattaccttaattccagacaatgcagctttcaataccatagacaaattattagaagaggtgaaacgctatggcttcatggaagaaaaatacagcggcactgatgacgaaaaaattaaaccaatcattcgtgacttctctataattaaaaatgaaaaagaaaaagatgtaataaacttaattacggaagcctacgaaaaaggttctttaatatacctatttgatgaaaacttattgaataaagacaatttcaaaaacaccatcaatgaggtgcaaaagaaattaattaaaaatatttacacccaaagactttcaaaacaattagaggagtcaaaaggagtaaaaatcctcacagaatcaaaccctttaaaattaaatttatacaacgctggtgacgaattcaaatttttcgataccaatggtaacttcgtaggagatcatcttaaaattgtagagcaactacgtacaaaaattaacgaacgatacattgatggtagaagtctagaagaaacctttggtctagatccatggggctattcttatggtacaatttctactaccttagcggtcttgtttagagcaggaaaactagtagttaaaacaaacgataccgattacttctcctattcagacagagcggttcaagaagtatttgcttcgggtagcaaattcaaaacagccagtttcaaatccatttctaaaacactttctacacagcaaaaaagtgaaataatcaatcaattaattgctttagaatttgaaaaacataaagaaagaaaaataagcgatacgtcaagtgatttcgacgtggcggatgccgtttctgtattagcagaacactttgttacgatagtaaaagcattagaaaatacagtgcctgatttcaataaaactttcaaacactgcttagaacaaagaaacttcttgcaaggttttgtttctaaaactaccgaagcaaattacatagacaaggcagaagatttcttaaaggattccaatagttacgctacggctataaaaacggttattaaaacggagaatttcgttaaaaagaacttagacaaaatcaaaggcttttcaaattttaccaaagcggttgaaaacgaattacaaaaagccaatagccaaaaccaaatcatcgaaaatcaaaccaaagtttttgacgaggcagtagccaaagatgtgatcgaaaaatttggcgacatacaaaatgccgtacaagccattaaagatgaatattacaacctcatgaaggatagcgcaactaaaatggcaacagcttacaaccgtttaaaaacggaaatagaaaaagcacaagccgatttagatactaattatcctgcggaattaaacattgagaacaaaaataaattaaaaatacttttagacaattgcaacaacaaaacgtccgatgatattgaaatcatttataaagtacactgccaaataacaggcttttcactttcagatattttaaactacatcgatttggtgcctacgcgcgaaaccgatttacaaattattaaagggaatttcctaaaagaagcaccaccaacaccaacaccaggtacacctaaaaaagtacagcttaacattaaaaataatgtaatgactgccaaagaataccgaggaatattagcctctcaattgcaatccttagcaggtttggataatgacgaaatgattgaaattacaataaataattaa

SEQ ID NO: 60 - DNA, 3624 bp, Gallionella capsiferriformans
atgaaaatcagagagctgtttaccaaacctatcgaccgaccaatcaacggtgtgatcaaagcggatcaacgcgatgccgagagtatttggcaagaactggatgagtacgtcgtcaccaagcagctgaccgagtattttcgacgttttttcgatgcgttcctagcagctgctgatagtcctaaagatccggtcgtcacctcgcgtatgggggtttgggtttctggcttctttggatcgggtaaatctcacttcatcaaaatcctttcctatctgctggaaaatatcgaggcaattgatcctgcaacaggcatccctaaacgcgcggctgcattttttgatgagcacaaaatcaaggatgcactcctgctggcggatattcagcgtgcggtaaagggtagttccgatgtcatcctgtttaatatcgatgccaaggctgacagtaaatcagaccgtgatgtcatcttgcaggtgttcctgcgcgtctttaatgaaaagctcggctactcaggcgatgcgccacatatcgccgacatggagcgccatctggttagtaagggcgattttgaagcgttcaaggtggcttttcaggaaaagaatggctcgaactgggacaaagagcgggatgccgtggattttctgcgggatgacgtggtctatgccctggcaaaatcactgaatatgaccgaggagtctgccgggctttggttcgacaattctcgcgacgattacaaaatcaacatcgaaggtctggcaaaaattattcgggattacctggcgaccaagccagccggtcatcgcgttatcttcctggtggatgaggtggggcagtttattggcgacaacacgcagatgatgctcaccctgcaaaccatcattgagcagctgggtggcttgtgtcagggcagggcgtgggtgattgtgaccagtcaggaagacattgacgcggctatcggtgaaaccaataaggccaagtcgcaagacttctccaagattcaggggcgttttcacacacggctgtcactggcgagttcaaataccgatgatgtgatcagcgagcgtctgctgtccaagactgaagcggcgcacgtcgagttgcgggattgcttcgcccagaagggcgacatcatcaataaccagctcgcctttgtcggtaactcagtctcgatgcgcagctacaaggatgcggctgaatttgtcgcctgttatccttttgcgccataccagtttaccttgctgcaaaaggtcttcgagtctatccgcaaggtaggggcaacgggtaagcacttatccaaaggcgagcgctcattactggatgcgttccagtctgctgcggtgcgtaatgcggatcggaatattgatgccctcgtgccgatgtatgatttttatccctccatcgaaagctttatcgataccagcgccaagcgctcgattgatgaagcgccctcgaatccatcgctggaaacctacgacgtactgctgctcaaggcgctgttcctgattcgttacataccggatatcgttaaacccaatgttgataatctggcaacgctctgtgtggatcagattgatgctgacaagctggcgctaaaacgcaagatacaggaaagcctgactcgactggaacagcaacgtctggttagtcgcaatggcgacctatggtttttcctgaccaacgaagagcgcgatgtcgcacgggaaatcgggcatgtcgatgtgtcttcggttgaaaaatcccgtttgctgggcgagttaatttttgaggaaattctcggtggcatgaccaaaattcgccatcgcgataccaagggcgattatgaaatcaaccgtctgttggatggtgcgccgtggaaaaatgccagccatcagctctcttttgaaattgtcacgccgttgagcgatgactacgagtcattgagtgatgccaaggcgattttgcgtagcgctgatcgtgccctgatccgtatggcagagagtaacaggctcgatattgagctgaacctctatcagcagatcgaaaaatatatcgacagtcctaaagccagctcagctgctgcaccgctcaaacgtatcctcgccgaccgtaaggatgaaaaccgtgagcgtaaagcacgcttgatcgagcagctcagtacggcactggtcaatggtgactgttatgcgttgggtcaaaagttgccgagcaaggcagcagcgccttcgacgcaagtggatgagttggttaactacctcatctccaatacctacaccaaactgaaatatctcaagatacgccagcttgatccgattgccgagatcaaggctgtcttgatggctgacagcattggtcaacatgccttgtcgttaggcggggaggagggtaatccgctcgcgctgaatgaaatgcgggaatatctacagctcaaagcctcccaaagtcgggtgatgttgtcggatgtggttgatcgcttcagcggcgcgccgtggggatggaagccggaatgggaaatcgtgctgctgattgctcgcctgttcatggcgggtgaaatcaaacttgtgtctgacaactccgatctcgaacccggttctgccgtggatgcactcaccaagtcggtgcgcttcaagcaagtctccattctcaaacgtaaaactgccgatgcagttcagctcaaacgcgcgcgtgaactacataaagacctgttctccaagctgggtcgtgatgacgaagacgggctggttgccgatttccgcgaaagtctgactcaatggcaatccaagctgaaggaatattctcacctgtccaccaccagacatcaccctggcaaggcggtcattgagcaaaacgtgttgagcatctccaaacaactggcgatccgcgactcgtttgaatttgtcgaggccatactggcgaataaggatgaatggctggatgctgccgatgatattcacgacctgatcagcttctatacgacgcagattgcaacctggcgcaggatgcttgacgcgttgcaacgatttgaacccaatcgtcctgcactccttaaagaggtcgcggcggcgactgcattgcaacaattggaagctatacgcgacaactccatgccttaccagcaaatcaatcagattgagaccttgatccaatcggtagatgcggtgaatgtcaaactcgtagatgccaagcgtgaacacgccttgctcttgctggaaaagaaaattgctgaggttggaggcgcattggatcaggcgcatgcacagcctgaattgcgcaatcgtgccttgtcttcgctacagaaaataaaattggatattgcggctcaatccagcatccctcaaatccattatttgcaggatcaatccggcagtgcgctggatggcgcgatggatatgattgccgccgcgctgagtgcagtacctaaagcgcaaccgctcgccgtaaagtcgccgggtgatcatgcgacggttatcaatgttggctcagtcccgataactcagaccgttacgccgaaacctgccagggtcattcgtgcagcggattactccagcaagtcttatcttgagacggaagacgaagtggatgactatttaggtaagctcaaagccgagctgctggcggcgatcagggcggggcagcgggcgcggatacagtaa

SEQ ID NO: 61 - DNA, 3486 bp, Gallionella capsiferriformans
atgaataacatgaaaaaccgcgaaattttcgacaaggatgttgatgctttttcactggaaaaccagggcgttgccaaagttgatgaagcgttagacgatcagcaacgccagacactccgctttgagttagaaacatttgtttgcaaggggcattacgaagaaggactgcgccgcatcttagagtcctttgtcgaaacgttgcgcaaagggcaagaagcgcctgccgcgtgggtatctggcttctttggtagtggtaaatcgcacctagtcaaaatggcccgtgccttatggaccaatgaaccgtttgatgatggtcgcaccccgcgcgatattgcccatctaccggtttctgtagccgatgccctcaaagagcttgatacgctggcgcgtcagcgtaaaaccaccatgcgtgctgcttccggcactttgagccaaggtgaaggcgatagcatccgaaaagccgtacttggaattgtgttcaaagccatggggctgccagcaaaatatgacgaggctcgcacactactatggttacgaaacgaaggaattgagcaggcagtgcgtgacactttgcatggcaaaggccgtggcctggaacgagaacttcaagacctttatgtttcatcacacctgcatgatgcaattctgactgcgaaaccttctttggcgcgtgacgcctttgacttaggggacaagctagaaaatcagttttcttccaagggagacatcgaccaaaatcactttctcaaatacttccgtgaagcaatttgtggcaatgacgaatttccagtatttctgctagttcttgatgaacttcagcaatatatcggcacggatgccgcaggtaatgatcgcgcattacgagtgcaggaagttttgcaaagtctatcggccaatgtaaatggccgtgtcttagtgattgcaacaggacaaagtgctctgtctggcctaaatactttatccaagctattaggacgttttccaattcccgttcaactatcggattccgacgttgaagaggtgctgcgtgaaacggttctcaaaaagaaggcatctgcaagcgctccgttgtcagcactgtttagctccggcggctgcttgggcgaagtgtcagcacatcttcacagcagtctcttcgcgcatcgccgagaagatgaagcaattctcgcatcaagctaccccctactccccacccgccagcgcttgtgggaaagggtgctggccacaactgacaccactggaacaggcgtgcagttgagatcacaactgcgtcttgcatttgatgcagtgcgtaaaagtaaagatgcgccgctgggccatattgtcggcggcgattttatttacgacgaaattcgtatgaggcttcgtcaatccagccaaatcagcactgagactgcaaatgcaatcgacaaccttgatggaaaaaatgcccctcacgccaagctaaaagcacgcgtgctcaaagcggtttttttactgacccgaattaccaacaactccgcgcaagacacaggccttcttaccgacgctcaaaccgttgcagacgtattggtcgacaacctaaccactcccagttcgacattacgaagtgacgttcgcacggcacttgatgagctagttgaaaaagaccacttgttgatgcgcatatctaccggtgcaattcaagaattcagactgcaaacaaaagagagcgcagactggtttgcatatcaacgcggcgaagaagatgcattgcggagtgatccttctgcatatgaaagtaaaattcgcgaacaattaatgcaactagccagcgaacaagttcgcaagcaacccattccgcaaggcgtcagccgcgaaatccgccgcctgaaactacataccgatcccatcaccgcacccaaagaagacgatggcgttcccgtttggttacgttccgacctagatggcacgcaggcaaaggaggtattgacggacgctgcgcgcgccggccttgactccgccatcgtgtttggccatgtagcgttacctaaaaaagatgagctagtacgtgccatcatcagtcgcgaagctgccgagcgcacgctgggccattttggcgaaccccagacgccagaaggtcaagaagcccgtaatgcgctgttgaaacaaaaaaatgatgccgatggtcgcgtcaatgatctgattaaggaagcactttctcaagctcaaatcattcaaggtggcgggcaaattatcgaagatggtgctggcctagatgatcgactgagaaaagctggtagtgacggtgctgcacgcctctatcgaaacttcaatctggcagattttactggctgggataaagcttatattgcagcggataaaggattggtcaacgcattggaaagtatcggtcactctggtgctgcggagaatcatcccgcagcacaggaaattatgactcgaattggctccgccactctcaatggcagcaaaattcgtacagaatttatgggcgctccttatggttggtcaaaagatgctgtggatacactattggctgtgttgtttgcctgcggccagttaagagtcgtaaatgcgggaggatccctttggcctgctggtaagtttattagccgtgatgtctccaccagcaatttctcgcgtgaaaatgcgcctatttccaacgaagaaaaacgtgccattgcccgcctggtgaaatgcaggccggatgaggcggagatacgcgcaccggaatttgtcagcaagctaaaagatacgcaggttcgagccaccggtgccgctcctcgcccggaagcaaaacccaatgcgctcatcgacgagctttccaccatctcgggccgtgatctcgtcaaacgtctcgcagaagaagaaacagcagcgtccgaactgcttaatgcgcttgaagctcaagccgccaaaatcaccaagcgagaaccggcctggctgcaacttaatgacttaatccggcatctgccgggtatgccagagcatagcgtgattgccactgaacgcgatgctatacgagatgctcgcctactacttgatgatccagataaagttgaacccttagttaatcgtgcggctgatgtgctgcgaggcgcactcaatactgcttatgctgtttatcacagcgaatatacagcctgcaccaaagaaattgaaaatgcagccgagtgggcaagattggcccccgaagaccgtgcagcaattttacgcgaggctcaactttcaacacctgaacaggcacccagagtcggtacgctttttgaacttttggaatcactcaataaatgctctccacaacgctgggcagaaagacgagatgcctcgcgtggtcagctgagccgcgcactaacattggcagcacaaaaactggagcccactgtccagccaattgcagcacctcgacgaatcttacgttccgaggcagatctcgatacctggctggccgaagtaaggaaaagcgttctggaaaagctgccgggtggacctgttcaaatttaa

SEQ ID NO: 62 - DNA, 3552 bp, Geobacillus sp.
gtgttacaaaacacatttactattcaggaactgtttaaaaagccgattgaccgcgaaattaatggggtagtgcaagcgggacaatacgacgaaaaagtggttcacagcgaattagaagaatatgtcatgacgaaagaaatcagcgaaaatatgaagtatttctttaaaaactacactaatagttttgatcatccgacgacaaaaataggagtatggatttccggcttttttggttcaggtaaatcccattttctaaaaattttatcctatttgctcaacaacgaaaccgtatatggcaaacgagcggttgatttctttacagaaaaaacagatgaccaagaattattagaaatgatgcagcgctccgcaacgtatgatagccatgcaattttatttaacgttgattccaaatcagcgggcggtaaaaaagaaaaagcaactattgtagaagtatttttaaaagtatttaacgaatatctaggatactctccaacgccttggattgcccatatcgagcggcaattggcggacgaaggagtatacgaggaattcgtaagacattttgaagaaatagaagggaaaccgtggaaggaagaacgggcgcggattttattaaaacgcaaaccgttcattcaggcgttagctagattaggatatgacgaagaaacgtcggcaggcttcttggacgcggctaagaaaacgtttgaaatcagctcagaggaatttgccaaaatcgtggccaaacacgtcaaagagaaaggagacaactaccgccttacattccttgtcgacgaaatcggtcagtatattggcgatgatccgaaccttatgttaaatctacaaaccgttgtcgaagatttaggaaactattgccaaggaaaagtgtgggtgattgttacttctcaagaacaaatcgatgccgtaacaaaaattaaaggcgctgacaatttttctaaaattcaaggccgtttcgcgacacgtattcacttaacgagctctaatacggacgaagtcattaaacgccgtctattagaaaaatggccggcagctgccgatcatttaaaagttgaattcgaacaaatcggacaaagtttaaacaatacgctaacgtttgaaaaagatacgtgcgtgcttcaaagcggattcaaaaatgaagaagaatatgcggcgatttatccgttcgtcccatatcaagtcgaattgctgcaacgggtttttgataaagtacgccgccaaggagaggcgggggcacatttagcgcacggagaacgttccttattaaatgccttccaggaagttgcgttgcaattaaaagataaagatacgaaccagctagcgcgcttttctcaattttatgaaacggttaaacgatttttaagcacctctgtttcggcgacgatcgcatcagctgcgaaacgcgaaggcatcacggagtttgatgtcgaagtgttaaaagtattatttatgattaaagggatcgagcagattaaagcaacggtagaaaatattaccactttgcttgtcgacagtgtagactgcataaaaaatgatttagaaaaagaagttcgccgttcgttaaaccgtcttcgccgaaacatgttaattgcggaaaatgcggataaaacgttcgtgttcttaagcgatgacgaacaagagatgaatcgcgagattgaacacgaacatattaacgaagcaaatgtcattgatgagttgggcaaaatattttttgaagatatcgtgcaaatgaaatcatatcgttatcaaaaaacacatgactttgaattcaataaaatatttgatacgtatactcgcggtggacgaacaaatgaactaacgcttcaagtatacacgggggatgtcacggaagaacaagcgcgggctgaggcaaactcaggcattttagtcatgtatattccacaagaatttaccgaaaagttttttgaaccgatggaatacgcgttgaaaatccgatcctatgcaaataaaaaaatttcaacgagcttaacggaaagacaacgtaaaatactggatgaaaaacgccaacaaatcaccgaatttgaaaagaaagcaaaagaagcgctagccgaagcggcattgtatgcgacttactatgttcaaggacaagagtaccgttttaacggcagtttagaaaatcagctgcaaagcgcttttgaaattcttgtccgtaatacgtacagctacttaagctatatggaagagccggttcctgtcaaaaacgcgaacgatacgatttatgaatgggcaacaaaaggtcttccagcgaaattagacggaacgtttgccaaccatcttgcgtacgacacggtgtttcgtttccttgaacaaagccgcaatcggcaaatggtgacgatgaaattgcttgtagaaaaatttaaaagcgcgccttacggctggagcgaaaacgatattgccggattagtagctgctttaatgcatgatggaaaaataaaattaacgtatttaggagaaagttttgatacgagccatccacagtttatttctcggattacaaaagcgtcggaacgcgaaaaagtaatgattgaggcgcaaatcgccattccaagccacaaacgtaaaatcgtcgtagaaatgatgcgggagttatttaacttctacgatgttggcgaaacgtatgatgaaattgcgaagaacattcgcatgcaaatgcaaaaacatttcttagaaccaataacagagatgctgaaaataaaagaatatgaagatccgcaatatccatatccaggcggcattcagctcgcgaaattaaagaatagcatcgaggaattgttgtcttattccaagagcgagaatctcgttgaggaattcattgagttggatgaagatttggaggaatggcttgaggatatacaaactttatctgcattttatacaaaaacggccattcgctattttgatgaaagtgtccgtctattaaaagagcgtgcggatgatttagatatcgccaaaaatcaaacagaagtacaaaaaattaaaaatcaaattgtttccatcttgacaatggatcatccttatcgagaaattcctaatctaccaatcttaaacgagaaattaagaacagaacttacgaattttgtaaagaaagaactgggcgctcagctcgaacaaatggaagaaattcgccgcaagatggaagagttgaaagagcggtacagcatcgaagtgatcaaagcaatggttcaacatgaattagaagagctgcaagcccgtatagagcagctgaaagatatggacagcatttcgcgtgtctactcctacacacaaatggcgacaaacgatttgcgtcgtttggaagaaaaagtgtatgaactgtatgtacaatatcagtcggaaacgagtgacggcgatgatcgtcaagtggaagtgccaatctcacgattcatccaagtcatgataccgtccggtcaagtcgaaattcgtactgaagatgacgtggatcgtttattagaaaaaatgaaacaggaactgctaaaagaaattcagaatggaaaagttgtcgtcattaaaaagtag

SEQ ID NO: 63 - DNA, 3645 bp, Geobacter sulfurreducens
atgaacaggattgctgatgtctttgaaagacccatcgatcgtaccatcgaagaggtcatcaaagttgaccaggcgaacgaggctactgtccaaaatgagctcgaagagtatatcgcgacggattcaattaaggaccaatttgccgaggtttaccgcgagatagctgccggtccgtctacacctcgagaggggattggcgtatgggtttcaggtttcttcggttcaggtaaatcatctttcgccaagatccttggctacactgtcgcccagcagaaggtaggcgcaacaactgctaccgagctcttcaagaaaaggctgcgagatgcccgcgtcgtagacctgctcgatctcgttaccatgcgaatccctttccatgcggtcatttttgacgtttccatggatcgcggtgtgcgcgccaccaatgaccgtctcacagaaatcatgtatcgcgcgctgctccgggagttgggttatgcggaagacttcgatctggccgaactggagataactttggagggagacggtcgtctcgaagctttcgaacggaagttcttggaattgcacggatcggagtggaagaaacgccgccagctggggctggcaatcaatgaggccggtgccgcgctacacgatctcgacccgagaacctaccctactgccgactcgtatgcccagggaatcggagccggccgggccgatgtcgacccgaacaagctggcccgtcgagcctttgaattgtgtgcgcgccgccatcctggcaaggcccttatcttcataatcgacgaggtgggacagtatgtttctcgcagtgtggacaagatgctcgatcttcaggcaattatccaggcatttggcgtcgaagggaaaaaccggaccgaacgccaggaggctgtttcgccattctggatcgtcgtcacttcgcaggaaaagctgaacgaagtggtcacggccctcgactccaaaaaaatcgagttggcgcgtctccaggaccgtttccgtatcacggtggatctcaagcaatccgacataaccgaagtcaccagcgaacgtgtcttgaagaaaaaggccggagcggtggacctcatcggtaaacgtttcgatgccgatgaacccagaatcaagcagtgctgcactctggaacgcacccatcggaacctggaaatcaatcgatcatcctttgtcaggctctatccttatctgccctaccagatcgatctatgtatcgacatcgttgccgggttgcgcctcaagcggggcgcccatcggcacgtcggcggcagcaaccggacgatcatcaagcaggcccagcagatgatgatcaatgaccgcacgcgcctggccgagcagcccatcggtacgctcgtcacgctggacaaggtctatgaactgctggaggtcggcaatctgctccccaccgaggtctcccgcgaggtggccaacgttgcccagcgattgccgggtaacccgcttgcccataaggtcgtgaaggcgatcgcactccttgagtccgtcaaggacctgccaaggactccccataacatcgcggttgtgctccatccgtccatagaagcaaacccactgaccaaagacgtggtggctgccctcaaggagcttgaagaagcgcagtttatccgccaatccgaggaagggtacaaacttctcaccgttcaggagaagaactgggaaacgcaacgcaacgggcgcgaccctcgtgaggccgatcgcaaccgaattcatcgagagttgattcgcgagattttttctgagccgaaactgcgtacctaccgctacaaggacctccgtggcttccgcaccagcttacttgtcaatggcgagtgggtggagtcagagggggaaattccgctcaacatcctccttacggccagggaggagcatcaggataccctggtcgacgcccgcgaggcgagcgtctccaaaacaactgagctgttctgggtggcaacgctcaccgacgaaatcaactccctcgtaactgagctcttccgttcgcgagagatgatcggggaatatgaccggctcgcagcacagcagcgtctgacggttgaggagaccggctgtctcgctgatgaaaaaagccggcgcgatcgtacccaaagaaatcttcgctccaagcttctcgcctgcatcgagggggggaacgccttcttcagcggagtcagctacgacgccccggtactcggttcgtccctttccgagtcccttggtacgctgcttgagagggcggtaccggtcctctacccgaaactggaggtcggggtgctcaggctcaacggcgatgagccggtgaagtttctcacttcagctaacctcaacggccttcctcagatcttctaccacgacaaggccgagcggagcctcgtcataaagcaggccgaccgctttgtgcctaaccttggctgcgagctctgtcgggaacttctcgactacctgaagcgtgaacatgcatacggcaaccggataaccggaaaaatgctggagtcccacttcagcggcctcggctacgcctgggagcgggagtccatccgcctgggacttgccatccttttccgcggcggcgccatagaggttacccatcagggacgcaaataccgtaactataccgagccgacctcgcgagtcccgttcgtgaacaatcctgcgtttcggtctgcttctttttcaccgcgtgaggcgctcgatctcaaagtcctagccaatgcagcgcggatgtatgaagaaatctccggtagggatgtggatatcgaggagggggcgattgcccaggcattcaagcagattgtagtttccgaccgcgaaaagctcctccctctggccgcccgcctgggcgctctcagtttgcccggtgccaagattgtgcaggaacagcttaattgggtcgagggtattctggagatgcccgccgatgactgcgtgaaaaccctggcaggcgatggcaaggcttatcttgaggggcgtcggcagtcttttgcattggataaagcggccaccgatgaaaatatccaggccatagcacgagcccgacgggttttgatggaacaatggcctgttctcgtcctgaataatgacgatccagagctgaaggatgcggccgaaaaactgggtgagacgttacagtcggaagatgcccttgcccggatcgataacctccgcttttacagtgaatctctcagcaatgcctaccgaacgttgtacgagaacctgtttgaaaagcgcaaagctgcctacacagcagctcttgaccagatcaaggggcgtcccgaatggctcgccgttgccgaagaccccgatatcgcacaggaacagctggaccttattctccagccgctgaccctgaaggctgaggctgttctcgaccttccccatggggctacggtatgtcaacggaccggcgccaccctggcccagctggagagcgacctggctgcggtggaggcagtcggcagagacgtgcttcgtcgcatcctggaactggctgctccggaagaaaagattgagcgggtcgcggtggccaggctttatcccggtcgcatcaccagcaaggatgagttggaggatttcatcactaacctgcgggagcgcctttccaaagtcctcgcccagggcggaaccataatcctggagtga

SEQ ID NO: 64 - DNA, 3435 bp, Haliscomenobacter hydrossis
atgctgaacaaagaattatttacgctgaatcctgaacaggtcaacctcaagaacgaaggggtggccaagattagagcccttaatgaacaagaagacctctcggttgccgagtatgaattgaagacttttgtttgtgagggggaataccacgatggcttgcgcaaaatcttggactactacctccaaaattaccaaagtgccgaacaagctgctttttgggtgagtggcttttatggcagcggtaaatcgcatttggtcaaaatggccagctacttgtgggacgattttgagtttccgaatggcaaaaccgcccgcagcctcaaacccctcccccaagacatccaggatttgttcgtggagattgaccgcaaacaaaaaatccagggcaaattgtccattgcaggtaccttgcgcgatttcccttcccgggacatccgctactcttttttacaaattttcttgagcgctctgggactgccccaacaataccaccactttaagtttgttttttgggccaaaaaggagggcatctacgacaatttgcaggcattggtggaagctgctggccgcgattttcgcaaagaaatcgaaaacctctttgtttctcccgttttggccaaatcggtactcgaactcatgcccgaactggccgagaatgaaatgaaactgaaagacctctttaaggcgcagtttccccgcatcgaaacgatcagccgcgaggattttgtcaaaaccatccgcgacgaaatcctgcccctcttttttggttccaaaatcccctgtaccatcatcatcctggatgaggtgcaacaattcattggcgacgacagcaatttgtcattcgacgtccagctgctggctgaagacctctgctcccgcttcgatggcaaattcctcttggtgggcaccggacaaaatgccttgaccgaaaccgccaacctccaacgcttgatggcgcgtttccgtgtacccatccagttgtccaataccgacattcaaacggtcatccgcaaaaccatccttgaaaagaaacctgcttcggtagcgccactacaaacaaaattggaggcttcattgggcgaaatttcccgcaatttggagggcagcgtctttggctacctcaccgaagacaaaaacaccctcgtggcggattatcccctgctgccctctacccgcaaactttggaacaaggtcctgcgcgagatcgatgtggcgggtacctccgggcagctccgcaaccaattgcgtatcgtcgacgatagcctcaagtctattgccagtctggagctcggccaaattgtgcccgccgactacatcttcaatcaaaaccaaacccagctcatccaggctggcctcttgctgaacgataccagcaacctgattcaggagcgcaaggccaaagggggtgactccgccatcgagggccgcattttaagcgccgtttttctcctggacttgttgacttccaatgtgcccgacaccggcctcaaagccaacgaaaacaccatcgctgatctgctgatcgacaacctgaatgtgaattccgacaccttccgcaccaaggtaaaggcattggtcaaaaacctggtggaggcaaaggtcttgatgcccatcaatgaggagtacaagctgcaaaccaaaattggcgcggagtgggaacaggagttcaccaaacagcacatcaaactcaacaactcgggcgatgatcagattcaaaccttgcgccggggtaaaatagtggcccacctcaaagacaaaacccgcgccatcagtgtggcccagggtgcttcgcgcacggtgcgcgattttgagctttgggacaaagacgccctacccaataccgagcacaaactcaatctctggatccgcgatggctggtttgaaaatgaaacccaggtcttgaacgaaatccgggcggcgggcagcaacgcgcccctggcttatgcttttgtgaaaaaattccgcgatccggacctgcgctcggccatcatcaagttcctcgcggctggtttggccatcgatgccaaagggctaccttctacgcccgagggggaacaggccaaaaagagcatggaaacccgcaagagtctggccgagaaggaaatccaggacttgattgaaaaaatttgcgccgaaaccctcgtctacctcgccgggggcaacctcgttcagtctggcggactcaacgagaacatccgggaggccctccacagcatcgccgaccgccagtttcctgagttcaagagcaaagccgattttttgaattggggccaggctttgaccaaagcccaggccggaaacccggatgcactgactgccatccagtactccggtgatgttgagaagcaccctgtggccatggaaatcctgcgcttcatcggcaataccaccaaaacgggcaaagacatccgcaatcaattcatgaaagcgccttacggctggccccaggatgcggtggataccctgttgatcctcttgaaaaacaaccagcacctttcttccaatgaaccggatttgaaacaggggaaaatcaacccggctaccttcaaaaaagaagtgcacatcctaggggccaaggagaaaatcaccctccgcaaactcctacaggacgcaggcatcacttgcccgcccaatcaggagattttccctttttccaacgagtacttggccaaactcaaagccctggctgcccaggcgagtggcgaggcgccccgccctgctcctttcgacctagcctttattcgcgacatcgaaaacaaggagggcaacgagcgcctcttggacatgctccaacagaaggaggacttgctggctaccttcctcgattggagcgccaaggccgccacggtcagcaagcgtgaaccgctatggcaaacgctccgcgaactggccagccacgcgccggacgaggcgcagatggaacagctcaaaaccgacgtggccgccatccgcgacaaccgcctcttgctccaggaacccgacttgatccagcccagcttgaatgccctggccgagcgcctgctcgatgtgctcaatggcaaaaaactgcgctacaaccagctgtatgatcaggccatggcggccctgcaggccaatgaatatgtcaaaaaactgagccccgagcagaaacacggcatctgggccaaacaccaattgctcagcaagcaggagatcaagaccctggatgctcaaggcttgctgtaccaactgcaaaagacttccctctacaattgggataccaaaatcgccgccttgcccggccagttccaggcggctttggaggacgccatcctcttggccgcgccccaggctcaaacctacgctttgccgcgcaaaaccatcagctccccagccgacattgaggcttatgtgacggatttgaaagcgcaactggaaactttattggaaacggctagctcaatcatcttgaagtaa

SEQ ID NO: 65 - DNA, 3567 bp, Halobacillus halophilus
atgatgcagattaaagatctatttgaaaaagatatatttcgtccaattaataacgtcgttcaggctgaacaagtagaagaggacgtagtggaaacggaattggatgaatacgtcctgaccgaagaaagtgagcattatcttgagagattttataagaattatttagctgtctataatcaaccctcaacaaaagtgggtgtatggatttcgggtttctttgggtctggtaaatcacacttcttaaagatcctatcttatttattacataatcagacaattgcaggtaaaacacctgctgattattttgaaaacaagtccgaaaaccaggagcttctgaacatgatgcaacaagtatccgagaaaaaatcggatgcattattattcaatatcgattcacgttctacatcttcttctaaggattcggaaaaagagcgtattatcgaagtgtttctgagagtgtttaataatcatttaggatattcagataccttatgggttgctgagatggaacgccaactagatagtgatgggaaatacgaagaattcaaacaaacaatctttgatcaaaacggtaagtcttgggaagaactccgtttgaaaattttattacgtaaaagaaaagttataaaagctcttgaaacagtaggttatgaccaagatacggcggaaacattctttgatatgagcagagaatggttttctattgatgctcaacgagttgcagaactcgttgctgattattgtaaaagtcagggaccagattatcgtatcgttttccttgccgatgaaattgggcagtatattggcaacaacacaagcttaatgctcaatctacaaacaattacagaaaaactaggggatttatgccatggtcaggcatggataatcgtcacatcacaggaaaaacttgagtcaaccgtatcggatttagacagtacgaaagacttttctaaaatccaaggacgttttgagacaaaaattaacttatccagtgcgaatacagatgaagtaattaaaaaacgtcttttggagaaagaaccagttggtgctgatacactaaatactattcatgaccaagaaggaaaactgattcataaccgtttggcttttgatacgaataacactcaattgcgttccggttaccgtaatatcgaagaattcgtttccttttacccatttgttccttatcaaattgagttactgcagttagtcttcaccaaaatccgtaatctgggagaaggtgggcagcacacctctcgaggtgaacgttccttacttaaagctttccaggaagctgcccaattaaatgctgaagaaaatgtagataatatggttactatggcagaattttatccttctattcgtgattaccttgaatcatcgattacgggtacaatcgcaagagcgcaagatcgtgcccgtaaccaggaagggttagaagagtacgacgtaaaagttttggaagttctctatctaatcaaaggaatcgatgaaatcaaatctacaccaagcaacattgcaacactcatgattgaaacggtttacgatgaacgccaaccgctggaatacaaaataaaagaatcgttgaatcggcttcagactataatgttcattgagcagcacgcagatggttcctattcattcttatcagacgaagaacaagaaattaatcgtgaaatacgcgtagaagactacaacggttctgctgtgaaagaacgattaggcaatctcttttttaatgccatgtaccttcacccgaaatatgaatataagtataatggccagacaaaacattttaattttaataagcggtttgacagttatgtgaaaggacagatgaaccacgaattgaccatacaagttttttctgagggaatgacagattcagaagcgatttctaaggcaaattctgggtatttaatcgttctcctgaacaaagatctagttgcagaagcagagagggctcttgcatatattcaacaggtagatagttatgtacgacgcaagcaaactagtacaacttcacagcagcaaaagcggatttatgaattaaaacttggagaagtggatgaattcgcagaaaaagctgaagaactgttggccaaagcatgtgacaatgccagcttttacattcaaggtcaacgtcgtgatttcagtggcaagtttgaaaacaaaatcgatcaggctatgaatatgttggttcgtagtacatttgagaaattagattatattgaaaagcctatatcctttaaggacaacaagaaagaatgggagcaagtcgtaaaggatttgggacaacaaagtttgtttagcgacacaaataagaatgcaatggatgagatgaagtattttatagaagaacttgaacgttttcatgatcaaagaacactaaaacaagtcgtgcaaaaatataagacgattccttatggttgggaagaaaaagatacgatcggtattttaatggggttaatgaatgcagggaaagtacggtttatgtatgcgggagaaccttttacacctaaatcaaaccaattttatgatcgattagaaaaattgtctgaacgcgatcgcatagttgttcttccaattgtagaaatggataataagctgaaacaagaactgattgcacttgtacgagatttcttttcgattactcaaccgtacgatacgtatgattcttatgacgagttaataagagaaaaagtagaagaagaatttgttcgtcctattgaaaaggtacgtgaaagaagacgccaacaggataccacaagtgaatatccgtatcctggcgaaagtgatataagaactgtagtcaatggaacacaaaaattactggctaaccgagatccagagcaattttgtcgcacgttcatacagtacgaagatgatattgaagagtggtatgacattttagagaagcttcaaggcttttatgaaggaaatcctatcgtcaagtttgatgaagcggttaaagctttagttgaacatgaacaggacatagaagtcattcataatgatgagctaggtgaaatcgtacgacggatgaaacaaattttgttacaggaagaaccaaccaaagatatcagtcagttaccaaagttagtggataacctgaagaaccttatccaagatgaaaccaataatcaaaaacaggcagtacttgtacaatctaataaatctatgaatgaactagagaccctaaatgatcaatattcagaatatgaaactataacagaatacatccaattaagaacgaacaaagctagtcagctttatgaaaagataaaggaaagtgaacgtatttccagtgcgcgtatcaatcaacaacaattaagagagctgattgattgtacaaaagtcaaaacacggcagatgcttaaagaattaagagaggaatcagatgctgttaagagagaaccaaaggttattaccgagcgagaattatatgattctttctttaaccaagttgatagtattgattctgaagaagacttggagcgggcaattgagtcattaaaaagaaatttaataagagaattacaaacatactattttgttaaatcataa

SEQ ID NO: 66 - DNA, 3594 bp, Halobacteroides halobius
atgaatttaaaagagatgttttataaggatattgaccgtgatattaaaggtgttattaaggttggtcaagccgatgaagaaaatatgaaacaagagttagaagaatatgtagtgactaatgaattagcagatcacttttctgagttttataataattatgaacaggggattaatagtttaactgataaaatgggtgtttgggtatcaggattctttggctctggtaaatctcattttattaaaattttatcttatttgttagaaaatagacaagtagataacaaacctgcagttgaattttttaatgataaacatgttgagcaagaactactagctcaaatgaaggaagcaggccaagttcctactgatgtagtcttatttaatattgattctaaaagttcttctgatagcaaagctaataaggatgcaatagttaaagtatttatgaaggtatttaatgaaatgcagggcttttgtggtagtattccttggttagctgatatggaacgaaaacttgtagataatggtttttacgaagattttaaagctgaatttgagagtaatgtaggttttagttgggaagagaaaagacaagatgcttactttgaagctgatgcaattattgaggctttagttgccactactgatatgagtcaaaaggcagcagagaactggtattataatgctgaagataattatagtttaagtgtggagcagtttgctcaatatgtaaatcaatatattgaagagcaagctggtgaccatcatgtagtatttttagtagatgagattggtcagtatataggtgatgatacagggttgatgttaaacttacagactgtagtagaagacttgggtacatattgtggaggtaaagcttgggtattagttacttcacagcaggatatggattcaattactgaagttaaaggtagtgatttctctaaaattcaaggacgatttgatactagattaagcctatctagtgctaatgtagatgaagtaattaagaaacggattttaaggaagactgacagtgctagagaaagtttggagttactatataatgagaatgaatctattttaaagaacttaattactttttctagtgatacagctgaaatgaaaaactatagtaatgctcaagattttgctcaagtatatccttttattccgtatcaatttgatttattacagaaggtatttgaggaagtccgattacatggagcttctggtaagcatttgtctgagggagagagatcattattaagtgcttttcaggaatctgctcaaaagtatggtacagatgaattaggtagattagttccattttcagccttttataattcaattgaaacttttttagattcaactattagtcgagtaattactaaagctaaacagaatagtcgtttaacagaagaggatgtagaagtactaaagttattatttatgattcgctatattgatgaagttccttcagaccttgaaaatatagctactttaatgattagcaatattgatgaagataaattggctttacaagaaagaatagctgagtcattagatagattggttagtgagactttaattcaaaaaaatgggccagaatatatgttcttaactaatgaagaacaagatgtaaatagagagattaaaggtactagtattgatgttaaaaagacaatagaaaaagtaggagaaatattatttgaagatatttatccagataaaagatatagttattctacagagtataattttagctttaataaattagttgatgatcaggctcgggggcgtcaaaagaatgaaattggagttcaggttttaactccttattctcaatttaatagtgaagaagaattaaaacttaagacttctgcagatgataaagtaattattaaactgcctagtgaaagtaatttaatgtctgaaattgaacaatctttaaagctaagtacctatttgaagaagaagagtggaacagctaaaaatgaaagtatggaagatatcttaacggctaagagtagagaattaagagaaagacagaagcgaattaagaagttacttatgtctgatctgaagaaggctgatttttatgttaaaggtgaaaagatgaatttgcagactagtgacccagtagaaaatattaaccagagttttgaacggttaattgatactatctataataagcttaatttaattgaagagtttgttaaaagtaaacaaggcttacttgataaattagatagtcaagaagtacagattaattttagtggtcaacaagctaatagtatagctctggaagaggttagaacttatattgagcgacagaatgaacgtaacttgaaggtaacaatgaagaagttagtagatagattcagttctaagccctatggttggaaagaatttgatattgctgctttagtaattgatttattaaaggctcaagagattgatttattatatagtagccaaaatgtaaattctcaaactaataagctaattaaatatttaactagatctagacataaagaaagattaattgtgcggaagagaagaaaagttgaacaacgattaatcaataaagccaagaagttaggtcgagaagtcttttatgagtcaggtctgccaactgatgaagacggtttgaaggaagagctacaggatagattaatttataatgagcgaaatgttattagagatctattagataattataaatctaatccagctaatgaatatgaaacatatcctggccaagatactttagaagagggagatagtctattagaagaattaatggagataaatgattcttttgagttttacaatactttagcagataaagaggatcaattattagattatgaagaagaggttagcaaaattaaagatttcttcaatagtcagcagcagaagtattatgatagagccttaaaggctttagatatatatgaacaagataagaattatgttaatgataaggaacttatctctattgtagaagaattacaagaaatcttaactatggagactccatatagtagaatccatgagctttctattttaagaaatgagtttcaggatggattaacggctttattagaaaaggagactactccaattgctgaaaccataaacaactgtcagtatagagttattaaggtcttagaaggatataatctacaagatgaatttgaagcagaagtaaaagaaaagtttgctgctttattagaggaattaaatcatgctaatgactttacagagatcttttctatggaaacaaaggctaagaagttagaagagaagtttattgctcaaatagatagtaaagtagaagagctaagaagaaagcgagaagagcaagaaaataatagtcctgaagaagatactactgatactggacagactaaaaaaatagctgaagaaactgatacttataaagagactgttgatgtcaaattaagtgatattataaaagatagagtttttgtgaagtcagaggaagaagtagaagaagtggttgctgagattaaagatgaattaaagcgccatattaaggataataagcaagttagactaggatag

SEQ ID NO: 67 - DNA, 3642 bp, Klebsiella oxytoca
atgaatattgaacagatctttgaaaaacgtctggaccgaaatattaatggcgttgtgaaagccgaacagacggacgatgccagtgcctggattgagctggatgaatacgtcatcacccgggaactggaaggacatctgcgccacttctttgaatcttatgttccggcaaccggtccggagcgcatacgcatggaaaacaaaatcggcgtatgggtgtcagggttctttggctcaggtaaatcacactttatcaagattctgtcgtatttgttgtctaaccgcaaagtcagccataacggtacagaacgtcatgcctacgccttctttgaagacaaaatcaaagatgctctgttcctcgctgatatcaacaaagcggtccatcatccgacggaagtgattctgttcaatattgattctcgcgctaacgtcgatgacaaagaagacgccatccttaaagtcttcctgaaggtatttaatgagcgggtgggctactgtgctgattttccacacattgcccatctggagcgtgagctggctaaacgcggtcaatacgaagcgtttaagaccgcattctccactatcactgagtcaagctgggaaaaagagcgcgattcctactatttcatcagcgatgaaatggcagaagccctaagccaggccacaggtcaaagcgttgacgcctcgcgtcaatgggtggaacagctggataagaacttcccattagatatcaataatttttgccagtgggtcaaagagtggctggatgaaaacggtaaaaacatcctcttcatggtggatgaggttggccagttcatcggtaaaaatacgcagatgatgttgaagctacagactatcactgaaaacctgggtgtgatctgcggtggacgcgcatgggttattgttacctcccaggcagacatcaatgcggccattggtgggatgagcagccgtgatggacaagacttctctaaaattcagggccgtttctcgactcgcctgcagctttcaagctccaacacctccgaagttatccaaaaacgtctgttggtgaaaactgatgccgcaaaaccggcgctggctaaagtctggctggaaaaaggcgacatcctacgcaaccagcttgcttttgatcccaccacaacggcttctttacgcacctacacctgtgaagaagaatttattgataactacccgtttgtcccgtggcactaccagattctgcagaaggtttttgagtctatccggaccaaaggtgccgccggtaaacagttagctatgggtgaacgttcgcagctggaagccttccagactgcggctaagcaaatcgcacagcaagggttagattctctggttcccttctggcgtttctatgctgcaattgagagcttcctggaaccggcagtgagtcgcaccattacccaggcctgtcagaacggtatcctggacgagttcgatggtaacttgctgaaaacgctgttcctgatccgctatgtcgatttactgaaaagcacgcccgagaacctggttaccctttctatcgacaaaattgatgccgataaagtcgagctgcgccatcgtgttgaaaaaagcctgaatacgctcgaacgcttaatgttgatcgcacgcgttgaagataaatacgtattcctgaccaatgaagaaaaagagatcgagaatgagatccgcaacgtcgaggtcgacttctccgcgatcaacaagaaactggcatcgatcatctttgatgacattctgaaaaaccggaagtatcgctatccggcgaataagcaggacttcgacatcagccgcttcctgaacgggcacccgctggacggcgcaatgcttaacgatctggtggtgaagatcctcacgccaaaagatccgagctatacgttctataacagcgatgcagcctgtcgtccttatacttcagaaggtgatggctgtattttgattcgcctgcctgatgaggggcgcacctggaccgatatcgatttagttgtccagaccgagaaattcctcagagacaacgccggacagcgcccggaacaagccagcctgctttcagaaaaagcccgcgaaaacagcgttcgcgagaaaatgctccgcgtacagctggagtcgcttattgccgaagcggacgtctgggcgattggcgagcgcttaccgaagaaatcctcgacgccatccagcatggtggatgaagcctgccgctatgtgattgaaaacacgtttgccaagctaaaaatgctgcgtccgttcaacggcgatatcgcacgtgaaatccatgcactgcttacggtagagaatgatgcagagctggatctgggcgagctggaggaatccaatcccgacgcaatgcgggaagtggaaacctgggtcagcatgaacatcgagttcaataagcctgtctatttacgcgatatcctcaaccacttcgcccgtcgtccttatggatggcctgaagaagaagtgaagctgctggttgctcgcctggcacgcaaagggaaattcagctttagccagcagaataacaatatcgagcgtaagcaggtttgggagctgttcaataacagccgtcgccacagcgagctacgtctgcacaaaattcgtcgtcacgacgaatcacaaattcgcaaagccgcccaaaccatggcggagattgcccaacaaccgtttagcgaacgtgaagaacccgcactggtcgaacatatccgtcaggtcttcgacgactggaagcaagagctgaatgtcttcagagcgaaagcggaaggtggaaacaatccaggcaaaaatgagattgagtcaggtctgcgcctgctgaattccattttgaatgaaaaagaagattttgccctgattgagaaggtcaccagccaggccaatgaactgctggatttcagtgaagatcgtgaagatttggtcgatttctaccgcaagcagtttgccacctggcaaaaactgggtgctgcactgaatggcagttttaaatccaaccgcagcgcgctggaaaaagacgccgtggcggtaaaagcgctgggtgaactggaaagcatctggcagatgccggagccttacaagcatctcaatcgcatcacgccgctgattgaacaggttcagaacgttaaccatcagttagttgaacagcaccgccagcgcgccctggaacgaattgacgcccgcatcgaagagagtcgtcaacgtttgcaggaagcgcatgccacatcggagctgcaaaacagcgttctgctgccgatgcaaaaagccagaaagcgcgctgaggtcagccattcgattccggaaattctggcggaacagcaagagacgaaagcgctacaaacggatgcagaaaagaagattaaccagtggatcgacgagctgcgtaaaaagcaggaagcccagctacgagcagcgaatgaagccacacgcgctgcagaatcacaacagacctatgttgtggcagaaaaacccgtaatccaaccggtaccgaaaaaaacgcatctggtcaatgtcgccagcgagatgcgcaaagccaccggtggtgaagtgctggaaaccgccgagcaggtggaaaaagcgcttgatacgcttcgcgctgcgctgctggcagccattgaggcaggtgaccggattcgtcttcagtaa

SEQ ID NO: 68 - DNA, 3702 bp, Lactobacillus amylovorus
atgatacaaataaaagatatttttgcaaaagatataaatagagatattcgtggcgtcattaaaattggtcaagatagtgatgatattaaacaacaagaactcgaagaatatgttgtaactgatgaattaaaacgtaactttactcgtttttttgatgcttatgataagagtattaataatcctaccgatgaaatgggagcatggattagcggtttctttggatcaggtaaatctcacttcttaaaaatcctttcctatttattagagaatgatacggtaaaaggacgtcaagcaattgattacttcttacaagatggtaagttcgatgatgatcatttagctgatgccattaataaagctactagtgtaccgaccgaagttgctttattcaatattgattcaaaggctgattcgaacgctgcaaataatgataattcaattctagatgtctttcttaaagtctttaacgagcaattaggatattcaccaattgcagtagtagcagatatggaacgctggcttgatagcgtcggcaaatatgaggcctttaagcaagcttttgcagatttagctacaacggatcattctagctgggttgaacttagaaaaaattatgcattaatgtcaaccaagatcaaaacggctttagtaaattgtggtgcattggatgaaacagatgcaaataattatgttcaaactctgttaactaaaaaatttagcattgatgcaacagcttttgctaagttggttaaagattatcttgataaaaaaggtaatgatgcccattttgtattcttagctgatgaagttggtcagtttattggtgacaataatagtagaatgcttaacttacagacaatcgttgagcaactgggtgtccaatgtcaaggtcgtgcgtgggtagtagttacttctcagcaacaaatggatgaagtcgccagcaacttttctaaatatgaacgagatttctctaaaattcaaggtcgttttaatactttgatcaatatgagttctgccaacgcagatgaagttattcgtaaaagattactgactaaaaagccactagtaagtgatcaattggcagatatatactctcaagagcaatatagcattaataataagattaatttcagtgatgcaatcaagcgtcaaaaatttgataatgctcaagaatttgtcgaaaactatccatttattccttatcaatttagtttattaaaagaggtcttaactgcagttcgtcaacatggtgcaaatggtagtcacatgtctgatggtgaacgttcaatgctgggaactttccaggaagctaccaagagatatgagaatgatgaattaggtaggttagtaccattttctgcattctttatcgggatgaaagagttcttaagtcatgatcaccaagtggtatttgatcgagctcaaaccgataggtatgttaacaaaaataatgaagactattgttttaatattcaagtattagctgttctcttcatggtacgttacgttgataattatccttcaactttagaaaacattgttactttactgctagatagtgttgatcaagatagacaagctttaactgcagaagttaaggatgctttgaatgtcttaatgagacagaattatattcaaaagaagttagatacttatcaattcttgactgattcagaacgagaagttaatgaagcaattaatgcaattgaagttgatgatcgtaaggtagctcaaaagattggttcatatttattaacatctaatttgattgacgccaaatatacttaccctcatatgaagaatcaatatatctttgagttcaacgaatatattgatgaaatggggttaaaccgtttaagcaataacctcaatattcagattatctccccattaattgctgataattatagagagattgactttaaacaaaaggcgatggatggtaaaaatatcatcattgttcttaaagatgatgatcgttatattgaaaactaccgtcatattgaaaagattagtgcttacttgcaaaagccagaaagtcgatcagatgataaaaagcaagaaattgcctttaatagaaaggctgaatctaagcaggtagaagaagctactcagaagatgatcaaggatgatctgattgatgctgatatctacgtcttggatgatgttttacctaagggcagtaattttgaaagtcgattagagcaagccaagaaggaaataattgatagtaattatcgtaatttacattatttgactgcggttaagacggatcaagatattcttgataccctaaagggtaaaaataaagatgatttgttcagtgatgatgaacaggcaatcaaagaaatcatcaactatatcaatgtccaagccagcagcatgaataatgtttcattggctaatgtgattaaacgttttggtgaaatcccttatggttataagccaactgatattgcttggatggtagctaaagcatttgttaacggtaaagttaagttctactttaacaatgaacagatttcattgactagtgctcaagaggatcctaaaggaacgcaacgttacttaatcggtaggaataatattaccaagttgacgattaaaccagttaaagaaatatcgatgcgtcaaaagagggatgcgaaagatttcgttgaggatattcttaataaacgtctgtcagtagatgaaaatactacttctgaacaaatggcagacgatattataaacaaaacaaaaggttttgttgcttgtttaaatgcattaatgcgtaaaaagtataattttgatacgccttatcctggtcataaattattagctgaaggtgttaatgacctgaatgctattgttaatgttaaagatagtgatcgtgtcttccaaattatttcagatcatttagatgattatgaagattggcatgaagaactcgaagataaagctattcttgagttttatggggatgtagagcaaacaagtaaccaacaaacaatttggaataaagcacatcgatatcttgatcgttataattacgctaagagtatgattagcgatcaagacttaattggaattgctcaaaaaattaaaggttgcctaaacgatgataacttcaacattacaattcctaagcttaaagagttaaatacccagtttgcagataagtacaatgatgtgatccaagaggcttacgataagatcgaggcacaaattcaaataagtcttgatgtaataaagaagagaattgcggaatcagattttccggaagataaagaccgcgaattaaatgatatggcggaaaatatcttcaatactttattgcaaaaagctaaggaatacagcaatagcgctagtgaagatgcttatgtatcattagttggactaaaaactaatattgatggtcaaaccaatgaacagaaggaaaatattgctcgagttagttcagaattagctgaacaggctagaatagagcaaaatgagactagcgataaagaagagccttcttctgtaacccatataactgataagtctaagccgattgttagagttaagagtaataaatctaaagatattactgaattagttcatgaagactcatggaagatcacgaatgaagaagatcttgataaatatttagatgaattaagaaagaatattgaacaagaacttcagcatacagatatcttaaacgtagacttcaaataa

SEQ ID NO: 69 - DNA, 3639 bp, Lactobacillus casei
atggaaattaaagagctttttaaacgaccgattgatcgtaacatccaaggtgttatcaaggttgatcaagatgatgaagcgaatgtaaagcaggagttggacgaatatgtcgtaaccagtgaactaagagatcattttgaggcctttttcaacgcgtttgataatagtcttcagacaccaacggatgacatgggggtctggatttctggcttctttggttctgggaaatcgcacttcttgaagatcatttcatatattcttgctaataaggtcgttgatggcaaaaatgctgtcgattacttcgatgacaagatcgatgatcaaatgattcttaacgagatgcatgcagctgcttcggcaaagaatgatgtcattttatttaacattgacgcaaaagccaaagacaccgttggctcagataaacaaagcatcttgaaagtgtttatgcgtgttttcaatgaaatgcaaggatttaccgatgctgacttttggattgccgaccttgaacgccagctgacagaagctggtaagttagatgcttttaaggaacaaattaccgcgattgatgctaatcataagtcttgggaagacttgcgagatgcctattaccttaacaaaggcaccattaaagcagcaatgattaattctggcttctcagatgaggccaatgcgcaaggctttattgatacattgagcacagaatatcaaatcagcattgatgattttgctgaattggtcaagcagtatattgataagactggtcatcgtgtcgttttcctggctgatgaggttggtcagttcattggtgatagcgttcaacgcatgcttaatctacaaacaattgtcgagcagttagggacaatgacgcgtggcaaggcatgggttgttgtcacctcccaacaagcaattgacaaagtaacggacattgcctcaggacaagacttttccaaaattcaaggccggttcaagacacgtctgtcgatgagttcagctaatgttgatgaagttattcgcaaacgtctactggaaaaaacagacgtggcggaaaaaatgcttgaagatcaatattcggcgaacgccgctgctattaacaactcatttgatttcgatgatgatgtcgaacggccaaagtatgaatcgccaaaagatttcgcccaaaactatccatttgttccctatcaatttaatctcttacagtttgtgttaacggcgattcgcgaaaacggatcggatggcaagcacttgtctgaaggggagcgctccatgctttcgcttttccaagagtctgcggaggctatgatgagcgagagcactgagactttagcaccatttagccgattctttgatgggttggaccagtttttggaccacacacatcatatcgtgctagttcgcgcgcatgacaatcctgctgttaatccgaacaaggaaaagaatccatttgctctgcaattactcaaagtattattcatggttaaatacgtttctaacttcacagcatcattgaacaatttaattactttgatgatcagttcagtcgatgctgatcgcattgcgcttaaaaagcaggttcaggatgcgttagatgtcttagtaacgcaagggtacgttgagaaaactgttaaggggtatgactttttaacagacgcagaacaagatattacccgtgaaatttcaaagcaggaagtaacagataatggagttgctaaagagatcggcgactatttatttaatgctaagccgggggttgccacaagcttgacctacccgaagcttaatggtcgctacgtctttgccttcaatcggaaaaccgacaatatcttcggtgcgcaacgtaataagttgtcggtgcacatcatcacgccagtcaatgatgattttcttgaagataatgattatctgcgagcatcggctggttcatggaatcacgatgtcctgattgccttgccgcggtcatcaaactttgtcggtgaaattcgaaatgctttacgcattcaaaaattcgttgtcaacagcaatgtttccactgacccacgctatcaagcgatggtttcaacacgacaagcccagcaaaatgaggagtttgctcatgcccatgaacagttgattgcagccttagatagcgcagaaatttatgaaaatggccaatcagttagcagtgaagcaggctttgatagtcgattagaaaaggcaatgaagctgttggtcgacaatacctatcgaagtttgcaatatatcacggttgcaaagtctgaaaaggatattcgggagctttttgaaaatatctcgagtttggcgcttgatgaaaaagacaatcaagcagccgtagatgctgttttggactacatgcgtcgtgagtctcaaaacaatgcgcatatcacgatggaaagtgtcctgtcgaagtttaacgatattccatacggttatactgacgaggacattcaatggcttgttgcgaagttagtcgctattggcaagttaaagatgttttacaatggcaagctcattgatcctcttgatgacgaatatacgacgcgagaccttgcaggtttctttactaaaaagcaggcaattaggaatctagctttccagatcaaggaagaaattgccccgtctaagattaaagctatgcaaacagtcgcgtctgaagtttttggtaagaagtcttttgaagccgataacgacgagcagaaggcttccgaactcaaaaagactgtcaaaaataaatatgatgccttgataacctttgaggcaagaccgcaagaatatccaggccacgctgtgctgcaacaaggcatccaaatgctacggcaacttttgattgcatctgattctggcgcattttacgattacattggcaagcataaggacgatctgttagattggaacgacgactttctggatgacggtattcgtgacttctattacagtgattcaatgcagaaaatttgggataaaggtctcaatgccttgcgagtttatcgcgactcgaatgattttctgagtgatagcaagttacaaaatatcgttgatgaaatgggcaaacttcttcgattgcagaagcttcagggagacacagcagttaaaatcagcgaattaaataatgactttgatactctatttactgcagcttttgataagaaggcagctgaatatttggcacaaatcgatgaatttaaagatttgggacttacccgaattctagagtctggcatctctgatgaaaaagtccaagatcaattaagacacgattttgaaaacaaaattcaggttatccgtgatgctgcaaagaacgctgtaacattgaaccaagtagttgcaaaaccagctcaggcagacgctcaattggaacaactgtccaaacgaattaagcaagaagttgaaagaattgtagtcgtttcgcctgcaacaggtgataagcacaaaaatgtggacgatgttactaaatctgttacgccagcaaatacgggaaaaataaaaccaaaggataagaagtttataaaagtggatcaagttcttcgtcgtggtgattacaagttggaggattccgctgatgtggcagaactaactgccgagtttaaacgattgttagaggcacaactgtcagataacacaatcgtgacattgcaagtcgactga

SEQ ID NO: 70 - DNA, 3717 bp, Lactobacillus helveticus
atgatacaaataaaagatatttttgcaaaagatataaatagagatattcgtggcgtcattaaaattggtcaagatagtgatgatattaaacaacaagaactcgaagaatatgttgtaactgatgaattaaaacgtaactttactcgtttttttgatgcttatgataagagtattaataatcctaccgatgaaatgggagcatggattagcggtttctttggatcaggtaaatctcacttcttaaaaatcctttcctatttattagagaatgatacggtaaaaggacgtcaagcaattgattacttcttacaagatggtaaattcgatgatgatcatttagctgatgccattaataaagctactagtgtaccgaccgaagttgctttattcaatattgattcaaaggctgattcgaacgctgcaaataatgataattcaattctagatgtctttcttaaagtctttaacgagcaattaggatattcaccaatttcagtagtagcagatatggaacgctggcttgatagcattggtaaatatgaggcctttaagcaagcttttgcagatttagctacaacggatcattctagctgggttgaacttagaaaaaattatgcattaatgtcaactaagattaagactgctttagtaaattgtgacgcattagatgaaatagatgcagataattatgttaaaactctgttaactaaaaaatttagtattgatgcaacagcttttgctaagttggttaaagattatcttgataaacaaggtaatgatgcccattttgtattcttagctgatgaagttggtcagtttattggtgacaataatagtagaatgcttaacttacagacaatcgttgagcaattaggtatccaatgtcaaggtcgtgcttgggtagtagttacttctcagcagcaaatggatgaagtcgccagcaacttttctaaatatgaacgagatttctctaaaattcaaggtcgttttaatactttgatcaatatgagttctgccaacgcagatgaagttattcgtaaaagattactgactaaaaagccactagtaagtgatcaattggcagatatatactctcaagagcaatatagcattaataataagattaatttcagtgatgcgattaagcgtcaaaaatttgatagtgctcaagaatttgtcgaaaactatccatttattccttatcaatttagcttattaaaggaagtcttaactgcggttcgtcaacatggtgcaaatggtagtcacatgtctgatggtgagcgttcaatgctgggaactttccaggaagctaccaagagatatgagaatgatgaattaggtagattagtaccattctctgcattctttatcgggatgaaagagttcttaagtcatgatcaccaagtggtatttgaccgtgcacagaccgatagatatgttaacaaaaaccatgaagattattgcttcaatattcaagtattagccgttctcttcatggtacgttatgttgataattatccttcaactttagaaaatatagttactttactgctagatagtgttgatcaagatagacaagctttaactgcagaagttaaggatgctttaaatgtcttaatgagacagaattatattcaaaagaagctggatacttaccaattcttgactgattcagaacgagaagttaatgaagcaattaatgcaattgaagttgatgatcgtaaggtagctcaaaagattggttcatatttattaacatctaatttgattgacgccaaatatacttaccctcatatgaagaatcaatatatctttgagttcaatgaatatattgatgaaatgggattaaaccgtttaagcaataatctcaatattcaaattatctctccattgattgctgacgattatagagaaattgactttaaacaaaaggcgatggatggtaaaaatatcatcattgttcttaaggatgatgatcgctatattgaaaactaccgtcatattgaaaaaattaatgcttacttgcaaaaaccggaaagttgctcagatgccaaaaagcaagaaattgcctttaatagaaaagctgaatctaagcaggtagaagaatctacccaaaagatgatcaaggatgatctgattgatgctgatatctacgtcttggatgatgttttacctaagggcagtaattttgaaagtcgattagagcaagctaagaaggaaataattgatagtaattatcgtaatttacattatttgactgcggttaagacggatcaagatatccttgataccctaaagggtaaaaataaagatgatttgttcagtgatgatgaacaggcaattaaagaaatcatcaactatatcaatgtccaagccagcagcatgaataatgtctcattggctaatgtgattaaacgttttggtgaaattccttatggttataagccaactgatatcgcttggatggtagctaaagcatttgttaacggtaaagttaagttctattttaacaatgaacagatttcattgactagtgctcaagaggatcctaaaggaacgcaacgttacttaatcggcaggaataatattaccaagttgacgattaaaccagttaaagaaatatcgatgcgtcaaaagagggatgcgaaagatttcgttgaggatattcttaataaacgtctgtcagtagatgaaaatgctacttctgaacaaatggcagacgatattaacaacaaaacaaaaagttttgtcgattgtttgaatgcattaatgcgtaaaaagtataattttgatacgccttatcctggtcacaaattattggctaaaggtgttattgatctaaaggctattgttaaggttaaagatagtgatcgcgtctttcagattatttcagatcatttagatgattatgaagattggcatgatgagcttgaagataaagcaattcttgagttttacggggataccagtagccaacaagcaatttggaataaagcacatcgctatcttgatcgttataattacgctaagagtatgattagcgatcaagacttaattggaattgctcaaaaaattaaaggttgcctaaacgatgataacttcaacattacaattcctaagcttaaagagttaaatacccagtttgcagataagtacaatgatgtgattcaagaggcttacgataagatcgagtcacaaattcaaataagtcttgatataataaagaagagaattgcagaatcagattttccggaagataaagaccgcgaattaaatgatatggcggaaaatgtcttcaatactttattgcaaaaagctaaggaatacagcaatagcgctagtgaagatgcttatgtatcattggttggactaaaaaccaatattgatggtcaaactaataaacagaaggaaaatattgctcgagttagttcagaattagctgaacaggctagaaaagagcaagaacttcgagaaaagaaaactgcagcagaagaaaatgagaagaaagaacctgtttctgtagctcccatatctaataaaactaaacctattattagagttaagagtaataaatctaaagatattaccgaactagttcatgaagattcatggaagatcacgaatgaagaagatcttgataaatatttagatgaattaagaaagaatattgaacaagaacttcaacatacagatatcttaaatgtagacttcaaataa

SEQ ID NO: 71 - DNA, 3735 bp, Lactobacillus helveticus
atgatacaaataaaagatatttttgcaaaagatataaatagagatattcgtggcgtcattaaaattggtcaagatagtgatgatattaaacaacaagaactcgaagaatatgttgtaactgatgaattaaaacgtaactttactcgtttttttgatgcttatgataagagtattaataatcctaccgatgaaatgggagcatggattagcggtttctttggatcaggtaaatctcacttcttaaaaatcctttcctatttattagagaatgatacggtaaaaggacgtcaagcaattgattacttcttacaagatggtaaattcgatgatgatcatttagctgatgccattaataaagctactagtgtaccgaccgaagttgctttattcaatattgattcaaaggctgattcgaacgctgcaaataatgataattcaattctagatgtctttcttaaagtctttaatgagcaattaggatattcaccaattgcagtagtagcagatatggaacgctggcttgatagcattggtaaatatgaggcctttaagcaagcttttgcagatttagctacaacggatcattctagctgggttgaacttagaaaaaattatgcattaatgtcaactaagattaagactgctttagtaaattgtgacgcattagatgaaacagatgcagataattatgttaaaactttgttaactaaaaaatttagtattgatgcaacagcttttactaagttggttaaagattatcttgataaacaaggcaatgatgctcattttgtattcctagctgatgaagttggtcaatttattggtgacaataatagtagaatgcttaatttgcagacgatcgttgaacaattaggtgtccaatgtcaaggtcgtgcttgggtagtagttacttctcagcaacaaatggatgaagtcgccagcaacttttctaaatatgaacgagatttctctaaaattcaaggtcgttttaatactttgatcaatatgagttctgccaacgcagatgaagttattcgtaaaagattactgactaaaaagccactagtaagtgatcaattggcagatatatactctcaagagcaatatagcattaataataagattaatttcagtgatgcaatcaagcgtcaaaaatttgataatgctcaagaatttgtcgaaaactatccgtttattccttatcaatttagtttattgaaagaagtcttgacagcagttcgtcaacatggtgcaaatggtagccatatgtccgatggtgaacgttcaatgttgggaactttccaagaagctactaaaagatatgaggatgataagttaggtagattagtaccattttctgcattctttatcgggatgaaagagttcttaagccatgatcaccaagtggtatttgatcgagctcaaaccgataggtatgttaacaaaaataatgaagactattgttttaatattcaagtattagccgttctcttcatggtacgttatgttgataattatccttcaactttagaaaatatagttactttactgctagatagtgttgatcaagatagacaagctttaactgcagaagttaaggacgctttgaatgtcttaatgagacagaattatattcaaaagaagctagatacttaccaattcttgactgattcagaacgagaagttaatgaagcaattaatgcaattgaagttgatgatcgtaaggtagctcgaaagattggttcatatttattaacatctaatttgattgacgccaaatatacttaccctcatatgaagaatcaatatatctttgagttcaatgaatatattgatgaaatggggttaaaccgtttaagcaataatctcaatattcagattatctctccattgattgctgatgattatagagaaattgacttccaacaaaaggctagtgatggtaagaacatcattatcgttcttaaagacgatgatcgttatattgaaaactatcgtcatattgaaaagattaatgcttacttgcaaaaaccggaaagtcgatcagatgataaaaagcaagaaattgcctttaatagaaaggctgaatctaagcaggtagaggaagccactcagaagatgatcaaggatgatctgattgatgctgatatttatgtcttggatgatgttttacctaagggtagtaattttgaaagtcgattagagcaagccaagaaggaaataattgatagtaattatcgtaatttacattatttgactgcggttaagacggatcaagatatccttgataccctaaagggtaaaaataaaaatgacttgttcagtgatgatgaacaggcaatcaaagaaatcatcaactatatcaatgtacaagccagcagcatgaataatgtctcattggctaatgtgattaaacgttttggtgaaatcccttatggttataaaccaactgatattgcttggatggtagctaaagcatttgttaacggtaaagttaagctctattttaacaatgaacagatttcattgactagtgctcaagaggatcccaaaggaacgcaacgttacttaatcggcaagaataatatcgctaagttgacaattaagccagttaaagaaatatcgatgcgtcaaaagagggatgcaaaggactttgtcaatgatatccttgatatgcgtttaacagtagatgaaaatactacttctgagcaaatggcaaccgatattaaggaaaagacagattattttgtaggtcggttgaaggcattaatgcgtaaaaagtataattttgatacgccttatcctggtcataaattattagctgaaggtgttaatgacctaaatgctattgttaacgttaaagatagtgaccgtgtcttccagattatttcagatcatttagatgattatgaagattggcatgaagaactcgaagataaagctattcttgagttttacggggatgtagagcaaacaagtaaccaacaagcaatttggaataaagcacatcgttatcttgatcgctacaattacgctaagagtataattgaagaccaagacttaatcggaatagctcaaaagattaaaggttgcctagaaaatgataacttcaacaatacaattcctaagcttaaagagttaaacactcagtttgcggataaatacaatgatattattcaagaggcttacgataagattgaggcacaaattcaaataagtcttgatgtaataaagaagagaattgcggaatcagattttccggaagataaagaccgcgaattaaatgatatggcggaaaatgtcttcaatactttattgcaaaaagctaaggaatacagcaatagcgctagtgaagatgcttatgtatcattggttggactaaaaactaatattgatggtcaaaccaatgaacagaaggaaaatattgctcgagttagttcagaattagctgaacaggctagaagagagcaagaactacgagaaaagaaaactgtagtagaagaaaatgagactaacaatgagggagcctctacttctgcagcttctgtacctgataagtctaagccgattgttagagttaagagcaataaatctaaagatattactgaactagttcatgaagactcatggaagatcacgaatgaagaagatcttgataaatatttagctgaattgagaaagaatattgagcaagaacttcagcatacagatatcttaaatgtagacttcaaataa

SEQ ID NO: 72 - DNA, 3732 bp, Lactobacillus johnsonii
atgaaaataaaagatatttttgcaaaagatataaatagagatattcgtggtgttattaaaattggtcaagatagtgatgatatcaaacaaaaagaactcgaagaatatgttgtaactgatgaattaaaacgtaactttactcgtttttttgatgcttatgataagagtattaataatcctaccgatgaaatgggagcatggattagcggtttctttggatcaggtaaatctcacttcttaaaaatcctttcctatttattagagaatgatacggtaaaaggacgtcaagcaattgattacttcttacaagatggtaaattcgatgatgatcatttagctgatgccattaataaagctactagtgtaccgaccgaagttgctttattcaatattgattcaaaggctgattcgaacgctgcaaataatgataattcaattctagatgtctttcttaaagtctttaacgagcaattaggatattcaccaattgcagtagtagcagatatggaacgctggcttgatagcgtcggcaaatatgaggcctttaagcaagcttttgcagatttagctacaacggatcattctagctgggttgaacttagaaaaaattatgcattaatgtcaaccaagatcaaaactgctttagtaaattgtggtgcattggatgaaacagatacaaataattatgttcaaactctgttaactaaaaaatttagcattgatgcaacagcttttgctaagttggttaaagattatcttgataaaaaaggtaatgatgcccattttgtattcttagctgatgaagttggtcagtttattggtgacaataatagtagaatgcttaacttacagacaatcgttgagcaactgggtgtccaatgtcaaggtcgtgcgtgggtagtagttacttctcagcaacaaatggatgaagtcgccagcaacttttctaaatatgaacgagatttctcaaagattcaaggtcgttttaatactttgatcaatatgagttctgccaacgcagatgaagttattcgtaaaagattactgactaaaaagccactagtaagtgatcaattggcagatatatactctcaagagcaatatagcattaataataagattaatttcagtgatgcaatcaagcgtcaaaaatttgataatgatcaagaatttgtcgaaaactatccatttattccttatcaatttagtttattgaaagaagtcttgacagcagttcgtcaacatggtgcaaatggtagtcacatgtctgatggtgaacgttcaatgctgggaactttccaggaagctaccaagagatatgaggatgataagttaggtagattagtaccattttctgcattctttatcgggatgaaagagttcttaagccatgatcaccaagtggtatttgatcgagctcaaaccgataggtatgttaacaaaaataatgaagactattgttttaatattcaagtattagccgttctcttcatggtacgttatgttgataattatccttcaactttagaaaatatagttactttactgctagataatgttgatcaagatagacaagctttaactgcagaagttaaggacgctttgaatgtcttaatgagacaggattatattcaaaagaagttagatacttatcaattcttaaccgattcagaacgtgaagttaatgaggcgattaatgcaattgaagttgatgatcgtaaggtagctcaaaagattggttcatatttattaacatctaatttaattgatgccaaatatacttaccctcatatgaagaatcaatatatctttgagttcaatgaatatattgatgaaatggggttaaaccgtttaagcaataacctcaatattcagattatctccccattaattgctgataattatagagagattgactttaaacaaaaggcgatggatggtaaaaatatcatcattcttcttaaagatgatgatcgttatattgaaaactaccgtcatattgaaaaaattaatgcttacttgcaaaagccagaaagtcgatcagatgataaaaagcaagaaattgcctttaatagaaaagctgaatctaagcaagtagaggaatctactcaaaagatgatcaaggatgatttgattgatgctgatatctacgtcttggatgatgttttacctaagggcagtaattttgcaagtcgattagagcaagccaagaaggaaataattgatagtaattatcgtaatttacattatttgactgcggttaagacggatcaagatattcttgataccctaaagggtaaaaataaaaatgatttgttcagtgatgatgaacaggcaatcaaagaaatcatcaactatatcaatgtccaagccagcagcatgaataatgtttcattggctaatgtgattaaacgttttggtgaaatcccttatggttataagccaactgatatttcttggatggtagctaaagcatttgttaacggtaaagttaagttctattttaacaatgaacagatttcattgactagtgctcaagaggatccaaaaggcacgcaacgttacttaattggaaagaataatattgctaagttgacgattaaaccagttaaagaaatatcgatgcgtcaaaagagggatgcgaaagatttcgttgaggatattcttaataaacgtctgtcagtagatgaaaatactacttctgaacaaatggcagacgatattaaggaaaagacagattattttgtaggtcggttaaaggcgttaatgcgtaaaacgtataattttgatacgccttatcctggtcacaaattattagctgaaggtgttaatgacctgaaggctattgttaatgttaaagatagtgatcgcgtcttccagattatttcagatcatttagatgattatgaagattggcatgaagaactcgaagataaagctattcttgagttttatggggatgtagagcaaacaagtaaccaacaaacaatttggaataaagcacatcgatatcttgatcgttataattactctaagagtatgattagcgatcaagacttaattggaattgctcaaaaaattaaaggttgcctaaacgatgataacttcaacattgcaattcctaagcttaaagagttaaatacccagtttgcagataagtacaatgatgtgatccaagaggcttacgataagatcgagtcacaaattcaaataagtcttgatgtaataaagaagagaattgcagaatcagattttccagaagataaagaccgtgaattaaatgatatggcggaaaatgtcttcaatactttattgcaaaaagctaaggaatacagcaatagcgctagtgaagatgcttatgtatcattagttggactaaaaactaatattgatggtcaaaccaataaacagaaggaaaatattgctcgagttagttcagaattagctgaacaggctagaagagagcaagaacttcgaaaaaagaaaactgcagcagaagaaaatgagaatagcaatgaagatgcatctgtttcttcagctcctgtacctaataaccctaagccaattgttagagttaagagtaataaatctaaagatattactgaattagttcatgaagactcatggaagatcacgaatgaagaagatcttgataaatatttagctgaattgagaaagaatattgagcaagaacttcagcatacagatatcttaaacgtagacttcaaataa

SEQ ID NO: 73 - DNA, 3666 bp, Lactobacillus reuteri
atgattattaaagatatttttgcaaaagacattaatcgaaatattcgtggggtcattaagattggccaagaagctgaaaccataaaaaaacaagagctcgaagaatacgtggtaactgatgaacttcagtctcactttaaaagattcttttcggcttatgtgaatagtattaatcggccaactgatgcaactggtgtttggattagcggtttctttggatccggtaaatctcatttccttaagatcttgtcttacctactagacaattctatggtggctgggaagcggccaattgattatttcagggatgatagcaaaattaaggatccggacactattcagctaattgaacaatcagagcaagttccgaccgatgttgtcttatttaacattgatgctaaagcggatgctaatgcagcggcagataagtcggctattctcactgtttttcttcgagtctttaatgaaaaactgggatatgattctaatccgtctgtggctaatctagaacgttggctagatgatcatggtcagtatcaggcgtttaaggacgccttttacaaagcttctggcagtcactgggttgatgttcgtaatagttttagttttatcaaaaatagtgttaaagaagccttagtgcaatccggatcgatgactgaaggtaatgctgccgattatttatctaatatgggaaacttcacgattaatcctgaagagtttgcgggaatggttaagaagtaccttgataagaagggcaataatcatcatattatctttttggccgatgaagtaggacagttcatcggcgataatggggaccggatgttaaacctacaaaccattgttgaacaacttcaaacacaatgtgctggccaagcatgggttgtagtaacttcccagcaacaaattgatgaggttactgctaactttactaatcaaaagcgtgaagacctttcaaagattcagggacgttttaacacaatgattaacatgtcatccgctaatgccaatgaagttattcagaaacgattattggctaagaagccaatggcaagtgatcagttagcagctatttttgaagaaaatcattacaacattaataacaagattaattttagtgatcaggtcagtcgtaagaaatatgcagacgataatgactttattacaaattatccgtttatcccctatcagtttgaccttcttaaggatgtattaggagcagtcagaaaacatggggcagaaggtaagcatatgtcagatggcgagcgttcgttgcttgctacttttcaggcagcaacagttacctatgaagatgataaagttggtcgcttagtgcccttttctgctttttttaggggaatgtatgaattcttaagccatgatcatcaagtagtatttaccaatgctgagggtaacgatgccgtttgcccaaatggtaatcatgatactttagctatgcaagttcttgaagttctgttcatggttaaatatcttgataatttccccgcaacattagaaaatattaccacgttattgattgatgggatttttactgatcgtgaagacctaacgtctaaggtaaaaaaggcattggaacttttgatttctcaaaaatacgttcagttgaatgtcgaaacatatgaatttttaactgataaagaacaggatgtcaacgaagcaattaatagttatgaagttgatgatacctacatcattaataagattggtggatatctaattggtgacaagtacctgagtgatcgttatgtgccaaagcatatgggtaaccaatatgtatttaactttaatatttatattgatggatcggcatacgggagatctaataacaatcaaagtttacggatcgttacgccgttaaacccagctggcgaagagcaatatcgcatgactgcccaaagtggcagtactgttgtgcttgtcctaccagacaacaacagctacatctctaattttcgccgtgccgggcagattgaacaatacattcaaaagtctgctggaaactttgataatcaagaaggtgctatccgtttaggcaaaatggatgagcgaaagaagctggaaaaagctgccgatagagccctcttaaatgatttaaataactctactatctacgtcatgaatgacattctggatgataataccgatattacaagccggttaagtaatgcttatcaagaagtcattgattctagttaccgcaacttgagttatctgaccgcgattaaggatgaaaaagacgtacttcacctgttaaaaggtaccggtgaagaggcaaatacgataattgatgacaatcaacaagcggttcaggcagtgattgattacctgatgatgaaaactaatcagggaatgcaagcactgtcgatggaaaacatccgtgatcactttaatgaaattccgtttggatataatgacgaagatattgcttggttggtagcgaaggcgtttaaagacggtaagcttaaattagcatttaataatgctccgatttctattagcgatgcggctaataatgctcaattaattactggctacttaacgaaaaaacagcaagtaagaaagctaactttgcaaattgtccgggaagttccaggaaaacagaggaaagctgcacgtgattttgtgaaggatattttacacaagcgcagcattcttgctgataatgattcgactgagcagttggcagctaaaattgttaccactactaaagaaaaaatcaatgaactaaatggctttgatgcctttcctcagggcccagggaaagccttgattgatcagggggtagaattgttaaaaccaatcgccaattcaggtaataatagtgaacgaatatatggcttgattgataaacacctagatgagttagaagattggctagaagacatggatgataatggtatctctgatttctatcattctgatactcagaaatcggtttggcggagatcgttggactacatggatagatataacctagcaaagggatttattgattctgataatgctgttcataaaactgcacaaaccattaaggaaagccttaagaagcaaaatattagtcgggtcattcctcaactagaagccttgaatcaggattttgctacccaatttaataatttagttgataagttgtatcgtcaataccaggacaagagtgaaaattacttgcaattactggaacaacgcttagcagacgctaatttcccagagcaaactgctaacaaacttcagcagcggattcaggatacaatttcaagagataaccaaattgctgaacaaaagagtaatgatggcaagtacactgaattaaatgaccaaatccagttgctaaaacgtgatgccgatcagctacaacgggaaattgatgaaactagtcaacaaattgctcgagatttacgccgtaagcaagaattggcagaacaagcaacgaaacatgattctagtgagcggcctcatccgattgaaaacatctcccgtgaagtagttcatactaaacgggtaaagacaattaagattagtgatcttgaaggacaagcatggcgaattactagtgatagtgatttggatagctatattaaccagttgaagcagtccttacaacgtgaaatagatttaaacgatattgtgaatgttgattttaagtag

SEQ ID NO: 74 - DNA, 3633 bp, Lactobacillus rhamnosus
atgaaaattaaggatctttttaaacgatcaattgaccgcaacattcaaggggttattaaagttgatcaagatgacgaagcaaacgttaaacaggaattagacgagtatgttgttacgcgtgagttgcgtgaccattttgcagcgttctttagtgcttttgataatagtttacagactccgactgacgatatgggtgtctggatttcaggcttctttggatccgggaaatcgcattttttaaaaatcgtgtcatatattttggcaaacaaaattgttgatggaaaaccagccgttgattattttgacgacaaaatagacgaccagatgattcttaatgagatgcatgctgctgcggcggcaaacaatgatgtcattctgttcaatatcgatgctaaggcgaaagacacagttgggtcagataaacaaagcattttgaaagtcttcatgcgggtcttcaacgaaatgcaaggatttactgacgccgatttttggattgctgaccttgagcggcgtttgactgaagctggaaagatggatgcttttaaggagcaaattaaagcgatcaatgccaatcatcagtcttggatagagttgcgtgacgcctattacctgaataaaggtacgatcaaggaagcaatggtgaaatccggattctctgacgaggcaaatgctcagggtttcattgaaacgctgagcaccgaatatcagatcagtattgatgattttgctgctttggtgaaacggtatatcgacaaaactggacgccgggtcattttcttggccgatgaggttggccagttcataggtgacagtgtacagcggatgcttaatttgcagacgattgtcgaacaactgggaacgatgacacgcggcaagtcatgggtagtcgtgacttctcagcaggcaattgacaaagtgacggatattgcatctggacaagacttttcgaaaattcaaggtcgcttcaaaacacgtttgtcgatgagctcggctaatgttgatgaagttattcgtaagcggttattggaaaagactgatgttgccgagcagatgcttgaagatcagtattctgcaaacgctgcagctattaataattcaattgatttcgatgatggtgtagagcggccaaaatataagtcgccaaaagattttgcacaaaactatccgtttattccatatcagtttaatctcttacaacaggtgctgactgcgattcgtgaaaacggttcggatggtaaacatttgtctgaaggcgagcgatcaatgctttccctcttccaagagtcagctgaagctatgatggatgcggacacagagacgcttgcaccatttagtcgctttttcgatggtttggaacaattcttggatcatacccatcacatcgtactagtgcgtgcccacgacaatcctgctgttaatccgaacgacgagaagaatccgtttgcactgcagctgcttaaagtattgttcatggtcaagtatgttactgactttaacgcatcattgaacaatttgatcaccctgatgattagttcggtcgatgcagatcgaattgcacttaagaaaaaagttagcgatgcacttgaggttctagtcggacaaggttacgttgaaaaaacagtcaagggttatgactttttgactgatgctgaacaagatattacacgcgaaatttcgaaacaagaagtgattgacaatgaggttgccaaggaaattggggattacttgttcaatgccaagccaggtattgcaacgagtttaacttatcccaaactgaatggtcgctatgtctttgcttttaatcggaaaacggacaatatttttggcgcacagcgaaacaagctttcagtgcacatcattacgccagtgaatgatgaatttcagagtgacaacgattatttacaagtttcgactggtgcgtggaatcatgatgtcttgattgctttaccacgttcgtcaaactttgtcgatgaaattcgaaatgcattacgaattcagaagtttgttgttaatagcagtgcatcaagcgattcacgttaccagggaatggtgttggctcgccaatctcagcaaaatgaagagttccagcacgctcatgaacagttgatcgcatcgcttgataatgcagctatttatgaaaacggccaattgattaatggcgaagcagggttcgatagtcgattagaacaggcaatgaagctcttagttgacaatacgtatcgcagtttgcagtacatcactgttgccaaatctgagaaggatattcgcgaacttttcgaaagtatctccagcctggcgcttgacgagcaagacaatcaagctgcggttgatgctgttctggattatatgcggcgcgagtcacagaataatacgcatatcaccatggaaagcatcttgtcgaagtttaatgatattccatatggctacacggatgaagatattcaatggctcgtcgcaaaattggtcgctattggcaaacttaagatgttttacaatggtacagtaatagatccgctaagtggtgaacggacaccgcgtgaaattgcaggtttctttactaagaagcaagcaattcgtaatttggcctttcagattaaagaagaagttgcgccttcaaagatcaaagcgatgcagacagttgcttctgaagtgtttggaaagaaatcatttgaggctgataacgatgaacagagggccgcagaactaagaaaactaatcgtgactaagtatcaaactctgaaaggctttgaagataaaactcaagactacccaggacacgtgttgttacaaaaaggacttcagttactacgtccattgactgaaatgtctgattctggtgcgttttatgattatatcagtaaacacaaagacgacttactggactggaacgatgattttcttgatgatggcattcgtgacttttattactcgcagtcaatgcaagatatctgggacaagggtttaaatgcgttgcgcgtttacggggagtcaagtgatttcttaagtgacaatcagctacaggatacagttgacaagatggcaaagttgcttcacttgcaaaaacttcagggcgatacagccgttaaaatcagcgaattaaataagcagtttgatgaattatttagtgcggcttttgataagacggcagctggttatttagcggacattgatgattttcgtgaacgtggcttgacacgtattgaagaatcagcgatacctgatcagaacgtgaaagataaactagctcatgattttgaaaatagaattaaagctatttctgaggcagccacggatgccacaaccttaaatgaggttgtagcaaaaccagctcaagctagtgcgcaattagatcaactgacggaccgaattaaccatgcaaaggcgcaattaataccagcgggtgaccactcaggtgaaagcaaaactgacgataagcataaggatccagataagcctgtgggtcccacggtcgtttcaccacaggagaagattgtcaaactggaagaggttcttcacaagggtgactacaaaatcacagcctcggctgatattgataagctgactgctcagtttaagcgctcacttgaggcacaattgtcagataacacggttgtgaccttgcaaattgactag

SEQ ID NO: 75 - DNA, 3633 bp, Lactobacillus rhamnosus; identical to SEQ ID NO: 74

SEQ ID NO: 76 - DNA, 3585 bp, Leuconostoc kimchii
atgaaaattcaagatatttttgaaaaggatattacccgtgatattcaaggggttatcaaggtgggacaggatgatgtccaaaccattaaacaggatttagatgagtatgttgtgacgtctgagttgcaacgttatttcgctgatttttttgatgcatatcaaaaaggaattaacggtacgacagacaagatgggtgtttggatttctggtttcttcggctctggtaagtctcacttccttaaaatcttgtcataccttttgaattctaaagttcaggttgatggcatgagtgcggtcgaatttttcaagcagcaaaataaggttgctgacccgatgacaattgctaatatggatttggcagctagtgttccttcggatgttattttgtttaacattgactctgaatcaaaatcaggcaataagtcctctgaaaatgccattcgtaacgtgtttttgcaagtctttaataagatgcaaggttttacggacaaaaacttttggctagctgacatggaacaaatgctcgttgcagacggactatatgatgactttaaggctgcttataaggaattgaatcctaagcatgatgattgggagaagggccgtgatcgttatgcatttgaggagaaaattgcaatcgaaccagctttgaagcaagttggatatcaatatgatatgcctaatttccatgcagattacgaactgaatattaaagattttgcagagcgtgttgctacctatatcaatgctaagggcgacaatcaccacgttgtgttcctagtggacgaggttggtcaatttattggtgatgatattaagcgcatgttgaatcttcaaacaattgtcgaagagctcggtgttgccactggcggaaaagcttgggtaatggttacttctcagcaagcaattgatgaggttaccactaatttaagtggtactgatttttcaaagattcaaggccgatttgatacaaagatttctatgagttctgcagacgttgccgaagtaattaagaagcgattgctcgcaaaaacaaatgatgctgctggattcttggaaggtgactttgaaaacaataagcaggccattttgaataagtttaactttggtagtgagcgtaagtggcgaaagtacaagtctgctcaggattatgcagacgtgtatccattcgtaccttatcagttcgagctgttgcaatcagttttgacagcggtgcgagaacacggatctgacgggaaacacttgtcagaaggtgaacgctctatgctggctattttcaaagagtctgcagaaaaggttggcgaagacgacaccagtacgctcattccatttagttcattctacgatgggcttgagggatttattgatcacgaacaccgcattgttatttcgaacgctgagaaaaatgaagcggtgaatccgaatgaagagaaaaatccgtttgcccttcgtgttctacaaacgttgttcatggtgaagcacgttgattctttcgaaaaaaatatcgatggaattacaaccttgttgatttcaagcaatgatgaagatgttattgaattgcgtaagcgtgttgaagacgcactgaatgtactgattaagcaaggttttgttgaaaaaacgacaaagggatacgaattccttactaacacagaacaagatattaaacgacaaattgacaagcaaatggttaatgacagtgatgttgataaaagtttgggtgatttcttgtttgctgaaatggctactacattcacaccggatggaatggggaaaaactataactttaagttcaacacatttgtggatgagtatcttcaaggttcaaatcgaaacgcactaaatatgaaggtcatcacgccactgaatgacatgaataatgttgatgtgaagcttgagatggagagtacagaatctaacactctagtgattgatttgccaaataatgctgagtatattgatgaattacgtcaggctattcgaattgcgcagtacctcagccgatcatcctcgcttgattctaaagctagccaattgattagcgtgcaatcagaagaacgaaaaagcttgatggatgccgctaagaaacatgcgcttgatgcactttcagaggcgcgtgtatttgttaatggaaatcaaattgagggtagcgtcataaagacgcgtttggaatcaggaatgaaaaatgttgttggaaacacattccgaaagttaaatgatttggttcagacacatacagaccgtgacatcgtttcacttttcgcatctgatgacgacatggtattggatgcggccgatgtaaatcaaaatgcattggaagatgtaaaaaacaagatatctaaagaactgacaaagaatcctaaagtgtcattggaaaccattatttcgcaatttcaagctattccatatggattctcaccaattgatacgcaatggctagttgctaagctgttcgttgacggtaaaatagacattgagagtgatggtgaaaaaatccttgttaaggatgaacattattctaataagcaaaaagctgatttgttcttaaagaatcaaaagagactcgcattgacgattaagcaagatattccgatgaagcaacgtaagacgttgaaaaatttggctaaagaggtctttggtaagcgcgcctttcaggatgagacagacgatggtatggtgcttgaattgcgagatgcaacaatcaagtatgaatatgaccgattgtcagattacgaggggcgtgattcaaaattccctgggcacgttgaattgcaaaagggaattcagttgctcaagcgattgctgggtgtgaaagatacggccgaattttatgcgcaaatgtcgtctatggaggaagaattgcttgattggcatgaagctatggaagacaaagatgttaaggacttttatggtaataaatcttctcaagcaatctgggagcaaggaataaagaatgttgatatttatcatcgttccgaaggctttatcacgaatgttgagctaaatgaacttgtagacaacttggaatcgttaatcaaatcaggcacggctaagaaagtgcaagatgttaaagcaaagaatgaagagttttcaaacctgtttaactcggttctggatgatgaacaacaaagagtaatcttgagggtacaggattaccaagaacgtggagaaacgctgatttctgagactgatttgagcgattctacaaagtcactgttaacgtcagattatatttctgaaatggaaaacattcgatctcaggctactgaggctgttgatttagaaactttgaatggtaagctaccgttggctagttcaaagcttaatcaattgatggctaaagttcagtcagaagtggcgaagcggcaagtgctgcctgttactcatgaagatggggatgaagtgcaaagtaaacctgctggaccagtcaagattccacgcttcgaaagtttacgtgattataccggtgcaacgagctggcacattacttctgagtcggacttggatgtgcaactagcagaattaaagcaacgaattttggcacaactaaatgatgggaaaacatcatttattgatttgaacatctaa

SEQ ID NO: 77 - DNA, 3585 bp, Methanobrevibacter smithii
atgcaaataaaaaacatgtttgaaaaggatatcgacagggatatcaaaggagtaattaaagtcggtcaaaatgatgatgaaaatatttatcaggaactggatgaatatgttgttacaaatgaactattgaaacattttactaagtttttttcaagttataataagggaatacaaagtcccactgatgatattggtgtttggatttcagggttctttggaagcggtaaatctcactttttaaaaattttatcatatattctagatagtaatcttaaagttcatggaagaagaccaattgattttttcaaggaagatggaaaaatcaaagattcaatggttattggagatatggaagctgcaacaaatgttagttctgatgtagttttatttaatatagattctaaatcatcatcacaatcaagttcaaataaagatgatattttaaatgtatttgtaaaagtttttaatgaaatgcagggctattgcggaggaatgccctttttagcagattttgaaaaaaaattagatgcaaaaaataaatttgaagagtttaaaacagaatttgaaaatatcaatggaatggattgggaagaatcaagagatgaattctactttataagtgatgatattatacaaagtgttgtaaatattggattcatgagtgaaaacgaagctaacaattgggcttcaaaagcagaagaaaactttaagtattcaattgaagattttgcaaatgaagtaaatgaatactgtatcaataaaggaaataatcatcatgtaatatttttagtagatgaagttggacaatatatagcagatgatactaaattaatgctaaacttacaaactatagttgaagaattaggaattaaatgtcatggaaaggcttgggttgttgttacaagccaacaaaacattgatgacatcaccagagacataaaaggaatggatttttctaaaattcagggaagatttaaaacacgtttatccctatcctcttcaaatgtagatgaagtaattaggagacggattctagcaaaaactgatgttgcccaacaaactttagaagcagaatatccaagctttgagcctattttaaaaaatattttaacttttgaaaaatctgcagaaatgaaaacatatgaaaatgcaagagactttgcaaatatctatccatttgttccttatcaattcaatcgtgttcaggatgttttaacatcaataagggaacattcctcatcaggaaagcatatggctgatggtgagcgttcaatgcttgcactcttccaagaatctgcaattgaaattaaaaatggttctgagggccaattagttccattcaatatattttataatgctattgaacaatttattgatcatactaacagtcaggtaattaataaagcacgggacaataaggaattgtatccttttgatgttgaagttttaaaagtacttttcatgattaaatatgtaaaagaaattaaatctacatctaaaaatttaaccacattgttaatttctaacattaatgaagacagactggagttacaaaataaagtagataaatcattatccagattacttgaacaaactttaatccaaaaaaatggggaggtttattcatttttaacaaatgaagaacaagacattaatcgtgaaattaaaaatcagatagttgataatggtgaagttttagataatgctgcaaataggattttccaagaaatttaccctaaaaacaaatatcgttatagcaatagatataatttccaatttaatcaatcaattgataataaaaagattaataatagagaatttgatattggaatgagaataattactccgttttatacatcagatttaagtgattgctctcaagctacttttgaagaaagtaatatgcataatattttaaaaggattatcagaatctaacaatgaagttgttgtacatttactttctgatttaacagtatttgatgaaataaaagaagcactgcaaattcaaaaatatttaactaaaaaaagtgctgaaatgaaggttgaactcagaagcagaaaacaagaggaatataatgataaaatagaaagaatcaaattattccttgaatcttctattaaagatgcaataatttatattaaaggagataaagtagatattgctgaaaaaaatgttgaatcaagacttgatgaatcaatgggcaagttagttgataaagtttataataaattaagttatatggactttgcacctgataaaagtgatattaaaaaagaattaacaaatgaatatcagcagacactgatagctagtgaaacaaaagctatgaatgcagtaaatgatatggacagttatatttcagatcagtcaaaactacataatactcttacactaaaaagtctaataaacagatattcaaaagctccttatggttttgtcaatttggatgtgcaatggttacttgcttcattatttgcacaaaaaagaattgtcttaacaattaatagtgatgaaatttctttaagaaatactgatgcctccaaaattttagattatttaacaaaaaatgaatacttagaaaaactattagtatctgaaaaagaagttattgatagtagtaaaattaggaaagttaaagaagttttaaaagaggtttacagtttgaatttaactcatgataatgatgaaagaatcatggatgaatttaaacgtgttaatacatctaaaattgaagaaattgataaatgtcttttagaatttagaatatcaaataaatatcctggcaaatcaatattggaagaatcaaaagaattatttaatgatgctaacaataagaaaaacacattgcaattctataactatgtgtctgataatgatgaagaatttttggatttggctgatgatttagatcctgttttagcattctttaatggaagtcaaaaagctattttcgatgaatcctgtgaagtatataaagtttatgaagaaaatattaacttaatcaatgattctgatttatcagatgttgcatctgaaatttacagaattatttcaatgccaaacccttattcaaatattagaaaactacctgaattaaacaataaattcactacacattttgatgaaatattagaagataaaaaaacaattattttaaatggaataaaggaagattatgaaagtatcaaattaagactaaatactgatgagttgaaagctaaatttgaaaataaatttatatctgaatttgattcacttaaaaataaattggattcagaaaaaaatattgctattattgatggaatcacaatggaatcagaaaatcttaaaaacaattgcatccatgaaattgatttatttattaattctataactcctatttatcctccagaaggtgcaataaataaaccagtatctccacaaccaattcctgtggaagtggatgtggacattaaaacaataacattatcacctaaggttaaaatcgaatctgaagatcaaattgatgaattcttacaaaaagtaaaaacagaacttaaaaataaattagaaaatgcagatattattaatttaaaactatga

SEQ ID NO: 78 - DNA, 3468 bp, Methanoculleus bourgensis
atggcttctcatgatgtaatcttaaataaagatgtcttccaccgggatccgctcggttacaccatcccgaacgatggtgtaacggaagtcggcccgatcgcgacggaacaagaatgggccgtcgctcgttatgaacttgaaaattttatctgtaaaggatcatatcacagaggattgaaaaatattctcgaatcgtttctcgataaccttgacaagtcggtgcagcccccggtgtgggtgagcgggttctttggttccgggaaatcgcacctcgtccgcgtgctggaatttctctggagcgacctggttttccctgatggggcgaacgcacgggagatctgtcaacttccggatgatgtaaaggatgcgcttcgcaatctctctagtgaaggccggaggcatggaggtatctggtctgcagcagggaaattgcgttccggttgctctggtgatccacggattgcggtacttcaggtagttctccgttctgcaggactccctgatgatattgatatcgcacgtgttcatctctggctcgcagaattcgggatcctcgatgcaatgtgggagaaactccgcgagcaggggagagatagagatatgaaccgcccctttgtctcccgaaagttcacagaagccctcatagaacttcaccctgattttcggggcatgactgtagagcaggtcagggaagatctgcgacggcaatttgagacaaacttccagataacggattcgttcatggttgagatgctcaaggatatctttgccatgaagagcaccgtgcccgggaagatgccgctggtgctgattgttctcgatgaagtccaatcatacctgacgcttggtgaggggtcagagggattggataccttcgaagatgttgttgaggcttgtagtaaaagatttagttcaaaaattctctttgtcgcaacagggcaggatgcgttggaggccaacaagatattacagcgcctccaggggagattttctctagatgttcccctcgagtcaaaggatgtcgatgtggtgctccgccagaccatcctcaggaagaaggagtcgatgaaagaaccgctagaggaagtgctggagttggccagtggtgagatctcccgccatcttgatggctcgaacctggcgtcacaggttgaggatgaggaggttctgctgcttgattatcccctgttgcctaccaggaagcggttctgggagcggatcctgcagagtgtcgacaggggagggatgagcacccagttgcgcaatcagttgcggttaacctttgacggcgcacgcacctttgcggcggaccctgttggaacggtcatcccggcagactttatcttcactcagcagagcacctacctgatacggaataatatcctctccccgaagatctacgagagtatcagcaaggaggatgacgggactccagagggacagcttcgttcccggatagctgcgcttcttttcctgatccagcaggtggacgaatctttcgggattagggctacgccggataccctcgctgatctcctggtcacggatcttgtggctgggagtgaagacctcaggcgagaagtcccgatcctgctcaacgatctccatgaccgcggggtgatcgcaaaagtcggggatgagtatcgcatccagactgaggaggggagtgtctgggaaggggattaccagaaacgaaaggccgacgccagggcgagcgacaccagtatcatgttcaggcgcgatgagatcctcaaaaccttcgccaataagcaccttgagaggctcacgctcgcgcagggcgagagtaaaaccccgcgtggcattgaatcaacctattttacatcacagaaacccgagatccggtcgaatgtgccggtatggatacgacacgagtgggaggttaccgaaggagctgtcaagtcggaggcagccgctgaagggagcgaaagcccgatggtgatggtctttttaccacggatcgaccatgatgcgttcaaagatgagatcggcggtctgctggccgccgagggcgtgatacgggaccgcccggctccgaccacgcctgaggggggccaggcgagatccaacatcgaggcgaagctgagcgggcatatgcagcggatcgattcgatagcagctgagatcttcaagcacgcgagggtgtatctcggtggcgggatcctcgtcgagaatgattcgtttgcgggtgctgtccggaaggcggcagaccgggcgatccagcggatgtactaccggttctctgatgctgatgccgtgggatgggaccgggtcatcaacagggtgaagggcggggacaagacgccgatgaaacagatcgggtttgaacgcgaacctgaggagcatccggtctgcaaggagatcctgaaacggttgaacacaccaaagaccgggaaggaggtgcgaaaggctcttgatgcgccgccgtttgggtggccgcgggacgcggtggacggggcgttgatggtgctggtggccaccggtcacctgaaggcccggttcaataacaagccggtttctgcccccgaactggataagacgaagataggtaaggcgacgtttgaagcggagaatatcgtcctctctcccatggagaaggtggcggcccgggaactctatacgaagtttgatctgccttcagagcccggacgtgaggtggaagaggcggtgcagttccttgactgcctccattccctggtcaaggctaccggcggagatcccccgctgccgccacgggtgtcaccccagtaccttgctgaactccgggcatactcgggcaaccagctggtgcgggaactggttgcgcggcgtgtcgatatcaaacaggatattgaccggtggatagcggtaaaagcgaagatcgaggagcgggtgcctgcctgggatgccctgcagcacctgatctcgcacgctgaggggtttctggaccttccggacatcaagaccgaggtgacggcgatccgtgagaaccggagcctgctcaatgatcctgacccggtcgaaccactgcttgctgatcttcggagggggctgcgtgagtccctgaaggccgggacggtccggttggaggagacccgacaggaggtgcttttcgcgctggatgccgacccagactggcacaggctggatgagaagcagcgggcgagtctggtccgggcacactaccttaacgagcctctcccgctgaggacggggaccgatgacgagatcgtggagcacctcaggaagactccgctgacgtcttttgacggccggattctgctggtcaggggggcgcttgaccggatcagggtgaaggtggcaaagatccttgaaccggagaccgtggtcgtctctctcggggcgccggtgacggtgaagacccgggatgacctcgatgcgtacctggaggaggttcgcggacgggcggtggccgaacttgagaaggggaacccggtggtgctcagatga

SEQ ID NO: 79 - DNA, 3558 bp, Methanolobus psychrophilus
atgacgagtgctataaaaattcaagatctcttccaaaaagacatcaagagagagataaatggtgttatcaaggtcgatcaggaagacgatgagaatgtatacactgaacttgatgaatacgtggttacaaaagaatcactgaagcatctggaccttttctttgagagatacttcaatgctctggaaaaccctacggataaagtgggtgtatgggtatccggattctttggttcgggtaaatcccattttatcaagatgttatcctatcttctggaaaaccgcgttgtacggggcaagtcggcccttgagttcttcagggaaaagatagatgatgcgcagttattctcttcgatcgaaaaagctgtgattcatggtacaaaggacgttatccttttcaacatcgactcaaaggcaaacacccttaaccggagcgatgagctcattgtgaatatcctgatgagggtattcaatgaaaaaagaggttttttcggggatgtcctgtggcttgctgagatggaagaggatctggttaacaaaggtctttatggtgagttcaaagaggagttcaggcagataagcggtgccccatgggaggagaagcgggatgcctatatctttgaacaggatgagatcatcgaggcacttgtaaattgtgattaccaaagcagggaatctcttgaaaggctgttccatagcgacggaagcagctctcatttcagcgtggagaaattcgctgaaaaggtaaagagatactgtgattcaaagggtaaggaccaccaggttattttccttattgacgagatcgggcagtatattggtgaaaatagtgaattgatgcttaacctgcagacggttgtggaggctcttgggacaaagcttacaggaaaagcctggatcgttgtcacatcccaggcggatattgattccattaccaaggatgctaagggctatgatttctccaagatccagggacgttttgatacccgtctgagcctttccagtgccaatgttgatgaagtgatcaagaagaggatactggcaaaaaaagcagtttacgtggagacattgacatcatattacactgataagaagacaataatgaagaacatcctcactttctcgcccggcggggctgagatgaagctgtacaagggagatgaggactttgtcaatgtatatccttttgtgccttaccacttctttgtgctgcagaaggttttcgataagataaggcagaccggttttacaggcaagcaccttgcaaaaggagaaaggtccatgcttaacgctttcaaggaggcatccgaggagtatgctgaggaagagcttggggtgctggtgcctttttccacattctataacactatagagagcttccttgatcccatcattaagcgcactattgaacaggcgaagggcaatgattgtcttgtggatggggattgcgagatactcaagatacttttcatgataaggcatgtgaatgtgttgcagccgagcctggataaccttgtggtgctttccatatcccatgtcgatgaggataaaaggaaactgaaggagaggatatctgcatccctacagcgtctggaggcccagacacttattcacaagtcaggggacaggtattatttcctgaccaatgaggaacaggagatcaaccgggagatcaagaacatcgatgttgagaagcataagatccttgatgagatgttcgcgtatgtctttgatgaggtatgtcctgccaagcataaggattacaaattccacaaatccattgatgataaggtcaagtctacggcaggtgcagacctgaccatcaagttcctgacgcctttgtcggatgacgtgcagcggggaagtggacagaggtcactgagcggggaaaacttaagcaatgtggactcaactgatactcttctttttgtattccagcatgatgctgtttttgtgaaccagatacgggattacatcaggatcagcaagtacttgcttcagaatacttccaatatgaatatcggagaggtcaaggacatcctcagcagcaagagaaacgatgaggtaaagcttcgggaagctgctaagaagtccatggaggaagggatttcagaggcacggatatttgttgacgggaaggaagtcacaagtattgagaagaagaaccccaaggaaaggataaaagacggactagacctgctctttcagaacgtgtacaagaaggcaggttatgtgacaagggagtttaccagcgataatgagatactgagaatactccaggcagatgaccttgaaaagttcggtgcaggggaatcagaagaaaaccagcttgccctgcgggaaatgctggactatttgaacgtaaggcatcagaagaatgatgttgttgtgctgcaggatatcaaggagaggttcaggcgcaagccctatggctggaatgaggtgaccatttccggtcttgtagctacgctgtttgcgagggatgagatcaaagtcaggtaccagaagacatatctcattctcaagagaccgaccgcggaggagatcgtgagatatctcacgaggaaggattttgcagataaggtcgtgcttgagatccgggagaaggcgaacgttgaggtcatcaggactgtaaaatcggtcctgcgggatgtgttcgagaagactaatatccctgagaaggagaatgagcttttcgaactcacatactcgctgttcaaagcggaatacacaaatcttgagcagatagaaggcagatacaaagaagagccaaggttccccggtaaagagaagatacgggcatatgctgatttcctgaacaatgtccttaacgtgacagacccttcatcattcctgcaagcaatagctgatgggaaggatgagtttgtccgggcacgcgcagaggttgagccggtactatcgttctttggaagcactaaggtggatatattcagaagggtcctaaagaagatggataacttcaagcgggacctgcagttcatggatgaagatacaaagttcaaagtgcaggaagttaaagccattctggattcaaaggaaccttattcagatatcaaatcattaccaccactcgaagcaagcattgaaagttccctttctactgctcttgccaacttaaaggaagcagcatttacagaaataggatcaatcaaaattgaattacaaaaatacatggcttcttatgtggagttagattcggattatagatatttgatgctaaagccctttgatcagttgaaggaaactattgcacaagctagtgactgtgtattcgtgcaagcacagtccactacattgaagtttctcgatgaaactacttatggggaaataaagaaccaactccaaacaattagggagaaaacagagggtaaggataaggacaagataactcctgtaagatcgactagagtcattagagacgtgtcactattcaaaactaaagatacgatcaaatctaaagaggaactggacaagtacctcgaggatttgaaaacagctttgttagaaatgctcaagacagataatttcaaggtgcagtga

SEQ ID NO: 80 - DNA, 3564 bp, Methanomethylovorans hollandica
atgactgctgcaataaagatacatgatctattccaaaaagacatcagaagagagatcaacggtgttattaaagtagatcaatatgatgaagacagcgtatatactgaactggatgaatatgttgtaaccaaagagacattgaagcatctggacaccttttttgataggtatctccatgcaatgtccgagcctaccgataagaccggagtatgggtctcaggtttcttcgggtccggtaaatcgcattttatcaagatgttgtcctacctgctggaaaatcaggtagtaaaaggtaagagtgcactggatttcttcagggagaaaatagatgaccctcagttactgaataccatcgagcaggcaattacttttgggacaaaggatgtaattctcttcaacattgattcaaaggctaacacattgaacagaagcgatgagctgatcgttaacattctcatgcgggtgctcaatgagaaaaggggtttctatggggatgtgttgtggatcgctgatatggaagaggaccttgtgaacaaaggtctgtatgataagttcaaggatgagttcaggcagctcaatggggaatcctgggaggagaaaagggatacttatgtttttgagcaggaccatatcatcgaggcgcttgtaaattgtggataccagagcaaggaatcacttgaaaggctgttccagtccgatggcagtacttatcatttcagtgtggagaagttcgctgagaaggtgaagaagtattgtgattccaagggtaaggatcatcaggtgatctttctgatcgatgagatcgggcagtatattggtgaaaacagtgacctgatgctgaacctgcagaccattgttgaggaactgggtacgaaacttgcaggtaaagcatgggtggtcgttacttcccaggctgatatcgatgcggtgaccaaggaaaaagtgaaaggttatgacttttctaagatccaggggcgttttgatacacgtctgagcctttccagtgccaatgtagacgaggtcatcaagaagaggatacttgcgaagaaacaggtctatgaggaaaccttatctttgtatcatgaggaaaagaagaccatccttaagaacctgttgaccttctcccccggcggggctgaaatgaagctgtataaagggaacgatgattttgtggacgtgtatccctatgtgccttaccagttctttattctgcagaaagtgttcgataagatacgacagaccggttttacaggtaagcacttagcgaaaggtgagcggtccatgctcagtgccttcaaagaggctactgagcaatatgctgaagacgatatgggaattctggtaccgttctatactttctacagcaccattgagagcttccttgatcctattataactcgtacaatcgagcaggcaaaggacaatgattgtcttgaggatggggactgtgatgtgctgaagatacttttcatgatcaggcatgtgaaggagctgcagccaagccttgacaacctggtggtgttgtccgtatcccatgtagatgaggataaacgtgctcttaagaacaggatcgccggatcactgcagaggcttgagagccagaccttgatacacaaatctggagatagattctatttccttacaaatgaggagcaggagatcaatagggaaataaagaatatcgatatcgagaaacacaagattcttgatgagatattcgagtatgtgtttgagtccaatgagatatgcccgacaaaacacaaggattacaagttcaacaaggccattgacgataaaacaaaacctgtggctggtgcggatctgaccataaagttcctgacacctttatctgatgatgtgctaagaggcagtagccagcggtcactgtatggcgacaatctgagcaatatagattccactgacactctgctgttcatcactcatgcggattccgaattcgtagaccagatacgcaattatctgaagatcgataaataccttaagcagaacacttccaataccaatataggtgaggtcaaggagatcctcagtaaaaaaagaagtgatgaggaaaacttgcgtctggatgcaaagaagtctatggaaagcggtatttccgaagctagggtctttgtggacggcaaggaagtcacaagcattgagaagaaaaaacctaaagagagaataacatgtggtctggatctgctctatgagaacgtgtacaaaaaagcaggttacgtgaccaaggatttcgaatctgacagtgagatcttaaaggtgttgcaggcggatgacctggaaaagttcgggtttgaaagatcggataccaataaacttgcccttaaggaagttctcgatcatctgagtctaaaacaccagaggaacgacagcgttgtaatgcaagatatcaaggataagttcaggcgcaaaccgtatggatggaaggagcttactgtatcgggtctcgttgctacgctgttcgcaagtgatgagatcaagctcaggtatcagaagacgtatcttgttcttaagaaacccaatgctgaagaagtggtgaggtatcttacaagaaaggattacgctgataagcttgtggtggagatacgtgaaaaagcgaatgccgaggtcatgagaatagtcaggtcgatcctgagggaggtatttgataagacaaatatccctgagaaggagaacgatctctttgatttcacacattctttgctcaatgatgagtttatcaagatagagcagatatcaggtaagtacgaagaggaaaagagattcccgggaaatgatgaggtcaaagcctatgctggtttcctcaaacagatactcaataccacagacccgtctgctttcctgcagaagatctccgatgaaaaggaagagctagtgaaattgcggtatgatgttgaacctgttatctctttcttcgggggtcagcaggtggagatcttcaggcggcttttgaagaagatcgataattacacccgtgacaggcagttcatggacgatgaaacaaagtcaaaagttagggatgttgaagctatcctggggtcaaaggaaccttacttcgagatcaagtcactgcccccgctggaagcaagcattgaaagtgccctttctactgctctttccgacttaaaggaagcagcattcaaagaaatagattcaatagtagctgatcttcaaaaggaaatgggtcatcatacgttatttaaccaggaattcaaggattccgttatgaaaccgttcactgacctcaaactgcgtatttcacaggcagaagactgtacatatgttcaggcgcagtctcctagattgaattcacttcagagtgaggcttatgacaagatcagcaaacaattgcagatcataaaggaaccaaaatctggttcgggtgaggtttctgttcatgtcaggtctgtaaagttcattaaagatacttcgctttttaagtcaaaggataagatcgcttctgaagaagaacttgataggtaccttaaagaccttcggacatatctcgcaaagttacttgaaacagatgatataaggttgttctga

SEQ ID NO: 81 - DNA, 3606 bp, Methanosarcina acetivorans
gtgctacacatgacagccacagaaataaaaatagaagatttattcgaaaaagatatccgaagggatatcaatggggtaataaaggttgatcaggaagacgaaaggagcgtctataccgaacttgatgagtatgtggtaacaggggagtcccgaaagcattttgatacatttttcagaaattatgctgcagcacttgatgaacccacagacaaaataggggtctggatctcagggttcttcggttcaggaaaatcacatttcctcaaaatcctttcatatttactggcgaatagggaagttcaggaaaagaaagcactcgaatttttcagggacaaaataacagaccctgctatttttgccaatatcgagaaagccgttactacaggcactaaagatgttattctctttaatattgattccaaagcaaacactgcaaacaagggcgatgaacagattgtaaatatcttcatgagggcttttaacgatatgcgagggtatctgggggatgttttctggatcgcagaccttgaagaagaccttgaagaaaaagggctttatgaggcttttaaaacagaatttgagagcataaacggggagccatgggaagaaagaagagtcacctatggttttgagcaggacgatattatagaagcccttgaaaactgtggccacatgagcagggaagctgctaccaggttgtttgaaaacgatggagcaggctatacttttagcgttgagaaatttgcaaaaaagctcgataagtactgcaaatcgaagggaaaagaccatcaggtaattttcctggtggacgaagtggggcagtatataggagaaaatagcgagctgatgctcaacctccagaccattgtggaggaactcgggaccaaactccgggggaaagcctgggttgcagtcacttcacaggctgatattgatactgttactaaagaacacgtaaaaggctacgacttttccaagatccagggacgttttaacaccaggcttggacttaccagcgctaacgtggacgaggttatcaagaaaaggatcctgagtaagaaggaggaataccgggaagttctggcctcatactacgcagaaaagcagactatactcaggaatttgcttgcgttttcaaaccgggctgaaataaaggtctacaaaaacgaagatgactttgtaaacgtatatccttttgtcccctaccagttcaaccttgtgcagaaggtctttgacaggatcagagaaacagggtttacgggcaagcacctggcaaaaggggaaaggtcgatgctcagcgcttttaaggagtcgaccgagaactactgcgagaataatgtagggatgctgattcctttccacgcattctatgagactattgaaggcttccttgacccgattatcgcaagaacaatttcccatgcccgaaaaaatgattttcttaatgacaacgactgcgaacttctggaaatcctgtttatgatcaggagcattccggaaattgagccgaacctcgacaacctgatagtgctctccatttcttcggttgacgaagataagatcaaactgaaacagagaatcgttgagtccctgcgaaaactcgaagaccagaccctgataaacaagtccgaagacaagtactatttcctgacaaatgaggaacaggagatcaataaggacatcaaaagggtagaaatcgaagagcaccagatgctagaagaaatccacgggatgctttatgagcagaaacaggggatctgcccggcttcccataaggaatacaggtttaacaaagcgattgatgacagggtgaagaccttcacaggcgcagaccttacaatcaagttcctgactcctctttcagaccagtattatagtaaaaaaggaaaccagcagtccctgagtggcgatactttaagcaatatcgattcaacggacaccctgcttttcattcttccggaagacgaattaatcgaccagatcaggtcttacctgaaaatagagaagtatctcaagcaaaactcctcaaaccggaacaatgtggaaatccagaatattctttccacaaaacagcagaatgccaacagcgcaagagcaaaagccctggaactggtccagaaaggagtttcggattcaagggtttttgttgataacaaggaagtaatccctgagaaatccagcccgaaagagcgcataaaggaagggctcgacctccttatacagaacgtctacaacaaagccggatatgttacaaaggactatgaaaacgacagcgaagtgctcagagtcctgcgctcggatgaccttgagaggttcggagttgaaggcagtgatataaacaggctggctttaaaggagatgcttgactacatccggttgaaatacgggagaagcggcagggtcctgttaagtgacttaaaggaacgcttcacgaaaaagccctacggctggaaagaaatgacgatttcggggcttgtggcaactctttacctcagggaagaaattaaactccgctaccagtccgaatatctgttcaaagacccggaagctacggcaaaacacctgacaagaagggatgaaactgacaaagtggtcatagaaatcagggagaagaccggagaagaggacctgaaagctgtcaggctgatcctgaacaacctttttgacaaattaaatctgaaagaaaaagagggagagctttacgaagagataaagtgcatattccgggaagagcttttgagcctgcaagaaatcgaaggcaggtatgaggaagagaaaagcttcccaggcagaattcagatagaagcttacagaaaattcctgaagaaactgacagagaactctgatccctctgcctttttcagagccattgcctcccaaaaaaccgagtttgaagagcttcatgccaatgcagatcctgtaaagagcttttttggaggttcccaggttgaaatcttcaggagtcttgcccacaagtacagggattactccagaaatatccagttcctcagtgatgaaataaaagcagatattgaggaagtatacagaattttgaatttggaagaaccctactctcagatccgccagcttcccatactggagaagaagatcgacgcttcaattaaagaggccctttttgcccagaaggaaaaggtcagagaaagccttgatacagttacaaaagagcttgaggatgacctttcagacgaaaagtactccgacgacttcaaggaatcggtgcttcggcttttcaatgtaatcaaaatgaccacggaaaatgctgaagactgcatttttgtccagagccagctccctataatagactctctccgtgtagacgcctacaggctgagagatgctgagaacctcagaatccgggaagagcaacagaaactagctagtgagaaaatcattgatacaccagaaaagccggatgaccagccggattcgcctcaagttacatcaagaaataccgaagttatcagcgatataacatttttcaagtccggaaaaatactggaaaatgagctcgatatcgaggaatacgttacccagctcaaaggaaaactaatgaaaatggtcagagaggaaaacattaaaatttaa

SEQ ID NO: 82 - DNA, 3639 bp, Methanosarcina mazei
atgacagccacagaaataaaaatagaagatttattcgaaaaagatatccgaagagatatcaacggggtaataaaggttgatcaggaagacgaaaggagcgtctataccgaacttgatgagtatgtggtaacaggggagtccagaaagcattttgatacatttttcagaaattatgctgcagcacttgaagaacccacagacagaataggagtctggatctcagggttcttcggttcaggaaaatcacatttcctcaagatcctttcatatttactggcaaatagggaagttcatgggaaaacagcactcgaatttttcagggaaaaaataacagaccccgctatttttgccaatatcgaaaaagccgttactacaggcgccaaagatgttattctctttaatattgattccaaagcaaacactgcaaataagggcgatgaacagattgtaaatatcttcatgagggctttcaatgatatgagagggtatctgggggatgttttctggatcgcagaccttgaagaagaccttgaagaaaaagggctttatgaagcatttaaaacccaattcgagctcataaacggagatccatgggaagaaagaagagttacctatagttttgagcaggacgatattatagaagctctcgaaaactgtggccacatgagtaaggaagctgctaccaggctgtttgaaaacgatggagcaggctatacttttagcgttgagaaatttgcaaataagctcgataagtactgcaaatcgaaaggaaaagaccatcagataattttcctggtggacgaagtgggacagtatataggagaaaacagcgagctgatgctcaacctccagaccattgtggaagaacttgggactaaactaaggggaaaagcctgggttgcagtcacttcacaggctgatattgatactgttacaaaggaacacgtgaaaagttacgacttttccaagattcagggacgttttaacaccagactgggacttaccagcgctaatgtggacgaggttatcaagaaaaggattctgcataagaaagaggaatacagggacgttctggcttcttactatgctgaaaagcagacaatactcagaaatctgcttgctttttcaaaccgggctgaaattaaagtctacaaaaacgaagatgactttgtaaacgtatatccttttgtcccctaccagttcaaccttgtgcagaaggtctttgacaggatcagagaaacagggtttacgggcaaacacctggcaaaaggggaaaggtcgatgctcagcgcctttaaagagtctaccgagaactactgcgaaaacaatgtagggatgctgattcctttccatgctttctatgagactattgaaggcttccttgacccgattatcgcaagaacaatctcccatgcccggaagaacgattttcttaatgacaaagactgcgaacttctggaaatcctgtttatgatcaggagtattccggaaattgagcctaaccttgacaacctgatagtactctccatttcctcagttgatgaaaataagctcaaactgaaagaaagaatcgttgaatccctgcggaaactcgaagaccagaacctgattaacaagtccgaagacaagtattatttcctgacaaatgaggagcaagagattaacaaggacatcaaaagggtagaaatcgaagagcaccagatccttgaagagatccatacgatgctttatgagcagaaacaggggatctgcccggcatctcataaggactacaagtttaacagagctattgataacagggagaagactgtcacaggtgcagaccttacaatcaaattcctgacccctctttcagaccagtataacagtaaaaaaggaaatcagcagtccctgagcggcgagaatttaagcaatatagattcaacggacaccttgcttttcatacttccggaagacgagttgatcgaccagataaggtcttacctgaaaatagagaagtatctcaagcaaaactcctcaaaccggaacaatgtggaaatccagaatattctttccacaaaacagcagaatgctaacagtgcaagagcaaaagccctggaactggtccagaaaggggtctcggattcaagggtttttgttgacaacaaggaagtaatccctgagaaatccagcccgaaagagcgcataaaggaagggctcgaccttcttatacagaatgtttacaacaaagccggatatgttacaaaggactatgaaaacgatagcgaagtgctcagagtcctgcgctcggacgaccttgaaaagttcggagttgaaggcagcgacataaacagactggccttaaaggagatgcttgactacatccaactgaagtccgggagaagcggaagggtcctgttaagcgatttaaaggaacgcttcacgaaaaagccctacggctggaaagaaatgacgatctcggggcttgtggcaattctttacctcagagaagagatcaaactacgctaccagtccgaatacatgtttaatgatgcgaatgctacagcaaaacatctgacaagaagagatgaagctgacaagctggtcatagaaatcagggagaagaccggagaagaagacctcagagccgtaaagaatatccttaacgacctttttgaaaaactgagcctgccagaaaaagaaggcgaactctacgaaactgcagagaaaatattccgggaagagctttcagccctgcaggtaatcgaaggaagatatgaagaagaaggaagcttccctggcagagcccggatagaagcctacaggaaattcctgaaggaactgacagaaaactctgacccttcatcctttttcagagctgcagccttacgaaaaaccgaatttgaagagctgcacgccgatgcagagcctgtgaagaacttctttaacggctcccaggttgagatcttcaggaggcttgcccataagtacagggattactccagaaatatccagttcctcagtaaagaaacaagagcagatattgaagaagttaacagaattttgaacatggaagaaccctactctcagatccgccagctcccagtactgaagaagaggatagaagttgcaatacaggatgccctttctgcccggaaaaaagagatcagagataaccttgatgctgttacaaaagagcttgagagggagctttcagacgaaatcttttctgacgatttcaaggaaacagtgctaaggctcttcaatgtgatagaaaggacgatagaagatgctgaggactgtgctcttgtccagagccaggttcagattataaattctcagagggtagaagcttacaggcagatggaccgggaaaggcagactatccgggaagagcagaagaagaatgaatataagacaagacctgaggctttagataatccgggaactccggcaacaaaatctgtggaccacgacacaggagcagaaacaaaaattgttcctccggcggcccctcagagaaatactgaagttatcagcaatatagcatttttcagatgtggaaaaatgctggaaaccgaagaagatgttgaggaatatattacacagctcagagaaaaattgatgggaatcctcaaggagaagaacataagggtgtga

SEQ ID NO: 83 - DNA, 3501 bp, Methanospirillum hungatei
atgaagacgagtaagagagatatgatattaaataaggatgtttttcagaatgatccgacagcctatgaaattcccaatgatgggtataccaaggttgcccccattacaacagagcaggagtgggaggttgcacggtgggaacttcagcattttgtttgtgagggatcatattatactggtcttaaaaagattttagattcgtttcttgatcatttagatcaaccaaagcaaccagcggtctgggtcagtggattttttgggtctggaaaatcacacctcgttcgcattcttgacttcctttgggctgacattacattctctgatggcgctacggcaaggactcttgcccgtctacctgatgatattcaggactcattaaagcgacttgatactgaaaccagaagagcaggcggtatatggtctgctgccgggacactttccggaggggattcacatgatcccagagaggcagtgttacaagtaattttacgggctgcaggttatccggatcatgatctccagcttgcccgaattcatctatggcttgcacagcaaggcatccttgatactattcgctcggacctgaaatcgatgggaaaggaagacgatcttcaatattgtctcatctccccggcatttgcccaggttgcactcaaatatcttcctgatcttggagccactcctcaggacctgtttaccaggcttgatcgtcaattccctgaagagacgaatatgacaactgacctgatggttagtttaattgatgagatattaaaaacaaaaattcaaaataagaaaaaaccgggacttgttcttatcgtgcttgatgaagtccagcaatatctcgcggtagagcaggatagtacaaaacttgttctcttccaggagatagttgaggcattgaccagtaagtttgagagtcggtgtctccttgttgcgaccggtcaggaggcacttcatgcaaacccatacttacagaaactaatgggaaaattctctctttatgttcccctggagagtaaggatgttgatactgttcttcggcagactatccttcgaaagaaagagagtgagaaaccaaaattatccgctcttttagagagtgttcacggtgaaattacccgtcagattgaaggttcgaagattgctcatagtcaggatgataatgaatccctcgttccagactatcccctcttaccttccagaaaacggctttgggaccatatattacggtctattgaccggggagggctgtcaacccagcttcgaaaccagttgcgccttaccttttcgggaattaagacctatgctgagtctcctctcggatatgttattccggttgattatatctacagccaacagcggccatatcttataaataatgggattctcccccaggaaacagatgaaatgattcggggggaggatgattcgtcttcttcagggcaacttaaatcacgtatttgtgctcttcttttccttattcaacaagtagatacatcattaggggttcgtgccactccggagaccattaccgatctgctcttgtcaggtcttgagtatgaaggagttgatctccgtcgtgaggttcctcttcttattgatgacctgaaagatcgtggtattatcagcgatgcaggagatgggacactcaggattcagaccagggaagggaagagatgggaccaggagtatcggaaaaatctcaatgcatggaaggatgatatcaatcggatatcgtttgaccgtgatcaggcattgatgaaatctgtgcaagcccttctgaaacagatatcgtataaggatggcgatacgaagaccgtcagggagattgatgccaggatttttaccgaagataagcccccggtgagtaaaaagatcccggtatgggtgagaaatggatgggggagttcggaagaggaggttcgaaaaacctcacttgaagaaggcccggagagtccgctaattcagatatttctgccaaagcaccatcatcaggatctgatcgatcatattgcagggagtattgcagcccagcagactatggattcgattggtgtcccgaatacgaatgaaggtattcaggcgaagaagaatattgaaacgaagaaggttgctcatgatacaaaagtgcaagcctatctggatgatatcatcagccaggcggttgtgtatcttggtggcggggataagaaagagggtggatcaccaaaagaggttctcttgaatgcggtgaaaatcgcatcagaaaagaaattttaccggttcaaggatgcagataatcctcgttgggcggatgtttttacaagaatcaaatcgggtcatgcaaatccgctttcagttatcggtcattcagggaatactgaagaacataatgtctgtaaagagattttacggttcctgaatgcaaattcaaagaagggttctgaaatcgtaaaatactatgaggatgctccttttggatggcccaaggatgcaattgaaggggcgattattgctctgtgtgcctccggacatctccatgctactaatgatagtcataaaaccgtctctttaagtgaccttgataatcgtcggactcttgagaagagtttctttacgtgtgagagtgaatctcccccgactgcagaggaaaaactgaaagccaaagcagtgtatcaaaaggttggaattcaggccaaggcggggtctgaaggggaagatgcttctctttgtattgaaaaactcagagagcttctggaaaagaccggaggagatccaccgttaccagaagttatgattccttcatatctggcggagatggatgggctctctggtgtgtctcttctcaagcggattgcagcacagaaggatataattatttcagatattgagaaatggaaaagtattgttgatgtaattgctgtccgtcagcaggagtggtcacggctatgtaaactacttgaccatggtgagggactttctggcctggatgtgattattcatgaggctgcagccatcaaggagcacagaagtcttctctctgatcctgatccggtcaccgaccttcttttcaaggttcaggaacgattacgggaagagatatctcatggtatcagccaggtgtcagaggcatatcagaatctcatctcatcactggagggagatccaaactggcatgagcttgagtctcatgagcaggagaagattctttcttctcatcatatcagggagattccccagatgcctcttgggacggatgaggagataatccacgccctgaagcggtatcctctttcagattatcagaaagcgttagaactcattaatttgtcacgggggccaattgtttcagatgctgctcatttgtatgctgcaaaacataagaaggttctgacttcagtttctctgaaacgaggagtaaaaattacaaatgaagaagagctggaaatatatattgatgatatcagaaagcgggtgaatgagttattacagcagaagcaggaggtacttatccaatga

SEQ ID NO: 84 - DNA, 3537 bp, Methanospirillum hungatei
atggagccgaagattcaggatttatttatcaatgatattacacgagagattaatggtgtcatcaaggtcgatcaggaggatgatcagaatgtatttactgaacttgatgagtatgtggtcacgaaggaatcgctcaaatacattgataccttctttcagcggtatgcatcagctcttgattctcctactgataagaccggggtctggatatcaggtgatttcggatccgggaagtctcactttctgaagattctctcataccttcttgagaaccggaaggttttcggaaagagtgcacttgagttttttcagtcaaagatctctgactctgatattttaactacaatagagaagtctgtcaggaccgggacaaaggatgttatcctctttaatattgattcaaagtcaggggagacgggagagaggattgtcgatatcctaatgcgggtatttaatgagaagagagggtattttcctgatgtcttctggattgcggagctcgaagagaggcttgaagagaaggggctgtatcagaagtttaaggatgcaatagcagagatctcaggagaaccctgggaagaggtcagaacccggtattcttttgagcaggatgttattattgaagccctggatcggtgtttgtttcagagtaaggagtcctctgaacggatgtttgaatctgatgggcagaattatattctcacgccggagaagtttgcacagaaggttaaaacctattgtgaggctcgggggagagatcatcaggtggtcttcctgattgatgagattgggcagtatatcggtgataacagccagctgatgctgaacctgcagacggtagctgaggaactcgggacaatccttaagggaaaggcatggattatcgttacatcacaggctgatattgagactgccttaaaggcgatgaaaggaaaagaggtgaaacaggacttttccaaaattcaggccaggtttgatacccgtgtcagtctttccagtgcaaatgttgacgaggttatcaagaagaggatactgaagaagaaagaggagtataccgagatgctctctctcttttatgaggagaagaagaccatattaaagaatcttatctcgttctcagggggagcggagatgaagaattaccgggatggtgatgattttacctcggtgtatccgtttgttccctatcagtttatcgtcctgcagaaggtgtttgagaagatccggacgaccgggtttaccgggaaacatctggccaagggtgagcggtccatgctcaatgcatacaaggaggcagcagagcggtacgggtcttctgatcttggaactttggtgcccttttattccttttatgatacgatagagagttttcttgatcccattattaagcggacgatcacccaggcgggggataatgaacatcttgaggagtttgactgtctcctgctcaagacgctctttatgatccgccatgtacaggagttaccaaaaaatcttgataatattattgtcctttcattgtccagcgttgatgaggataagttacagcttcgggaacgggttattgcttctttgaaccggcttgaacgggagacccttattagtaagtccggtgataacttctatttcctgacgaatgaggagcaggagatcaacagggagattaaacagattgatattgaccgtcatctgattgtgcaggagatctttgatcaggtgtttacgtccaattccatctgtcagaagtcatatggcgagtataagttcaataagtcggttgatgacaaggtatcctcctcttctgatgcagatctgacgatccggtttctgactccgcttgctgatgagtatgtcagagggagcggtcagcagtctcttggcggggagaatttgagtaatattgactcgaaagatacgcttctttttatctttccggaagagagtggatttgtcgggcagattcaggggtatcttcaaattgagaaatttctaaagcagacccggtcgaaccggaatgatgagctgatgaagaaatatcttattgagaagcagcaggaagcagcgtccctgaaggaatcgtctatctctgctattcatgagggggtgaaagatgcccgggtttttgttgatggcattgaggtttccctttcgtctggaagtccgaaggaactggtacgggatggatttgagcgactcatcaaggctgtttatcataaatcccattatgtgaaccaagagtttgcgtctgattcggatgttctccgggtgctgaaatcggctgatcttacacagttcggagtgagcacgtctgaagtgaatcatctggctttacaggagatgcatgactacatcagtgtgaaggatgagaagaaggtaccggtggtgatgagtgaacttatctctcatttctccagaaagccctatggctggaaggtgatgacaatatccggtcttcttgccatgctctacaagggtgatgatatcaggctccggtatcagcgggcgtatcttgctcataatccggaggatattgccagatatatcaccagaaaggagaatttcgataagattgtcattgaactgaagaagaagacgtctgcagagattattcagaatgtgaaggcattgcttcgtgatgtctatgatatttctgctcttccggaaaaggagcaggagatctctgatctcatccggtctacccttgatgagaagaaaggggaactcgctgctgatctggcccggtattctgaagagccacggtatcctggcaggaaacgaattgagccatatctgaccatgataaaagagatcctctccatctctgatccgaccgcatttcttgagaaactgtcagaggataaggatactcttgcagatatggctcatgaggcaggtgtggcggtacagttctttgaagggaatcagaaggatatcttcaagagggtgcttgataagattgacgggtatcaccgaaactcccaatttttagatgattcggcacaggagagcctgcaggagttggaccggatcataaaggctgataatccttattctgatatcaaaaagcttcctcaactggagagtgtgattgagggatctctcgcagtatcacgtgagcggttacaggaagaactgaagaattctgctgatcagttcaaacagaagatagatagaaagttcagttattcggatgagtacaaggagtcaatagcacctctagtcagggagacgtttgatggttctgtaagccgggcactgaattcgaacgattgttctcatcttaagttggcggcatcaaatctctctaatctctatatccgggcctgtaaaactacggaagagaagattaaaaaaattatcgagaacgaaccagatattaatccggtcccggtacgatcaaaccatgtcatcaattcaaccgatttcttcaggactaatactgtcattgagaatgaggaggatcttgagcggtatctggcgggtatcagggtgaagcttcgggagatactcaaagataagaacatcgaggtgatctga

SEQ ID NO: 85 - DNA, 3531 bp, Microlunatus phosphovorus
gtgaccgtcatgcagctcaccgagattttcgccaaggatgtccagcggcccatcgagggcgtcatcaaggccgatgacgtggcgcatctgggcaccgaggtcgacgagtacgtcctgaccaatgaagccgccaagggtctggaactgctgcttgagtcgtacaccaactacaccaacgcgaacggcgtgtggatttcgggtttcttcggctccggcaagtcgcacctgttgaagatgctcgcgcatctcctcggcgaggtggagggcgacgacttcccgcgtgagcgagtgtcggagagctttcgtgccaaggcgacggatgctttcctgccgccgctgctcaacaaggccgaccgcatcccggccaagagcctgttgttcaacatcgatcagaaggccaccctgatcagcaaggatcagaccgacgccttgctgcgtgtgttcgtgaaggtcttcgacgagtcccgcggttactacggcgatcagggccacatcgcccgattcgagcggcagcttgacgacgaaggccaactcgatgcgttcaaacaagccttccgagccgtgtccggccgagactggatggagcgccgtccgagcttcggcctcccaaccgtgcgccgtcaggtcaacgcggcctatgcacagatcactggcattgactccgcaaccgcaggagacatcctcaagacctatcaggacacctacgcggtatcgatcgaggacttcgccgacgaggtccgtgtctggctcgaccaacagcccgcgggctaccggttgaacttcttcgtcgatgaggtagggcagttcatcggctccaacacgcatctgatgctgaatcttcagacgatcgccgagtcgctgaacacgaagtgcggcggtcgggcctgggtgttcgtcacctcgcaggaggacatggacaaggtcgtcggagatcgcaccaagcagcagggcaacgacttctcgaagattcaggcccggttcaagacccgcgtcaagctcacctcggccgacgtggaagaagtcatccgcaagcgtctgctggagaagaacgacaaaggtactcaggtgctcgaagccgtctacgcgcaggagtcggcgaacttcaagaccctgttcgactttgtcgatggcgggaagacttaccgcaacttcaccgacgagaccaagttcatcggcacctacccgttcgtcacctaccagttcccgctgttccaggccgcgatcgagggcatctccgaccacaacgtctttgagggccgcaacagctcagtcggcgaacgttccatgctcggcgtcgtccagcaggtcgccaaagacatcggtgacgtggagatcggctcactggccaccttcgacgctatgttctccggcatccgcgcctcgctgaagtcggcggcgcagcgctcgatcgaccgtgcggagcgcgacctccccgacagcggctcaccggtcaccaagctcgcggtgcggctgctcaaagcgctgttcctggtcaagtacgtggagaacttccaggccacaccgcgcaacctgaccgtgctggtctacgaccgattcgggctcgacctgccggcgttgtccaagcaggttcaagaagcactcacgctgctggaaacgcagacgtacgtgcagcgcaacggcaacgtctacgagtacttgaccaatgaagagcaggtgatcgaggaagagatcaagaacgtcgagatcgactcctccgaggtctccacccggctcaacaggattctctccggcgatgtcgtcaagacctccaagctccgctataccaagaacgggcaggacttcccgttcgggtacaagctcgacgaccaggcattcggacagcagcgtgaactctcgctgcacttcatcactcccgagtatccgtatggacccgaagagattcggatgcactcggcgggcaaggacgagctccgggtgatcctcgctcctgacgaccgggtgctggccgacttgcggctgctgatcaagaccgagaaatacaccaagcgcaagcagaccagctcgctgtcgccggtcgaggaacagattctgcgcgccaaggcgacccacaacgcgcagcgggagaaggagctggtcgagcggatccgccgcgccgtcgggcgagccgatctcgtgatcaacgcagcagacctggcgccgggatcacaggacgcgctcatccggatcaccgacggattccaggacctcatctcacgcacctacacgcagctgagcctcctcggaggacgtacctacaccgagcagcaggtcgccggattcgcgaaccctgaccaatccacgctgttggacggctcctcgatccatgcactcgccgcgccgtccgacgaggtgctgtcgtacctgctgcagcgtgaccggctccgtgagcaggtcacggtcaagaagatcgtcgatcactttcaggccaagccttacggctgggatctggcctccatcgagtgcgtctcagcctggctcgtcggtacctcaaagatcaccctcaccgtcgactcaaacatcctcaaacgcagcgaagtcgcgaccacactctgcaagaccccgaagcactctcacgccgtcgtcgccccgcagaagaccttcgacccgcgcaaggtcacggtgctgcgcgccttctccacagacttcttcgatgagcccaccgcgccgaaggacccgctcgaactggctcgacacgccagcgagcgcctccgcgccaagtgcgaggagctcaaggcacgagtcagcggctcgaagtaccccttcgtgactcaactcgaaggtcccatcgcgctgctcgaatccgtcgtcggaaagcccgacgactggtacctgaccgacttcgccaccgccgatgatctgcttgacgcgaagaccgacgtcatcgatcccatccagatcttcctcggtggcgcgcagcgccagattttcgacgaggcagccgacctgttggccgccaacgcaagcaacctgaactacttgccctccggaagcagccaggaggtgtcgcgtctcctcgccgacccgcaagccttccgcggaaaccggatgaccaagctcaaagccgctgccgtcgagctccagtcgagcatcgacgatgcgctcgtggccaaccgcgacggagcgcttctggagatcgactcccgttgggcaccactccagaccagcacgatctatctgaaagccaccgacgaggcgcagcacagcgtgactcggaaggtcaacacgattctcgaccggatcggccgagagcgccagatcgctgtcgtccgcgagatcgcgaacaccttcgaggaacgcacctacccggccatgctcgaccagctcgctgtttctcatcgcagcagcgacgcggatggcagcggcgagcctgacccggcaccgatcaagaagcagaccgtctcggtcaagagcatcagccccaccggcatccatggcgtgctggaatccgaagaggacgtcgatcgctacctcgacgcactgcgcaaggcgctggtccgagccctcaacgacaacaagcgcatcgcgctgtag

SEQ ID NO: 86 - DNA, 3447 bp, Moorella thermoacetica
atgaagaaccgggatattttccagcgtgaccctgtggtttcaaaactgcttaatgacggcgtggctacagttactgaagcggccacatccaaagagattgaaacccttcgctatgaactggagcattttgtttgcgaggggcagtataaagacggacttatacgcattcttgagtcttacttgagcaatgcggatgctacaagccagccggcggtctgggtaagcggtttttttggcagcggtaaatcacatcttctgaagatgctccgtcacttatgggttaacaccaaatttgaatcggatggagcgactgcccgtgaactggcaaggctacctgtggaagtaaaagacctgttaaaagaattggatatattagggaaaagatgtggcgggctgcatgctgcggggggaacgctgccatccgggggaaggaaaagtcttcgtctggcagtgctcagcattatttttcgctcgaaaggtctgcccgaatctcttccccaagcacaattttgcctttggcttcaaaaaaatggcatctatactcgggttaaaaaggttgtggaagattcaggcaaggtttttcaacaggaactccgtcatttgtatgccagtccggtattagccagggccctgttggaggctgaccctgattttgcctccgatctcaaacaggtgcgggccaccatccaggcccagtttcctgacgtagacgacgtctcgacatccgaatttatccagatcatttgtgatgtcctttctgtaaacaggcaacttccctgcacggcgattgtactcgacgaagtccagctctttataggtgacagtacggctcgttcctatgaagtacaagaagtagcggaagccctttgcaagcagcttgatagccggatactgcttataggggctggccagactgctctgagcggcaatcttccgctgctccagcgcttgaaagatcgttttaccatacctgtggaactctctgatacggatgttgaaactgtaacccgccgggtggtgctggctaaaagggcagataagcgcaaggccatcgaagaaatattaactgcttacgctggtgaaattgatcgacagcttgccggtacccgcattgcacccagaagtgaagaccgggcgattatcgtcgaagactatccccttttacctgtccgccgccggttctgggagcatgtcctgcgagctgttgatattcctggaaccagtagccagctgcgcacgcagctccgtattgttcatgatgctgtccgggagattgctgaaaaacccctgggtacagtcgtgcccgctgatttcatatttgaccagctacagccggacttgcttcgcaccggggttcttttacgggaaatcgatgaaaccattcgcaatctggacgatgggactccggaaggtttattggccaggcgtatttgtgccctggtattcctcatccgcaaactcccccgtgaagccgtcgttgatattggtatccgtgctaccgcggagacgctggccgatcttctggtaagcgacctggccggcgatggtcccgccctgcgcagggagattccccgggttttagagaaactggttaaggaaggaaagcttatcaaggtggacgaggaatacagccttcagacccgggagagcagcgaatgggaccgggaatttcgtaaccggcaaacccggttgaacaatgatcttgcggctttggccagtaaacgttcggccctgttgaattcggcctgtatgaccgcccttggcaacattaaactcatccagggaaaggacaaagtgccgcgtaagttggcaattcactttggcagcgagccgcccgaaactaaaggccacgaaattccagtttgggtccgcgacggctggggagaaaacgagaataccgtggtggccgatgcccgggccgccggcaacgatagcccgattattttcgtctatatccccaaagcaaatgccgaggacctgcaaagaacaattattgaatatgaggcggctaaagcgaccctcgaattcaagggaacccctacaaatccagaggggcaggaagcccgcgacgcgatgtccacacgtatgaagacggccgaggctacccgggatgagattattaaagaggttattaatgccgccagggtgttccagggtgggggccaggagcgttttgagcattccatgaaagaaaaagtggaggcagccgccgaagcgtccctggaccgtctctttccccacttccgggatggtgatgatgatcaatggccggctgttatcaaccgggccaagagcggcgacgaagccgcccttcaggccataggctggaatgatgctcccgaaaaacaccctgtctgtgcggccattcttgctgaaatcggatccggtaagacaggcaaggaaatcagggatatctttatgaaaacaccttatggttgggggcaggatgctgtcgacgccgctttgattacgctttttgccaccgggcatcttcgcgctgtatataaaggggtccagcttgaccgtggccaattagatcaagctaaaatcccggctaccgacttccgggtggaaacggtaaccatagatgtccatagccgcatgaagctgcgcaagctttttcaaacagctggctttaactgcaaggcgggggaggaatcttccgtagccgggcaatttcttgccaagcttatggacctggccgatcgtgccggcggcgatccaccaatgcctgagcgcccatctaagacccatttggaaacaatgcggggactagctggtaacgaacaacttgcagcgatactggaacagtttgacaccctggcccaacaactgcagaattggtcagcattggcggacttggcggcaaagcgcagacctgcgtgggatagacttcagatcctgttgagacacgcccatggccttcctgaagcggaagatctacagagtcaggcccatgctgtgcgcgacgaacggcgcctgttagcagagcccgatccggttccggacatttaccaggcagtcgccagggtgcttcgtaccgctgtcaggcaggcttacgccaactttgaaatggtatataaccgggagaaagcggcactggaggcaaatgcgaactggcagaaactatctccggaacagcagcaaaaaattcttacggctgaagggattgccagcgttccccggctttccatagaagatgacgacgccttgcttcaaagcctccaggaaacccctctgtcaggctggaaaaccaggacagatgccctgccccagcagttcagtaatgcggccatggcagctgcgaagctactggagccaaaaacgcagaaggtaaaactgaccagcagcaccttgagaacgaaagacgaagtcagggcctgggtagccggagttgagagagagcttttagaaaggattaaaaacggccccgtcgtgatctcgtag

SEQ ID NO: 87 - DNA, 3516 bp, Parvularcula bermudensis
atggccgtcatgctacgagacattttcctgaagccggtcgaccggcccattgatggcgtcatcaaagcagatgatgaggcgagtctgcggaccgaactcgaagaatatgtgatcacgggtgaaatagcccagcgcgtcggtcacttcctcgatgcctacaacaattatgatacggctaatggcgtttggatctctggctttttcggctcgggcaaatcgcatctactgaagatgctggcgctgcttctcgaaaaccgggtggtcgagaacatccccgctttcgacatcttcgtcgagcaactgcgcgaagaccccatgctcgctggcgcgctcaggaaagcggtatcgatcccctcgcgatccatcttgttcaatatcgatcagaaagctgacgtcatctcaaaggcggacgtcgacgcgctcctgtcggtattccagaaagttttcgacgaaatgtgcggctattatggcaagcaaccgcatatcgctcagtttgaacgcgacctcgatagtcgcggagtgttcgacgccttcaaatcagcgtttgagaaacatagcggccgttcctgggagcgcgggcgcgagcaagcactcctcgaagctccaaatatcgctgttgcatttgctgatgcgaccggcggaagcgctgaggctgcaaaagatatattgtctcagtaccggaaggatactcgtgtctcgatcgaggacttcgccaattcagtcaaaacctggatcgacaagcaggggccaggcttccgattgaacttctttgttgacgaagtcggccagtatatcgccgacaacgtcaagctgatgacaaacctccaaacgatcgctgaaagtctgaacacgaagtgcaaggggcaagcctggatcattgtcaccgcccagcaggcgattacggaagtcgttggcgacatgagcgtgcagcaggagcacgacttctcgaaaattcaggcgcggttccgaaaccgcatgccgctcaactcggcggacgtagctgaagttatccaacgccgcctgcttgcgaagtcggaggatgcgcaagtgcgccttgggaccctgtttgcccgtgaagaaaacaatctcaaaacgctatttgagttttccgatggatcgtttcggttcaaacctttttcaggccgggaacatttcatcgcgagctatccttttccatcatatcagtacgacctgtttcagcgcgcgattacagggctttcccaacacaacgccttcgagggcaagcacagttccgtaggcgagcgctcgatgctcggcgtttttcaagaggtggccaagtcgctcgcgaagcatgagcttggcgatctcgcaaccttcgatctgatgttcgaggggattcggactgctctcaaatcagccgttcagcaatccatccagatagcggaacgcaatctggatgatccgttcgcggtgcgcgttctcaaggcgctgtttctcgtgaaatacgtcaaggagttcaagccgaccgttcgcaacgtcagtattctgatgttgcccgagtttgaggccgatcagaccgaattgcgccgcaaggtcgaggaggctctggcccttctagaacgcaacacgctcattcaacgaaacggtgaactctacgagtttctcacgaacgaggaaaaagatgtagaagccgaaatcaaatcactggacgtcgacccgaccgagctcaccaaagaattggaaacgctcgcattcgacggtgttatcaagcaccgcaagatccgccatcttgcaacaaacaatgagtactctttcagccgaaaactcgacgatcatcttctcggtcgagagtacgaactctcaatcaatatcgtctcccccttcggtgatgatatcgagtcgccagaggctgtcaggatgcgaagcctcagccgcgaagagttgtccgtccttctcaaaccggatgtccggtttatccgcgacctgacgctttacaagcagaccgacaaattcattcgccaggcgcggggcggaacgtcacagccaagccgggatcggatcatcgcggaaaagggcgagcaaaatgcacgcagactgagagaccttgagctgcgcttgcgaaagcacttctcagatgcgcggttctttgttcgcggcgacgagatcgatgttggcggtgaggatgcgcaagagcgggtggtcaaagcgttccagaccctggtggacaaggtctacgtgaacctgcccatgctgcgcggggtctcctacactgaggcggatatcgccaaagcggccagccctgacagtgcgctcttgggtgatgacgatggcggcggcatgtccgaggccgaactcgaagtcctcaactatgttcaatcccaggcgcgcaacgggatcaaagtctctgtcaaatatctcgtcgaaaggttcgccgagaaaccctatggctggccagcaacggcgacgctgtgtctggcggcgggtctgtccgggaaaggcaagatcgaggcccggtcggacggcacggtgctggagcgcgatgacctcgccaaggctctgcgcaattcacacatgctggcgaacatccttctgacgccacaggctgagtataccgctgcccaactgcgccaagcgaaagacctctaccgggagctgtttggaaagccggctgagggcgcggacgcgaggcgactgggcgcggaatgggccgaggccgttcgcgaactttcgaatgaacttgatcggctcatcaaccggcagcacgactatccgttcctcaccgcgctgacgccactcgcagccaaagtcgacgccatgcgggacaagcctgcgggctggtacgtaaccgaaccggccaaacaggaagacgacctcctcaacgccaaggaagacatcctcgacaaggttcgcagcttcatgtccggggcgcagaaggacatctatgacgaggcccgcgccttcttgcgagatcaggagggcaatcttggctatgccgacccggcgagcgtcaccgaaatccgtgaggttctcgacgcgccggactgctacaaaggcgccgcgatccagagcctgaaaacggacctctaccagctgaaggaagccgttgagctgcaacgcctcgacgagcgcaaaagcgcaagcgcagccattgaggattgccggtcgaaaattgaagcgctggaggactatgccagcctgtcggatggacagcgccaaaccatcagcgcccggatagagcggatggcagcgcggatcgacaacacgccgctcatcccggtgctgcgtgatcttggcgcgagcgtgcgcaaaacgctcctgccggagctgctgtccgaaatcgaccgcatgcgcgcgccgaaggggatgggtgagaaaccggcgaccgactgggagggcccaaacagcaatgccaatccaatgatcgacgtcacacaggtgaagatcactttcgccaagccctatctcaccgatgagagcgacgtcgatgcctatatcgacacgatgcgcgaacgcctgctggccgaaatccgttcgggcaagaaggtgatcgtgtga

SEQ ID NO: 88 - DNA, 3642 bp, Pectobacterium carotovorum
atgaatattgaacagatctttgagaaacgtctggaccgaaatattaatggcgttgtgaaagccgaacagacggacgatgccagtgcctggattgagcttgatgaatacgtcatcacccgggaactggaaggacatcttcgccatttcttcgaatcttatgttccggcaaccggtccggagcgcatacgcatggaaaacaaaattggcgtatgggtttcagggttctttggctcaggtaaatcacactttatcaagattctgtcgtatctattgtctaaccgcaaagtcagccataacggtacagaacgtaatgcatactccttctttgaagacaaaatcaaagatgctctgttcctcgctgatatcaacaaagcggtccatcatccgacggaagtgattctgttcaatattgattctcgcgctaacgtcgatgacaaagaagacgccatccttaaagtcttcctgaaggtgtttaacgaacgggttggctactgcgctgattttccgcacatcgcccatctggagcgtgagctggctaaacgcggccaatacgacgcgtttaagaccgcattttccactatcactggttcaagctgggaaaaagagcgcgattcctactatttcatcagcgatgaaatggcagaagccctaagccaggccacaggtcaaagcgttgacgcctcgcgtcaatgggtggaacagctggataagaatttcccattagatatcaataatttttgccagtgggtcaaagagtggctggatgaaaacggcaaaaacatcctcttcatggtggatgaggtcggccagttcatcggtaaaaatacgcagatgatgttgaagctacagactatcactgaaaacctgggtgtgatctgcggtggacgcgcatgggttattgttacctcccaggcagatatcaatgcggccattggtgggatgagcagccgcgatggacaagacttctctaaaatccagggccgcttttcaactcgcctgcagctttcaagctccaacacatccgaagttatccaaaaacgtttactggtgaaagccgatgctgcaaaacccgcgctggcgaaagtctggcaggaaaaaggcgacattctgcgcaaccagcttgcctttgatcctacaaccaccgcttctttgcgcccctacaccagcgaagaagaatttattgataactacccgtttgtcccgtggcactaccaaattctgcagaaggtttttgagtctattcggaccaaaggtgccgccggtaaacagttagccatgggtgaacgctcgcagttagaagcattccagactgcggcgcagcaaatcgccccgcaaggtctggattctctggtgccgttctggcgtttttatgccgcgattgagagcttcctggaaccggccgtcagccgcaccatcactcaggcctgtcagaatggcatccttgatgagttcgatggtaacttactgaaaacgctattcctgatccgctatgtcgatgtgctgaaaagtacactcgataatctggtcaccctttctatcgataaaatcgatgctgataaagtcgagctgcgccatcgtgttgaaaaaagcctgaatacactcgaacgcttaatgttgatcgcacgcgttgaagataaatacgtgttcttaactaacgaagaaaaagagatcgagaacgagatccgcaacgttgaagtcgatttctccgcgatcaacaaaaaactggcgtcgatcatctttgatgacattctgaaaaaccgcaaatatcgctacccagcgaacaagcaggacttcgatatcagccgtttcctgaacgggcacccgttagacggcgcaatgcttaatgatctggtggtaaaaattcttacccccaaagatccgacctatgatttttatgacaacgatgctgcgtgtcgcccttacacctcagagggcgatggctgcattttaattcgtttacctgccgatgcccgtacctggaccgacattgatttggtcgtccagactgaaaaattcctcagagacaatgcagggcaacggccggagcaggccagcctgctttcagaaaaagcccgcgagaacagtgttcgcgagaaaatgctccgtgtgcagctggaatcgctccttgccgaagcggacatctgggcgattggcgagcgcttaccgaagaaatcctcaacgccgtccagcattgtggatgaagcctgccgctacgtgattgaaaataccttcggcaagttgaaaaacttgcgtacgttcaatggtgacatctcccgcgagatccatgcactacttacggtggagaatgatacagaactggatctgggcgaactggaagaatccaatcccgaggcgatgcgtgaagtggaaacctgggtcagcatgaacattgagttcaataaaccggtctatttacgcgatcttctgaaccactttgcccgtcgtccttatggatggccggaagaagaagtgaagctgctggtagcccgtctggcgcgcaaaggcaaattcagctttagccagcaaaataacaacatcgagcgtaagcaggtgtgggaactgttcaataacagccgtcgccacagcgaactgcgcctgcacaaaattcgtcgtcacgacgaatcacaaattcgcaaagccgcacaaactatggcggagattgcccaacaaccgtttagcgaacgtgaagaaccggccctggttgaacatatccgccaggtcttcaatgactggaagcaagagctgaatgtcttcagagccaaagcggaaggtggaaacaatcctggcaaaaatgagattgagtcaggtctgcgcctgctgaattccattcttagcgaaaaagaagagtttgctctgattgagaaggtcaccacccaggcaaacgaattgctggatttcagcgaagatcgcgaagatttggtcgatttctaccgcaagcagttctccacctggcaaaagctgggggctgcgctgaacggaagctttaaatccaaccgcagcgcactggaaaaagacgccgtggcggtaaaagcgttaggtgagctggaaaacatctggcagatgccggagccttacaagcatctcaatcgcatcacgccgctgattgaacaggttcagaacgttaaccatcagttagttgaacagcaccgccagcacgccctggaacgtattgacgcccgcatcgaagagagtcgtcaacgcttgcaggaagcgcatgccacatcggagctgcaaaacagcgttctgctgccgatgcaaaaagccagaaagcgcgctgaggtcagccagtcgattccggaaattctggcggaacagcaagagacgaaagcgctgcaaacggatgctgagaagaagattaaccagtggattgacgagctgcgtaaaaagcaggaagcccagctacgagcagcgaatgaagctacacgcgctgcagaatcacagcagacctatgttgtggtagaaaaacccgttatccaaccggtaccgaaaaaaacacatctggtgaatgtcgccagcgagatgcgcaaagccaccggtggtgaagtgctggaaaccgccgagcaggtggaaaaagcgcttgataggcttcgctctgccctgctggcagccattgaggcaggtgaccggattcgtcttcagtaa

SEQ ID NO: 89 - DNA, 3579 bp, Pelobacter propionicus
atgcatatcaagaacatcttcgccaagaacctcttccgccccataaatggcgttgtcaaggctgaccagcaggatgaatcggtagtctggcaggagctggacgaatatgtcgtcaccagggagctggacaagcacttcgtcaagttttttgatgcctatctcagcgccatggataaccccaacgacccggctgttgccgctcgtatggcagtttgggtttccggcttctttggttccggtaaatcccactttctgaaaatcctttcctaccttcttggcaactaccaggcccacaattccgaaacaaatcagaaccggaaagcagtcgagtttttcgaagagaaaatcgccgatgccatgctgcaaggcgatatcaagcgggcagtcgcttccgatacggatgtaatccttttcaacattgacagcaaagccgacaacaaagacggcaaggatgccatcctttcagtattcctgcgggtcttcaacgagaagctgggatacagcggtgatgacccccatattgccagcatggaacggtatcttcagagtaaaggcgctctggagaaattccaccaggctttcaaggaagcttccggaaccgattggatcaaggaacgggatgcctactcattcagccgtgatgagattatcaaggctctttcaattgccctggaaatgggcatcgaatcggccagcatatggttcgatgaagcagaggaacgcttcaaaatcaatatcgaagggttctccaagctggtcaaggagtacctggacagcaagggaccgaagcaccgcattgtctttctggcagatgaagtcggccagttcatcggcagcgaaacccacctcatgttgaaccttcaaaccatcaccgaagacctcgggcgaatctgtaacggcagggcatgggtcatcgttacctctcaggaggatatagacgccattttgggagaggttcgcggatcaaaggccaacgacttttccaagattcagggtcgtttctatacgcgactttccctatccagcaccaacactgacgaagtaatccaggcccgacttctggaaaagaccggcgatgcccgtcgtgccctggaagaactctggcatcagaaaggcgacatcctcaagaaccagataagtttcacccacagcgccaccctgaagaactattccgatgcaaagaccttcgaggagaattacccctttgccccgtatcatttccagctggtgcagaagatatttgaatccatccgcaaggcaggagcaaccggcatgcatctcagccgtggtgaacgctccatgcttgatgccttccagtccgctgcaaaaagcgtttcagaacaggaaatcggtacgctagtaccgctctatgagttctaccccgccatcgaaagcttcctggataccatcgtcaagaagactatcgagcaggccgacgacaataccgggcttgaaccgttcgataccaagcttctccgggtactctttctgatccggtacgtggacatcctcaagccgaccgttgataaccttgtcaccctctgcatagacaaggtggatgccgaccgcctcaccatcaagcgccagatcgaagaaagtctgcaacgcctggagaaagaaaccctgattaccagcaacggcgatctctatttcttcctgaccaacgaggaacgggatgtttcccgagaaatcaagaacgtcgatatcgccagcagcgagcagaccaagcagcttgccgaactgatatttgaagaggtctacaagggtgacaacaagttccgctatcaggtaaacaagcgggactacggctacaaccgcatctgtgacgggcagttcttcggctccaatgccggacatgatctgaccattgaggtcatcaccccgctcaatgatgattatcaggcgttcaaccctgccaagtgcatcatgcagagcgccagcaccaacggcggttccgttgtcatcaaacttgaggacagcaaagagcttgggagggagttacggactctcctgcaaacagataaatacatccggctgaaaaatgatgccgcagcacccgacaatctcaagcgcatcctcaaggatcgtgcggaacagaaccgtgagcgcaagggccgcctgattgcgctgctggataccatgctgctggaatccgattactacgcatacggccagaccctgcaaatcaaggcatccacagccagaaatgctgtcaccgaggggataaactatctcgttgaaaatatcttttccaagcttggatatctcaaaatcatcaaggaagaaccgctcaaggaaatcactgccattctgaaaagcaacgacatcggccaatacagcctgcaggttgaaggtggggacgccaatgagcttgccgtcaaagaggtcaagcagttcatctacctctcaaccaccaacaaccagaaggttctgctgcatgaactggtagaacggtttgcccgcagaccctatggctggggggaatgggaaatcatcctgctggtagcgcgcctgttcatggcaggcgaccttaacctcatgtcagatggagcagcccttacgcccaaagaggcggttgaccctctcactaaacaggttaaatggaagcaggtcaccgtcctgaagcgcaaggctgttggggaagaagagctgaagaaggcccgtgccatcggcaaagacattttccacgtcatcggaccggacagcgaagaccagctcaaccagttcctgcgcgagaatatcaccgcatggcaggatagcctgaattcattcaagccccttgcacagagcggcagatatcccggcagcagtgagataaccaatgggctgaagcttatccagaagctgctgaatattcatgacagcttcgagttcttcgatgccttcaacaaggcaaaggatgacctgcttgacctgtcggatgacatgcaggagctgaacggcttttacaccacgcagaaaccgacctgggacaagctccagagcagtatggacggtgtgtttaaggccaaccggcaggagttggtaaaggatgcagatgcgaaaaagtctttactgcggatggatgaaatcctcaaggctccgcgtccttacgggatgataaaagacgtcgatggcctgataaatgcggtatcagccgttaatgccaagtgcgtggacaaagagcgtgtaatcctcttgagcaagctggaggagaaaatctcccttgttgcagaaaatcttgaggcatacaaggctactgcagacgttcgtaaccactcgctgaagccacttcaggatattaaaaaacaggtgcaggaagagcagtcaattccgaacatgcactatcagctcaataaggctgatgacgctgttgatagcgcaatggaggaaatggaaaaggctgttgaacaacctcctaagcctggagggggtggacctatttcgccaccggcaaaaccggtaaaaaatgtaaccgctgcaagctgttcatccaagtctttcctggagaccgaggcggatgtaaacgaatacctggaggctctaaaaaaagagctgatggcggcagtgcagaacagcatgcgagtgcgaatcaagtaa

SEQ ID NO: 90 - DNA, 3636 bp, Pelodictyon phaeoclathratiforme
atgcccaaaatcaaagagctgttgagtctcaacctcgatattgatatcaagaatgtcattgaccttgaagagcaggttgaagaggagattcgttacgagatcgacaactacattatcaccgaaaatattggccgtcacctctccacctttgcctcaaaatataactccagcatcaaggagactggcgtctggctctcaggtttttacggctccggcaaatcctattttggcaagatgcttggctacctgctcgacaacagggtaattatgggaacccaagccatagagcgcatcatcccgcgactctccgggctcaatgatgccgcccttatcgaaaacgacctgcgcaaattcgccagtagcaacaaccgggttatctctctcgacatcgccaaacagaacaccgacaaggggctgacctttaccctcttccgcaattttttgaaaagcctcggatttcttgactctgtgtacggctatattgagtatcagctctttcttgacggccactatccagcctttgtagagaaggtaaagctgctcacgggtgaagagtggcagagcattcgggcaagctccatgcgcgtcccctcaaccattcgcaaagtcttgaccgcatggaaatataccgaacaggagtacgacgaaaccgtcatccatctgaactcgatcattgacagcttcagcgcatcgaagctcaaggatgaactgagccgctacctcgaaaagcagcaaggcgaaacaatcgtctttatttttgacgaagcaagcgaagccatcagccagaaaaagtttactctgcttgaccttgaagggctaagcgaatcactctccgccatcgcctccagagtctggaccatcgccattgcccaggagaagctcgacgatgtgatcaacaacaacagtatcagcaagagtcagctcaccaaagtgactgatcgctttaaaaccaagattcaccttgaatcaactgaagtcgatgtcattatccgcagccgcctgctccagaaaagtgacgaagggcaacagttgctcaacacctttttcgaccagaacgcagggaaaattgccgacatcaccaacctcaaagcctccatcccgaccaagtcagagaacagggagctgttcaccatctactaccctttccaccactaccagttccagttgctgcagaattttctctttgcctccaacgccctgacggcctcgcaggtggctgcccgagggatgattatcaccaccttcgacgttcttcgcaacaagcttggcaagctcaatgcatacaattttgccaccgcctttgacatctgtgacgaagcgcagacggccccaaccgctgccctggtcaacaagtacgaccttgcccgccagatgctcaaagagtcagccattgacggcatccggctgctcaaggccatccactttctctcggtatcagagcttgttgcaactacggctgagaacatcaccaaagtctacatctctacagttgacgactactacagcgtaaagcccctgattgaagaggcgcttacaaccttgaccacggcaaaagtacttcttgagagcaacaactccttcaaaatcacttctgatctggagacaaagctcctcgatgaaatgaaggattttacggttgagcacttcaaacgcaaaaatgagctggtcgcccgattgcagaaaaacagctccatccgctcaatcggaaccatcagcgacaagagcgtcacctacaattttcatgttaccactgaccttggcgatgaacttatgggctcatcaaacaaggatctccagatagaggtgtgcagcctctacagcatcaccgaaaaccggctcgacttcatggagagcatcaaacagcagacccgcgacatcaagcacaaaatcacacttctccccgacaacgcacaattcagcaccatcagccacctgattgaggagatcctgcgattcgcctacatggacgacaagtacaaaaacgacagcgatgcaaccatcaagcaaatcatccgctcattctcggtcatccgggacgaacgggaaaaggatctccttaacctgatcaacagcgcctataccaacgccaaagcgatctacctcttcaatacggtgcagctcagtgaagccagtttcaagagtgaaataaacacccttcaaaaaaaggtgctcgataatgttttttacaaacgcccctccaggcagctctccgaagcgctggctacctcaattataaaggagcggcagaacgacaagctgccaaagttcaatttcagtgaaaacggcggcaacgactttacctttttcgactccaacggcaacttcgtgggcgacactcttgagtgcattgagtcggtaaccgccaaaatcaaaagccaatacctcagtggcaaagatcttgaactggagttaaagagcgcccccaccggctacgaatatggcacggtagctacccttgtggctgtactctttcgtaccggtcgcctcaccgccaggttcaacgccaaagatattttttcgtaccgcgacgatgttgtcgaaagcatcttcagctccagccggaacttccagaaagcctccttcaagtcactctccaaatcgctgacgaccgcccagaaatccgatatggtcaccctgcttcgagccctcaagatcgaagaggtgaccaaagagcgggttgactggaacagcaatgactttgcgctcattgaggccatccgtgccctctcggagtactacatcaacgccgtccggacgctgaaaaagaccgtaacggactttgaaccgctctttggcagcgaaaccacccttattggcaaactgcaccagttttccggcaaggtgactgagggcaactttcttgacacggctgacaacttcctactcaatcaggcggtgtttgaggcaacggtcaaaaaaatcgagaagattgaaaaattcatcaagtcgaacctgcaaaaagccagattcatcaagcgctttgttgatgagctgaaaatcgagcttgaaaaggccaacgtcaccagccgcgaaattcaggagaccattacacgctttgatgaaatctactcatcatccgtggttgaagggtatagggagattcttgttgaagggcagaagctcaaggacttttaccacaccctgatggttgatgccaatacaacggccagcgacgcaaaccgggagctgcttgccgtcgcaaccgcactcatcacagagatcaacagctatcccgaaacacagaaccgtgacctgttgcggcaggttcagttcgtcaaagagtatgctgaaaagcgcatcaatcaagaggtcaagctcgactacaccatcaagtgcgccagttcccacttttcactctcggagatgatcacctgcaccgcgcttgctccgcagaagcttgccgagctggaggttgccgcaatgagtattgtcaaggaagctcctcctgcccccgtaccggtggaagagagcaatagcggagaagtcatccccataccaccaccgaaagcattaaaacggatctcgctcaaaattgcccgcaccacaacggtcggggcattcaagcagatgcttcagctccagttacaacaggttgccggaatgcaggagagtgaccaaattgaaatagacctctaa

SEQ ID NO: 91 - DNA, 3609 bp, Polaromonas sp.
atgaaaatcagagacctttttctcaagccaatcgaccgccccatcaatggcgtcatcaaagccgaccaaatggacgccgccagcgtctggcaagagctggaagaatacgttgtcaccaagcagatcagcgactacctgcgccgcttctttgacgcctaccttgccgccattgaccgcccgcatgacgccgccatcaccgatcgcatgggagtctgggtttccggtttcttcggctcgggcaagtcccacttcatcaagatcctgtcctacctgctggaaaacatggaggccaccaatccccagaccggggaaaagcgccttgccagccagttctttgaccaccaaaagatcaaagacgccatgctgctcgccgacatccagcgtgcggtgcagggcacggccgatgtcattctgttcaacatcgacgccaaagccgacagcaagtccgatcgcgatgccatcctgcaagtctttctgcgggtcttcaatgaaaagctgggttactcgggcgactcacctcacattgccgacatggagcgccacctcgtcgccaagggtgcctacgacgccttcaaagcagcctttgcggcgtccaacggcagcacctgggaacaagagcgtgacgcggttgatttcctgcgtgacgacgtggttgccgcgctcgggcaggtcctgaagatgacgccagagtccgccagccaatggtttgaccgtgcccgcgacgacttccgcatcaacattgagggctttgccaaggtggtcaacgactaccttgcgacccgcgcggctaagcacaaggtcatctttctggtcgatgaggtgggccagttcatcggggccaatgcccagctcatgctcagcctgcagaccatcaccgagcagctgggcacccagtgcaagggccgtgcctgggtcatcgtcaccagccaggaagacatcgacgcagccatcggcgaagccaacaaagccaggtcgcaagatttttccaagattcaggggcgctttcatacccggctgtccctggccagcagcaacaccgatgaggtcataggggagcgcctgctcgctaaaacagaggccgctcatgtcctcctgcgtgatgactttgcgggcaggagcgatgtcatcaataatcaactcgggtttgccggcaattcggtcagcttgcgtggttataaagacacggccgagtttgtcgcttgctacccgtttgccccctaccagttcacgttactgcagaagatttttgagtccatccgcaaggtgggcgccactggcaaacacctctcgcggggagagcgttcgctgctcgatgccttccagtctgccgccacgcgcaatgccgaccacagcaccgatgtgctggtcccgctgtacgacttttacccgtcgatcgagagcttcattgacggggtggccaagcgctccattgatgaagctccgctcaaccccgcgctgcagccctatgacagcttgctcctcaaagcgatgttcctcatccgttatatccccgacatcgtcaagccaaacatcgacaacctagccaccctgtgcattgaccagatcgacgccgacaagctcgccctaaagcgcaagattcaggagagtctggcccgcctggagcagcagcgcctggtcagccgcaatggtgacttgtggttcttcctgaccaacgaagagcgcgatgtcgcacgcgaaattggccacgttgatgtctccgcatctgaaaagtcccggctgctcgccgagctgatttttgaggaaatcctgggcaaccaagcgaaggtacgtcaccagggcaccaaagccgactacgagttcaaccgcctgctcgatggcgctccttggcgtcaggccagtcatgccctgagctttgaagtgctgaccccgctgggtgatgagtacgacaagctccagcccgccaagtgcattttgcgcagcagcgagggagcagggcgcgccatcgtccgtctggccgagggtgaacgcctcgacatcgaactggcgctctacctgcaaatcgaaaaatacatcgtcagtcccaaggccgaccatgcgaccccgtcgctcaagcgaatcctggctgatcgaaaagacgaaaaccgcgaacgccggatgcgcttggtgcatcagctctcagatctcatgaccacgggcgacttttacgccctgggccagccggtagagttcaaggccggcagtcccgcgacggtgcttgaggcgctgctgaactacctcattaccaatacctacagtaagttgccttacctcaaggtacgtcaggccgacccaatagccgagatcaaggccgtgcttagcgctgatgacctgggccagcacgcgctggggctagacggtgatgcaggcaatgcgctcgccatcaaagagatgcgcgactacctgcagctggccgccagccaaaatcgggtgctgttgtctgatgtggtggaccgttttgccggcattccttggggctggaagcctgagtgggaaaccgtgttgctcatcgctcgtctgttcatggctggcgagatcaaactcatgctggaaggctctgaccttgatccccaatcggccgcagagcctctgaccaagtccgtccggttcaagcaggtctccatcctcaagcgaaaaacggcagacgccggcgccatcagacgcgcccgcgagctttacaaggacctgttcagcaagctcggccgcgaagaggaagacagcctggtggccgacttccgcgaccaattcactgaatggcaagctgacctcaagagctacgcccataccgccgccacgccccatcacccgggtagggccgacatcgataccgcgctgacccggatttcccagcaactcgcggttcgcgacagctttgcattcgtcgaggcgctgctggacgccaaagaagtctggctggatactgcggacgacatccacgacctggtccacttttacaaaacccaaatcaccgcctggcgcaaactgctcgatggcttgcgggctttcgcagacaaccgtgaagccctcgacaaggtgccgcaagccgccgctgcgctcgccgagctgacccagattcgcgacaatcccaagccctacgggcagatcaatcgcatcgaaccgctggtcgccgctgtcactgccgtcaacgagcagctcgcccaggcccgtcgcgaaaaggccctgctgtccatcgacgccaagattgccgaggtgcaagccaagctcgacgccgtgggtgccacgcccgagttgagcaataaagccctgcgcccgctgcaagacctcaagacccgcattgccagccagaccagcattgcccagatcctgtacctgcagggccagggcggcgacgcgatggacgacgcaatcgccctcatcgaagaggccatggcaaagctctctgcggccacgggtggcaccgcgaaacccgtgcaggcggtccagcctaatgtggccccgccggttgcaaaacccacccgcgtcgtccgcgccgcagaactctccagcaagacctatcttgaaactgaagctgacgtggacgcctttgtggtcaaactcagggccgagctgctggccgccattcactctggacaaatggcgcgggtgcaatag

SEQ ID NO: 92 - DNA, 3642 bp, Pseudomonas brassicacearum
atgacgatcaaaaaactcttcgaccccagcaagagcatcaatcgcagcattgaaaaggtcatcacctatggcgtgtcacaagaggcgcgcctgaaatcggaaatctcggaatacgtggttaccgacagcattgatcagcagtttgagaatctcctgctcaagatggaagccgccatggacattggtggcgaaaacgaagtcggcgtctgggtgtcgggcttctatggctcgggtaagagctcgttcaccaaatatctgggcctggcatttgacgatcgcatcaccattgatggcgttccattcatccagcacctccaagatcgcctcaaacgtcagcaaaccaagtccttgctttcgaacgtagccaagcgctttcctgccgcagtgctgatgttggacttggccagcgaacaggtcgcaggtgcgaccatggaagaagtgtcgacggtcctgttctacaaggtcctgcagtgggcaggttattcgcgcaatcttaaagttgcagcgctggaacgcaggctcaagaaggaaggtcgttacaacgaattcctggatgcattcaaagaagctgcgggcggtgaagactggaacaattaccgtaacgacgagttggtggtcgacagccttattcctgagattgcgcacaagctttatcccacacttttcaaaacgtccagttcgttcacgaccgaatcaagtgaaatcgtcgttttcgaaaacgaccgtgtgcgtgaaatgctggagattgcccgcgaggcgtcgggcaaggaatacatcatcttcattatcgatgaagtcggtcagtacgttggcccacggcccaatctgatcctgaacctcgatggattggcgaagaacctgaaaaacatcggcgacggcaaggtttggatcgtcggaacggcgcagcaaacgctcacggcggacgacgcgaaggcagctctcaactcgccagaattgttcaagcttaatgaccgcttcccgattcagatcgcccttgaatccaacgatatcaaggaaatttgctacacccgtctgttgggcaaatcgtcaccagcggaagccgaattgggcggattgtttgatcaatatggtcagcagctgcgccagaacaccaagcttgtcgatgcgcgagtctatggcgttgatttcgatcgcaagacttttgtcaatctctacccgttccttcccgcgcatttcgacatcctgctgcacttgctaggcgcactggccaagtccacgggtggcatcggcctgcgctcggcgatcaaggtggtgcaagatattctgattgacggctctgaaggcaaacctgccgtcgcagagcaagccgttggctggctcgccaccaccgtcacgctgtttgatgctctggataaagacatcaagcgcgccttcgcctctttgcacgcatcggtcgagaaagtcacaaagatccgcttcccgcattccgagttgcatcaaaacatcgccaaaacggtcgccgttctgcaaatccttggcaacctgccgatcacccgtcaaaacgtcaccagtctgatgcacgccagcatcgcaggggcgtctcaaggagacgctgtggccaaggcggtcgaagacctgatcaacgaccccatcgttccatttggcgaacaagacggcaacctttgcttcttcagtgaaaagctgaacgacattgaacaggaacgcagccaagttgcactgcgcggcgttgagttgcgtcgcatcgttaacgaagcgttgaccagcgtctatgcgccgttgccctccacccaactgcacggctcctatgccgtatccaccggacttaaggcgcaatcggcaggcaatgtgcccgcatcgttggcgggtgagcgtaaccagatccaaaccattgttgaattggtcgaccccaaagaaatcgacagcacacgcactcgagtcactgacgagtcgcgtcacaactcatccaagttcaacatctacctagtgggccgcacgacgccggaaatggacgaactgacggctgacatccaccgatgccgtgagatcgccaaccgctaccgcagcgatccagatcaggaaattcgcgaatattgcaacggccaggccgaccgggctgaacacctcagcaccaaactgcgggcacagatccagcgcagcctgttgcaaggctcgttcatcttccgtggccaggttgtcgcagtagatactctggcggcggagctgctggatgccgctcgcaaacacttgagcgaagtggccgagcaagtgttcgatcgctatgttgaggccccggtgcgcgccggaaccgaactcgctgaaaaattcctccgggtcggcaatttgtcgggcatcaccagcgctctcgatcctctgaaccttgtgcaaacccaaggcgggcggcacagcattcgcacggaccacttggcgatggtgagcatccgtgactacatcgatcgcaacggcacagtcgacggcaagcgcctcactgatgcctttgctgatgcgccttttggttggtcggctgacaccctgcgctatctggtggcggccatgctgctggcgggtgagatcaagctcaaggtggctggacgtgaggttaccgtcaatggccaacaagcaatcgacgccatcaaaaccaacaatacgttcaagatcattggcatttcgcttcgcggcggcgaccgtccgaccaacgaagtactggcacgcgctgcaacccggttaactgaattgactggcgataccgtcgtgccgctggaagacgacatcagcaaagtcaccaccaagctctttccgcaactgcagcaccaatacggccctctcactgaaaaactgcgcagcctgaacttgccaggtgtaaaccgcctgcaaaacctcacgcacgagattaacgatgtgctgctcaccgacgcttcggatgcgccgcgacgcctgggcaacgagcaatcagagctgtttgaaaatctcaaatgggctgccgaagtcaaactcaagttggagcaaggcctggagcaaacgctacgcgatcttcgccagcactgctcggccattgccaatctgccgaatgtggctttgctggccacactaaaagaagagttggctgaggccctcagccttatcgacgagcgcctgcagcaggccgacttctatcgttttgcggctgatttcagcaccagcctcaccaccattcgcgctcgcattcgcgatacggtgattgcgatgcaagatctgctcaaaacacgcatcaaagaggccgaggttgacctcaaacgggtgccggagtggatcaagctcacccagcaagagcagactgaactgttgggtagcctagagcgtttgattgtggaagtgacgcctgatttgttgggactcaattccattacaaacaagctctctgaactgcaggatgaagtgcaaggtttgaaacacagcattgagcgtcttggcacgaagcggattaaggaggagcttgaagctgagattcctgtaccaagtgctgtaaatgaaccgaaaccagccatcgcgcgcagtatcaaagcgcgcaccaagatcaccaccatggatgatctggatgcgctgatcacgcagctgcaacaactgcgtggcgagctgaagtatgcacatgccttcgccgtcaacctcgaactgcaggacgaataa

SEQ ID NO: 93 - DNA, 3567 bp, Pseudomonas stutzeri
atgactcttaagaccatttttcacaagccggttgaccgcccgattgaaggggtcatcaaagctgacgatgaggccagtcttcgcctcgaaattgaagaatatgttctgaccaacgaagtcgaaaagcgacttgagtcctttctagatgcctacaacaactatgaaggcgccaatggcgtttgggtttccggcttcttcgggtcaggtaaatcccacctgttgaagatgctggcgctcttgctcgaaaaccggcagatcgacggggcctcggctcttgacctgttcctgcccaagtgtggcgacaatgaaatcctgcgcggcgatctcaagcgagcggtcgccatcccgtcgaaaagcattctgttcaacattgaccagaaagcggacgtcatcagcaagactcagctcgatgcgctcctcgctgtcttcgtcaaggtctttgacgagatgtgcgggtactacggcaaacaagggcacatcgcccagtttgagcgcgacctcgacagtcgtggcctctatgaacagttcaagtcggcctatgaatccgcagcgggcagaacatggcaaaagggccgcgagcaggccctgcttgaagcgaaaaacattgccaaagcctatgcccaggcaaccggtggtgacgaggcatcggccatggggatactcgataaataccgcagccaataccgtgtctccatcgaagattttgccgaacaggtgcatgcatatatcgagcggcaatcgcccgatttccgcctgaacttctttgtcgatgaggtcggtcagtacatcgctgaaaacgtcaagctgatgaccaacctccagaccatcgccgagagcatggcaaccaaatgccgcggccgcgcatgggtcatcgtgaccgcccaggaggacatggggacggttgtcggcgagatgggcaaacagcaaggcaacgacttctcgaaaatccaggcccggttcgccaatcgcatgaagttgaccagcgccgacgtggcggaggttattcagaagcgtctgctcatgaaaaccgaagaaggcgtccgccttctgtcggacacttaccacgcgcagtccaacaacttcaagaccctgttcgactttgccgacggttcgcaaacctaccggaattatcaggatcgggatcacttcattcacagctatccgttcattccgtaccagttcgcgctgttccagtcggccattcagaatctgtcgcagcataacgcctttgagggcaaacacagctcggtgggcgaacgctccatgctgggtgtgttccagcaggtggcgatccagatcggggatcatgaaatcggtcagttggcgaccttcgacctgatgttcgaaggcattcgcaccgcgctgaaatccaatatccagcgggccatcatccaggcagagaaccatcttgatggtcccttcgcgatccggctgttgaaaacgctcttcctggtcaagtacgtcaaggaattcaagccgaccgttcgcaacctgtgcgtgctgatgctggacggcttcaatcaggacctgcccgcactgagaaaacgtgtcgaggaggccctgagcctactggaacagcagacctatgtgcagcgcaatggcgagctttacgaatacttgaccgacgaggaaaaagacgtcgagcaggaaatcaagaacaccgaggtggagtcggcagacgtggccgccgagcttgagaagatcgttttcgaccacgtcatcaagcatcggaagattcgttacgacgcctcttcatcaaaagatcagggccaggattatccgttctccagaaagctcgatgatcggctgcacgggcgcgagcacgagctggccatccatgtcatcagcccgttccatgagcacgcagaaaatgagccaatgctgcgcacaagctcaacttataagtctgatgaactgtttttgatcctgccagcggacgaacgcttgatccgcgacattctgatgtacaagcggacggagaaatacatccgccagaacatctcaatcacgcaacaagaggcggtcaaacgcatcctgacggacaagggtttccagaaccgggaacggtatgccgagctgcagcagcgcgtccagagcctgatgagcaaggccaagctgttcgtggcaggtgccgacatcgaaatcggttccgaggatgcgcagacccgggtgctgcgcggattccacgagctcatctcccgcgcctatccgaaccttcgcatgctgcgcggcatcagctacaaggaagagatgatcaaaaccatcctcagtaacaaggatggaactctgtttggaagtggcgccacctccctggccgaatccgagcaggagctgttggcgttcatccagagtaacaaccggggtggcgtgcgtaccacgctgaaaaacctgctggagaaattcgagcgcaaaccctacggctggtactacgccgccgtgctttgcacgctggccaacctgtgcgctcgcggcaaggtcgaggtccgcaccgacggcaacttgctggaagaggacgagctggaacgggcgttgcgcaactcccatggccacggcaatgtggtgctggagccccaggtcgaatttagcgcttcacaggtccgcaccctcaaggagttctttgaggacttcttcgatgctccgcccggagccggtgaggctaaagcactcggcaaggaaaccggcaccgcgctccaggaactcacgcatcagctcaccccgctgtcggcccaggcatcccaatatccgttcctgaacgcgctgacaccggtgcttgagaagctcaaggagctgaccggcaagccctacacctggtatctgaccgaactcacccgccaggaagatgcgctgctcgatatgaaagaaagcgtcatcgaccctgtccgcaagttcatgagcgggccgcagaaaggcatcttcgataacgcccgcaagttcgttcaaacccaagagcccaacttcgcctacatcgaaggcgatgaatccgctcaggtagtcgccagcttgaccgatccggagtgcttcaagggcaaccgcatgcagcaggtgaagatgcaagttgaaaccctgcaggagaaggtcacggcccagatcgaggccgagattgccaaggccaaggagacggtcgccgcccttaaagaccgcctctgcggcatgactgaattcggcgcactgaacggcgagcagcaggagcagatcacccgtccgttcaacgaattcaacgcggccattgagcgccagaaactgattgccgtcatccgcgacaccctgcgccggtttgaggaaagcgactaccagcggttgctttcgcagatgacatcctgggcgcaaccggcaccaacacccgagcctgcgccgaaacctggtcagaccgccacgccggacgaaggtacgaagcccacgtcaccggccaaaccggaaccgcgcattgagtacgtgcccagccgctcggtgaaggtctctttcgacaaagcttggctggccgacgagaccgacgtggaacgctacctggaatccatgcgcgaggcgctgctggatgaaatccgcaagggaaaaaggattcaaatctaa

SEQ ID NO: 94 - DNA, 3606 bp, Psychrobacter cryohalolentis
atgactgcccttaaaacaatatttcaaaaaccagtaaatcgtccaattgaaggtgtaattaaagctgatgatgaagccagcctacgcctagagttagaagagtatgtattaacagatgaagtagaaaatcgtctaatatcatttttcgatgcttacaatgactatcaggttgctaatggtgtctggctttctggattttttggttcgggaaaatctcacttattaaaaatgttggcgctattacttgagaatcgtcaaatagatagcacatcagcactggagttattcttacctaaatgtggtgacaatgatgtattgagctctggtatcaaaaacgcggttgcgattccctctaaaagcattttgtttaatattgatcaaaaagcagacgtcattagtaagacacaggttgatgctttattggcagtatttgttaaagtcttcgatgaaatgtgtggctactacggtaagcaaggtcatattgctcagtttgaacgtgatctcgatagtcgaaaactttatggtagcttcaaagaggcgtatgaatccatcgctaataagccttgggaaaaaggacgtgagcaggcaatacttgaagcaaagaatattgctcaagcttatagtcaggttactggagaagatcaggcactagctattggtattttagataaataccgtagtcagtatcatgtatcgattgaagattttgcttctcaagttgatgactatattgagcgtcagattaaagaacatggctacactgagtttcgtctaaacttctttgttgatgaggtggggcaatatatagctgaaaacgttaagcttatgaccaaccttcagacgatcgctgagagcttagcgaccaaatctcgtgggcgttcttggattattgtgaccgctcaagaagatatgggaactgttgttggtgagatgggcaagcaacaaagtaatgacttttcaaaaattcaagctcgctttgctaaccggatgaagctaaccagtgccaacgtagcagaggttattcaaaagcgacttctcgttaagactgatgaaggcgctcagttgttatcaggcatatatgataatcagtcaaacaatttcaaaacgctgtttgattttgctgatggatcacagacatatagaaattttaaagacaaagaacactttataaacagctatccattcatcccttaccagttcagcttgtttcagtctgcaattgctgatctatccttacataatgcttttgagggtaagcatagctcagttggtgagcgttcgatgttgggtgtgtttcaacaagtagcaataaaagtaggtgatcatgacataggtcagctagcaacttttgatttaatgtttgaaggtattcgtaccgcattgaagtccaacatccaacgagctgtcatcaatgcagaaacccatttagataacaaatttgcagtgcaggtattaaaagccttgtttttagtgaaatatgttgatggattcaaatcaacaattcgtaatatatgtgtcttaatgctgagtagctttggtgaggatgtagctatactccgtcagcgtgttgaagaggcgcttaatctactagaagacgagacctacgtacaacgtacaggagatatgtacgagtatttgacggacgaagaaaaagatattgaagaagagataaaaaatacggaagtagaagcagctgatgtggctagtgagcttgaaagcataatctttgatcaagtgattaaaagtcgcaagattcgttacagtagcggcgcatcaggtagccaaggacaagactattctttttcacgaaagcttgatgataagttatatggtcgtgaatacgagataggtatcaatgtcatcagcccattttatgagcatgctgaaaatgaagagatgatgtctaataaatctaacttttctagcgatgaattatttgtaatcttgccagccgattctcgcttgatgagtgatataacgatgtacaaacgtacagagaaatatgtcagacaaaattattctattgctcagcaagagacagtaaaacgtatcttaggcgagaaaggacaacaaaatactaagcgtcaggccgagttgctacagcgaataaaaagtctcatgagtcaggcaaaactactcgtagcaggtacggagctaaatgttagctcagaagacgctcaattacgtattgagaaaggcttcaatgagcttgtttctagatcataccctcatctacgtatgctacgcgatgcatcttacacagaggctgatgttgccaagattctcgactctacccaacaagacatgttgggtgccgatatatctacattagccgagccagagcgtgatgtattatcttttatccaaagaaatgctagtgcggctatacggacgacagtaaaagggttgttagaacagtttgaaaaaaaaccatacggatggtcatacgcagctgtgctcagcacccttgcaaagctatgtgtaaatggcaaagtcgaagttcgaatggatggcaacatattagaggacagtgagcttgcgcgcgctttagtaaatagtcaacgtcaaagcaacctggtattagagccccaagttgaattttcttcgtcacaagttcgtcatctcaaagagttttatgaagacttttttgctaagcctgctagtaataatgaggcaaaagcactaggcaatgaaacgattgatgcattcaaagagatgttacaagatttggagggttggtatgcacagtccgcacgatatcctttcttgagtgcattagatcccgctattcagcaaatcaaaaagctttcaaaatcatcctacgcatggtttttaactgaccttaacgaagatattgaagatgagcttctgaagatcaaagagcagctgatagatcctatttacaattttatgaatggttctcaaagagaaatatatgataacactcaaaatttcttgaaagatcaatcagcgaactttgattatatcgaaagagaacaggtgagggtgcttgaggccagtctaaacgatacctctatatataaaggcagtaagatccaacaggtcaaagtgctattaggcagcttgaaagacaaggtcaatgatgccctacaggaagctcgtagccaatcgattgaagcgcttaaacaaatgcagtcgcgtatgcaagagatggatgagtataaaaaacttccagatatcagacaggcagaacttgacgctccttatacacaactgattgataaggtgaatgaagagaagttgattgccgttattaatgatagattgcgatactttgaagacaagggctatgcaactttattgcagaaaatggtagtaatggcaacgcccaagccaccaccaacgcctgcaaaggtaagtactaacaacggtgataagagtgataaagaccaatcacaagtgtctgcgctatctgagcctaaacaggtgagtgagcctaaaaatgagtatatcaactcaaacaaaatcagggtggattacgatcgagcttggatagagaacgagaccgatgtagagcgttatctagaggcgatgagtgaggcactgctcagcgaaatacgtaaaggtaaaaggatctatatctaa

SEQ ID NO: 95 - DNA, 3507 bp, Rhodococcus erythropolis
atgaagctgaacgagatcttcgccaaggacgtccaacgcccgatcgaaggcgtcatcaaagcagatgacactgcacatctgggtatcgaggtcgacgagtacgtcctgaccaacgaggcggccaagggcctggaacttctgctcgaggcgtacacgaactacaccaacgccaatggcgtgtggatctcgggtttcttcgggtctggtaagtctcacttgctcaagatgctcgcccatttgctcggtgatgtggagggtcaggacttctcgcgtgagcaggtagcggcgagcttccgctccaaggcggagggcgggttcctgcccggctcgttaaccaaggcggagcgcatcccggccaagagcctgctgttcaatatcgatcagaaggcaaccgtgatttcgaaggatcagagcgatgccttgttgaaggtgttcgtcaaggttttcgacgaaagccgcggctactacggaaaccagggtcacgtcgcccgattcgaacgggacttggacaaccgaggtcagtacgagtcgttcaaatccacgtacgcgcggatcgcgggacgcgactggctgcagggccgtgaggagggtgtactcgaggagatcaatgtcgccaaggcgtacgccgagatcagcggtcagtccgagggaactccgtcgaacatccttaccaagtaccgcaatgagtactcggtgtcgatcgagaatttcgccgacgagatcaagacatggctcgatcgtcaggagccgggcttccggttgaatttctacgtcgacgaagtcggccagttcataggctcgaatacgcacttgatgctgaaccttcagacgatcgcggagtcgttgaataccaagtgtcagggccgggcgtgggtgttcgtcacctcgcaggaggacatggacaaaatcgtcggtgaccgcaccaaacagcagggcaatgacttctccaagattcaggcccgcttcgccactcgcgtcaagctcaccagtgcagacgtcgaggaagtcatccgtaagcggctgttggagaagaatgaggtgggcgagtccgccctgcaggcgatctacgctgccgagtcggccaacttcaagactctgttcgacttcgtcgacggtgcgaaaacttaccgtaactacaccgacgagatgcacttcgtcggtacatacccgttcgtcagttaccagttcccgctcttccaagcggcgatcgaaggtatctcggaccacaacgtgttcgagggccgcaacagctcggttggcgagcgctctatgctcggggtcgtccagcaggtcgccaaggatatcggcaatgtcgaggtggggcgcctcgcgacgtttgaccatatgttcgcgggcatccgcgcctcgttgaaatcttcggcgcagcgcgccattgaccgttcacagagggatctccccgatcctgaatcggatattacgaaacttgccgtgcgccttctcaaggcgatgttcctggtcaagtacgtcgagggcttccatgccaccccacgcaacctcactgtcctggtctacgacaggttcggactcgatcttcctgttctgtccaagcaggtccaggaggccctgacgttgttggagacgcagacgtatgtccagcgaaacggcaacgtctactcgtacctgaccaatgaagaacaggtcatcgaagaagagatcaagaacgtcgacatcgacgcttccgaagtcagcggtcgcctgtccaagatcctgtcgggcgatgtcattcgcacctacaaactgcgatacgccaaaaacgggcaggactttacattcggttacaaactcgacgaccaagtgcatggtccgcagcgcgagctgacagtgcacttcatcactccggagtacccgttcgagcccgaagagatccggatgcacagcgcgggcaaggacgagttgcgggttatcctcgagcccgacgaacgtgtcttaccggatgtgcggttgctgatcaagaccgaaaaatacaccaaacgcaagcagacgacgtcgctctcggcgatcgaggaccagattctgcgctcgaaagcgacgcacaacgtcgaacgcgagaaagagctggtcgagcgtatccgccgtgccatcggtaaggcggaactcgtcatcaatgccgctgatgtgacctccacgtcgcaggacgccgttgcccgtgtgaccgacggttttcagaacctcgtcagccgaacctatacccagctcaaactgctcggcggatccacttacagcgagcagcaagtcgccgcgttcgcgaatcccgatcagcagagtctgatcgacgatccattcctgtcgacgctctctgcccccggagacgaggtgctgtcgtacgtgctgcagcgcgaccgactcggtgagcaggtgaccgtgaaaacgatcgtggatgcgttccagtccaagccttacggctgggacgccacctcgatcgaggtggtcactgcctggcttgtgggcacctcgaaggtcaccatcatcgtcgacggcaacgccctcaaacgcgccgaagtcgctgcagtgctgcgtaacacacacaaacgctcgcatgcagtagtcgccccgcagaagattttcgacgagcgcaaggtcacggatttccgcaagttctgtaccgacttcttcgacgaggcaatcgcaccgaaagacccgctggagctggcccggcacggcagcgacaagttgcgcgcaaagttctacgagctgaatgcacgaatggatgggtcgaagtatccgttcgtggagcagttgtcggccccgatcgcactactcgaacaatcagtaaacaagccggatgagtggtacctaaccgaattcgcgcttggtgacgagctactcgacgccaaagaatccgtgatcgacccgattcagtcattcctcagcggtggtcagcatgaaatctacgacaccgcagtcgccttgctcactgcgaacgcgaacaatctcagttacctacctgatggcagcgacagcgatgttaaacgtctgctcgacgaccccaacggcttccgtggtaatcgtatgactcagctcaagcaagccgcgggagctctcggccgacagatcgatgaagccctcgcagcgaaccgtgcgacggtcatcgagagtatcggtggccggaaatccaaggttctcggcagcagctattacgagaattcctcagaagacgcacgccagcgggccgtgtatgagatcgatcaaatcgtcgaccgtgtccagcaggaaacgcagatcgctctagtccgtgaggtgggaaacaccttcgaagagaagacctatcccgcactactcgatcaactcgcatcctctacacgcccaacaggcggagaaaatgatcccgagcctgcacctgccaaacagaccgtctcggtcaagacgatcacggcactcggcgttcaaggcgttctcgagacctctgcagatatcgacaattatcttgacgcactccgtatcgctctggtgtccacgctcaacgatggaaagcgaatcgcactctga

SEQ ID NO: 96 - DNA, 3534 bp, Rhodopseudomonas palustris
atggctggcgagatcgcatcgctgttcgcaagcgacatcactcggcagatcgaggaggtcatcaaggtcgaccagacctcggccgacatcatcgcatccgaaatcgacgaatacgtcgtcaccgacgcgatcaagaagcactatgtgcacgtcctggagcgataccaggagacccgtctcaagcctcacgaaggcggggcgatctggatctccggcttcttcggttccggtaaatcgagcttcgccaaggtgctgggcctcgcgatcgaagatcgcgacatcctcggaacgtccgctgcgaacaggttcgccgcgcgcgccggcgacccgaagctcgccgtggtcctcaagaccatcaacgagcagatcccgacgcacaccgtcatcttcgacgtctcgaccgacagaggcatccggtccggcaatcagatgctgaccgagatcatgtatcgcctgttcctgagtagcctcggctacgccaaggagatcgatccggcggaactggagatcgcgctcgaaggagaggggcgcctcgataagttcaaggaggtgttccaggagcttaacgggaaatcctgggatacccagaagaacctgccgatcttcgccctcaaccaggcgagcgccgtgctgcacaagctcgagccggccacctatccgatggcggattcgtggtcgaaaggccgaccgaagatcgacattaccccggggcgtctggccgaccgtatcgtggagttgatgaaccgccgcaagcctgggcaggcgctcatcttcgtcgtcgacgaagtcggtcagttcgtggccagagatacccagaagatgctcgacctgcaggccatcgtgcagcagctcggcgtcaagggccgcggcaagtattggatcgcggtcacctcgcaggaacgcctgagcgaagtcgtcagcggtctcgacaaccaccggatcgagcttccgaaactgatggaccgctttcccctccaggtgcacctggagccgtcggacatctcggaagtcaccagccggcgcgtgctcgcgaagaacgcggtggccgagacggtgctcggcaagctctacgacgacaaccgcgcccgcctggatctcaattccaagatcaccgccgacgtctcgctgccgaccctgtcgcgcgagcggttcgtcgatctctatccgcttctgccctatcagatcgacctgatcatcgacgtcgtctccggcctgcgcatgcagggcggcgcgagcaagcacgtcggcggcgccaaccggaccatcatcaagctcgcgcagcagcttctgatcaatcccgcgaccaagatcgccgaggccccgatcggagcgctggtgcgcctcgatcaggtctacgatctggtcgaaggcaacatcaattccgacatccgcgccaagatcatctccattcccggcaaggtcgagcacccgctggctcaggccgtggcgaaggtcgtctgcctgctgcagttcgtccggaccgtccatcgaacgccggaaaacatcgcggccgcgctggtcgaccgcgtcgacgccgattccaggttgaccgaagtccacgaggccttggccaagctagaaagcgcccacatggtccgccagggcgacggcggataccggatcccgaccccggccgaagacgactgggatcaggcgcgggcctcgatcgaccccaagcgcgccgatgaacgccgcctctacgcgtcggtgctgaccggcttctgggcgccgcagcccggcttcacgctgggcgacgccaagaccttcaaggccggcctcatggtcggcggcaacgaggagatgagcggcgacgtctccttccatctcgatctcgcggaaaacgcggagcaggcggccgtagaggcggagaacctgcggcgacgcagccagatggaccagaaggacgtgttctggagcgtggcgctcgatcaggacatcaggcgcgagatgcgcgaagccttccgttccgacgagatgatcaagcgcaaggggcggggggccccgactgcagacgagaccgcgctcatcgccgaggagaaggtccggcagcgcaatcacatgcaggagctcggccgtcgtctaaaggctgcgtgcctgtccggcaaggtgttcttccgcggcaacgaccgcagccccgccggcacggcaaccgaagtcgggaaggccgtgacgggcgtgctcgaacaggtgctccccgacgtctacaaccgcttcgcggaggcctcggccaagaaggccgaggtcacgaagggcgtcgacgcccttctcaccgccgagaacctcgcgggtctgccggcggtattctcgcatctggagctgatgcgcgacgaacagaacaagcgcgtcttccggaccgacgtcgtgccgttgtccgagattctcaccaagatcgaagagcgggcggcctacggcgagcaggtcaccggcaaatacctggaggacgaattcctgaagccgcccttcggctgggatttcgacgtcatgcggcttttgacgctgtcgctgctgcgtgcgggcaagatcgaggcgacgtccaaggggcaagtgatcgaccaggcgacgaccacggccgccaaggattgcttctccggcaacaacacgttccgggcggcgagcttccggccgaagaagggcatcgatttcgccgtgctggcccaagcttccgagaactaccgggacacgttcggcgacgaggtgaaggagctcgccgccggccccatcgcagccgaaatccgggcggcggtggaacggcaagaagaaggactggacgccgtgctcggtacgatgcggtcggcccagcttccgggcatcgacgtgctcgacggtgccgtgaaccagatgcgggccatccgccgcagcaacgaagagaacgccatcctgactttcaacgcctcccacaagagcctgaaggatgcgatcaagcgcggttcggacctggccggcgccctcaacgagtccgcattgaaggcgatcgccgacgcccgagaggctgcgaagctcgttccggtccttgaagaggagccggacctcgatgccgcctttcccgagcaagccaaggtcctgagcgacctgttgagcaaggaaaccttctatcgcgagatcggacccatttcgaaagcggcgacctcgatcaagaccgagtacaaacggcgctacgaggaggcactcgacgcccgcgtgaaggcctatctcgacgccctcgaagtgctgaccaagacgccgggttgggaacgtctcgacgaggcgcagcgcgacgaactctctggtcacctccggaagtgcgccgacaagaactggaacaaccagaccatccgccacctcagatcggaagcggaattggcggagagccgcctggccgccgcaatcgccaagatgcatcagattcttgacggcgaacgcctcgcgaccgtgtcggtcggtcagttcttctccggcggcatcgagaccgaggagcagctggaccaggcactgggcggcatcagggacgagtttgcgcgcctcatcggcgaaggcaagaaggtgatcgtcaggtga

SEQ ID NO: 97 - DNA, 3438 bp, Saccharophagus degradans
atgattaaccaggatatttatttaaccagcccatctagccgtaaattggttaacgaaggtgttgccagcgttaatgatgataaaacccaagaagcactgaatgtgctcaggtacgaactggaaaccttcgtctgcgatggccagtacgaaaaaggcatcgaagatattttagatacctaccttaagaatgttgatcaagcccagcagccagcggtttggatcagcggcttctatggttcgggtaaatcgcacctggttaaaatgctacgcgccttatggacggatatgaccttccccgatggcgccagttcgcgcggcattgccaagctgccgcaaaacgtcaaagacctattgtccgagcttactacccagggcaaacgccacggtggtttgcacgccgcctcgggtaccttgggcgctggtgccagcggcagtgttcggttggcgctgctgcgcattgtgtttaagtcggtggggctgccagagcaatatcccgttgcccgtttcgttatgtggctcaagtcggaaggcatctacgagcaagtccaacagcacgtcgagaacaatggccacgattggaatgaagagcttgataacttctacgttgcagaaggcttacatgaggctctgtgtgtggtaaagcccaacctgttctcgtcaccggtttcctgtgtggaaactctgaacaacctgtacccctatgtgcaggatgtcagctccgatgacatgatcaaaaccatcaaggcggccttgtcgaacaatggcaagtttccgctgacactcatcgtgctcgacgaggttcagcagtacatcggtgaagacagccagcgctccatcgatgtgcaagaagcggtagaagcttgctgtaaaaacattggcggcaaactgctgtttatcggtaccggtcaaaccgctgtaacgggtacatctaacctcaaaaaactggaaggccgttttaccgtccgtattgagctttcggatgccgatgtggacgcggttatccgccaggtgatcttggcgaaaaaggcggaatcgctacccaaaattgaacagaccttgcagcaaaacctgggcgagatttcccgccacttagcagagtccaaaattggtcatcgacaggatgacattcagttcttcgcccaagactatcccatcctgccggtacgccgccgcttctgggaaaacaccctgcgtgtactcgaccaaaccggtaccgacagccaactacgtaaccagctgagcatgatccacaagtgcatccaatctaacctggataaaccgctgggcagtgtgatccctgctgattacctctacttcgacggggccgataagctcctgcaatcacgtgtgctgccgcgcaaagtacacgaaaaaaccttcagctggatgaaaggcaacgacgagcagaaactcttagcccgagcctgtggcctcgcctttttggttggtaaactgcaatccgagaacaaagagatcggcatcaaagccaacctggaaaccctggctgacttgatggttgaggatttaaaccaaagcagttcggcactgcgcactaaactggcgggcctgttggataactgcgaattgctgatgaaagtcggcgatgaataccgcattcaaacagaggaaagccaagcctggaacgatgcttacttgcgtcaccgcaatacccttgccaacgaagcgcaccgtttggagaccgaacgtaccgaccgcatccgtaaaaagttcgccgagcgggtgaagaagttttctgttaaccatgggcagtccaacgtgccgcgagccttgtcagcactgtttgatgcctcactgcccgccgatgccgatagcaaaatctatgtgtgggtgcgtgacggttggagtatcgacgaaaactcggtgcgtgtggatgcccgccaggccggcaatacagcttccactatttatgtgcatatccccaagcgctcggcagacgacctgcgtcatcacctgatcgacctcaaggccgccatcgccaccttagaagaaaaaggctcgcccgataccccagaaggcaaggaagcccgagccgccatgcaaacggctcaggcaatggccgaatccaaggtgaatgacctgctagctgacatcctcgatggtgtccgtgtcttccaggccggcggtaatgaagtgctgggcaacgacctgcaagagatgattttagaagcggctgagaattcgctcacccgcctgtatccgcaattccatgtcgctgaccacaccggttggagcaaggtttacgacaaagccaaagccggtgcttcagacgcgctgaaagccgtaggtgacgacggtgaacccgccaagaaccccgtgtgtaaagccgtgattaacttcttggccggtggcaaaaaaggcgccgatattcgtacacaatttgaaggtgcgccctacggttggccaggtgacgccgtggatggtgctttgcaagtattggtggtggcaggtgtggtgcgtgcccaaaccgatcgcggccagaacattgagccgcgcgagctggagcgtaaaaaaattggcctgagtttttttaaattagaaactgccgtagtcaccacgccgcagcgcatccaaatccgcaaattgctgcagcaagtgggctgccaagccaaacaaaatgaagagctggcggtattgccagagtttctacaaaaactgagtcagctggcggaaaacgctggtggcgatgcgccacgccctgccaagcccaacactagccacctggacgatattcgtcgtgcagccggtaatgagcagctactcgccatttacaacctgcgcgatgaactcaagcagcaaattgatgattggcaggcattgagtgccagcattcaacaacgcctaccggcctggcaaagcctgcaagtcttcgctaaccacgccaaatcactcgatggcgccgaggtgctgcaaacccaggttgatcaaattaaagaacaacgtttattgctggccgagcccgacctcatggcgccactcatggccagctacacccagttactgcgcgatgagctaaacaccctgcaacaggcctatgacgacgcccatgccaaaggcatgcagcgcctgaacgaagacagcaactggcagcagctggaacaagagcaaaagcaccagttcttggccgagcaaaagctcaccgcaaccgacaagcccgaaatcgccgtcggctctagcgacgatattcaaaagacgctgcaacgcatcagcattggcatgctggctgaacgcattgccgccatgccaagccgctttgatgccatctctatcaaagccgccgaagagatggagccgaaagcgcagtttattcgcactccacgccgcaccctgaaaaccgaggccgaaatcaccgcctggttagacgaggtagaacagcaactcaaaaccgccttggccgaagggccaatcgtgttgcaataa

SEQ ID NO: 98 - DNA, 3642 bp, Salmonella enterica; identical to SEQ ID NO: 8

SEQ ID NO: 99 - DNA, 3642 bp, Salmonella enterica
atgaatattgaacagatctttgagaaacgtctggaccgaaatattaatggcgttgtgaaagccgaacagacggacgatgccagtgcctggattgagcttgatgaatacgtcatcacccgggaactggaagggcatcttcgccacttctttgaatcttatgttccggcaaccggtccggatcgcatacgcatggaaaacaaaattggcgtatgggtgtcagggttctttggctcaggtaaatcacactttatcaagattctgtcgtatctgttgtctaaccgcaaagtcagccataacggtacagaacgtcatgcttactccttctttgaagacaaaatcaaagatgctctgttcctcgctgatatcaacaaagcggtccatcatccgacggaagtgattctgttcaatattgattctcgtgctaacgtcgatgacaaagaagacgccatccttaaagtcttcctgaaggtatttaacgaacgggttggctactgtgctgattttccgcacatcgcccatctggagcgtgagctggctaaacgcggccaatacgacgcgtttaagaccgcattcgccactatcactgactcaagctgggaaaaagagcgcgattcctactatttcatcagcgatgaaatggcagaagccctaagccaggccaccggtcaaagcgttgacgcttcgcgtcaatgggtggaacagctggataagaatttcccattagatatcaataatttttgccagtgggtcaaagagtggctggatgaaaacggcaaaaatatcctcttcatggtggatgaagtcggccagttcatcggtaaaaatacgcagatgatgttgaagctgcagactatcactgaaaatctgggtgttatctgtggtggacgcgcatgggttattgttacttcccaggcggatattaatgcggccattggtgggatgagcagccgtgacggacaagatttctctaaaattcaaggccgtttctctacccgtttgcagctttcaagctccaacacctccgaagttatccaaaaacgtttgctggtgaaaaccgatgccgcaaaacccgcgctggcgaaagtctggcaggaaaaaggcgacattctacgtaaccagcttgcttttgatcccacaaccaccgcttctttgcgcccctacaccagcgaagaagaatttattgataactacccgtttgtcccgtggcactaccagattctgcagaaggtttttgagtctatccggaccaaaggtgccgccggtaaacagttagccatgggtgaacgctcacagttagaagccttccagactgcggcacagcagatctccccgcagggtctggattctctggttcccttctggcgtttttatgccgcgattgaaagcttcctggagccggccgtcagccgcaccatcactcaggcctgccagaatggcattcttgatgagttcgatggcaacttactgaaaacactgttcctgatccgctacgtcgatgtgctgaaaagtacattagataacctggttaccctttcgatagacaaaatcgataccgataaagtcgaactacgccgtcgcgttgaaaaaagcctgaataagctggaacgagaaatgttgattgcacgtgttgaagacaaatacgtgtttctgaccaacgaagaaaaagagatcgagaacgagatccgtaacgtcgaagtcgacttctccgcgatcaacaagaaactggcctcgatcatctttgatgacattctgaaaaaccggaagtatcgctatccggcaaataagcaggactttgatatcagccgcttcctgaacgggcacccgttagacggcgcaatgcttaacgatctggtggtaaagatcctcacgccaaaagatccgacctatgatttctatgacaacgacgcggcatgccgcccatacacctctgagggagacggctgcattttaattcgtttacctgccgatgcccggacctggaccgatattgatttggtcgtccaaacggaaaaattcctcagggacaacgcaggtcagcgaccggaacaagccagtctgctttcagaaaaagcccgtgagaacagcgttcgcgagaaaatgctccgcgttcagctggagtcgcttattgccgaagctgacgtctgggcgattggcgagcgcttaccgaagaaatcttcgacgccatccagcatcgtggatgaagcttgccgctatgtgattgaaaacacgtttgccaagctgaaaatgctgcgcccgttcaacggtgatatcgcacgtgaaatccatgcactactcacggtggagaatgatgcggagctggatctgggcgaactggaggaacccaaccccgacgcgatgcgcgaagtagaaacctgggtcagcatgaatatcgagttcaataagccggtttatttacgcgatattctgaaccactttgcccgccgtccttatggatggccggaagaagaagtgaagctgctggttgcccgtctggcgcgcaaaggcaaattcagcttcagccagcagaataacaatatcgagcgtaagcaggtgtgggagctgtttaataacagccgtcgccacagcgagctgcgtctgcacaaaattcgccgtcacgacgaatcgcaaattcgtaaggccgcacaaactatggcggaaattgcccaacagccgtttagcgaacgtgaagaaccggccctggttgaacatatccgccaggtcttcaatgactggaagcaagagctgaatgtcttcaaagcgaaagcggaaggtggaaacaatccaggtaaagatgagattgagtcaggcctgcgcctgctgaattccattctgagtgaaaaagaagattttgccctgattgagaaggtcaccagccaggtcaatgagcttctggatttcagtgaagatcgtgaaaatttggtcgatttctaccgcaagcagtttgctacctggcaaaaactaggcgcggcgctgaacggcagctttaaatccaaccgcagcgcgctggaaaaagacgccgtggcggtaaaagcactgggcgagctggaaaacatctggcagatgccggaaccttataagcatctcaatcgcatcacaccactgattgaacaggtccagaacgtcaatcatcagttagtggaacagcaccgccagcacgcccttgaacgcattgacgcccgcattgaggaaagccgtcaacgcttgcaggaagcgcatgccacgtcagagctgcaaaacagcgttctgctgccgatgcaaaaagccagaaaacgtgccgaggtcagccagtcaattccggaaattctggcggaacagcaagaaacaatggcactgcaaacggatgccgagaagaagattaaccagtggatcgacgagctgcgtaaaaagcaggaagcccagttacgagcagcgaatgaagctaaacgcgcggccgagtcacaacagacttatgttgtggtagagaaacccgttatccaaccggtaccgaaaaaaacgcatctggtgaatgtcgccagcgagatgcgcaaagccaccggtggcgaagtgctggaaaccgccgaacaggtggaaaaagcgctggatacgcttcgtacttcgctgctggcagctattgaggcaggtgaccggattcgtcttcagtaa

SEQ ID NO: 100 - DNA, 3642 bp, Salmonella enterica; identical to SEQ ID NO: 8

SEQ ID NO: 101 - DNA, 3642 bp, Salmonella enterica; identical to SEQ ID NO: 8

SEQ ID NO: 102 - DNA, 3642 bp, Salmonella enterica; identical to SEQ ID NO: 8

SEQ ID NO: 103 - DNA, 3642 bp, Salmonella enterica; identical to SEQ ID NO: 8

SEQ ID NO: 104 - DNA, 3642 bp, Salmonella enterica; identical to SEQ ID NO: 8

SEQ ID NO: 105 - DNA, 3543 bp, Selenomonas sputigena
atgatgataaaaaacatgttcgccgaggacattgaccgcaaaatcaacggcgtagtcaaagttgagcaggatgaaagcgccattctcgtgcaggaactggatgaatatgtcatcacgaaggaactgaaaaagcactttatcgcttttttcaataactacggcgagtcctttgaagaaaatatctccgatattggcgtgtggatttccggcttctttggcagcggtaaatcccactttttgaaaatgctctcctatctcctggagaacaaagaagtgcagggcgtaaagaccgtggagcgtttccgtaagaaatttgaggacgacgccgccgcgttcatgccgattgacaaggtcacccgtggagaaacgcacaccattctcttcaatattgacgtgcaaagttccggacaaaaggacgaaacggctgttcttcgtgtatttgccaagatgttttatcactatctgggcttttacggtgaagatttgaaggtcgcaaaattggagcagtttatcgaaaaacaaggcaagaccgccgagttccgtcgggtattcgaggaaaagaacggcgcatcgtggctgtcctcccgtgattcctttgcgttctttgaggacgatgtggtcagcactctgacgcaagtcctcggcatgagtgagagtgccgctgaaaactggtttaacggcacacagaccgtggacatctccattgccaagctggtatccgagatcaaggaatattcggatgccaagcctcaggattttcggctgctctttatgattgatgaagtggggcagtatgttggcgatgacagaagtttgcttctcaatcttcagtcgctggtggaaacgatcggagctgagtgcaaaggaaaagtttgggtggtctgcaccgggcaggaagccatcgacgaggtcatcaaggcgcgggaaaatgagttctcccgcattcaggcgcgattcaagacgcgtctctccctctcctcagcctcggcggatgaggtgattcagaagcgtatcttgaagaaaacgccggacgcccaagaggagctggaatctctctatacgcaaaacgactccgtgctgaaaaacctcttcagcttcacggagtcggtgaaagatattcgcggctacaacggcgccgccgaatttgcccggaatttccccttcgtcccctatcagttcatcctcatgcagaaggtctttgccgaaatccgcaagcacggcaattccggcaaacatctctcgggcggcgaacgttccatgctctcgggctttcaggaggcggcgcagaaaatcgaagacaagaacgagtatgcccttgcgcctttctatcttttctatgacacagtgcataccttccttgacagttccattcgccaggtcatcgagcgggcagaacgggcagccgaggcaggacatggcctggaaatgcaggatgtggctgtgctgaaactcctctacctcgtgcgctatgtggacgatgtgaaagcgaccctcgacaatcttgttatccttatggcggataagatcagcctcgataaaatcgccgtgcgggagcgagtgggcgcgtcccttgagcggctcctcacgcagaactacatcggtcgcgcaggggaaatctatagcttcctcaccgacgaggaacaggatattcagcgcgacatttaccgcaataccgtcgtggataccgccgccgtcgtgtcccaaatcggcagcatgatttttggcgatatttatacagccaggaaatatcgctatggcggcaaatatgattttccccttgacgggatggtggataacactgtcgtaggcacagcgacgggcggcatgaaactcaaaatcctcaccgtagctgcagatgccgtcgaaaaaacagacctgcgtcttactgccgaatccgttgggcaggctttggtcgttctcgccgacacaccttactatcaatcccttgaaaacgccatgaaggtgcataagtacgtcaagcagaaaaatatgacgcagcttcctccgtcggtgcaggccatcatccgaagccatcaggaagaggcgcgaaagtacgagttggaagcaaaaaaagaactcgtcaaagccatagaaacggcggagttttatgtagacggagaacatctgctgctgaaaggcggcgatgccaaggggatgatcgaccaggcgctggagtatctcgtcgaccatgtctacagcgatctttctctgattcgtaaaaatgcggacagcgaggcggatatttcctccatcctgcgcggtacggagcagaccctcttcggcacgggagcgaacagcgaagccgctgtcaaggtggaggaatatctggagatacagcacgccaaaaaactgcgcacctcgatgcaggacatccagagtcgctataaggggattccctacggttggaaggaattggacatcgcctgtgtggtggcgcagctcatccacgagcagaaggtcaccgtgaaatatggcggcagtaccatccagccgaatgatccgaaactccctcagatgcttcataagaagagtgagatcggcagcactatcgtttcgaagcgccagacggtatctcttgccaaaatccgcgaagtccgagagttcctgcgcgattacttcgatgagatggacgtgcccgaggacgaggatgggctgatccgccacatcacagtccgattcgagggggaaaaggcgcggtatgaaaacctcctcgccctctatgcggggcgcaaataccccgataaactcctggtttcttcggcggtagatgccatgaaggagcttctctcgcacgccaaggacaatatggcgctcattgactacgtaatcaaaaagcaggatgcgatctgtgatctgaaagaacaggtacagaatgtcgaatccttcttcagcaatcagaaagcgctttttgacgaggcggtgaagtacgaggaagcgctccaacacgaccttgaatacatcgctaaggataaagaggcagagaaggcgctcaacacgattcgtctcattaccttgattccggacggcggcggtttcaactataggcggctgccggagctgaacgacctgctggcgaaggtacatgccaagcatgatgccatgttggaggaaaaacggcaggaacttctgaagattgtcgatgattgcctggaagaaatccgcgccaaagccaagaccgagagcaaggcgagggacatccttcaacaagaagagggctatttcgctcgcaagaaagagtatatcgctggcatccgggtgctgaccctcatggacgggcaaatgcccaatatttggctgcgcaaggacgaggctatatctcgcatcgagaacctctgcaaagaggatgacaagcgggaagaagaacagaaaccatcggttacggcaggcaaaaagccgaagaaaatcatcaaatcggtctatcgtcagtcgatgttccccaagcgcacgatcgaaacggatgcggacattgacgaatatgtggaacatatccggcggcgcatgaaaaccatgctgaaggactgcgacggcatccgactcgattag

SEQ ID NO: 106 - DNA, 3474 bp, Shewanella sp.
atgctaaaccgcgatatatatcagttagacccactggaaagcaaactcgccaacaacggcgtggccgaagtaaaagacgacctgtctcaaggcgcgctcgaaacactcgagtatgagcttcgcacttttgtgtgtagtggtgcttatgccaaagggctagacgatattctcagtacatttctacgtaacgtaaaaagcagcggagaacagccaggggtatggatctcaggcttcttcggttctggtaagtcacacctggctaaaatgctcagaacgctatggaccaatcaaaaaataaatgatggcaccgatgctcgctcactggttgatttgccggacactataagtcatcactttgacgaactctcaacattaggcgccaaattgggtggtttacatgccgcctccggcaccttaggtgcgggtgttgatgataaggtgcgtttggcgttattggcggttattttcaaatcggtcgggttatcagagcaataccacctggcaagatttgaactttggcttaaggccgaaggtattctggcgcaggtaaaggcctatatcgagcagcacgccaaagggaaagaaggcgaagatttgtggcaaaaagagctgcgtaacttacacatgtcacctgtgatggccagtgcagtgttgcacgccatgccagctttaagtggtgatgccgtaggcgtcaatcagatgatcagagctcaattcaaaatagttaaggatgtatcaaacactgaaatggtgcaggcgatagtcgatgccttagccccacatggtgaaatgccattaaccctaatcgtgctcgatgaggtacagcaatatattgccgacgacccagataaagcctatgcagtgcaagaggcgatcgaaacctgctgtaaagcaggcaaatttaaagggcgcttgttgtttgttgctaccgggcaaagtgccttatctggcttgcaaaacctgcagcgtctgatgggtcgcttccaggtatcggtccaactggaagacaccgatgttgatgccgttattcgcaaagtgatcctgcagaaaaaggaaaccgccagagtcagtattgagagtgtgattcaagaaaacttgggtgaaatcaaccgccatctgcgcggttctgttattgaatccaataaagatgatgagcagtggatggtcgccgactatcctctgctgccagtacgtcgccgcttttgggagcgggtattaccagcgctagacaaaaccggtactggctcacagctacgtaaccagcttcgagtcgtacacgaggcaactaagttaacagcacttaaacccttgggcagtgtggtgccagccgattttatctacgatcaaattgccattaatctgctgcaaactggcgtgattggcaaagacatctacgaaaaaataggccgcttaaaagccggtaatgacgatgagcagttgcaagggcgtctgctgtcattgatcttgcttatgagcaagttgccagccgatatcaaccatggtatcgcctcaacggaagcttttttggcagacttgctgcttgaacatttaagtgaaggtaagcacgaacttcgtgcccgacttccaggcttactcagccagctggtggaagagggcgcattactgccgatgaacagcgctgctggcgttgaatatcgcctgcaaaccgtcgagagtcagaaatggcatgacaccttcaagcagcagcaaaacgacctgcgtggtaacccacagtcgcttgagactttccgcagtcaggaaattcagcattatattcgcagacaattggcagcagccaaagttaaccaggggacagtggctgaaggccgtactatcaatttgtgtttcgatgcggatctccccgccgatgccaataagcgactgtatgcccatgtgctggaatgcagcgagcgccaatttaccgatgcggtgagacgtgccagcgccgacaatgccaccttatttgtccatgtgcccagcattcgccgctctgatctattaagtgccattgtggattttaaagccgcggagaccaccttagatgtgagtggcctgccagccacggatgctggtaaagatgccaaagcagccatggagcatcgcaaatatgaggccgaacgcaccaaaaagcttattttaaaagagatttttgacggcattatggtgcaattagccggcggctctgaggtcatgggggagacccttaccgaacagtttgaaaatggcggtaaaaaggcctgcgagcgcctttacaacgaattcaaactggtcgatgtcaaaggctggggtacagtgtacgaccgtgccagtaagtcggccgatgccaatgctcttgctgccattggctttaatgacgaagccgacaaacaccccgtgtgcatggccattaagcgctttatcggtgtgatgaaaactggtgccgaaatccgcgataacttccaaaatgccccttatggttggcctaaagacactatcgacggcgccctgtacgccatgttggcttctggggtattaaaggcgaccgatggccaagaaaaaccgctcgatgccaaaagccttgagcgcgccaaagtcggccaaactaaattccgccccgaaacagtcagcctaagtacggtgcaaatcctcaaggtgcgcagtttaatcaatgccattggggtgagttgtactaacggtgaagaacagtccaagctaagccaggcgatagcccaggctaagcaaattgcccgtaaggccggtggcgatgcgccactgccactgccgccagcaaccccgcacttgaatgagattgaagtcttgtcaggtaatgcgcaattgcttgccgcctatcaatcacagcccattattctgcaagagttggaacaatggaaagcgcaggcagataaagtcagtactcgtctttacctatgggacgagttcaaggctgcactcaagcactgtcaaggtttagcgggatacgatgcccttgatagtgaaaaacgtgctatcgagcaaaatcgcagtctcttggctgagcctaaccccatagaaccactgctcaaacaggccattgaagcgattcgcctagccatcatgaagaagtatcaagacttccaggaggaatatcaaacctgcttgcaagagcttgagcaagacgccatttgggcgcagctttcaagctctcagcaaagcgagctgttaaccaagcaccatttggataacctcgagatgcagccgctttccggcaacgacagagtgatcgacagcatcgaaaacacctcgctcacccaatggagcgacaaaacctccgccttggctggccgctttagtcgggtacggcaagaggcggtagacagattagtgcccaaggccaagcaggtgcagctgtccaaggtggtgattaataccgaagctgagctcgatgcctggcttaagcaggtgcgggccgatgtcatggcggcgcttaacgataatcgccctgcgtcgttaaagtag

SEQ ID NO: 107 - DNA, 3474 bp, Shewanella sp.
atgctaaaccgcgatatatatcagttagacccactggaaagcaaacttgccaacaacggcgtggccgaagtaaaagacgacctgtctcaaggcgcgctcgaaacactcgagtatgagcttcgcacttttgtgtgtagtggtgcttatgccaaagggctagacgatattctcagtacatttctacgtaacgtaaaaagcagcggtgaacagccaggggtatggatctcaggcttcttcggttctggtaagtcacacctggctaaaatgctcagaacgctatggaccaatcaaaaaataaatgatggcaccgatgcgcgctcactggttgatttgccggacactataagtcatcactttgacgaactctcaacattaggcgccaaattgggtggtttacatgccgcctccggcaccttaggtgcgggtgctgatgataaggtgcgtttggcgttattggcggttattttcaaatcggtcagattatcagagcaataccacctggcaagatttgaactttggcttaaggccgaaggtattctggcgcaggtaaaggcctatatcgagcagcacgccaaaggtaaagaaggcgaagatttgtggcaaaaagagctgcgtaaccttcacgtctcgcctgtgatggcgaaggcgttactgcatgccatgccatcttttggcagcgatgataaagaagtgcgcgatatgctgcgtgcccagtacaagattgtcgaggatgtttcaaacactgaaatggtgcaggcgatagtcgatgccttagccccacatggtgaaatgccattaaccctaatcgtgctcgatgaggtgcagcaatacattgccgacgacccagataaagcttatttggtgcaagaggccatcgaaacctgctgtaaagcgggtgtcttcaagtcgcgcttgttgtttgttgctaccgggcaaagtgccttatctggcttgcaaaacctgcagcgtctgatgggtcgcttccaggtatcggtccaactggaagacaccgatgttgatgccgttattcgcaaagtgatcctgcagaaaaaggaaaccgccagagtcagtattgagagtgtgattcaagaaaacttgggtgaaatcaaccgccatctgcgcggttctgttattgaatccaataaagatgatgagcagtggatggtcgccgactatcctctgctgccagtacgtcgccgcttttgggagcgggtattaccagcgctagacaaaaccggtactggctcacagctacgtaaccagcttcgagtcgtacacgaggcaactaagttaacagcacttaaacccttgggcagtgtggtgccagccgattttatctacgatcaaattgccattaatctgctgcaaactggcgtgattggcaaagacatctacgaaaaaataggccgcttaaaagccggtaatgacgatgagcagttgcaagggcgtctgctgtcattgatcttgcttatgagcaagttgccagccgatatcaaccatggtatcgcctcaacggaagcttttttggcagacttgctgcttgaacatttaagtgaaggtaagcacgaacttcgtgcccggctgccaggcttactcagccagctggtggaagagggcgcattactgccgatgaacagcgctgctggcgttgaatatcgcctgcaaaccgtcgagagtcagaaatggcatgacaccttcaagcagcagcaaaacgacctgcgtggtaacccacagtcgcttgagactttccgcagtcaggaaattcagcattatattcgcagacaattggcagcagccaaagttaaccaggggacagtggctgaaggccgtactatcaatttgtgtttcgatgcggatctcccagccgatgccaataagcgactgtatgcccatgtgctggaatgcagcgagcgccaatttaccgatgcagtgagacgtgccagcgccgacaatgccaccttatttgtccatgtgcccagcattcgccgctctgatctattaagtgccattgtggattttaaagccgcggagaccaccttagatgtgagtggcctgccagccacggatgctggtaaagatgctaaagccgccatggagcatcgtaaatatgaggccgaacgcaccaaaaagcttattttgaaagagatttttgacggcattatggtgcaattagccggcggctcagaggtcatgggggagacccttaccgaacagtttgaaaatggcggtaaaaaggcctgcgagcgcctttacaacgaattcaaactggttgatgtcaaaggttggggtacagtgtacgaccgtgccagtaagtcggccgatgccaatgctcttgctgccattggctttaatgacgaagccgacaaacaccccgtgtgcatggccattaagcgctttatcggtgtgatgaaaaccggtgccgaaatccgcgataacttccaaaatgccccttatggttggcctaaagacactatcgacggcgccctgtacgccatgttggcttctggggtattaaaggcgaccgatggccaagaaaaaccgctcgatgccaaaagccttgagcgcgccaaagtcggccaaactaaattccgccccgaaacagtcagcctaagtacggtgcaaatcctcaaggtgcgcagtttgatcaatgccattggggtgagttgtactaacggtgaagaacagtccaagctaagccaggcgatagcccaggctaagcaaattgcccgtaaggccggtggcgatgcgccactgccactgccgccagcaaccccgcacttgaatgagattgaagtcttgtcaggcaatgcgcaattgcttgccgcctaccaatcacagcccattattctgcaagagttggaacaatggaaagcgcaggcagataaagtcagtgctcgtctttacctatgggacgagttcaaggctgcactcaagcactgtcaagggttagcgggatacgatgcccttgatagtgaaaaacgtgccatcgagcaaaatcgcagtctcttggctgagcctaaccccatagaaccactgctaaaacaggccattgaagcgattcgcctagccatcatgaagaagtatcaagacttccaggatgaatatcaaacctgcctgcaagagcttgagcaagacgccatttgggcgcagctttcaagctctcagcaaagcgagctgttaaccaagcaccatttggataacctcgagatgcagccgctttccggcaacgacagagtgatcgacagcatcgaaaacacctcgctcacccaatggagcgataaaacctccgccttggctggccgctttagtcgagtacggcaagaggcggtagacaggttagtgccaaaggccaagcaggtgcagctgtccaaggtggtgattaacaccgaagctgagctcgatgcctggcttaagcaggtgcgggccgatgtcatggcggcgcttaacgataatcgcccagcgtcgttaaagtag

SEQ ID NO: 108 - DNA, 3543 bp, Slackia heliotrinireducens
atgctgctgaaggacaccttcctcaaggacatctatcgcccaatcgaccctgtcgtcaaggcgaacgagctcgggcatctgaagagcgagctggaggagttcgtcatcacgaacgaggcgaagtcgcacctgcagcgattcttcgacgagtacaacgaccccgactccgcgggcaacggtgcgtggatctcgggcttcttcgggagcggcaagtcccacctgctcaagatcatggccgtcgtcatggaggacaggcaggtggacggcaggggcgccatggactacatcctccccaagctgtcggacacgccagcgcttgcagcggcgatggagcagtcgaggctgaggcacccatcggaaagcgtgctgttcaacatcgacagcttcgcgcccaacgcgggccgttccgaagcaggcgcgatactctctgccttcatcaaggcgttcaaccaccactgcgggtacttcgacggggaccagcagcacatcgccaagctcgagtacgacctcgaccgcgaaggccacttcgaagcgttcaaggcgagggtcgaggagctctgcggcaagccctgggagcaggttcgctcctcatcgctgctctacggaaagaagatcacgtcggcattcgacgaggtatgcggaaacccagagggcacgaccgcaaacgtcatcagctactaccagcagacctacaagcccgatatccgcatgttcgcacaacgcgtccaggcctacatcgccgagcacgggaaaggcttcaggctcaacttcttcgtcgacgaggtcgggcagttcatagcccagaacacgagcctaatggtgaacctccagaccatcgccgaggagctcgacaacttctgccacggggactcctgggtcatcgtcacctcgcaggagaacgtcgaggatgtcgtcggccagatgaagcagatcagcgccaacgacttctcgaagatcaaggaccgcttcaagacgaggatggtgctcacgtcgtcagacgcgaaggaggtcatacgcgacaggctcctggcaaagcatccaggggacgagcccttcctggaagagatgtacgaggagtaccgtgccgacttcgacgttctgttcgacttcgcagacggcgccaagcgctacaagcagtaccagggggcacaggagttctgcgacacctatcccttcgtgccctaccagttcgaggtgttcatgaccgcgttgcgcggactgtcggaccacaactgcttcacgggcaggcacaactccaccggagcccgatcgatgctcggcgtcttccagatggtcgcgcagcgcatatgcgacgccggcgccagcaccgagcaggggacgctcgcacccttcgacctgatgttcgagggcctgcgcaacgacctcaagagcgaggtgtacgccgcaatctccacggcagaggaccagctcgacgacgaggtggcggtgcgcctgctcaaggcgctcctactcgtcaagtactgccaggacttcagggcgacgcctgggaacctgcgcgtgctactgtacgggtccttcggcgagagcacgagcgagctgaacggaaagatacgcgacgcgctcgacacccttgaagagcaggtctacgtcaggcgcaacggcaacatctacgagtacctgaccaacgacgagaaggaagtcgagaaggagatcgcgaacaccatcgtcccagaagtggagacgagaaagcagattgcggagctcttcaaggacgtgtgcggcgcgaccagggtcacgtatcggaacggttcattcgagcattcgtacctgtacaacctcaagatcgacggcgaggcccagggcctgcagaagaacgacctcacggtcgacatagtcaccgaccgcgatgacggcgggctgttcggcgacatagtgcccacgccacccaagacgctcacgatcgagctccgaaactgcaaggagttcctgataggcgtgaggacgttcaagcagaccgagacgtacacgggcgtccacagcggcgccggcgaaattcgggaagccatcctacacgacaagcaggtggcgaacggaaagctctacgccaggctcaaggacgagctagcccagctcctgtccgacgcccggtacaatgcgggaggggtcgatatcaccggccaggtgacaggcaccgcggcagacgccgtccagtccgcaacacaggagctcgtccgcaggtcatacacgggactgcaacagatcgggcagaaattcagcgacaacgacgtatacacgcagtgcttctcctccgaggcggccttcggcctcccggagtactgcgagacggtcctctctcgaatcaggctcaccaagggggcggtcgcgtcgaccgtcgcaggcgacggctcaggcagcctgacgggttacttcatcaagaacgagtacggctggccggaaatcgcggtccgctccgcgatagcgcggctcttcgccgcgaacaagatcgaggtccggaagtcggggtccccgctcgagaagtcggcgctggctgacgccctcaaaaggaagcgggacctcgataagctggtggtctcaaccatcgacgaggtatcgcccgaggacatcgccgcgctcagccgcgcattcaagctgttcgccggcacgcagcccaagggcgtggaccagaagacgatcgcctcggagctagccgaggtagccgcatccctcgccaaaggcttcgggtcaaccgcctctgcagcgcacgtttacccattcggcgacgcctatgaagcggcgcttgcgaaggtcgaggagtgcgctaagaacgcatcggattggagatgggctctcggcgagttcccagcaaaagcacaggagtacgccgacgcgacgagcgatctgaaaaagatggcctcgttcgccggggggtcgccgatgagcaagcggtggctcgagctgaggtccttcatggcgtcggaggcggcacacctcaccgagcttggtatcgtcgacgagggagtcgcagcgatcagcgcgatcgtggaggatccggaatgcttcaagaactccgggataccccaggcagccaagcagatggaggccctgaagaaagaggccgaatccgcgcgcgcgagcctgagggatgctgagagaaggaagctcgccgagtacagggcctcatacgagggtacatacgatatcgccgcgctcccgcaggaggcggccgaggagttcgacggcctgttctcagaggcagaggagcagctgggccttatccgcatcccgtacaagatcaaatcgttcaccgaggacttcaagaaggacaaggcagctcgtctgctcgagctcgtgaccccaaaaccggcacctcccgtcacgccgccaatcgacgtgcccacgcctcccgatgatgacgacgtgccgccggtgcacgttccgaagaccatcccggtcacgagcctgtcggcaaaggggtacagcaaacccgccatcacgaccgaggacgatgttgacaaatacctcgctgccctcagggcctcgatcgtagcagtcgtttcgggcggagacatcgtttccatctag

SEQ ID NO: 109 - DNA, 3561 bp, Spirosoma linguale
atgttaacaacgattaaagaaattttcgaaaaatccattgatcgtcggatcaatccggcggtagttgtcgacaataccgacccggagactattacgacggaaatcgatgaatatgtgtttaccgccagtttaaccgaacagctttacaaactgctgaacactcttggtagtaaggcccagattaaaacgggtatttggatcaatggctactacgggtctggtaaatcgcactttctaaagtttttttcttattgcctgagtgatcaaaatcaggagcgggctttcaggcgtctgatcaatgaaggtattgctcccctgagcaaagaaaggcccctgaccgatgcaacaccggctaacgcggaaaacctgttgagtcgactgcgggggtctggtacggaggttatcatgttcaatgtagaagcggtttcgcctgataatataaagagcgaagacaagtttctacatatgctgctcaagcaatttaacaaacaccgtggcctcaacagtacaaacattccattggcgctgctgctggaaaatcatttgcaacagagcggcttgtttgatcaattcattcaggcagttgagtcgaagtaccgcaaaagctggcgggacaaagccacggacttattttcgttatacggtatcaacatcgtacggctggccgctgaggtggacccttcactcgacgccgacatgctcttccagaaactcaagcaacctgatgccgttaccattgaggatacgcttattccggaactaagggcctatattcaaaccaaacccgccaattaccgactggtgtttctactcgatgaagtctcgcaatacattgggcgcaataaagacttgttgctcaacctgcaaaccatcattgaggccttggaaaaagcctgtaaccggcaagtgtgggtagcctgtacagcgcagcagaccctcgaagaggtaaccagtacggctcaggtaaccaaagaagacgagattggtaaaattctgggtcggtttgaaacccgtattgccttagacaataaagacgctgagtttattacccaaaaacgggtgctggacaaaagcattgacggtcaacaggatttacagcaacggtaccgccagcacgcccacgccattctgaaccagttccagtttggtaataatacaacttaccggggttttggtgatgaggatgagtttgtgcgtatgtatccgtttgtgccttaccagttcccccttatcctgaacgttttcgactcctttagccaaaagggatacgtcgttcgtgaagtcaaaaataatgagcggtcggtattgggaattacccatgccacgatccaaaactttgcggatgagccaattggtggttttgtgccgttcgatgcattttttaatgacttatttcgcaataacctgctccaggtggctcaacagagtatttaccgggccgaacaggttattgaccggtcaggggagcggctctcagatctacgttttgccaaacgtgttctacgggcattatttatgctggcgaatctgaacagcagtgaatcccgtcgttttccggctacgcgtgagcaattggttaccctgctcatgactgggcttgacgataaccggctgcagctagccaaccgaacgcaggacgtgctggatgtgctgattgccgaaaatattatttacctgaacgacgacgcccactttgctttttataaagaggaagagattgaggtagccaatcaaattcggcgaaccaatgtactggaacttgaccgcctggataactggaatgacgtgtttctcaaatcattggggctgaataaagaaactcgctacacgtttggaaagaacacgtttcggctgggttatggcgtagatcgcaaagactatggtaacacgggtgatattcaggtgcggttctttgtcatggacggtactgatgccgccacgctggccctcaatcagcccgctcatgaactagccgtttgcattagcgcctggctcaatgatccgtcgaataccgacaacgattttagccgggatgttgaaaattatattcgtacccgcaaatacctgggcttgtattatacggcatcgaccgggtcaatggctgatacgttgcgggattttgaaaagcgaaatgccgcactgctgcaatcgcttaccacccggctcaaaacaggctttgcttcgatccctatgtatgccgggcaacaacggatcgaccccgctggcttatcgggtaaccagcccgacgttcgcctgaagggtgccatcgagaagctgttcaatgttgtatttaagtaccagaccgatgtgaacagctatgcccataccaatgatgggttgcgtgagaatgcacgcaataccgggcagcttagtaccgataccacattgacagcggccgaacaacgcgttgaggattggattaataaccggggaggtaaagcaaccgttgccgatgtcgtgaaggcgtttgaagatcgaccctttggctggaaagacttagccactattgatgttctcctggggcttgttgccaagaaaaggaaggaaattgagtaccaaaatagcccactcagtgcgccgactgagtttgttgagaaagcgatcaaaacctcggaacgtacagcgctgctggtgcgtaccacagaagacattgctccgcaattgattcagcatgctatacgggcttatggtcaggtatttaacaaaacgctgaatctggcccccgatcctacggctgtgcagggggctatcaaaacggaattgagtcgtgaaatcgaccgactggctccgttaaccaccatccatgctgctttgccatttgcgcccgcgttgactcagttggttgactccctgcgggccgttggcctgaaacgggatgccaagatgctgtttgaaacactcgtggctcaggcgaatgagttgcggaaacagtgcgatgccgccaaagaactggatgcgttcattaccgaccgactcgatgaatacgtcgatatgcgccagtatgtgttgacccagaaaggcaacttcagtgcgctacctgagcaggaagcccgacaagcccgcgatctctacgacgatctactcaacaaccctacgccccaggaagcattcgccctgaaccggaaacggttcctggccgtaaaacgagcgattggcgactcggtaaccaccttgcgccaaaccgttaggaaggcttatgaaacggcctttgacgaactggacgcctaccgggtagaacatggccatgatgacccgcatacccttgccgaccgagatcagacattgctcagtattgataaactgaataacctgaccgaactggacttaaaactggcacgcgtgggcgattttaaggccgaacaactacgcgttcttattcaagcaaccaacaaaaaagctgcccccggtagtttggtacgtgaaccggttatgtttgaatatgggaaacaaatgctaccaacccagatcgcatctgaaaccgaactcgatcaatacttagcgcagttgcgacacttgttgaaagcacagctagaccaaaataaggttgttatttttaactaa

SEQ ID NO: 110 - DNA, 3492 bp, Sulfuricurvum kujiense
atgatcatcgaaacgctgtttaaaaagcctatcacccgaaacatcgaaggggtggtaaaagccgataacgacgatctcgaagcgatacgccaggaggtcgaagaatacgtcgtcaccaacgagctcaatgcccgcttggacgatttttttcgcgtctacgcttcttccatcaccaaacccaccgccgataacggcgtctggatctcgggctttttcggatcgggtaaatcgcatttgctcaaaattctctcctacatcctcagcaacaaatcgctggaaaacgaacagatcgccaaaatcttcgaagaaaagatcgccaaagaggactttgaactacgcggcaacatcaacaaatcgctctccatcgccgccgagacgatcctctttaacatcgaccagaaagccgaaagcctcaccgtcgcccaccaggacgacaaactcctcagtgtgtttttgaaagtcttcaacgatcaccggggctactacggtaaattcccctttatcgccgcattcgaagcaatgctcgatgacgcgggagagtatgggcgttttaaagagctcttttttcaggccaaaaatgtgacgtgggacaaagcgcgcgaaaccctcgccctctacaaagctcccgcagccgaagcgctcagcgcggtgaaaaatatccccatcgaggatgccaaacgctacatcgacggcctcaaagaggattacaaaatctcgatcgaggatttcgcgatcgaggtggcccgttacatcgagcgcaaaggggacggcttccacctcattttctgtgtggatgagatcgggcagtacatcggggataacaccaagctgatgctcaacctccagactatcgtcgaatcgctcgcgaccaagaccaacggccaatcgtgggtcatcgtcaccagccaagccgacatcgactcactcctcgaaaaccgagacgacaaactctccaacgacttctccaagattatgggaaggttcaaggtcaaaatcaacctcacctccaaagacgccgacgaagtgatccagaagcgtcttttggacaaaaatgacgaagcctgcaccctgctgggcgaaacgtacacgcgtgtgcagaacaccctgcgttcgatcatccatttcgagaaccgccagtacggcgattacaaagatgccagccacttcatcgccacctatccgttcatcccctaccagttctccctcttcggacagtcgatccgaggcctctcgtcgcacggcgcgtttcagggagcgcaccagtccgtcggtgagcgtagtatgctcggcgtcttccaggatgtcgtcaaaagcgtcgcctcggattcgaccgactcgctggtgagctacgacaaattcttcgacggcctcaaacaaacgatcaaaggggagatccagaccagcatccttctggcggaaaaccatctgaacgatccgtttgccctgcgggtactcaaagtcctctttatggtcaaatatgtcaagggcttcaccccgacggtcgattcgatctcgacgctgatggtcgattcgttcgacgtcaacatcgccagtctcaaagaggagatcctccgcgccctgaccaaactgaccgatcaggtctacatccagaaaatcggcgacagctacgagtttctcaccgacaaagaaaaagacatcgagaacgagatcaaagagactcagtgccccgaatcggagatcaccaaagagctcgccgactgggtgttcgatgacattatccgcgtcagcaagctccgtttcgaagccaaccgaaacgactacccgttcgagaaaaagatggacggaaaccgggtcaaggggaaagaagagaacatcgtcatccacattatgacgccgctgggctctgccgactatcccgaagaccgcctcatccactacacgatggcgaacaaagagatcgtattcctcctcgaacccaaccggcagtttgaaaaagacctccgcctctatgtgcagaccaaaaaattcctcccgcagaagatgtcggcatcgctgagcgaaaccgacaagctcctgctggcttccaaacagacccagaacacccagcggcgcaccaaactgatcgagtctctcaaagcgatgatggaagagagccgggtctatttcaacggcgcaccgatccaaatcaccgccaaagaagcaaaaaaccgcgtcgaagcggcgttcaatcaggctatcacctccatcttccctcagatcacgatgctgcgcaaaaactactccgaagacgacatcaaagccgccctgttcaatcagggggatctgggatttggcgatgagacgatgaacgaagccgaaaacgagatctttatgaagctctcccgcgccaaagcggagcataaaaccctcaccatcaccgccatcatctccctcttcgaagaccgcccctacggctggtaccaaaacgcgatcctgaccctgctcgcttcactctttacacgcggaaagatcgaactgcgccagaatgctccgctggagcgcaacgaagcgttcaaagccctcaccaacagccgcgaccataccagcacgactgtatcggtcaccaaacagatcgacgatgcgcgcctgcgcaaaatccgatcgatcgccaccgagattttcccagatatcgctgcgggtgcttcggccaaagatctctatgcccagacacgccaggccgcccagagcctggtcgcacgactcgaatcgttcgtgagttcctactcctatccctttttagcctcgctttccgatggaatcgtcctcttcacccaactctcaaaagtcgatatggacgacttttttgactttatggagaaccgccaggacgatcttctcgatgccaaagaggacaccatcgaaccgatcctggagttcttcaacggatcgaaattcgagatttacaaacggatcggcgaattcctccgcgacaacacggacaacctcaaatcgatcaccgatccgaagctcaatgacctctacgcgctgatgaaagacgaaaaaccctacgccggatccaaaatccagctcgccaacgaatcgctccagtcgcttcacgccgccatcaatgcccagatcgatgctgcccgtacccaaaccaatgcagcgatagaggagaaaatttcctttatcagctcacgcgaggatttcgccaccctctcgcccgatgagaaacatcaggtcctctcgccgctccttgcacgccaaaagagcctccaaaacctccgccagatcgattcgatccgctaccagggttccgaagagtctctgggcaaactcatcagcgacgcactggaactgatccccgaactcctcccgccgcctccgggcggaatcccgagtgctccgagaaaacaggtggttcgtctctcgtcgatcaatccaaaaacccgctccaccctcaccacggccggggacgtcgaagagtacgtttccgccctgcgtgccaagctcctcgaagcgatcgaagcggaaaaagaggtaatcctgtga

SEQ ID NO: 111 - DNA, 3666 bp, Synechococcus sp.
atgaaaaccattggcgacctgctgactcgcgacctcacccgtaagatcgaggaaatcattcaagtcgatcaggcggatgagcaatccgtttacgctgaaatctctgagtatgtcgccactgatagtattcgtgagcaataccacgacttactcaaagctatggcggaggctccgtctgaaccacacgaaagtattggcgtttggatatctggcttctttggttctggtaagagttcattcgctaaaaacctaggctatgctctgcaaaaccgtagtgttatgagtcggagctttgctgatttctttaaacagcagattgacgacaatcgaataagcgaccttcttgatctcatcaacgttaagacacccactgaagtcattttgtttgaggtagcgaaagaggttgatacgcgcaaggtcacacagcggattgccgagttgatttacacagttctactgcgagagcttagctacgcggaagatttcgatgtagctgaattggaaatagagcttgaggctgagggaaagcttgatcaattcattgaaatttgcaagttggaattgaaaaaggactgggaaacagtgcgtgccggtgcacagaaaatttctcgtgctagtttaatcttgcacaatcttgacccgaagacatatccttcggccgactcttgggcacactctcaacgtaatcgggatgcttcaatctctgtcagcaaggttgtggagcgaaccttcgatctgtggggacgtcgtcgccctgggaagggactggtattcatcattgacgaagtgggtcagcacgttgcccgtagcggcgacaagatcgaagacctccgggcaaccatcgaagagttcggcaaggctagcaagaacttgctcaaggcccgcaagatcacggctccttgctggatcgttgtcacatctcaagaaaagctcgatgaagtcgttgctgccatcgactccaaacgggtcgaattggccaagctgcaagatcgtttccgttaccgggtagacctcgcgccgtctgacattcgggaagttgctaccaagcgtgtgttggccaagaaggcagaagccgaaaccccactcaaggagttgttcaagaagaatgaaggccagctaaacactgcattgcggttggaacgtaccacccgccgtaccgacatcagcgagagcgacttcattcacttctatccctatccgccgcactacatcgacctgtgcattggcatcatgtcgggcatacggcttcaaccaggtgcgcctcgtcattacgggggcagcaaccgcaccatcatcaagcaggcttatgagatgcttgtttcggaacgcacagcttttgccaataagctcattggggcaatggtgacgctggataaagtattcgaactggtagaaggcaacctctcaaacgagaaacgcaccgacatccatcagattgctgaacgattcaagaatgagcctgaagaccatggctgggcgctccgggtttccaaggcgatctgcttgttggagttcattcgcgatctcccacgcaccgaagctaatctcgccgccgtgctggtggatgaagtcggtaaggctacgccactcgctgaggttaaagctgcggtacaacggttggaagccgccaagtttattcgcaataccgaagaaggctggaagcttcaaacagcccaagaaaagaactggacaaacgaacgcagcggttaccttgatcccaagccccgagaacggaacgaactcacccgtgccgcccttcagcaaatcttcaatgagccagattttaagacctaccgctaccagaaccgctcttttcgcattggtatcagtattgatggcagtagcatcggagatgaaggggaattgctgctgagcttatgtgtttccgacgatgccgacgaactcaccaatcgcattgagcagattcgtaccgaaagccagcagaagttacacgagaacgatttgtactggctgttttgcctcacacctgaaattgatgatctggttgcccagcttcatgcatcacgaaagatggtagacaagtacaaccagttgagtgctcaacaaaagatcagccccgatgaggcaacctgcctgcaagatgaaaagaactctaaggtcatctacgaaaaccgcctgcgagacaagcttactcagggcatggagcgaggcactggcatgttccgaggcgtacagaatgatgcatcagcattgggcaaatcactaggtgaaatccttaagaagctctttgggcagattgtgccggatttatatcccaagctacaaatgggttcttcctcactcaagggcgatgaagctgaacaaatcctcaagactgctgatctaaaggtgctacctaaggtcttctacgaaggagaacaggggctggctctggtggtgaaggatggggctaaacttgtcatccacaccaatgccgaagtgtccaaagaagtactggactacctcaagagcgaacatagctacggcaacaaagacacgcgcatgggcaaggccctggaaaaacgctttggcggcacgccttatggttgggaacgtgacatgctgcggttggtcctcgccacgctgttccgagcaggcgaaattgaagtcacttaccaaggcaaccgctaccacaattaccaagacccaacttctcgcacaccttttactaacaacccggcattccgcacctcgctattttcgcctcggcaatcggttggtctaaagacactcacacaagccgtccaaaaactagaagacctaactggggaagaagttgatgtcgaagaaggagccatcgccacggcgtttaagaaggttgctgccgatgagcttgaaaagctccacccgctcaaggctactgcccaggctcatcagttgccgatactaacaatgctctccgagtaccagcaaaccttagtgggcattcagtcttcgacatccgacgattgtgttcgcatccttaccgaaaatggagaagattttggagaaacacgggacaaagttcgcaagttgcgagaatcgtttggtactgagactattgaccttcttcgacaagctcgacaagccactgaacaagtctggcagtccttattgacttacgctccttccccggaactggaaactacggttgcagaactaaaaacgctgctgacctctgagcagtttatcgactcatgggatgagatcgcagccagtacagaaatggtgttggatgcctatcgcaccacctattgcgaactatttgagcgccgcaaaaaatcctacgaatcagccattgacgagattcagaaccgatccgaatgggctcccctaaaagttaataaccccggtatggcctcgtcgctcctgtcgcagatgcaagcacgggtgggctccgatgaggacaaagaagccgtcgagcaagggcattcacttggtaaagccagcctgtcccaaatggagtcagacctcgccgctgttgatgggttgaaatcatcggtactagtcaagttgcaggaactctccattggcagcgataagaaagcccccgtgcgaaaggtgcgggtatcggaattctttaatcggcccattcagactcaggatgatctgaaaacagcaataaaactaattgaagaaacacttcaaaagtgcatcgacgaaggtgccatcatcattttggagtga

SEQ ID NO: 112 - DNA, 3600 bp, Syntrophomonas wolfei
atgaagataaaggatagtctgactattgatttaactgaggatataaaaaatgttatcgacctggaagatcattccgaagcagaaattcaggctgaaatcgaaaattacattgttactgatggcctggcccgtgattacgaagattttgcagctacatttacttctgatattgtagaaaccggagtttggatttctggattttatggttcgggtaaatcgtatttcggcaaactgctgggctacctgctcagtaatcgcagcattgccggcactcctgcccgggatagaatcctgcaaagatttaccggtataagggatgaagccttaattaaaaactctattgcccggcttgatccggagaattgtcgggtagtatttatggatgtagccaagcaggatacatcaaaaggtttagcctttactctctttagagtgtttttaaaatcattggatctaccggagaatgaacatggtattttattatatcaattaatgataaatgataatcagactaacattcatgattacattgataaaagaatggataaagactggagtaagattcaaaccagaatgctggagtacaccaaaacagccaaatcaatctatatcaatgcgggaaacagcgagagtgattatgataacttaatgactaccattcgccgcgatatggatcaatttagtgcatcccgtttaaaagatgaattaagtaattatttacagataaatactggtgagaaaatcatttttctctttgatgaagccagtgaagccattacccagcaaaaatttaacctgctggatctggaaggtatcagcgaagccttatcatcattgggggcaaaagtatggactattgctattgcccaggaaaaattagatgatgtcattaataattccaacataaacaaagctcagcttaccaaagtaaccgaccgcttcaagaccaaaatccacctggaagctaccgaggtagatataataatccgcaatcgcttattaaacaaaaagactgccgcagaagataaattaagggttcattataataaaaactccggaaaaatcagcgatcatgctgctttaaccggtataggaataattaaaacggatacgctggattcttatttaacatattatcctttttatcaatatcaattcaacctgctgcaaaatttcttgtttggaaccaaaggctatgcttcaagtaaagtagctgcccggggcatgatcataactacctatgatattttaaagcgggagttagccgaaaaagaactgtttgccactgctaccggatggcaaataaacaaacaggctcagccccaacctccggcacacctggttaaccgctacgataatgctgaacgcatactaaaagaacgcagctccactatttccggtcgcagattattggaaactattaattttttgaatgaagcggaagttggccccacgactaccatatccaatattattaagtcctacatagatgatccggaagactaccataaagtgtacgagcatattgtcaaagcattggatgatttagtagaagccaaaatactcttatcaactaataacacctatcgtattacttccgatctggaacagcgtttattggaggaaatgaaccgctttatcgttcaaggctttgtgaagaagaagaatgctgttactgcttataaagacagctcttttataaaaacattggcccgcattaccgacagcaatctgccttatgatttttacatcagcaccgacaatgatgatgaattaactaatcccgccttgaaagaactcaaaatcaaagtaaaaagtgtatataaccagggtgataaccgcagtgctgacatagagacattgaaagcacaaagccaaaatgataaagatctcatctggctcttaccggataatagttcatttcctgaactggatcgtctcattgatgaaattcaacgaattacctatctggaagaaaactataataacccgcagtccgaggaagccggcatcataaggaatttttcaactgccaaaggcgaaaaagaaaatcgggttaaggaactgatagagcggtcattacataatgctaccgccatatatctatataacacctatcaattggatcaggataactggcagactaccctgcaaaacctgcagcgcaatgtcatacagaacgtctatttcaaacgactgactgcccaattaaatgatgaagtagcaggcagggtaattaaagaagcgaacaatacgcgtttaaggacttactttgccggttcagaatttcagttttttgatgcccagggaaatttcattggtgaaaacttaaaagctgccgaggagatactgtttaaaattaaaaatacttttgcagatggggataccctggccaaagaattgggaaaacctcctaccggttttgcttttggcacggttatttcaacggtggccgccttgatgcgtggtgctaaaataatagctaaatacaatgggatggagaagttttcctggcgtgatgaaggagtaagcactattttctcaactgctcgggagtttcgtaaagcctccttcaaagccgtagcaaaatctttatcagcccagcaaaaaaacgatatggttactattctgcaggagtcgaaatgtgagcaaagaatcgataaaaagattgactggagcactaatgattttgatttagccaatgctagcaaagaactggccaaaatgttctgcaataaagcggatgaaatgcgcaagcaaaacccggattttgatttgctctttgccgatataaatgagcaaaagaaaaccctgggggaatttaccggggtcgttagtgaagccaactatatcgaaagagcggagaactttctcacccgtaaagatacctttaccagcgcggttaaagccatcgaaaaggcggaaaaatttattcatggcaaattgcctaagcttcggcagtggtatacttttgctgatggagtaaaggatgaattaagcaaatcggctcgcagtagcgaaatacttacccgtttcatatcggagttcgataatttatatgctcagggagtagtaaaaaattatgctgctttacaagagactgcccaaaaaataaaggatgaatactatgccctcttaagcagtgccgccggtgatatggccggtaaatacagccagttaaagactgccgccgaagcagttattgaagaaatcaatcgcctcccgaccgggttgaatgatgaagctttggttaaagcggagaccctgttacactatgccgagcagagaatgctggccaatgtagagattgattttgaggtgcaggacaagcattcccattttacttattcggaaatgctctcgtttattgaactgtataatacaaagaaaactgaactagaaattattagagcaggtttgataaaaaaagcaccgccggaaccgaaaccgggtggtccggttccggaaacgataacccatactaccaggctgcccggtttacggctaaaagtaggtagatacaaaaaatggctgcagcaggaaatgcataaattagccgctgtaagtgataacgatgaaatagagatcaggaagggataa

SEQ ID NO: 113 - DNA, 3558 bp, Syntrophomonas wolfei
atgctggttcgggaaatgtttaaaaagaaaatagaccgggaaataaaaggggtcatcaaggttgcccaggatgatgaggataaccgctaccaggaactggacgaatatgtggttaccagagagctgcataagcatatcgctagcttctatcaaaactatcagaagggaatagatggctataccgatgaaatgggagtatggatatccggtttcttcggttccggtaaatctcacttcttaaaaatcctttcctacctcctggaaaacgatgaagttaaaggtacaaaaccggtcgctttctttactgacaagataactgatcaggttctctatgccgatatcgagcgggcatcacgggtagaatgcgaaactatcctttttaatatagattccaaaagcccactggggatgaaaactgataaggaagccattcttaaagttttcctgaaagtattctatgagcacctgggctactacggcgatgatttcaaggtagccgaattggaaaagtttcttaaccgggaaggggtactggagcagtttaaaactgattttgcggaaataaaaggagaatcctgggaggaacggcgcagttgtttcttctttgatgaagatgcagtggtggcagcgctcagtaaaagtgccggtatggccgagaacagcgccagaaattggtttaaccacagccagaaccctaagctgagcatcgagcaatttgcccaggaagtaaaggactatgtagacagtaaaggggagaacttccacctggtatttctggccgatgaggtggggcagtacattggtgacaatagtgagatgatgttaaacctgcagaccgtggccgaagacctgggaacccattgcaaaggtaaggtgtgggtcattgtaacttcccaggaagatattgattccgttaccaaagtaaaaggcaacgatttctccaagatacagggccgtttcaaaacccgcctcagcctttcagcggcctcagttgatgaagtcatcaagaaaagaatcctggaaaaatcggagtatgccgccgataaactgcgtttaatttacagtgaacaggcggctgccctgaaaaatctcatccatttttccgaaggcacggtagctgatttaaagggatacggtggtgaagaagatttctctgctacctatccctttgtaccttatcagttcaaactcctgcaggaggtatttacccagattaggaagtatggggccagcggcaaacacctgtccgaaggagaaaggtcgatgctgtctgcctttcaggatgccgcctgtaaatatgccgatgaagaggcgggggtgctcattcccttttatgccttttatgattcggtacatgcgtttttagatggcagcatccagcgggtcattatccgggcgggtgaagctgcttataataaggaaggactaaaagccggggatgttgaggttttaaagctcttattcctcattcgctacataggggatattccggccaacctggacaacattgccaccctcatgatatccggggtaaacgaagataaactaagtttaaaagaaagcattaaggcagccctgaaccggcttatttcccaaaattatgtgcagaaaaatgcagatgaataccgtttcttaactgatgacgagcaggatatcaaccgggaaatcagaaacacggtaattgacgggaatgctgtggtggaggaaattggcaactatatattcaatgatatttacgaggatcagaagtaccagtatagcaaacgctatcctatcccttttaaccgcaaaatagacgagagcaacataggcagtcaaactgcccgtatgggacttcgtatcttaacccgggcttctgatgattatgatgctgatgaagccgaactgaagatggtctcagccggaaataatgacctgattatccgcctggatgaaagcagtgactattttgaagagatgcaagcagccttaaaaatagaacgctttgataaaatcaagcagactaacctgcccgccaacctgaaaaagattatggctgagaaacaggaagaagcccgcgagcgtaaaagccgggctaaaagaatgctggaggatgccctgcttaagggacgccattataccaatggagaaagaatcgatcctcgcggcagcagtgcccgggaaaagatgaataacgggctgaaactgctggcagaaagcgtttataacaaactgccctatgtaaaagaattcctggacaacgaccaggatattttggatatcctgaaccgaaagctggaacagttcaccataataggaagcggggaagaacttaaccagttagccctggatgaaatcttaagctacatagacctgcaggaggcgaagcacctgcagattaccatgaaaaacctgctggataagtttgaagatgccccttatggctggcgggaaattgacatcgccggcatggtcgccaccctgtttaagcagcaaaaaattcgtctgcactaccagggggcttatttggaaacaagcgataaagctattcccgcttacctgcgtaaaaagaccgaggtagagaaaatcctgattaagaaacgggtcagcctggatgaaaagctggttaaaaccgcccgcgaaattggcaaagatttattcaacgtggttaatttaccctccgatgaagatggcttgatgcgggagctattagcaaagataacggataaaacgggtcagattgagcgcgactatctccgccattatgaaggcaggaaataccccggtaaagacctggtcatgcagggcctaaacattttccaggaactgcagcattataaacaggatcacagcatcctgctgagcaaactgaaagaataccaggacgatttgttggactgggatgaaaatatgaaaatgatacagaacttcttcaagcatcagcaggttatttttgataagggacttaatatggtaaaacggattgaaaacaaccagagctacttgcaggaaaaggaattcatggacaaaaacgcagaattacaggctattatcgccgacccggcgccctaccacaagatttctcagattccagacctgagctcctggctggataaacagtttgaggaaaggctgaacctgcataaagaggatagccgaaccaaagtgcaaaaagattatgaacaactgcaaaaagccctgctgcagtatggtctgggtaatggggagcgacagaagtttactgtcggcatcaacagctggtatgaggataaatataaatatattgatgacagcattggttttgagcggctggacgccgctattcaacagagtgcgaattaccgggataagatgctggctgaaatcaaagccgccctggaagccaaacagggtaaaattgctggaggtgacgagggagatccggttaatgaaccggaaatccatatgctggaactcaaagaaatcgccctggtggacgcccttcgcacggaagcagatgtagataattatgtaaacagcctgggcaaaaagctcaagggtctgataaaggagagaaaggttattcgctttgggagataa

SEQ ID NO: 114 - DNA, 3498 bp, Syntrophus aciditrophicus
atgaaaaacagagaactctttcaacgcgatcctgccttagctaagctcctgaatgatggcgttgctgccgtgcgcgagacagcaagcgccaaggaaatcgagacgctccgttatgaactcacacattttgtgtgcgagggccagtacgaggacggtttgatccgcatacttgagtcctacctcggcaacgtcagttcgacgacacaaccggcggcctgggtgagcggcttctatggcagcgggaaatcccacctcttgaagatgttccgccatttgtgggtggatacgctcttcactgatggcgcaaccgcccgcggactggtgagcctcccgcaggaggtgcaggatcttcttcgtgaactcgacacgttgggcaagcggaatggcggcttgcatgccgcgtcaggaacgctcccttccggcggtggcgagagcgtccgactggcggtcctgagcatcgtgctggtatccaggggattgcctgaggtgcttccccaggcgcaattctgcatgtggctccagaagaatggcatcatagaccaggttaaggccgcagttgaatctgccggcaaggaattttacagcgaactccatgatctttatgtcagccctatcctggccaaggccgttctcgatatcgaccccgatttcgccgctgacctgaagcaggcgcgcgcggccctgcgggcgcagtttcccgtggtcgaagacatctcgactaacgaattcatacggctggtccgcgaggtactttccgtcgatggacaaatcccctgcaccgtgatcgtgctggatgaaatccagcttttcattggcaacgatccgggccgatcaacagatgtacaggaagttgccgaagccctttgcaagcaactatacagtcgagtgttactgattggcgcgggccaaaccgccctggcagggtctgtcccgttgcttcaacgactcaacggtcggtttaccatgccggtggaactctccgacgccgatgtggaaacagttacccgtcgtgtcgtgttggcgaagaaagtggacaaaaagaaggccattgaagaaatggtcaacgcccatgccggtgaaatcaaccgccagctcgccggcacgcgcatcgccgcctgtgctgaagaccgagacatcattgtcgatgattacccactactgccagtccgtcgacgcttctgggaacatgtgcttcgcgcggtggacgtacctggtacggccagtcagcttcgcacgcaacttaaaattgttcacgaggccgttcggcagtcagcagaggaaaacctgggtaccgtggttcccgcggacttcatctatgagcagatcagtcccgacctacgcaagactggcatcctgctccgtgaaatcgacgagacgatccgcaaccttgaccacggctctgatgatggccggctcgcccagcggctttgtggcctgatctttttgatccgcaagcttccgctcgaagcggtggccgatataggcgtccgcgcgacaccagagatgctggcagacctcatggtgtccaatctggccaacgacgggacggaactccgcaagaacattccgcgcatactgaaactcctgaccgacccgccgccggagtccgagcggccgacctggctaaggaaagccatgcaggacaagggagcgctgcttattgagattgatggcgaatacagcctccagacccgcgagagcagtgaatgggatcgggagttccgcaaccgccagacaaggctgaacagcgacccgacttccctgccgatcaagcgcggcacgctcatcagcgccgcttgcggtgaggctctcaagggcatcaagctcgtacagggcaagtacaaagaacatcggaagctgctggtccacttcggcagcgaaacgccgctgaccggcaggaccgaaattcccatatgggtccgcgatggctggggagagaaggaaagcactgtcgtcaacgatgctcgcgccgccggcagtgacagcgcgatcgtctacgtttacattcccaaagccagcgctgatgatctgcaaaaggccatcgtcgaatacgatgcagccaagtccacgctggagttcaaaggtacgcccacctctcctgaaggctgcgaggcccgtgacgccatggctactcgcatggctgcggctgaaacttcccgcaaccagattttacacgacttgattgaccgtgcgaaagtcttccagggtgggggtggcgaacggttcgaattaaatctcgtggccaaggtcgaagccgctgcacaggcatcgctcgaccgacttttccccagcttcaaggatgccgatgacgaccgctggaccaacgtcatcagccgcgccaagaacggtgacgaggcggccctgtcggccgtggactggaccgacgctcctgaaaagcatctggtctgtgcggcagtgctcgctgaggtcggttcgggtaaacgtggaaaggaagtccgtgatgccttcggggccagtccctatggctggcctcgtgatgctgtggatgccgcgctcatcgtcctgcacgccaccggtcacatccgcgccacccacaagggcatgaccctctcacagggtcagcttgatcaggcaaagattcccgtgaccgacttccgggcggagacagccacgatcaacgccaaagaaaagatcaaacttcgcaagctgttccagacggcgggcgttgactgcaaacccaacgaagaaaccgccaaggccccggtatttctggctcgcctgtcagaactggccgagtgtgccggcggcgatccacccatgccagtccggccggcgacggtccatctggataccctccgcggcttcggcggtatcgaacaattggccggaatcctcaagcagcacgatacgctcgggcaacaggctggggactggagtaagctggctgaccttgccaacaagcgcaaacccgcctgggttactctctgcacgctcctcaagcatgccgaggccatccctggaaccgaagaaatccgcaggcaggccgacgcggtgaagtccgaacgccggctgctcgacaccagcgatcccgtgccggagatccgcaaggcggccgttgatgcgctccgtaccactgtcaccggagcctatgccgagtatgagaaaatttacaacgaacagatggccgctttgactggcagcgacaactggaaaaaactaaaggccgaacagcagaaacaaatccttgccgatgaaggtattgatggactgccactgctttccgtaggcaatgaaggagacctgatccggtcactggagcagacagcgcttccatcatggaagaccaagactgatgcattgccccaacagttcgcccgcgccgccatggcggcggcaaaactgttggagccaaagactcaacgcgtccacttgactagcagcacactcacaacggaacaggaagtaaaggcttggttggctggtacagagaaggacctgctggcaaagttaacaagcggtcccgtagttatttcctga

SEQ ID NO: 115 - DNA, 3567 bp, Tepidanaerobacter acetatoxydans; identical to SEQ ID NO: 10

SEQ ID NO: 116 - DNA, 3567 bp, Tepidanaerobacter sp.; identical to SEQ ID NO: 10

SEQ ID NO: 117 - DNA, 3612 bp, Thauera sp.
atgaagatcggcgacctttttaccaagcccatcaaccgccctataaacggggtgatcaaggccgaccagaaggacgccgagagcgtctggcaggagctcgacgagtacgtcgtcaccaagcagctcaccgagtatttccgccgcttcttcgacgcctacctggcagcggccgacaacccgaacgacccggtcctcgctgcgcgcatgggcgtctgggtgtccggcttcttcggttcgggcaagtcgcacttcatcaagatcctgtcctacctgctcgagaacctcgacgccaccaaccccgccaccggcgagaagaaacgcgccgctgccttcttcgacgagcacaagatcaaggattcgatgctgctcgccgacatccagcgcgcggtgcgcggcagtgccgatgtggtgctcttcaacatcgacgctaaggccgacagcaaggacgagcgcgacgtcatcctccaggtcttcctgcgcgtgttcaacgagaagctcggcttcagcgccgatgccccgcacatcgcccacatggaacgctacctggtggagaagggcgcgtatgacgccttccgtgcagccttcgccgaaagcaacggctccacctgggaggccgagcgcgatgcggtcgacttcctgcgcgacgacgtcgtgcatgcgctctcggtcgcgctcgggcaaagcgaggaatccgccggccaatggttcgaccgctcgcgcgacgagtaccgcatcaatatcgaatccttcgccaggctggtgaacgcctacctcgagacccggcccgccggccaccgcatcatcttcctggtcgacgaggtcggtcagttcatcggcgacaacaccaagctgatgctcaacctgcagaccatcaccgagcagctcggtaccgcgacgcagggtagggcgtgggtcatcgtcaccagccaggaagacatcgacgccgcgctcggcgaggccaacaaggccaagtcgcaggacttctccaagatccagggacgcttccacacccggttgtcgctcgccagctccaacaccgacgaggtcatcggcgagcgcctgctcgccaagcgcgagggcgcgcacgatgcgctgcgcgacaccttcgagaagtccggcgacatcatcaacaaccagctcgccttcgtcggcaactcggtgaacctgcgcggctacaaggacgccgccgagttcgtcagcgtctatccctacgccccctaccagttcaccctgctgcagaagatcttcgagtccatccgcaaggtcggcgccaccggcaagcacctgtcgcgcggcgagcgctcgctgctcgacgccttccagtccgccaccgttcgcaacatggaccgggacgtcggcctgctcatcccgctgtacgacttctacccctcgatcgagagcttcatcgacaccgtcgccaagcgctccatcgacgaggcgcccaacaacggcgcgctcgaagccttcgacgtgttgctgctcaaggccctgttcctgatccgctacatcgccgacatcgtcaaacccaacgtcgacaacctcgccacgctctgcgtcgatcgcatcgacaccgacaagctcgcgctcaaacgccagatccaggagagcctcggccggctcgagcagcagcgcctggtcagccgcaacggcgacctgtggttcttcctcaccaacgaagagcgcgacgtcgcgcgcgagatcggcaacgtcgaagtgtcttccgccgagaaggcccgcctgctgtgcgagctgctgttcgacgacatcctgcagggcagcacccgcatccgccaccgcgacaccaagggcgattacgacgtcaaccgcctgctcgacggcgccccgtacaagaacgccagccacgagctcagcgtcgaggtcgtctcgccgctgggcgacgactgggacgcgctcaacgatgcccgcgccgtcctgcgcagcagcgagggcaatggccgggcgctgatccgcctcgcagagggcgagcgcttcgacatcgagctcaccctctaccgccagatcgagaagtacatcgacagccccaaggccagcaacgccacgccttcgctgcgcaacatcctcatcaaccgcaaggacgaaaaccgcgagcgccgcgctcgcctgcgcgaacaactcgccaccatgatgctgcagggcgacttctacgccctcggccagcgcgtcgaactcaaggcgtccaaccccggtagcctgctcgacgagctgggcaactacctcatcaccaacacctataccaagctcggctacctcaagcaccgcaacgccgacccgatcgctgagatcaaggccgtcctgctcgccgacgacaccgcccaacgcaagctcgcgctcgggggcgaggagggcaacccgctcgcgctcgtcgaactgcgcgagtttctccagctcaaggccagcaacacccgggtgatcctggacgaggtggtcaaccgcttcaccggcatcccctggggctggaagcccgactgggaggttgtcctgctggtcgcgcgcctcttcatggccggcgagatcaagctgatgatggacagcgccgacctcgaacccaaggccgccatcgagccgctcaccaagtcggcgcgcttcaagcacgtgtcgatcctcaagcgcaaggtggccgacgccgccagcatcaagcgcgcgcgcgagctgcaccgcgacctctttgccgagatgccgcccgaggccgaggacggcctggtcgccgccacccgcgagcgcctggccgcgctgcaggccgacctcaagggctacgcccacgtcgccgccacgccgcatcaccccggcaaggccgtcatcgacagcgcgatcgccgccatcggcaagcagctcggggtggccgacagctacgaattcatcgacgccttcgtcaaggccaaggacgactggctggacctgtccgacgacatccacgacgtcatcagcttctacaagacccagacccccacctggcgccggctactcgaggctctggagcgcttcgagcccaaccgcgaagccctcgacaaggacgtcaaggccgccgtggcgctgtcgaacctcgaaggcatccgcgacaacccgaacccctggggtgccgtcagccagattgagccgctgatcaccacggtcgacgcggttaacgaggccctcgcccagagcaagcgcgagcacgcgttgctctccatcgacgccaagatcgccgaagtggaaaaggcgctcgacgccgcacaagcctcggacggcctgcgcaaccgcgcgctgctcaagctgcaggagctcaagaccaaggtcgttggcctcaccagcatcccgatgatcttctacagccaggagcgggcaggcgatgcgctggatgcggcgatgaccatgatcgagtccgccacgcccaaggcggccccgatcacggccgccgaaaagggcagcacgaccgctgccaccaagacaagcggtccggtcgttgcgcccaagccgaccaaggcggtccgcgcggccgatttcagccccaagacctacctggaaaccgaagcggacatcgacgcctacctcgccaagctcaaggccgaattgctcgccgtcatccaaagcggcgggcgtgctcggctgcaataa

SEQ ID NO: 118 - DNA, 3447 bp, Thermacetogenium phaeum
atgaagaaccgtgagatcttccagcgcgaccctgttgtttccaaattacccaatgacggtgttgccactgttgctgaagcggccacttctaaagagatggaaacccttcgctatgaactggagcattttgtttgcgaggggcagtataaagacggacttatacgcattctcgagtcttacttgagtaatgcggattcgacaagccagccagccgtttgggtaagtggtttttttggcagcggtaaatcgcatctattaaagatgctccgccatttatgggtcaacaccaaatttgagtctgatgggtcgactgcccgtgaattagcgcggctgccagtggaagtaaaagatttgcttaaagaattggacacgttagggaaaaggtgtggcgggcttcatgctgcggggggaacgctgccgtccggtggagggaaaagccttcgtctggccgttctcagcattatctttcgctcgaaaggcctgcccgagtctcttccccaagcccaattttgtctttggcttcaaaaaaatggcatctacggtcaggttaaaaaggctgtggaggattcgggcaaggacttttggcaggaactgcgccatttatatgccagtccggtaatagccacagcgctgttggaggctgaccctgattttgcctccgatctcaagcaggtacgagccactattcgtgcccagtttcccgctgtggacgatatttcgacatccgagttcatccagatcatacgcgatgtcctttctctgaacggtcagctcccctgcacagcgattgtgctcgacgaagtccaactcttcataggcgacagcgcagcccgttcctacgatgtgcaagaagtggcggaagccctatgcaagcagcttgatagccgcatactgcttataggggcaggtcagaccgcgctgagcggtaatctcccgcttctccagcgattgaaggatcgttttacgatacctgttgaactctcggatacggatgttgaaactgtgacccgccgggtggtgctggccaaaaaagcagataagcgtaaggccatcgaagaagtgttaactgcttacgccggtgaaattgaccggcatcttatcggtacgcgaattgctccccgaagtgaagaccggagcattatcgtcgaagactatccccttttacccgtccgccgccggttctgggagcatgtcctacgggccgtcgacgtttcaggaaccaggagccagcttcgtacgcaactccgtattgttcacgatgctgttcgggagattgctgaaaaacctgtggggacggtcgtgccggctgatttcatatttgaccagctccagccggacttgcttcgcacggggtttcttttacgggaaattgacgaaaccattcgtaatctggacgatggaactccggaaggtttgttagccaagcgaatttgcgcacttatattcctcatccgcaaactccctcgtgaaagcatcgttgatattggggtccgtgctaccgcggatatgttggcagatcttttggtaagcgacctggccaatgatggccctgtcctgcgcggagagattccacgggtcctcgagaaactggttgaggaaggaaagcttatcaagctggacgaggaatacagccttcagacccgagagagcagcgaatgggaccgggaattccgaaaccggcaaaccagactcaataatgatcttacggctttgtccagtaggcgttcggctctgttgaatgctgcttgtatggatattctaaacaatattaaattgtgccaggggaaatgcactgagcggcgcaagctggaaattcactttggcagcgagccgccaaaaacgcaaggcttcaaagtcccggtttggatccgcgacggctggggagaaaatgaaagtactgtcttggccgatgcacgggcggcaggtaatgacgacccgactattttcgtctatatcccgaaagaaagtgctgaagacttaaagaaagcgattattgaatatgaggcggctaaggccaccattgaattcaagggtacacccacaacagatgagggacgggatgctcgtgatgctatgtccacccgtatgaaagcggcagaggctgcccgggacagcattatccgggatgtgattaatgcggccagggtgtttcaaggcggggggcaagagcgttttgagttctccatcaaagaaaaagtgctggcagccgcagaagcatccttggaccgcctctttccgaacttccgggaagccgacgacgaccgctggccgattgttctcgatagggcaaagaacggcaacgaagacgccttccaggccgtaggctggaacgatgcgcccgaaaaacaccctgtctgttcagcaattctttccgcaatcggatccggcaagacagggaaggaaattcgcgaaacctttgaaaaagcaccttacggctggccgcgtgatgctattgacgctgctttgatcacgcttttcgccaccggacatctgcgcgctgtctataaaggtgcccagctagagcgcggtcaattggatcaggccaagattccggctaccgacttccgggtggaaacggtaaccatagatgcccgcagccgcatgaagctgcgcaagctctttcaaacggcaggccttcgctacaaggcgggggaggaatcttctgttgccgggcaatttcttgccaggcttatggatctggccgatcgtgccggcggcgatccgccactgcccgagcgtccatctaaggcccatttggaagcaatgcgggggctggccggtaatgaacagctggcagcgatactggaacagtttgacaccttagcccaacaactgcagaggtggtcagcattggcggacttggcggcaaagcgcaagcctgtctgggatagacttcagctcctgttaaaacacgcccatggcctccctgaaggagaagaactgcaaaaacaggccaatgctgtgtgctctgaacgtcgcttgttagaggaacccgatccggttccggacatttacagggcagccgttaaagcgctccgcagcgctgtcaggcaggcttataacaactttgaggcggtatataaccgggagaaagcagctctcgagggtaatgagaactggcagaagctatctccggaacggcagcaacaaattcttgcggctgaaggtattgccagcgttccccaactttccgtagaagatgatgaatccttgcttcgaagtctccaggaggcccctctgtccagctggaaaaccaggacggatgcccttcctcagcagtttagcaatgctgccatggcggctgccaagctgcttgagccaaaaacgcaaaaggtaaaactgaccagcagcattctgaggacagaaaatgatgttaaagcctgggtggctgaaattgagagagagcttctagaaaggattaagagcggccccattgtgatctcgtag

SEQ ID NO: 119 - DNA, 3561 bp, Thermoanaerobacterium thermosaccharolyticum
atgcgtataaaagaaatgttttataaaccaatagacagggatatcaagggagttattaaggttggccagggcgatgacagcaatgtataccaggagcttgaagaatatgtcgtcacaagggaactggcaaagcactttaacgatttttttgaagcatataaaaagagtattgtaggtactaccgacaaaatgggggtatggatttctggattttttggaagcggtaaatcccactttctcaaaatactctcttatctccttgaaaacaaagaagtcaatggaaagaaggcaattgaatacttcaaagacaaaatccaggacagtatggttctggccgatatgaaattggcaggggatacgtctgccgatgtgattctctttaacatcgattccaagagcgattctgactctaaggccaacaaggatgccattgtcaaagtgttcaataaggtatttaacgaaatgcagggtttttgcggttccatgccgtggatagcagacttagagcgacaaatggtaatggatggcgtttatgaggattttaaaaaaacattcaaagaaatatcgggaagagagtggcaagatgcaagggaagatttttactatgaggaagatgccattgttgaagccctttcaaagagtaccaaaatgagtatcgaggcagcgcggaactggtatgcgaaagccgaggaaaattatacattaagcgttgagaagtttgccagaagggtaagggagtatattgaaaggaaaggaaaaaaccatcatgttattttcctggtagacgaaatcggacaatatatcggagataactcccagttgatgctcaatctccaaaccgttgttgaggatctgggaacggaatgcggcggcaaggcctgggtcattgtgacaagccagcaggatattgactctgttacaaaagtaaaaggcaatgacttttcaaagatacagggtaggtttaatactcgtttaagcctttccagcgccaatgttgatgaggtaatcagaaaaaggatacttcttaaaaacgatgtggcgaaggatacattaaaactcctttatgagaataaaaatgccatacttaaaaaccttattaccttttcagcagacactccagagaaaaagatatataaagacagtgaggattttgtagagtgctatccatttataccatatcagtttaatctattgcagcaagtattgacttctattaggatacatggtgcgtcaggcaagcatctggcagaaggtgagcgttctatgattagttccttccaggaatctgctatcaaatatatgaaccatgaagaaggagccctcatacccttttcagccttttatgacaccattgaagccttccttgattctaatataaggacggttattatccatgctcaggagaacggaaatctgaatgactttgatgtagaacttttgaaagttctttttatgattaaatatgttaaggaaatacctgcaaatatagaaaatctggctacccttatggtaagccatattgacgaagataagatagaccttaaaaagaaaatagaggattctctaaagagactgataaaggaaacacttgttcaaaaaaacggggaccaatatatctttcttacccatgaggaacaggatatcaacagagagataaagaatatcagtgtagatttgggagaggttatacagaaagtatctgaaatcatctttgaagaaatctatatcgataaaaagtataaatattcctcaagatacaactttagttttaaccaggttgtagacgatagattcttcaggggcaatcaaggaaatgacataggccttaaaattattaccccctattatgatacgggagtagaacttacagataatgaacttaaactaatgtctgcaagggaaaacaacttaattgttaaacttcccaatgatactgcttttctcgacgaaatggaggaagtattgaaaattgaaaccttcctgcgtagaaagggaggcacttcccttactcagaaaattgaagaaatcaaggatagaaaaagaagggaactggtagaacgtaaggagagggtaaaatttcttctgatcgaagccatcaggaatgcggatatgtatgccaattcccagaggcttgaaattaaggaaaagcatcctgttgataggataaatgacggctttaaggtgcttatcgaagggatttatacgaaacttggctatattacctactttaccaccactaaggacttgtacgatatatttgccgataatgaacagattgcattaaatggtgtggaatccccaaataaacttgcccttgatgaaatggcaggctatatagaaagaaatactacaagaagtatacctgtgaccatgaaaacaatccttggcatatatggaaaagccccttatggatggcttgaggaggatattgaatggctggttgccaaactatttaaggcacaggaagtgaaactgcaattaaacagccagtacctcgatgttcaggacagggagattgtcaaatacctgactaagagggattatgccgacaggctccttattgaaaaaaggataaaggtacctgcacaccagattaacaatgccagagaactgtgcaaggaactgttcaatattactgctgtcccttctgatgaggacggactcatgaagaggttcaaagacctggcaagggatgaaatagcaaaaataaatgaattgctagtgtactacaaacagtccaaataccctggacaggatattttacaggaaggtaaggaagctttggagaagatttgtaaaatccatgatgccagggagttttacgatgaacttcaaagagagaaagatgtactgctggactatgccgatgattccatagatgttaagaagttttttggcagcaaccagaaggagttctttgataaggctgtccacaagataaatgtgtacaacagcaacaagacctatgtattggacaaggaagtcatagaccttattgaacagatgaaaaagattgtagaaagcaaggagccgtattccgatatccataaactgcccagccttatagataaatttgtagccaggtttacagaacttctggaagaggaatgcaagcctgtaaggcaggtaatagagagtgattataacaaggttcttgaggaattgaacaagtacgaattcaaatctgaactttttgacaggttcaaaggtagatttgatgatcttttaagcaggctggaccacgccaataacttctacgaagccatagcaatgaaagaggaaagcgacaggctcaagttaaggtgctttgatgaaattgctgcggaaatcgcaaaaaggaagcctgtcgaacctcaaataacacatgaagaaccaggtaagccaacagttgtaaaagatccgccaaagcagtataagaaaacagtaaatatcagtattgccaatatcctgcatggagcaaaaagcattgaaagtgaatcggacatagaggatgttgtaaatgaaataaggaacaggttaaaaagcgagttaaaagatggcgtcattattaaacttgtataa

SEQ ID NO: 120 - DNA, 3621 bp, Thiocystis violascens
atggacattcgcgatcttttcgtctctgacgtcaccagagacattccgccggtcgtctatttccacgagcagagtcccgagaagctcgccgccgaagtttccgagtacatcatcaccggcggttggcccgaggatcaccccaatcatcgacgtgttccggatggcatccacgagcaatacgtccgtctgctgacccacatcgtctccgagctggacaagcccggtggcccagagctgccgaacgtctggtgcgctggcttctacgggtcgggcaagtcgagcttcgccaagctgctgggtctctcgctcgacggcgtggtcctaccagacgggacctcccttgccgagggttggctacgccgggacacctcgccccgggccgccgagctgcgctctgcgtggcaggcgctgcgtcaacgaatcgaccccatcgccgtggtcttcgacatcggtggcacggcgcgcgacaacgagcacatccacgcggccgccgtgcgtcagctccagaagcggctcgggtattgcgccaccgaggcactcgtcgccgacttcgagctgcggctcgagcgtgacggtgagtgggcgcgtttcgagcgcgcggccgaagaggtgctgagacatccatggtccgaggtcaaggacaaagccctagcggaggaggacttctcgctcgtcctctcggtcctctatcccgagcgctataccgatcccatgagctggttcaccagccgcgggggcacccatcagcgtgccgagtcccccgaggagtccgtcgccgccatccgggacatgctccgcttccgacgtcccggcgcgacgctcttcttggtgatcgacgaggtctcgcaatatgtcctcgccagcaaggatcgcgtcgaccggctgcgcgccttcgccaccgcgctaggcgcgaccctcaaggggcaggcctggctgatggcgctcggccagcagaagctggacgaggaggccgacgattccttcctggtctgggccaaggaccgctttccgcccaagctgcgggtgcatctggcggcgaccaatatccgcgacgtcgtgcacaagcgcttgttgcacaagaggcccgaggtcgagcccgtcctgcgcgagctcttcgagcgtcatcgccccgatctcaaactctatgcctatggctgcgagactgtcagcgcggatgacttcgtcgagtgctatccgctgcttcccgcccaaatcgacctgattctgcagctcaccaccgcgttgcgaacccgctcggcccgcgctcagggcgatgatcaggccatccgtgggctgctgcaattgctcggcgagctgtttcgcgatcagaagcttgccgatcactccgtcggggcgctggtgacactcgaccagatctatgccgtccagcacaccgcactcgactcggatgttcaggcgaccatggcgcgcatcctcggccaatgtagcgcggacgccgatgccttactggtgcgtgccgccaaggccgtcgccctcctggagctgatccaggagaccatgcccacggacgcccgattggtcgcccaatgtctctacgaccgtctcgatcgcggcaaccagctcgcgaaggtcactgaggcgctggaagagctgcgccggcgtaacctgctgggatactcggagaagcagggctacaagctgcaatcatcggccggggaggaatgggagcgcgagcggcgcgacatcggtgtggcccgcgagacactgaccgcgatcgtgcaggaaggactcaagtacctgctgtccgagccggagcgcccccgtctgcagggtcgtccattcccctgggccgctgttttctccgatggtcgccgcgccgatgacctgaccctgatcgacccgcgcgacgaggcggccttgcgcgtcgattgccgcttcctggccagcgaagagcggaccgaaagcacctgggtgcgtcgcagcgccgagtcatcgctggcggatcgcctgatctgggtcgctggcgagagcgagatggtcgagcagttgtcccgagagcttcatcgctcgcgcgccatggccagtaagtatgagccgcgtcgggaatcattgagcggcgcgcgcaaactgctcttgcagcaggaaaagaatcggatcgaagacatcgagacacgggtacgcgaggccatcgcggtggcctggatggcggggcgcctttacttccgtgggcgcgcgctgtcccctatggatcagggcggcagcttcgggactgcggtcaacggcgccgcgaccctgatcctccccgagctctatccgcacttcatcgctacccagattctgcccgccgaactcatgcccctgatcgcagccgagctggccgggccatcgcctaagtttctccccggtgagctggggatcctcgagctcgattccggacgttatgtcccggcctgcagcggtgtcgtcccgctgcgcgttcaggagcgcatcgagtccgagggcggtctggcggggacctccttgctcgcctggtttggcgggccgccatacggctataccgtcaacgtcgtcaaggcgtgcgtcacgggcttgttgcgtgccggcaaggtgcggatccagcccgagggcggcaatgagatcaccgccatccgcgatgccggggtgcgcgacctcttcgagaaagaccgagcctttcgccgcgccaccttctttccggccggcgaggacgatatcggcttcagtgcgcgggcgcgcatctgtaagttcttcgaggagcggctccagcatcggatggaacgcgaggatcatgcgatcgccgatgccgtcggccagtatttccccgccctggcccaacagcagcgagccgtcctgacgaatctggaccggttgcctggcgagcgccgtgattcggatctgctgcgcaacctgggcgaggcactggaacagtgcgtcagtgtctgtcgccagaccaagccgaccgtcaaactggtcaagaaatggctcgacgtcctgagcgacggcgtgcaacagctccagatgctcgccgccgagctgacttcggacgccatccaggcggtcagcgcgctgcatcaggtcttgaccgtccaggccgcacagctcgccgagatcggcagcctgacgccagagatcgaggccgtcatggggcggctgaccgatcagctcgccgccgagcgtccctggcgtgacatcgccgcgttggagcccgatctggagacgattcgatcggcctatcgtgccgaacgtgagcgccttctacaatggcaggagcagcacgccgagcaggcgcgagcgcggatcaaatcgcgcatgggcttcagtaccctcaccgccgaccagtctcaccgtgtgctgcgattcctgacgcgcgccgtgaccgacactgccgccgaggccgtggcgcccaccctgagccaactccaggatcccttcctgctggccttgcagcgagccgaggaagatgccgacgacgccctcgacgagatcctgagcgaaggtgcgcggcccttgttcaagcgtgtcgatctgcggctgcgcaaccgtgagctgaccagcgaggccgaggtcgatgcgctgctcagcgagatccgggcgcagcttctggagcaattgcacgccggagcacgggtgcgtctgctgtag

SEQ ID NO: 121 - DNA, 3630 bp, Thioflavicoccus mobilis
atgaccatcagaacgctcttcgatcccagccgccagatcgaccggcgcatcgagaaggtgatccagtacgacgcgatggctccggacctgctccggcaggagatcgccgagtatcaggtcaccgagaagatgacctcggagcttgagaagctgctcgacgccatcgacatcgggatgggcgaggggagcccagaggtcggcgtctgggtctccggcttctatggctctggcaagagctcgttcaccaagtacctcggcttcgccctcgacgatcataaccagatcgacggcaagccctttctgaatgccctccaggatcgcatcgggagcaccacccttcgccagcgcctggccacggtcgccagccgccaccgacccgcggtcatcatgctggatctcgccagcgagatgcttgccggcgccagcatggccgagatctcgacggtcctctacgtcaaggtcatgcaatgggccggctactcgcgggatcgcaaggtcgcctacctggagctgatgctggagcgagacggcaagctcgatgccttcaaggaaaagatcgcccaagtcgtgcccggcatgacctgggagcagatcaagaatcagcccctggtcgccaatcagctcgcctcccagcttgccgccgagctctatcccgccgtctatccgactcccaagagcttccatgaccagaggctcgacgaggtcatcaaggtggacgatcaggcccgcgagatggtcgagctggcccgtcgtcgctccggccgcgagaacgtcatcttcatcctcgacgaggttggccagtacgtcgccgcccgggatgccctgatcctcgacctcgacggcctggcgaagaatctcaaggccatcggcgggggcaaggtctggctcatcgccacggcccagcagaccctcaccgaggacgacccgcgcgcccagatcaacaccccgaagctcttcaagcttcaggcgcggtttcccgttccggtggacctcgatgccagcgacatccgggagatctgttatctgcgtctgctcggcaaggccgctgccggaaaggctcagctggaggcgcgctacgatcagctgggccagcagctgcgcttcaacacccagcttcacaacacccgctactaccaacgggacctcgacaagcaggcattctgtcggctctaccctttcctaccacagcacttcgacatcctcctggagctgctcggccgcctcgccaagaccatgggtgggattgggctgcgctccgcgatcaaggtcatccaggacgtgctgatcagtccggagtccccggccggtcccctcgcggaccagcccatcgggaccctggcgacgacggtcaccttctacgatgcgttgcgccgggacatccagacgtcgttccgacagctcgtcgaggcaatcgacaaggtggttcgcgtcttcggcgccgacagcgccgaggcgcgggttgccaagaccatcgccatcctccaggtgctcgatgacttcccagtcagtcgcgagaacatcgccgcactgctgcacccgagggacgacgccccgtcgcagctcgatgccgtggagcaggcggtcaatgcgctgatggacgaggagacgatcccgctggccgagatcgatggcaacctccgcttcatgagcgaggcggtcaccgagctggagcagcagcgtcgcggactcatcccgatccttgccgagcgcaaccgcatccagaacgacctgctcaaggagctgttcacgccgccgcccaaggccaatctgcacaacacgcgcgccgtccactgcggtatccgcacccagggagttgccggcccggtctcgatcgccggcgacaaagaggagctacagctccttgtggaattcgtttccgagggcgagatcgaatcgcagaagggcacccgcgttgccgactctacccagtccgccgagcgcaacactctgttcctgatcggcatcgagcccaaggggctgcaacagcagatcgaggagatctaccggggcgaggagatctttgcccagtaccgcaacaagaccgtcgagaaggagatcggcgagtacctcaacggccaacagcaacgggccgagaacctgcgtggagagctggccgccaggctgcgcaaggggctggagcaaggcagtttcgtcttccagggtcgcccccatgccgtcgcgagtctggggtcgaatctggaggaggcagcaaaacggcaactggaagaggcggcgaaggtggtcttccacaagtacgccgaggccccgatccaggccgagtccgcactggccgagcgcttcctcaagaccgatcgccttgaccggatcgagagcaggaacgatcccctctcgctcgtgaccgcgacgggtcagatcaaggtcacacatcccgcccttaagaccgtcgtcgatctgctgaggcatatcggccgggaggaaggccgggtgctgctcgacaagctcaaccgtgcaccctacggctggtccaaggacaccctgcgctacctcgttgcggcactcctggtgggtggcaagatcaagctgcgggtcagcggcgaggacatcaccgtgcgcggcccgaccgccatcgacgcgctcaagaccaacgcggccttcaatcgggtcgggatcgacctgcgcgacggtgccgtcgatcccgagagcctgctgcgttcggcggagcgcatcctggagctgaccggcgaggacgttctgcctctggaggccgaagtcagcaaggtggtcacgcgccgattccctgacctgcaacgcgactatgcctatctcgcctccgagctgcgcaatctggggctggcgggcgccgaaacggccgagagcatccaggacagcctctcggaaatcctaaagggcgacgcctcggatgccgccgcgcgactcggtcccgaggagtgcccgctgttcaaggacctgctctgggcgcgggacctcgacaaggcactgaaaggccacctgcctgccatcgtgcggcgagcgagccgctacatcgaggccatccccaagctgcccgcggtcggccccctggccgccctccaggccgaggtcctggaggatctcgccggtcttcgggaagtcttcgcgcagaccgacttcttcaccaaggcgccggacatccagagccgggtatccagcgtcgagaaggcgatcgaaaccgcagcaacctccctggtcgccgagtacaacgccgacctggagtcggagaagcagcgcctggagcagtcgccgaactggccccgcatcggtggcgacaaccaggaggccttcgccgcgcagctcgatgccctccagctcgctgtcgagccgagcctagacggtatccgcgcctgcctcgatgcccgctatcccctccagcagcgcgtggcggagatcgcccaggccatcgcgcgcatcgtggaggagcagactcgccaggcgtctcaagatgatgccgaggacatcgatacgcaggttgggggcggcacagaaggcaccggcccaaaggccctggttgtggccgatttttcgtttcccgcagagatcgcatctcgtgagcagctcgaagatctgatccagcgcctggaggcactgcgagccgagttgacgcgttactccaagatcgtcttcaagccatga

SEQ ID NO: 122 - DNA, 3678 bp, Vibrio cholerae
atgaaaattgaacagattttttccaagaagttgacgcgtgacattaatggcgttgttaaagcggaacagaaagacaatgacagtgtgtatgtcgaacttgatgagtatgttgtaacccgagagctagatcgacattttcgcgctttctttgaggcttacgttccatctgtgacgcaaagtggcgcatcaatgtcaggaaaaattggtgtgtggatctctggcttctttggttcgggtaagtctcacttcctgaaaattttgtcttacctcctcgaaaataagtctgtcgaaaaggatggccaaggccgtcaagcatttgagttttttaaagacaaaatcaacgatgccatgctgttggccgatatccaaaacgctgttaccaaagatacagacgttattctttttaacatcgattcacgagccaatacggatgaccgagaaaatgccattcttaaggtcttcctcaaagtctttaatgagcgtgtaggatactgcgctgattttcctcatattgcgcacttagaacgcgagcttgataagcgtaatcaatacatgtctttcaaggacaaatttgctgagttgactcaatcaacttgggaaaaggagcgtgacgcctatgacttctatcgagacgaactttcagaagcactcgctcatgccagtgagcaatcattagagtctgccaaagcgtgggttgaacaggttgaaaacaatttcccgctagatatccgaaacttctgtaagtgggttaatgaatacttagatcgaactggggatcgtaaccttcttttcttagtcgatgaggtcggtcagtttatcggtaagaacacgcaaatgatgttgaagcttcagaccattactgaagatcttggcacatattgtggtggcagagcttgggtcgttgttacctctcaggcagacattgatgctgccattggtggtatggataagcgcgatggcgaggacttctctaaaattcaagggcgttttagtacccgcttacagctgtcgagctcgaatacctcggaagttattcaaaagcgtttgttgtccaaaacggaagaagctcgtacacacctcatcgatgtctttgctgaaaagggcgacattcttcgtaaccagctgacatttgataaaacgacaaccgcgtctctaaagggctacaccgacgctccgtctttcgtggacaactatccgtttgtaccttaccactacacgctggttcaaaaagtgtttgagtcaattcgaacaaaaggcgcgacgggtaagcacttagccatgggtgagcgttcattacttgatgctttccaatcagctgcaaaacagatgaaggactctggccttgatgtgttaatcccgttttacagtttctatgcaccgattgaaagctttttggagccagcggttaagcgaacgattgaccaagcctgtgagttggattccttaacagaattcgatggcaagattctaaaaactcttttcttgatccgttatgtggacgttgtcaaaagcacactagacaaccttgtgacgctgtcaattgatcgaatcgatgcagataaaattgcgctgcgtaaacaaattgaagagagcttgaatcgtcttgaacgccaattgctgattgcccgtaatggtgatgaatttatcttcctgaccaacgaagaaaaagagatcgagaacgagatccgccacactgacgttgaaatgtcagaggtctctaacaagctttcagcaatcgtatttgacggtattttgaaaggtaatcgtgcctatcgatacccgattaataagcaagactttgcggtgagccgtttttgcaatggtcatccaaaagatggcaccacgctggaagacctagtcattaaagtcatttcacctttggattcgcactttgaaaattactcccacgatcaagcgtgcatcaatcatacgcttgaggctgatgggtgcgtgctcgtcaagctgggcgaacataagcgtctttgggatgacctgacaacctttattaaaactgaccgattcttaaaacaaaattcaggacagcgaccagagcaagaacaccttctccgcgaaaagcagatggaaaatattgagcgtgaaaagcgcttaagaacggattttgaagctttgtttgcagaggctgacgtttacgctatcggcacaaaactaccgaagaaatcagcaacgccaagtgccatcgtcgaagaagcatacaaatacgttatcgaaaacaccttcgctaaattgaatatgctcaaggcaacgcctggtgaagttttgcgtgagctacaggccgttcttgttgctgatgatattgctcagattggactggatcttcaagcggatgaatgtaacccagaagctacgcgtgaggttgagcagtacgtaacgctaaaagtcgagcgtaatgagcctgtgtacctacgtgacatcgttgcccgcttcggcaagcgcccatatggctggccagacaatgaaatcttattgctcactgcaaggctgggcttggctggaaaggtatcttttagtacccaaggcacagatctggcgttgaaaaaagcttacgagccgtttaccagtgtgcgtaaacgcggcgagatccgtgtacataagatcaggcaacatgacgagcgccaaattaaaaaggctgctggtcttgttaaagagatcttttcaaaaacctttaccggctctggtgaaaaggagctctacgaattagtgcgcgatgaattactggcttggaatgaagagcttaaatcattcagaaccaagtcacagacaggccatttcccaggtaaatctcaaattgacgatggtcttgcattggtcgcgggtattcttgagcaaacttcaagcttcgcccttatcgcccgattcttagaagacgctgatgcccttgaagagtttgctgaggactttgaggatcttgatgacttctacaatagccaatttcaaacttggcaagcccttgctggcgcattaaacgagaagtttaaggccaatagacccgcgttagaaaaagacagtgaagcgttaaaagcgctcactgaattagaacgcatttacaatatgccctcaccgtatgagcagctgcgccacattaatccgcttatcgagcaggtggcaaaagttaacacaacattggttgaagaaaaacgcactcatgccttagagcgtgttgatctgcgcatcggacgtgtaaaagaagcgctagctgaagctcatgcaccgtctgaactacagaaccaagcactgcgcccgttacaaatgtgcagacagcgcattgaagcaacctcttcaataccacaaattatcagtgagcaaactgaagcggaaggttacgaggacgaagcttatgagttgctgaatggctttatcgaagatcaacgcaaaaaagctgaagctgagcaaagacgtcgtgaactcgaacagaagaaacgcgaagaggaagcagcgaaagccggtaaggcagctccagcacctgagccagcccctgaaccagtgcagccacagccggttgcaaaacgtaccgtaacgattaacccaaccgatgccatggctaagtcagtaacaaccggattcattgaaagtgaagccgaagttgatgcctatcttgccgctttaagagagcagctgattgctgcggtcaaagctggcgaccgagtaagaattaagtaa

SEQ ID NO: 123 - DNA, 3690 bp, Vibrio cholerae
atgacaatcataaatgacatactaacgttagatcttaaagaagatattaaaaacgttattgaccttgaagaccgttcagagacagaaattcaacacgaaatcgagtcatacatcgtaaccgaaggtattgggcggcacctctacgaatttacaaaccaattcacctctaatattaaagagacaggggtttggttatcaggtttttatggctctggtaagtcatatttcggaaagatgctgggttatataatagataaccagattataaatggtactcctgcacgtgagcgttttataccacgcttaaaaggtgtaagtgatgcaggtcttattgaaaacgccctacgtaatcttgacgcaattaacagccgcgtagtgttccttgatgttgctaagcaaaatactgaacgtggattggctttcaccttgtttgctaatctgcttaaaaatcttggttttcgtgatgatatttacggttatatggagtttgatctgctcctagatggtaaatacgacgagtttaaatccattgtccaaaaactagagtcgaaggattgggatgagctaaagaaaagtaatcggcatgtcgctagagttatgcgaaaggtcttttcagaaatgggctacagcgagtcagattatgaagatactaaaagcgtctacagtgcttcaatagaggatttttctgccagtaaatttaagacggaactggaaaaataccttaagtttaattcagaagaaacactggtctttgttttcgacgaggcgagtgaggctattagccaaaagaaatttacccttttagatttagaagggattagtgaatcactatcgagtataagtaataaagtttggaccatagcgattgcacaagaaaagctcgacgacgtgattaacaatgctaacgttagtcgcagtagtttgaccaaggttactgatcgttttaaaaccaagattcaccttgagtctacagaagtagacgttatcattcgtagtcgattacttcaaaaaacagaacaggcaaaacaagatttagttgcttattaccaaaagaatgaaggcctaatcagcgacgccaccaacctgaagtcatcgttccctacgaaaacggaaacagctgaagattttgcggtctattatcctttccacaaatatcaattcgatattttgcaaaagttcttgtttagctcaaacgctttagttgctacccaaattgcagctcgaggcatgattatcacaacatttgacgtactacgtaagcaaatgcgtgacaaagagctgtatagctttacgccagggttcgcgatatgtgatgaagcccaaaccgcaccgccagttggattggtcaacaaatacgatactagccgcaaaatattaaaagaaaatggcagcagcattgacggcgagaaactgctcaaaaccatgcatctattagccgactctgaagtagtagctccaacggttgaaaatataaccaaaagctacattacggacatcacgtcgtactatgaagtaaaaccagcaattgaagacgcgcttaagctactgcttgaagcaaaagtactactactatcaaacaacaactacaaaattacctcagatcttgaaggcaaactgctcgaagaaatgaaagattttgatgtcgaacttttcagcaagaagcgtgagttaattaagtatttgaaggactacaaaacctttaacgcagttgcatcctacaatgatggcagtgatgcattcaaatttagcgtgctgtcagaccaagacgatgagttagcacctgtaggaagcaaacacttaaagatcacagcctatagcttgttcaatatcagtgatgatcgtcaggattttattgaacaactgaagcttgatactcagtatcagaaagagcttattaccttggtgccagatacttcagagttctcccagattgataaattgataggcgaagttatgcgctacgcctacatggaggaaaaatactcgaatgaaaaagatgccgataagcgtcaaattattcgtgaatttgaagttatacgagaagagaagcaacgaactttaagagggctaattcaagacgcatatcacaatgcatccctgatctacatgttcgacgagcatctgttgaacgttgatacatttaagggaaccattgccgacaaccagcgaaaaatggtgaaaaacatctacaccaagcgtttatcaagtcaactttctgatagcctggtctcgaagattttcagcacacataaagaaagcctgaataagttatttaccgctaatgattttgcattcttcgacggtcacggcaattttactggcgatcaccttaaaattgttgaagaaatcaatgctaagataaagtcgcgctatatggatggtaaatctctagaagctgacttgtcaggtgctccatggggctatagctacggaacattagtaacgactcttgcagtactattccgtgccggtcgactatcggttaagtttaacggcgacacctatttttctcatgagcaaaaagcggttcacgatgcctttacgaataccaccaagtttaaatctgcgtcgttcaaatcgattactgcaacgctaaccgctgtgcagaagaaccaggcagtacaactactgatggaactcgaaacacaggaccatatcggcaaaaaggtagattggaatacaaacgattttgacttggctgacagtattcgtttgatggctgaacattttatcagtgccattaccaacctgagtgatactgttcaagattttgaagaactattccccaaagtggtaggtttaaaacaagacttgcaaggttttgcgggtaaagttaccgagagtaactatatcgaaaaggttgagtatctacttaataacagcgatacgttcagcgatgcggttcaagccatattaaaagctcagaaattcattaaaaagaactttccaaaagttaaagaatttaagcgctttattgacgatgttcgaagcgagctgattaaagctgatcgcagtgacaataacattgatgaagcctatgaagaattcgagcgcttattcaaacaggatctggtgaaaaactttgccaatctccagcaacaagtacaagttgtaaaagatgcttattacaagttagttaagacagcatctataggtatgagtcacgagtacaaggtcctgagcggtaaaattgaggctgcttttcgtgaacttaagaactaccccgcggcgccgaaccgattaaatcagcaaaagcttgatgccttaaaagcctacgcagaaaaacgagtagttggtgaaccagtacttgcgttcagcattagttgctcaaatagtggtttttctctctccgatattttgaattacacagctcaagcaccgctaaaagatagcgagctgcttatcgtgcaaagtagttttatcacagaagagccacagcccgagcctgtacccacaccgcagcctacacctaatcgtggtcccgatggtggcgagcctgcaccagccccgactccagttcaatcaccagcaccgaaacaaccccgcaaagttgcttttaaagtttctagtaaggtgatgacagtgcaagagtataaaaccttgctgactacgcagctaacggcgcttgctgcggccaagcccgatgaagaaatcgaactaactgtagatattaatagcgaaggactgtaa

SEQ ID NO: 124 - DNA, 3540 bp, Zymomonas mobilis
atggctactcttctacgtgatatctttgccaaaaaagtcgaccgttcaatcgatggggtgatcaaggctgacgacaaggccagcctcctgaccgagctcgatgaatatgtcattaccaacgagatcggcgcccggctggagcagttcctcgacgcctacaacaattacgataccgcgaacggcgtctggatttcgggcttcttcgggtcaggtaagtctcacctgctgaagatgctcgcccttctgctggagaacgacgaggttgagggccagcgcgccgtcggaatctttgagcgaaagctcgcggacaacccgatgctggcgggggctttgcgaaaggcagtgtcgattccatcccggtcggtcttgttcaatatcgaccagaaggcggatgtgatctcgaagacggatgttgatgcgcttctggccgtcttccaaaaggtctttgacgagatgtgcggctattacggcaagctcccgcatatcgcgcagttcgagcgtgatctggatagccgtggcaaacttgatgccttcaaggcggcgtttgcgcagtcttccggtaagccctgggagcgcgggcgcgaacaggctctgatggaaggcaggcatattgcggccgcctttgcggaggtcacgggcgatgaggtcaaggatattcttggccagtatcgcaaggacacgaaggtctcgatcgaagatttcgccaacatggtgaaatcgtggatcgatgcgcaggggccaaaattccgactgaacttcttcgtcgatgaggtggggcagtatatcgccgacaacgtcaaactgatgacgaacctgcagaccattgccgaaagcctgaacacgaagtgcaaagggcaggcctggattgttgtcaccgctcagcaggacatgggttcggtcatcggcgatctgacggcgcagcaggagaatgacttctcgaaaatccaggcgcgcttcgccaatcggatgccgctgaactcccaggatgtggccgaagtcattcagcgccgtcttctggccaagaccgaggccggtcagatcacccttggcaatctttatgatgctgaggaaaacaacctgcgcactctgttcgattttggagataattccttcaagttcaggaacttctccggaaaagaccagttcgtcgcgagctatccgttcccgaactaccagtatgacctgttccagcgcgcgatcatgggcctctcgcagcataacgcgtttgagggcaagcacagttcggtcggcgaacgctctatgctgggggtgtttcaggaggtggccaaaaagctggccgacacgccggttggggggctggcgacctttgacctgatgtttgaggggattcgcaccgccctgaaatcatcggttcagcagtcaatccaactggctgaaaagaaccttggcgatgattttgccgtgcgggtgctgaaggtgttgttccttgtcaaatacgtcaaggaattcaaaccgactgcccgcaacatatcgatcctcctgctgtcccggttcgaggcggaccagacggagcagcgtcgcaatattgaagaggctttgtcgcttctggaacgccagacgctgattcagcgcaacggtgaggtctatgaattcctcaccaatgaggaaaaggacgtcgaggccgagatcaaggcaatcgccgtcgatcccgccgagatagaacggcagctcgatgaactggcgttcggcgcgatcctccgtcacggcaagatcaagcatgccggcacgggcgtcgattacgctttcacccgcaagcttgacggccacagcctgaaccgggaacatgagctttccgtcaatatcatctcgccgttcagcgacgattccgacgcaccggatgtggttcgttcgaacagcatggcaagcgatgagatgattgtcctactcgggcgtgatgtgcgttttacgcgcgatctcgtcctctggctccagaccgtaaaatttgcgcgtcaggtcaccagcggcgacgcccaacccggtcgtgatcgtatcattgcggagaagcgtgaccagaatacgcggcgcgaaaaggaactggtgcagcggctgcgcggcctgatcgcggatgctcgactcttcgtgcgcggtgccgagctggagatcggcggcgaagatccacaggatcggctggtcaaaggtttccaggtcttggtggacaaggtctataccagcctgcctgtcctgcgcggcgccacttacaccgaagcagatcttgggcgagccggacgcgtcgatggcgggcttttcggcggcgaaggcagcggtctgaccgaagccgagcaggacgtgctgaatcatgctcaggctcagatgcgccttgggacgcgggtctcggtcaaagctttggtcgagaagttcggagcaaaaccttatggctggcccgccatcgcggttctctgcctgaccgcgagccttgtcgcgcgcggcaagcttgaggctcgggccgacagtgctttgctggaaggggatgcgctggtgcaggggctgcgcaacagtcatgcccttggcaatattctgctttccccgcagatcgagttcactgctgcccagatccgcaaatcccgcgaactgtttcaggaactgttcgatcttccagcctctggcaatgacgcgcgcagtctgggtgcggagtggcagacgcaactgcgcaagctgctcggcgatgtcgagcaggagagtcgcgccattgcagcctatccctttgccgccgccctcgatcccctgcgcaccatgctggatgggatgcgcgaccagtcggcgacctggttcatcaccggcccgatcgggcaggaagaccagcttcttgatgcaaaagaggatgtcttcgacaaagtccgcagcttcatgcgcgggccgcaaaaagccatctgcgatgaagtgcgctctttcctgaccaagcaggatcagaaccttggctattccgaaggtgctgccgccgacaaactgcgtcaggttcttgaggatccgcagtgctacaagggcaccgcaattcaggaactgaaagcggatttttacgccctgaaggagcgtatcgagcaaaccgttctggctgagcgcaccgctgtcatcacagcgattgacgaggttgctgaaaaagtcgcccagacttcggagtttggcgctctgccgcccgaacagcaggcgcgcatccgcgaagagcttgtatcgcggaaatcaggccttgccgcacagagcctgatcccggccttgcgccatctggtgactgaagtgcgttccaatcttctggcagacacgctgacgcgcattgctgaactgacacctgcaccagctccgacgcctgcgccccagcccgaaccttccggtggcgtggctgaagctccatccgcgccatatgtgcagccggcaccggccaagcctcaatatatcaaggcgcagtcgatcaccgtccccttcgcgaaaacctatctcgaagatgaggacgatgtgacccgctacctcgacgagatgaaaaagaccctgttggccgagatcggcgcgggtaagaaagtgattgtctga

SEQ ID NO: 125 - DNA, 2385 bp, Magnetospirillum magneticum
atgggggggaatatgctgatccgtgaactcttcgagaagaagattgaccgccccatcaatggcgtcatcaaggccgaccaaaccgatgatgcatcgaagtggcaggaactcgatgagtacgtgatcacccgcgaactcgataagcacctgcatggtttctttaattcatatctgaaatccatcgacgctcctggtgacccggaacttgcggggaaggttggtgtctgggtttcagggttcttcggttccggcaagtcgcacttcatcaaggtgctgtcctacctgctggagaacaagatggtcagcatgggcggtgaatcccgccgtgctgttgaattcttcgatgggaaaattcaggacgccatgttggccgctgacatcaagcgtgcggtcaacgccgacaccgatgtcatcctgttcaacatcgattccaaggcggataccagcaaggatgattcgatcctgaccgtgttcaccaatgttttcaacgaacggctcggatatagcccagatcacccccatatcgccgaccttgaacgtcgtctcgatgcaaaggggaagtttggtgaattcaaagcggcataccgggagattaccgactgcgattgggtctccgaacgcgatgcctttcacctcaattcggacagcatcaagaccgctctggctcgggttttagggcaatccgaggatgcctttgaaaaatggctcgataaccccgaggcggtgttcaatctttcccccgacaactttgccggttgggtgaagcaatatctcgattccaaggggccaaagcaccgcatcgtgttcctggtggatgagataggccagttcattgggcaagacacccacatgatgctgcggcttcagaccatcactgaaaacctcggcaccatttgcggtggacgggcatgggtcgtggtgacctcgcaggaggatattgacgccgttcttggtgaaatgcgttccgcgaagagcaacgacttttcgaaaattcaggggcgtttcaaaacccggctttcgctttccagtgccgatgttcatgaggtcatccaggctcgattgctggaaaagactccagccgccagggatgcccttgtctcggtttacaaggacaaggcggacatcctcaaaaaccaactgagctttaccaacgtcggaatgacgttcaagccgtttgccaacgacgaccatttcgccaaggtctacccgttcgccccctaccagttccaactggttcagaagattttcgaggctatccgccgtgttggtgccactggtctacaccttgcccgtggtgaacgctcgatgctcgatgcgttccaaaccgcagcaaaggacatggcatcggaaaaggtcggggtgctggtcccgctgcaccgcttctacccgtccattgaaagtttcctcgacaccgccgtgaaggcgaccatcgatcaggctggtgataacgcttcgctggagccgttcgacaatctggttctgcgaacgctgttcctcatccggtacgtggaggagatcaaggggacggtcgaaaatctcgtcaccttgttcatcgatcagatcgacgccgaccggctggcgatcaagattcagatggaggccagccttcagcggttggaaggccagaccctcgtgcgtcgtaacggcgatgaattctttttcctgaccgacgaggagaaggaaatcgggaagggcatcaaaaatgttgatttgcatggtggtgaagatgtcaaagctcttggcgaaatgatttttgacggggttcttggcgggtatcgtaagcaccgcttcgaggacaccaagaaggattttccattcaatcgattctgcgatcagcacccgtatggagccagaggagacggcgatttggcggtgttggtgatcactcctctgtcagaagactaccccgactggaatgaagcccgttgccttatgaagtccactgaagacggtgggcaggtggtcatcaagctaccggacgatagcaggccgggaacaagcgatagcttgctgaaccgtgaattgcgtactcttctcaagactgaaaagttcatcgcccgtacaaatgatggaacactcaccccaggtatgaaaaatatcctccggaatagggctgatgaaaacaacaagagaagagataatttaacggtccatattggggatttgattcggggggccgacgtattcgctgcggggaatagagtcaccgtgaagggtggtggtgatggtgcgatccgtcagtcattagattacttgatcaaaaacaccttcactaagttgggctatctgaagcacatcagccaagacccgcttgcggaaattaaagccgtcctgaatgcaccagacaccgccgatcagaggctgaagcttgatggtgaagattga

SEQ ID NO: 126 - DNA, 1134 bp, Magnetospirillum magneticum
gtggtacttctggtcgcccggttggtcgtggccggtgaactcagcatgtccatggatggggcattgttgacccgcgacaagatttttgaacaggtgaagacgcccaacaagtggcgaagcatcatcgtaatcaagcggcagacggttgatgccgccctgctccaacaatcccggaatctcgggaaatccgtgttttccaagatggggccggacggcgaagacgcactctatggcttcctgcgggaacagtgcgaaaagtggcaggccaacctcagcggttatctgaaattggccgaaaccggcaaatatccgggcaaggatgccatcgacgccggtctgaagcttctgaagctcatcctggcggagaaggacagctacggcttcatccagaaattcgtcaccctgaaggcggagtttcaaaatctatccgacgacgtaagtgatctcgacaccttctacggcacccagcagccagtttgggaattgctgggtaggaagtacgctgagttcgtcgtcaatcggaaggaactcgaccacaaccccgatgcggcggcggccttgcatcagatggaatccattttgggtcatgccgccccctatccgttgatcaaggacatcagcggcttggtcagcaaggtcacggccatcaatgatgccctggtggtcaaacgtcgcagccacgccctggaaaagatcgatcagcacgtctccgaagtgaaggaagccctcgaccatatcgcggcaccgcctgatctcagaaacaggtgcctgaaggaacttcaaaagcttcgtcagatcgccgagacgcaaaccagcatcgcccacattcatcaggctgtcacagacgccatcgaggcaaaagatgatgccctggatgtcattgaccgctatgtgccgcccaaaccagccgctccgacgccaccgccggttactcctggtaccggtggtgcagaacccacaaagaccaaagcagaacctccgccgccgatcttcaagaagccgcgtgtggtacggcctgccgaaatgaaatcgggctacctgaagacccaggccgatgtggatgcgttcctcggaaaactgcggaaggaacttgaagccgccctggccgctgaagaacccattgaaattcgctga

SEQ ID NO: 127 - DNA, 3582 bp, Marinobacter aquaeolei
atgacattgaagaatatttttctaaagcccgttgaccgccccatcgaaggcgttatcaaagccgacgatgaagccagtcttcgcctcgaaattgaagaatacgtactgaccaacgaagtcgagaagcgtctcgaagagttcctggacgcctataacaactacgaaggggcgaacggggtatgggtatccggcttcttcggctcgggtaagtcacacctgcttaagatgctggcccttctgcttgaaaaccgggagatggacggtgctacaaccctggacctgttccttcccaagtgtagcgagaatgaaattctccggggcgacctgaagcgagctgtctcaattccggcgaagagcattctgttcaacatcgatcagaaagccgatgtcatcagcaaaacccagatcgatgcgcttctggccgtgttcgttaaagtctttgacgaaatgtgcggctactacggcaaacaagggcacattgcccagtttgagcgcgatctggacggccgtggcctgtacaagcagttcaaagccgagtacgaggccatcgccggccgcccctggcagaaaggccgggagcaagcccttctggaaggccccaatattgccaaagcctacgccgctgtgaccggtggcgacccgcagtcggcagcgggcattctggacaagtaccgcagcgaataccgcgtttcaattgaagacttcgcggacaatgtgaatgcctatatcgagaagcaggcaaaagagggtggccacaaagagttccgcctgaacttctttgtggacgaggtcggccagtacattgccgacaacaccaagctgatgaccaacctgcaaaccattgccgagagcctcgccaccaagtgtcggggccgggcctggattatcgtcaccgcgcaggaagagatgaaaaacgtggttggcgaaatgggcaagcaacaaggcaacgacttctcgaaaattcaggcacggttcaataaccgcatgaagctgtccagcgcggacgtggcggaggtcatccagaagcgcctgctaaccaagaccgaagaaggcgtcaatcagctgtcggacgtctatcacgcgcaggcaaacaacttcaaaaccctctttgacttcgcggatggatcggccacctaccggaacttcagggacagggaccacttcatccacagctaccccttcgtcccctaccagttcgcgctgtttcaatcggcgatccagaatctgtcgcagcacaacgccttcgagggtaaacacagttccgtcggtgagcgctccatgcttggggttttccagcaggtggccatccacatcggtaaccatgaggtgggccagctggccacctttgacctgatgtttgaaggcatccgctccgcactgaaatcacaaatacagcgggcgattattcaggccgagaaccatctcgataatgccttcgctatccggctgctgaaggccctgttcctggtcaaatatgtcaaggaattcaagcccactgtgcgcaacctctgtgtgctgatgctggattccttcgatcaggatctgccggcacttcgcaccaaggtcgaagaagccctgagtcttctggagcaacagacctacatacagcgcaacggcgaccagtacgagtacctgacggacgaggaaaaggacgtcgagcaggagatcaagaacacagaggttgagtcatcggacgttgcggacgagctggaaaagatcgttttcgactttgtcatcaagcagcgcaagatccgctatgacgccggctcctcccaaaaccaggggcaggactactcctattcacgcaaactggatgatcgtctgcatgggcgtgaatacgaactctcgatcaatgtcatcagcccgttccacgagcatactgacaacgagcagatgctacgtacagcctcgacctacaaggcggacgagctgttcgtgctcatgccgtcggacgagcgcctggtgcgcgatctgctcatgttcaagcgcaccgagaagtacatcaagcagaacatttccgttacccagcaggaagccgtaaagcggatcctgaatgacaagggctttcagaaccgtgagcgcgaggccaggctccggcagcaggttcagaccctcattggcaagtccaagttgctcattggcggggctgatgtggaggtcgcgaatgaggacccccagacccgtattattcggggcttccatgagctgatttcacgggcttacccgaacctccgcatgttgcgtggcgtttcctacacggaaaatgacgtcagcaattgcctcaaccgtacagacgatggtcttttcggtaatgatgccacggccctggcggaatccgagcaggaagtgctggcgttcattcagagcaacaaccggggcggtgtccgcactaccctcaagagcctgctggagaagttcgaacgcaaaccctacggctggtattacgccgcgattctctgcacgctggccaacctttgtgcccgtggcaaggtggaagttcgtctcgacggtaacatcctggaggacagcgggttggagcgcgccctgcgtaacactcacggccacggcaacgtggtgctggaaccacagattgagttcaccgcctctcaggtccgagccctcaagtcattctacgaagacttcttcgacagcccgccccgcagcagcgaagccaaggctctgggtaaagaggccggcgaagcctttcaggacatgtaccacgacctggatcggcgggtagcacaggtcgaccagtacccgttcctcaatgccttgaaacctgccctggtgacgctgaaagaggtcgccggaaagccctacacctggcacctgacggaattgggcaagcaggaagaccagctgctggacctgaaagaggatgtcatcgaccccatccgcaagtttatgggcggttcacaaaaagacatctacaaccaggctcggtccttcctgcagagccaggagcccaacttcatctatgtgtccggggacgagatcgagcagatccgcaccatcctgaacgaccccaactgctacaaagggaatcgcattcagcagctcaagggccaactggatagcctgcaggagcgcaccgacgagaaagtgcagcaaacccgagctcaggcagaaacctccctgaagaccatgcaggaacgcatgcaaagcatggacgaatatcagtccctgccggagccgcgtcaggatgagctcaacaaaccgttccgggatctggtcgattacattgggcaggagtgcctgattgccgtgatcaaggaccggacccggtactttgaagaagagggctaccagaagctgctgggcaaaatggtggcgctggccaatcaaaaatcagcaccggcagacgactcccagcagcctccgggtagtcaggacgagaacgagaatagggggcagtctaacgaggtcaaggaatcgcccgccgactatgttcacacccgcaacctccgtgtcgcgttcgacaaggcctggttggccaacgagggtgacgtggaccggtacctgaatgccttgcgcgaggccctgctggctgaagtccagcaaggccgcaaggttcagatctaa

SEQ ID NO: 128 - DNA, 3540 bp, Nostoc punctiforme
atgaatatcgccgaactcttccaaaaagacattcaccgtaatatcaatggcgttatcaaagttgggcagaaggacgacgagaatatccgtcaagaattggaagagtatgtcgttaccaacgaactggataagcactttcggacattttttgaacgctacactaatgccctaaataatcctacggataaaatgggtgtatggattgctggattttttggctcagggaaatctcactttttgaagattctgtcgtacctattggctaatcatcaactggaaaatagccgtgctttagattattttgatgaaaaacgcatacccgatccgatgttgcaagccttgatagcacaggcggcacatagttcttgcgatgtgattttattcaatattgactctaaagctgatgccaataataaaaaccataaagaaagcattaccaaggtctttcaaaaggtatttgacgagcatttggggtactttgggacggttcttcccattgctgagtttgaacgtcaactagatcgccaaggtaaatatgcagcttttcaacaagctttcttggcagagagtggcttggaatggaaagaaaaccgagatgcttggggttttcatcaagatgcgatcgctagtgcattacaaactagcacgggcatgagtgcagaagcggctaaccgcttactggattttggcgaacaaaattatactctgagtccagaaaagtttgctggcatggtaaagcaatatctggatagtaaagggccgcaacatcgcctaatttttatggtggatgaggtaggacagtatattggtgaagacagcaaactgatgctgaacttacagactgttgtggaagatttgggtacttactgtttgggaaaagcttgggtggtggtgacatcccaagaggcaatggatgagattaccaaaaacaagattaaaggcgaggatttttctaagattattggtcgtttttatcgcccactgaatttgtcttctgctaataccgatgaggtaattaagttacgtctgctcagcaaaactgatgcggcgcgggctgggttggaagctttgtatagccagaagattgctattctgagaaaccaaattgcttttactcaagacagtgccgatatgccgggatatggtaatcctcaagatttctttaccgcttatccctttattccctatcagtttaatctgttacaaaaggtttttactcaaattcgcctcatgggttctgctggcaagcacttggcatcaggagagcgatcgctattggatgcatttcaggttgcatcccaagcggtagccggagaaccccttggtgtgctggttccgtttcacaccttttacatggcagtagaaggctttttggatagttcgatcaaccaagttattattcaggcgggtcggaatccgcaactaaattcttttgacattgacctattgaagaccctattcatggtcaagtatctgaaagaaattcgggctaatttggataacttaactactcttagcttaagtaatattgaccaggataaactagctttgcggcagcaggtagaagcagctttggggcggttggaacgtcaaactcttatccagcgtaatggcgatgaatatattttcttgacccatgaggagcaggatattggcagagaaatcaaaaatactccagttgattcaggaaaagtcaaagaagaactacgaaagcttatttgggaatcaattttcactgataaactatttcgttacagtcagcgacaccagtataaatttaaccgcaagctggatgaacaactccatagtcaacaaagcgatataactctgcacattgttactccttgtgctgaaacttacactgctatgaaggaggatactttctgcattggtactacagggggaggttatgaggtcttagtgcgattgccttatgagcaacgtttggtagatgacctcgaaacccttgttaagacagaaaagtatataaaattgaaaagtggtagcaacctcagccctagcatccagagaattttaagagatcaaagcgaccaaaatagtaagcggtgtgaggatgtgaaaaccatcctagaaaatttgattactcgtgctgatgtatttgcctgtggtagcaagttagaaattcgcagccgagacactaaaaccttgctgaacgaaggtttgagctatttggtaggcaatgtgtatcaaaagctcggttacgtggctagtggttttgaaaacgaagatcaggtaagcaatgccctaactcgtgagagtcaagaacaagatattaacggacagcctgttaatgtggctgctcatagtgaaatgcgagcttggttaatggaagaaacccgcgttcgccgccttgtcagtattaaggcattggtagataagtttgcagtccgtccctatgggtggtcggaattcgacactttgggggtgatggcggaacttgctaacaagggtgtaatagaactgcgacacgctcaaggtaacgttaatctgcatgataaaggtttagtgatgcagttgcgatcgcgcaaagaaatagataaatataccgtccgccttactgatgaaattaacccagcaaacttgaagattgccaaagatatggccagtgacttactcaatggcaatatgtctagcgatccacagttgctatttgaacaatacaaaaatgccctaacaaaacgctctcaagaacttgaaagttggttaatccaagcagaaggtgggcttcccttcgctgaattactgcgtactaacttaaatttgctggctgaattgttaaccaaggatagtgcggctaagtttttcgacacatttcgtcagcgacgggatgatatagaagaatttatcgaagatgtgcaaaagctgcaatccttctttagcacacaaattaagctgttccagcaagctcgtaatgacctgaaaactctagaaccagaactacgccatattagtgagccagatttgctcaggcgggtggatttagttaagcaaattttggcgatgtctgaccccactgccaagattccagaattagcaatgttactcctacctgtcaaagataaggtgcaggaagcgctaacaactcaaatctatcaggtggagagtaaaagcaaggcaatgcgggagaaattagctgagtatgtgacttccgctcacgaagacatttctgcacagcttgacctcagcaatatcacccaagacatcgataaagttgtcacctcagttaaccaggtaacaagtatcgattctgcgatcgcacgtcaaagtgaactagaaagcatcctcccacaattgctgcaaaaagtagatcagcaagccaatgaaatcattcagcgtcagtcaaacaatggcagtaacggcaaagttacttgtgtcaaacccatcgtatcggtgcaggtagcgagagttgcgcctaaacccctactggaaacactccaagatgtggatgtttatctagaggcgttgcggaaaaccctattagatgagattcaacaaaatcatcgcgttcgtcttgagtaa

SEQ ID NO: 129 - DNA, 3522 bp, Runella slithyformis
atgatacaaagagagttatacttaaatgatatttttcgtacgattgagggagtgataaaagccaatgatgaacggcacgttcggcaggaattggaagaatatgtattgaccaacgagcttttgggtatctccaatcgaaaccggatgcttcccgggctgtttgaagagttggtcaaaagtaaatttaacagcagcatctggatttcagggcattttgggtccggtaaatctcacttactgaaaatgctttcgttagtgctggagaatagggaaatcaacggagccaaatgtgcggatatttttgcctcgaaagcagcagccgattttgaactggagagaaacattaaaaaagcggcttccattactactaaatccatcctttttaacatcgcggctaagtcggatgggattacggcgatgggttcagcgaccgaccccgtattgagtatttttctcaaagtattcaatgaattgctcggctatgatcctctcaaccccgaaatcgcggaggtggaaaggcacctggaaagcatcggccaatacgactacttcaaatcagaataccaaaaacgcttccataaaagttgggaaaaaggtagagaagccattttcttaaaccaacatgaactggcggaaatatatgccgagataaaatccatcagtgccgacgaagccaaccgttttattgataacctcatcaacaattataagttggacattgaaggttttggcgaattggtttccaaatacgttaaaacgcaatcagccgggtttcgattggttttttgcgtggacgaagtcggccaatttattgccgaaaacgtcaggctcatgctcagcctgcaaaccattgccgaaaccctttcttttaaaacgcagggacaggcgtttatgatcgtgacctcccaaaacgatattgacgccaccctcggtgagttgaacgctcaacgcaaacacgatttttcgcgcattcaggggcggtttgccatcaaaattccgttgacgagtgccaatgccgatgaggttatccaaaaacggctcttggttaaaaatgacccggcccatcaattattggccagtatttacgaaaaagagcagaacaacgtcagaacacttctgaaattcaatgacaattcccgtcagtaccaaacctatcgggataccgaacactttatcaatacctaccctttcctaccctatcaatttgacctgtttcaggcatccatcaaggcgttgtctgaccacaatgctttcatcggcagtcaacaatcggtaggagagcgctctatgctgggcgtgtttcagcaggtagccaaaacctacgccgttcaggaagtggagcatttggtttcgtttgcgcagatgtacgaaggaatcaaggatgtactgcaaagcaacattcaaagtgatattctgcaagccgaaaaaagcatcggttccgagctggccaaagaggtattgaaagccctttttctggtcaaatacgtcaagggttttcaggcaagtatcaacaatattgccattttgctgctgcccaaatttgaaattgacctctcggccttccaccgtcagttgcaggaagcgctgaatctgttggaaaaccaaacctacattcaacgcacggcgggagatctgtacgagtacctgaccaatcaggaaaaagacgttgaaaacgagatcaagcaaaccgaaattgaccctactgcccccggcgagctgttggcaagctatctttttgacgacatcctgcgcgattcaaaagtcaaattagagaccaacaatcagccgtatgagtttgggcgcaaactggacgataacgtcatcggacgggagaaggatttttacgtcaattttattacgccgctcaatgccaattcggtcacgcgttccaacgtgagtatgttctctatcggacggcccaacgatttgattatttttctgcccgaagagaaacgcctttttgatgaactgcggctctttaaaaaaaccgaaaaatacattcagaccaccaattctcccgcgctggatgccaccaagcagcgaatcttgggcgaaaaagcccaacaaaatcaggatcggaaaagagcggtggtgaatctgctgaaagaaggaatcggcgaggctaaaatgtacctgaacggctccgaactgaccgatattgggaccaaagacccaaaaacaaaaatcacgcagggagtgcagcaactcatccggacaatttataccaacctcaaaatgctcacggttgattttaccgaaacgcatttggtcaacattgtacaggggaaagatccgcttttattcccccttacgctgcatgaagtggaaattgaggtactgaatcgtattcaacgcaacaaggccaactacgagcgcactaccaccaaagccctgctcgatacgtttgcggcccgcccttatggctggtaccaaaccgccgtgctctgtatcattgccaaactgtttaaacgaaataaaatcggcctgaaacaggacggcactgcgctcgacgaccgacgggtgctggaggcattgcaaaaaaacaatcagtacgccaatacgctcattgagcccgaagaagaaattcaaaacgcccaaatacagaaactcaaaagtttctaccaggagtatttcagcgagcccaacctcggcactgagcccaaggaaatttcccgccttttcaaacagcggttggaaaaagaagtaaaagacctcacggaaatgtacatcctgcgcggtcggtttaagtttttggaggcgatgggcgaaccgctcaaccggttgaaggcactggctcagaaagagcacccttactttttcaatgcgttgaaccactacgaagacgaactgctggacgacaaagaaaatgtactggacgccgttcggaagtttatggacgggaatcagcggactatttttgaaaatgtacagacgtacctggaaggtaatcgggccaattttgactacattgacaaaagcagtatcgaaaaactgagtatcgtggccgaaagccctgcaccctacaaaggcaatatcatgcaggaagccaaggcggtgctggaggtgataaaaacggaggtaacggcccaacaaaaaaccgagcgcgaaaacgccgtcgagcacatccgtcagagtatggagaaactcagttcgtttgctgattttatcctgcttgatgccaaacagcaggaacaaatcatggctccgtttgaaaaagccgtcaaagagcttgaacacgagcgattcatcggtaacatccgaaccaaggccaaccacaccgctaccgagctgtatcagaagcagttggagttgatgatgcggctggccaatccgccccaacccgcagtgcccggcactcctgagcctcccaaaccaaaaatcgtatttgtgagaaaggacagcatacggattaactttgccaagcctgccttggaaaaccaacaggacgtggaagattacctttcggctttaagagagcaatacctgagaatccttaaagaagaaaaaagaatatcgttgtaa

SEQ ID NO: 130 - DNA, 3711 bp, Halorhabdus utahensis
atgaccgacgagtcctggttcgccgccgacgtcggatctgacttcgaggagtccgtacggatcgaccgcgaagaagacgggcgtgatcaccggctggagtccatcaccacctaccacgtgaccgacgaggctgaggacttcatgtcggacttcttggcgcggttgctcggtcggtcggaggacatgcggtcgggcgcaaactactggctctacggctactacggcagcgggaagagtcatctcctcagcgtgcttcggggcctgatggacagcgagtggctccgccggcgagaggaaatctggagccagctggccgaaggacggaagttgtcttcgctgcgagccacgtgggagtccattcacgacgagtacgaggtcatcccgatctcggtgaatctcctgaagcaccaagggcagaaggaactcagcttcagtgaaatcgtccttcaggccgcccacacatcggaacccctcaccggtgtcgaaggaggattctcgccccagctcgatgtggcgtacttcgaggactggtatcggacgaccggcgcgtggcccgaccgcacggcccacgcccgggccgcactccgcgacaccgtcgccaacccggacaagtacgactgggaggacgtacagcagtacaacgcgctggccgacgtggttctgccgacgctcttcgagagggagactggaacggccgatggattgaccgacctgactccctcggatctcgatcccgaggcgatggtcagccggctcgaacagctgcgaagcgaccgggaggacgaactcgggcggccagtcaaacttgtcctgttgctggacgaggtgagcctgttcatcggaaccgacttcgaccgcctgaccgaactgcagacgctcgcggagagtgtcgacgaggtcggcgacggcgacatccagttggtggcgaccgcacaggccaagatcgaggacgtccagccgcagttcgcggcccgcggtgccgacttcagcatcgtcaaggatcgattcccgcaccgtttcgggctgcccagcagacacgtcggggaaatctcgacccagcggctgctcaagaagaccaaggacggccgacaggcaacggaacgcattctcgaacgcaccagcaacgagccagaaacgctgctcgtgtattcgggcatcgagcaaaacaccgaaccgccgctggacgacatcgaccgcgagcgactcctggacttctacccgttcctgccgtatcagccggcgctcttccttgagattctctcgaacctccggcaggaggcccgcgatcccgccaagtcgatcttctcggggacggcacgggccattctggccctcgtccacggccttctgcaagagtggatggaggccggcgaggagacacacctcgtttcgctggttgatttctacgacctcatcgaaccggaactcgaagacatcacgccgcaggacgtcgcggtcatcgaggagatcgaggagcaacaccggcagggcgagctggagaagatcgacgtggccgtcgcgaaggccgttctgctcctccagcacgttcccgagacgattccgatgtccgagcggaatctcgcggtggccatcctaagtgacctcgacggcccgacccagttccagatggagaaccgggtcgaagactcgctccaacgtctccggaagttcatccggccgacgcacgacgagatggggccgaagtatgccttcacccacccggaggagcgggagatcatcgaggccgccgaacagaacctcgacgatcccgactgggatgccatcatcgagtccgtcgacagctacctctgggacgatgtcgttcgcgatctctcgctcccgacatctgtcgagtacgccgacactggggagcagtaccctgttcgctacgagttcagcgttgacggcatcgcgttcgacacgaccgtcgaggccgacgacgcacttgatgtcgaggtcgccatcgaagggctgtcacccgaggtatcggaggtcgactatgatggcaacccactcgaatggacgatcggcgaggacggtctcgacgatctccgcgacaacctcatcgagtggtggtcgctcagggccgccgtcggcgcccacacgctcccgcagtctgtggagcgtgatctctcggatcgggcgacgcgcgtccgaagcaagctcgtcgaggcactcaagagcggctcgtttgccgtcaaggatcggactggccttcgtggactggcctcggcggtcgaagagttcgtcgacgttcgctatcccgacgacttccaccccgtgatgctgcagatcggtgatgaacacctacaggaactccggggactctcggcccaagacccgctgcccgcgtgggcccaacagatcgaggttgccactgaggatccggagacccacggcggttccatccagaacaacgtgcgggcattcaccggccagcaattgaagcagagcgacggtagtctcgcgatgatcaagattcttgacggaatcgtagagaaagaagaacagcaacgcgagaagacctccgaactcgcagtgtatggcgatgcccggccggcgttgtgcgccatcatctgggggctctgtcgtaagggggacttccttcccgtcgacgagacgggggactcgctcgaactcgactcggtcatcgatctaaacgagttgacgaccacacgcctcaagattgcaggagggagtggtgtccgcgaggcactcgaggccggtggcttcatcgactcgacggagacgatcccggacgggatggtcaggctccagtccgcgaacgacacgctggccagccgcctcgggagccttatcgaggacgtggaactggtcgcagaaagcgacgtccagacgcaacacgttcagggtctgctcgactcgttcgtcgacgctctcgaatacagacaacaggacgctaacgaccgccacgaagccgtcaagtcccgcgataccgactggcagcgggtcgtcgaagccaccaacgatgcccaagagtggtacgacgatgccacggaggtgtggaacctccgcttgccggcacttgcacaactcgacgcccagctcactctcgctcgacagtctttcgactggctgaccgacgagtgcgaagctgccagccggaaacttcgggacaacatcgcggagtacgacgacgagtggtggacacacgacggatgggacaggttcaacgatgcccgcactgtctcgccgtccttggacgacgccatcgaggacacatggcagacgttccagaactcgactgacgtggatacactcgttcgcaaactcgatgaccacccgtggatacgaccgccgagcgaattcggatcgaacgtccgccctgccttcgagaacgaatacatcacgccgcttcgccgtgctgtgtcatggtacgaggacatctcggaggccgtcggcaccgtgactggcggtacgacggggactgaggcggatgccttcattcgtgcgacggacacgctggtcgacacggagccactccgcgtggtcacgggcagtgagatcagcgaactgcgggccacgttcgaagagttgcagacggtcgtcggcaaccaacggccgtcggaggtcactgcagtcggcgtcctcccgtcggatcgagagtcgctggacgctgaactcgagcggttggcggaacggcgtgatctcagtatcgagcggacggagacgggggtgatcgtccgatga

SEQ ID NO: 131 - DNA, 3843 bp, Halorhabdus utahensis
atgagcgaccaccgaatccacgatatcttccagcagtcaccgacccgcgaactcgaggaagtccagaaggtcaatgccagagcgcaggccgaaaacgacgtgcgcgagttctacgagaccgacagcgcacggagcgtcctcactacgctcggcaacctcgtcgacaagtacccacaggaggagccgcgcttcctctacatctccgcgacgttcgggtcggggaagacccacctcctgaagctcgccggattcgccgccgacaccgagtcgaagttcgctgacctcggtgaggaactggcgagtcggtggccggggttccagtcgttcagacagagcatcgccgactcccacgtcgaccgcctgaagccggtcttcctcaacctcctcaacagagacgcgtcacaggagccgccactcccctacctcatctacgaggtcatcggccgcgaactcgggtatccgaacgatccgaactggctgctcgaatgggcgtggcagctggacatgaaccacggcgactgctgggagctactgcaggagatcgaatacgacgggcgaacgttcgacgaggtgtacgacgagcgggcctcgctacgaagctggctctacggggctgttccgacactcgatgacacgccgtatcgctccagtagcgaagtaaaacagtcgatcgatactgcgatcgaggagatcgacccggacgaattcgatccggacgaactcgtcgaccgggtcgaagcggcacaagaggccctgagtacgcccgagacggagacggagctgttgatcggcctcgacgaggtggcactgttcatcggcgacggccgccaccgctaccgggagttccaagaaacgatggaggccctgaccaaccccgcgacggggccgaacccacccatcgtcgggacgggccagtatcccttcgatcgcatccacggggagttcgaggactcagacgtcaccgacgaaccgtggtggggcaagcaggagccgctggagggggccgacaccgagatcatcgtccgcaaacgatggctccagaaggacggcgacggcgagcaggcggtcgacgcggcgattcatgagcttcccgacctcacgcttgatacgtacgcggacatcacgggcgcggatcccgatgcaatcgagtcgtacccgttccgcgagtacgacctcggactgttgcgcacggtgatccagcagctgatgccgcgcggtcgcgtgaccgaggaggagtacgtgcaggggcgagccctgctcatcctcgttcggtcgctgttcacgcggttcgagtggggcgagaaatccgtcggtgcgctcgtcacgtgggacgagttgtacgacctgctggtcgaggagacgacgtacgtcccgctgtgggtgcaggagatggtcgagaacaagctcgtcccgtccgcaggtggagatgaagatgccttctcggtgcgagtagcgaaggcgctgtacctcctgaatcaggtgcgctcggaggtaccgtccacgccggcgaacctcgcccgactgatggtggaatcggccgacgcatcgctcgaagaagtccaagacgatgtcgagtcggcgctggccgacctcgttgaggacagaaaggtgctgaccgagacgagcgaccgaggtgacgaggagtacctgctcgtctccgaggagcaggaggacatcctgacgcgggcgaagacacgtgctcaacagatttcgtcgcatcgcctgtcggccaagctggagacgtacctgcaggaggggagtgaccacctcctctcggctggcagtcgacacgaggtcgatctcgacggcgagcgccgggtgccgctccggttcgattactccgtcctcgatccgatcgagcgggctcccacgccggagttcgatgccattcgcgtccggcttgttgccgaccgccccgacacggtggccgatcaggtggacgcgtggcagtcgaccaacgagggacaggacgggggcgaacacgtcctcgtagccgtggagatctcggagtccacggttgagcgtctgcgggacgtgatgggaatgcaggaagtcctctcggaggagacggagacctatccggacttggagtccgaccatcgcgacgatcagcgtgcgctcgaatcgacggttcgcgaccagctcaacgaggccgacatctacgtccgagccggcgacacgaggggtcgttacggcgacgtgttcgagcaggtcgtgacgaatcaggtgcagtcggtgttcggtcggacgaggcacgcattgacgaacgggatcaccgaggtcgacgatgcaaagcagatggcgcggttcttccgcggtgttgatgactggccgctgtcgagcgaagacgctgtcacactcggtgtggacaccaaccggggggaactcgcggacgggtggtgtcaggagttcctcgacgactacgagaacacgcaatcgctccgcggtgaggacttgctcgctcagaccgtccagcgcgggggcaaataccgcgggacgccacgggagtccatcgcggcgctgctgatcacgctcgccacggccaacgagatcgctctccgccgcgacgacgagtacatcaccgagcccgaggagatcggacgggcggtcaggaacaagacgaatctgaccggtctacagattcgattcgagtcgctggacggcatcgatcccgaccagattcgggagacagtccggacgctcatgagcgaatcaccggagggtagcgacccggatgcgtggctctcggagctggctgagtgggtcgacgagaatagcgttctcgtgaaacgcgtccttcggggcgtcagcagagagtttggcgaaggtgcatcactggatgagttggaaaacgccctcgaaccggcactcggcggagaggcactcgagaccgaggacttcgcgaccgacgaagtcgagcgagaggccgaacggttcgctcgtgccagagggctgttccgtccagatgaggacgatacgacgctgtgggcgcggttcagcgagcgcacggccgagatgcagcggctccaccccggggcagacgtcaccggcgatatgcagagcatcgccggcggtaacgaggtacccgacgctgagcgtctgcggacgctgatcgatgaggcagacgcccacaggcagcgcgtcgtccgagaacagtacgagcgcatcaccggtgagacgccagccgacgaggagtcggagagtgtcgtttccagcctcgcgacgtggttgttcgctcacgacggaagcagcaaggaaatcgccgaccgcgtctccgtcgaattcgggggtgtgacgatcgacgacctgtacgatctcttcgagacggcgtgggaaggtgactcattctcggaagaggaactcgtcgatccagcggttgtccagcaagccgagcgatactcgagggcgcgggagctcctcgaatcacccgaaggcgaggtcagtctttggtcgaagctccaagacgcgtcgaggcgacttgaagaggagtatccgaaccacccagtcacaagcgacgtggaggagacgctatctcggtcacagccgccgagcgtggatgaagtggaacggcttcttgataaggcagagagcccattcgaagtcgacgaacggctggcagagctcgccgacgaactgcagaccgagtacccaaatcacgaagttaccgcaacagtcgttaacgccgttgaaggacccagccagccgagcgacgagcgcgtgggcgaattgattgaagaggctgaacagctgcttgaaggtgtggatgagcagttgcggcggattagagaaacgatgaacgaacttgacgatgggtccgttgtggtggtcgagtctctcgattga

SEQ ID NO: 132 - DNA, 3708 bp, Halobacterium salinarum
gtgctcaccacgctcgggaacctcgtcgacaagtatccacaggaggaaccgcgcttcctctacatctctgcgacgttcgggtcggggaagacgcacctcctgaagctcatcgggttcgctgccgacaccgaatcggagttcgccgacctcggcgaggagttggcgagcagatggccaggtttccagtcgttccgacagagcgttgctgactctcacgtcgaccgtctgaagcccgtcttcctgaacctcctcaaccgggacgcgtcacaggaaccgccgctcccctacctcatctacgaggcaatcggccgcgaactcgggtatcccacagacccgaattggctgcttgagtgggcgtggcagctcgacatgaaccacggtgactgctgggagcgactacaggaagtcgaccacgacgggcagacgttcgaggacgtgtacgacgagcgggcatcactacggagctggctctacgacgccgttccgacactcgatgactcaccattcgcgtctcgggaagaagtcaagcagtcgattgacgacgccatcgaggaggtcgatcccgacgagttcgaccccgacgaactcgtcgaccgcgtcgaagcagcgcaggagttactgagcacgccggagaccgagacggaattgctgatcgggctcgatgaggtggcgctgttcattggcgatggccgccaccgctacagagagttccaagaaacgatggaggccctgactgagctgggcgtcgggcccaacccgccagtcatcgggactggacagtatccgatcgagcgtatccacggtgagttcgatgataccgaagtcacggcgcagccgtggtacggtgctcaagaaccgctcgagggtgccgacaccgagattatcgtccgaaagcggtggctgcagaaggacgctgaaggtggacaggccgtcgaatccgcgctccaggagatgcccgacctgacgctcgacgcggactctgatattgccggcgccgacccggacgcagtcgggtcgtacccgttccgcgagtacgatctcgggttgctccggacggtgattcagcaactgatgccacagggacgcgtaaccgaagaagagtacgttcagggtcgggcattgctcatcctcgtgcgctcgctgttcacgcggttcgagtggggagacaaacaggtcggggcgctcgtcacgtgggacgagttgtacgacttgttggtcgaagagacgacttacatcccgctatgggtgcaggagatggtcgagaacaaactcatcccttcggctggcggcgatgaagatgcgtcctctgtccgcgttgcgaaggcgctgtacctgctgaatcaggtgcgttcagaggtgccgtcgacgccggcgaacctcgcccggctgatggtcaagtcgactgacgagtcgttcgagtctgttcgggacgatgtcgaatcggcactctccggcctcctcaaggatcggaaggtactgacggagacgaatgaccgcggcgacgaggagtacctgctggtctccgaggagcaggaggacatcctgacgcgagcgaagactcgcgcacagcagattccgtcgcatcgactttcggccaagttggagaactccattcgagagggaagcaacctcctgctctctgaggggagtcgacacgaggtgggtctcgagggtgagcgcaaagtcccgctccgtttcggctactctgttctcgaccctatcgagcaagcaccgacgccggagtttgacgccgttcgtgtgcggctggtcgcaggccgagacgaggaggttagcgatcaggttgatgcatggcagtcaacgaacgaagggcgggacgggggcgagcacgtcctcgtcgccgtcgagctacagggatcgacgatcgaccgcctgggggacgtaatgggtatgcaggaggtactgtcagaggagacggagacgtatccggacttggagtccgaccatcgcgacgaacagcgggcgctcgagtcggcgattcgcgagcaactcgaggaagcgggcgtctacgtccgaaccggcgggacgagaggacgatacggagacgtgttcgagcaagtcgtggaaacgcaagtacggtctgtgttcagcgggacgcgctttgtcctgaccaacggaatcacggaagtcgaggacgccaagcagatggcggggttcttccgcggcgtcgacgactggccgctctcgagcgaggacgccgtcacgctcggtgtggataccgaccgcgccgaactcgccgacggctggtgtcaggaattcctcgacgagtacgaggacacccagtcgcttcgtgctgaggacttgcttacccggactgttcagcgcggaggcacgtatcgcgggacaccgcaggaatcgatctcagcactgttgatcacactcgcaacggccaacaaaatcgcgctgcgccgtgacgacgagtacattaccgaaccggacgagatcgggcgagcggtcagaaacaagacgaacctaaccgacgtactgattcggttcgagtcactggacgggatcgatcccgaccagattcgggagaccgtcgagacgctaatcggcgaggagccggacggaaccgaacccgacgcgtggctttcagagttggctacatgggttgacgagaacagcgtgctggtgaaacgcgtcttgcgaggcgtcagcagagagttcggcgaaggtgcttcgctggacgaactcgaaaccgctctccagcccgcactcgggggcgaatctctcgaaacagacgactttgcgtccgacgaaatcgcacgtcagtccgagcgtttcgctcgggcaagaggactcttccggtcgacggaggatggcgataccctctgggagcagttcagccagcgaacgatggagatgcagcggctccaccccggtgcggacatcaccgggaagatgcaagacatcgtcggcggggacgaagtacctgatgccgaccggcttcgggcaacaaccgacgaagctgacgctcacagacgaaccgtcgtccgtgagcagtacgaacggatcacgggagaatcgccagcagacgaggagcccgagagcgtggtctccagtctcgcaacgtggctctacgctcacgatgggagcagcaaggaaactgccaaccgcgtcgccgtcgaattcgacggtgtaaccatcgacgatctctacgaactcttcgagacggcatggaacggtgattcgttctcggaggaagacctcgtcgacccgacggttgttcagcaagccaagcggtacaaacgggcacggggactcctcgaagcatccggtagcgaggcctcgctctggtcgcagcttcgggaagcatcagaacgactcgaggaagaatacccgaaccacccagtcacgaccgatgtaaacgagatgctcagtcggtcgcagccgccgagcgtcgacgaggtggaacagctcctcgacgacgcggagaaccccttcgaagtcgacgaacgactagaagaactcgccaacgacctgcagtccgagtatcccgaccacgatctcacccaagaggtcgtcgatgcagtcgagggaactagccccacgagtgaggaacgcgtgggtgaattaatcgaaggcgccgagcagttgctcgacggtgttgacgagcagttgcggcggattcgggagacaatggatgagctaccggatggctctgtgatgatgatcgagccgctcgactga

SEQ ID NO: 133 - DNA, 3567 bp, Halobacterium salinarum
gtgacggaggagtccgaggacttcatgtccgacttcttctcgcgcctgcttggccgttccgaggatatgcggtcgggagcgaactactggctctacgggtactacgggagcgggaagagccacctcctcagcgtgcttcgcggcctgctggaccgcgaatggcttcgacagcgagatgatgtctgggagcagctaaccgacggtcgtgagctggagacgctcgaatccacgtggtcgtcgatccacgatgagtacgaggtcatcccgatctcggtgaacctcctgaagcaccagggccagaagaaactgagcttcagcgagatcgttctccgtagtgctcacacgtcggaacggctcaccggttccaagggagggctctcgtcgcagctcgacgtcgccttcttcgaggactggtaccggacgacagacgcatgggacgaccggactgccaacacccaaacggcactccggagtacggttgacagccccgagaagtacgactgggaggacgttcagcagtacaacgctctcgcggatgccgttctacccaccctctttgagcaggagaccggtacggtggatggtctagacgacctgatgccgtccgatctcgacccgcaggcgatggtcgagcgcctcgaacagttgcggagcgaccgcgaagaggaactcgaccacccagtcaaactcgtactactgctcgacgaggtcagtctcttcatcgggacggacttcgaccgcctcactgagctgcagaccctcgcggagagcgtcgacgagaccggcgacggcgacatccaactggtggcaacggcacaggccaaaatcgaggacgtccagccgcagttcgcggctcgcggggccgacttcagtatcgtcaaggatcgattcccacaccgatttggccttccgagccggcacgtcggcgaaatatcgacccagcggttgctcaaaaagtcggaaaccggtaaggggaatgcagaacgcgtcctcgaccaaactagtaacgagccagagacgttactcgtgtactcgggcatcgaacagaacaccgacccgccgctcgacgacatcgaccgcgagcgcctcatcaagttctatccgttcctcccgtatcagccaccgctgttcctcgagattctctcgaacctccggcaagaagcacacgacccagcgaagtcgatcttctctggaaccgcacgggcgattctggccctcgttcacgggctcctccaagagtggatagaggtcggcaacgagaccaacgtcatttcgctggtcgacttctacgacctcatcgaaccggaactcgacgacatcaccccacaggacgtgggggtcatcgaagagatcgaggaacagtacgaaacaggcgaactggaggagatcgacgtggacgtcgccaaggccgtgctgctcctccagcacatcccggacatcattccgatgtccgaacggaatctcgcggtcgccgtgttgagcgacctcgacggcccgacccagttccagatggagaaccgcgtcgaggactccctccaacggcttcgaaaattcatccgtcccacgcacgacgaggccgggccgaagtacgcgttcacgcatccggaagagcgcgagatcatcgaagcctctgagcaaaacctcgacaacccggactggcggtccatcatcgaagccgtggacgggtatctctgggaagacatcgttcgtgatctctcgctgccgacgtcggccgagtacccagataccggcgagcagtattccgttcgctacgaattcagtatcgacgggatcgaactcgatacagcggtcgacgttgaggacgcactcggtgtcgaggtcgccgtcgaaggaatttctcccgctgcagctgatgtcgactacaacggcgacccgctggaatggacgatcggacaggacggactcgacgatcttcgagatagcctcatcgagtggtggtcactcagagctgccgtcggagaccacacgctcccacagtccgtcgagcgtgacctctccgaccgcgcagctcgcgtccaaagcaaactcgtcgaggcgctcaagaccgggacgttcgacgtcaaggatcgcggcgatcagatcggtggcatgatctcgggcgtcgaggagtatctcgacgtcaactaccccgatgacttccaccccgtaatgctgcaggtcggcgacgagcacttacaggaactccgagggctctccgcacaagacccgctcccgacgtgggcccagcagatcgatgtcgcaacagaagacccggaaacacacggtggttcgatccagaataacgtgcgcgccttcaccggccgacagttgaagcaacggggcgggaacctcgcgatggcgacgattctcgacggcatcgtgaagaagaagccgatctacgaggacgctcgccccgcgctgtgttcgattatctggggcctctgccggaagggagatttcctgcctattgacgaaacgggtgactccctcgaactcgacgccgtcatcgatctggacaaattgacgacgacgcgtctcaaaatcgcaggaggtggcggtgtacgaggaatccttcgcgatggaggattcatcgactcgacagacaccatcccggacggaatcgtcaggctccagtccgcgaacgacacgcttgcgggtcgaatcggtagtctcgtagaggacgtcaggctggtcgccgagagtgacgcccaaacgagacaggttcgaaacctcctcgaatcgttcgtcgaggagctcgaagccgagcagcagagcgcgatcgaccgacgagaggccgtcaaatcacgagacaccgactgggaagacgtcgtcgaagcaaccaacgatgcgcaggagtggtacgacgacgccgaggaagtgtggagtttgcgcctcccggcgctcacacgaatcgacgcacagttgactctcgcccagcagtcgtacgactggctgaccgaggagtgcgaaacggccagccagacgcttcgcgagagtatcgacggctacgagggagaatggtggacacacgatggctgggatcggttcaacgacgcccaaacgacctcaccggcgctcaacgacgcgatcgagactgcgtgggactcgttccaggcggaatccgagttcgacgcgttcgtcgacgagttacaggagcatccgtggatccagcccgcgagcgagttcggatcgaacgttcgcccggccttcgagagcaagtacatcacaccgctccgtcgggccgcatcgtggcacgaggacatctcggacgcggtgtcgacggtgatcggcggaacgaccaacaccgaggctgacgacttcattcgcgcgacaaacacactcctcgacagcgaacccctcgctgtggttgcagacagcgacatcgacggattacgggatacattcgaggagctacagacactcgttggggatcagtcccccacagacatcacggcgattggggttctcccgtcggatcgcgaatcgctggactcggaactggaacgactcgtcgaacgccacgacctcagtatcgagcggactgaaacaggggtaatcatccgatga

SEQ ID NO: 134 - DNA, 3843 bp, Haloarcula hispanica
atgagcgacacacacattcacgacatcttccagcaatcaccgactcgcgaactcgaagaggtccagaaggtaaacgccagagcgcaggccgaaaacgacgttcgcgagttctacgagaccgacagcgctcgcgacgtgctgaccacgctgggggacctcgtcgacaagtatccacacgagcaaccgcgtttcctctacatctccgcgacgttcgggtcggggaagacacacctcctgaaactcatcggcttcgccgccgataccgaatcggagttcaccgatctcggcgaagagttggcgaacaggtggccggggttccagtcgttccgacagagcgtcgctgactcgcacgtcgaccggctgaaacccgtgttcctgaacctcctcaaccgggacgcagcacaggagccgccgctcccgtatctcatctacgaggcgatcggccgcgaactcggctatccgactgatccgaactggctgctcgagtgggcgtggcagctcgacatgaaccacggtgactgctgggagcggctacagcaagtcgagcacgacggccagacgttcgaggatgtgtacgacgagcgggcgtcgctacggagctggctctacgacgccgttccgacgctcgatgactcgccgttcgcgtctcgggcggaggtcaagcagtcgatcgacgacgccatcgaggaggtcgatcccggtgagttcgactccgccgatctcgtcgagcgcatcgaagcggcgcaagcgtcgctgagcacgccggagaccgagacggagttgctgatcgggctcgacgaggtggctctgttcatcggcgatggccgccatcgctacagggagttccaggagacgatggaagcgctgaccgagctcggcgtcgggcctaacccgccggtcatcgggactggacagtatccgatcgagcgtattcacggtgagttcgacgatacggaagtcacggagcaaccgtggtacggtgcccaggaaccgttggagggtgccgacaccgagatcatcgtccggaaacggtggctgcagaaggatgtcgagggcggacaggccgtcgagaccgcactccgggagatgcccgacctgacactcgacgcatacacagatatcgccggggccgatccggacgcagtcgagtcgtacccgttccgggagtacgacctcgggttgctccggacggtgattcagcaactgatgccgcggggacgcgtgaccgaagaggagtacgtgcagggtcgggcgttgctcatcctcgtccgctcgctgttcacgcggttcgagtggggcgacaagcgggtcggtgctctcgtcacatgggacgaactgtacgacctgctggtcgaggagacgacgtacgtcccgctctgggtacaggagatggtcgagaacaagctcgtcccctcggcgggcggcgacgagaactcgttctcagttcgggtggcaaaggcgctgtacctgctgaatcaggttcggtccgcggtgccgtcgacgccggcgaacctcgcccgactgatggtcacgtcgaccgacgagtcgttcgagtccgtccgagacgatgtcgaatcggcgctgtctgccctcctcaaggatcggaaggtgctgacggagacgaacgaccgcggcgacgaggagtacctgctggtctccgaggaacaggaggacatcctgacgcgggcgaagactcgcgcacggcagattccgtcgcatcggctgtcggccaagttggagaactccatccgggagggcagcgatcgattgctctctgctggcagtcgacacgaggtggatttcgagggagagcgcaaagtcccgctccggttcggctactccgtcctagacccgatcgagcaagcaccgacgccggagttcgacgccgttcgtgtgcgcttggtcgcgaaccgcgacgccgagatcagcgaccaggttactgcgtggcaggcaacaaacgagggccgtgacggtggtgagcatatcctcgtcgccgtcagtctacagcaatcgacaatcgaccgcctgcgggacgtgatggggatgcaggaagtgctctccgaagagacggatacctatccggaccttgagtccgatcaccgcgacgaacagcgggcactcgaatcgacgattcgcgagcagctcaaagaagcggacgtctacgtccggacgggtgggacgagagggcggtacgaggacgcgttcgagcaggtcgttcaaacggaagtccagtccgtgttcagcggaacgcggttcgtcctgacgaacggtatcacggaagtcgacgacgccaggcggatggcacagttcttccgcggtgtcgccgactggccgctcacgagcgaggacgctgtcacgctcggggtggatacagaccgcgccgaactcgccgacggccggtgtcaggaattcctcgacgagtacgcggacacccagtcgcttcgtgccgaagacgtgctcacccagactgtccagcgcggcggcgcgtatcgcgggacgccccaggagtcgatctcggcactgctgatcacgctcgctacggccaacgagatcgcactccggcgggacgacgagtacattaccgaaccggaggagatcggacgggcggtcagaaacaagacgaacctgaccgagatacagatccgcttcgagtcgataggcaagatcgatccagagcagatccgggacaccgtcgagacgctgatcggcgatgagccggacgggaccgaccccgacgcgtggctctccgcgttagccgagtgggttgacgagaacagcgtgctggtgaaacgcgtcctgcgaggtgtcagcagggagttcggcgacggcgcttcgctggacgaactcgaaacggcgctccagcccgcactcgggggcgaatcactcgaaacggatgcgttcgcgtccgagacggtcgaacggcagtccgagcggttcgctcgggccagcgggctcttccagccgagcgaagacggccagtccctctgggagcagttcagccagcggacagtggagatgaagcggcgctaccccggtccggacattacgggggagatgcaagcagtcatcggcggggacgaagtgccagatgccgaccggcttcgagcactactcgaagaagctgacacacacaggcgtaccgtcgtccgtgcgcagtacgaacgcatcacgggcggaccgccgacggacgaggagcccgagagcgtggtgtccagtctcgcgacgtggctctacgcacacgacgggagcagcaaggaaaccgcggaccgcgtcgccgtcgaattcgacggcgtaaccatcgacgacctctacgatctcttcgagacggcgtggcggggtgactcgttctccgaggaagccctcgtcgacccgacggtcgtccagcaggccaagcggtacgagcgggcacggcggctcctcgaaacatccggtggcgaggcctcgctctggtcgcaactccgggacgcgtcgaaacgactcgcggaagaccatccgaatcacccagtcacggccgacgtgagcgagatgctcagccggtcgcagccgccgagtgtcgacgatgtagagcaactcctcgatgcggcagagaaccccttcgaggtagacgagcgactcgaggaactcgccagcgaactgcagtccgagtatcccgaccacgatctcacccaagaggtcgtcaatgcagtagagggaaccagcccgccgagtgaggaacgcgtgggtgaattggtcgaagacgccgagcagttgctcgacggtgttgacgagcagctgcgacggattcgggagaccatggatgaactaccggatggctctgtgatggtgatcgagtcgctcgactga

SEQ ID NO: 135 - DNA, 3684 bp, Haloarcula hispanica
gtgacggacgagggctggttcgctgccgacgtcgggagcgatttcgaggagtccgtgcgcatcgaccgcgaagacgacgggcgggatcatcggctggaatcgatcgacacctaccacgtaacggaggagtccgaggagttcatatccgacttcttctcacggctactcggtcggtccgaggatatgcggtcaggcgcgaactactggctctacgggtactacgggagcggaaagagccacctcctcagcgtgctccgcggacttcttgacagcgaatggctgcgacagcgggacgatgtctgggaacggctacccgacggtcggtcgctagagacgctcgagtcaacgtggtcatcgattcacgaggaatacgaggtcattccggtctcggtgaacctcctgaagcatcagggccagaagaaactgagcttcagcgagatcgtcctccgaagcgcccacacgtcggaacggctcactggtgcagagggagggctctcctcgcaactcgacgttgccttcttcgaggactggtaccggacgaccgacgcgtgggccgaccggaccgccaacacccacacggcactccggggtacggttgacagccccgagaagtacaactgggaggacgtgcagcagtacaacgctctagccgacgccgttctcccgacactcttcgagcaggagaccggcacggcggatggtctagatgacctgatgccgtcggatctcgacccacaggcgatggtcgagcgcctcgaacagttgcggagcgatcgcgaagcggaactcggccgcccggtcaaactcgtgctgttgctcgacgaggtcagtctcttcatcgggacggatttcgaccgcctcaccgagttgcagacgctcgcggagagcgtcgacgagaccggcgacggtgacatccaactggtggcgacggcacaggccaaaatcgaggacgtccagccgcagttcgcggctcgcggggccgacttcagcatcgtcaaggaccggttcccgcatcggtttggcctgccgagccgacacgtcggcgaaatatcgacgcaacggctactcaaaaagtcggaagccgggagggaggacacggagcgcgtcctcgaccgtaccagcaacgagcccgagacactgctcgtgtactccggtatcgaacagaacaccgaaccaccgctcgacaacatcgatcgcgagcgtctcatcgagttctatccgttcctcccgtatcagccaccgctgtttctcgaaattctctcgaacctccggcaggaggcccacgatccggcaaagtcgattttctcgggaaccgcacgggcgattctggccctcgttcacggcctcctgcaagagtggctagaggccggcgacgagactcacgtcatttcgcttgtcgacttctacgacctcatcgagccggaactcgatgacattacgccacaggacgtgggagtcatcgaggagatcgaggaacaacacgaggcaggcgaactggaggagatcgacgtggctgtcgcgaaggccgtgttgctcctccagcacatcccggacacgattccgatgtccgagcggaatctcgcagtcgccgtgttgagcgacctcgacggcccgacccagttccagatggagaaccgcgtcgaggactcgctccagcggcttcggaaattcatccgtccgacgcacgacgaaaccgggccgaagtacgcgttcacgcatccggaagagcgcgagatcatcgaagccgcagagcggaacctcgacaacccggactggcagtccatcatcgaagccgtggacgggtatctctgggacgacatcgtgcgtgacctctcgctcccgacgtcggccgagtacggagagactggcgagcagtaccccgttcgctacgggttcagtatcgacgggatagaactcgacacgaccgtcgacgctgcggacgcactcgatgtcgaggtcgccgtcagaggtatttcacctgcggcgacagacgtcgaccacgacggcgacccgctcgaatggacgatcggtcaagacgggctcgacgacctccgagatagcctcatcgagtggtggtcactcagagatgccgtcggagaccacacactcccacagtctgtcgaacgagatctctccgatcgcgcggctcgcgttcagagcaagctcgtcggggctctcgatagcggggcattcgacgtcaaggatcgcggcgaccagatcgggggcatgggctcgggagtcgaggagtatctcgacgtcacctatcccgacgacttccatcccgtaatgttgcaggtcggcgacgaacacttacaggagctccagagactctccgcccaggacccgctccctgcgtgggcccggcagatcgatgtcgcgacagaagaccccgaaacgcacggcgggtcgatccagaacaacgtacgcgccttcaccggccgacagttgaagcaacgcggcgggaacctcgcgatggcgacgatcctcgacggcatcgtgaagaagaagccgatctacgaggacgctcgcccggcgctgtgtgcgattatctgggggctctgccggaagggggacttcctgcccgtcgacgaaacgggcgactccctcgaactcgacgccgtcatcgacctcaacaaactgacgacgacgcgtctcaagatcgcggggagtggcggtgtccgagggattctccgcgagggcggcttcatcgactcgacggagaccataccggacggaatcgtcaggctccagtccgcgaacgacacgctcgcgggtcgactcgggagtctcgtagaagacgtcaaactggtcgccgagagtgacatccaaacgcgagccgttcgcaccctcctcaagtcgttcgcgggggcgctcgaagccgagcagcagagcgctatcgaccgaagagaggccgtcaagtcacgcaataccgactgggcggcagtcgtcgaagcaaccaacgacgcacagggatggtacgacgacgccgaggaggtgtggaatttgcgcctgcccgcgctcacacgaatcgacgcgcagctaacgctcgcccagcagtcgtacgactggctgaccgaggagtgtgacacggccagccagacgctccgtgggagtatcgacggttacgagggcgagtggtggacacacgatgggtgggatcggttcaacgacgcccaaaccaccgcaccggcgctcaacgacgcgatcgggaccgcgtgggactcgttccgagaagaaaccggggtcgatgcgttcgtcgacgagttacaggcgcatccgtggatccagcccctgagcgagttcgaatcgaacgttcggccggctttcgagagtgaatacatcacaccgctccgccgcgccgcatcgtggtacgctgacgtctcgaacgcagtgtcgacggtgactggcggaacgaccaacgccgaagctgacgacttcattcgggcaacgaacgcactcctcgacaacgaccctctcgccgtggttgccggtagcgacatcggcgatttacgagcgacgttcgaagagctacagacactcgttggggagcagtctcccgcggacgtcacggcgatcggggtgctcccgtcggatcgcgaatcgcttgactcagaactggaacggctcgtcgaacaccacgacctcagtgtcgaacggactgaaacgggggttattatccgatga

SEQ ID NO: 136 - DNA, 3720 bp, Halophilic archaeon
atggtcgacacgagctggttcgacgaccttccggaggatttcgaggagtccgtccgtatcgaccgcgacgagcaagatcaccgccaacgggcgattcggtcctatcatatgaccgccgactcccgccgatttatcgaggacttcgtcgaccgcatgctgggccagtcagacgacatgcgaacgggatcaaactactggctctatggctactacggaagtgggaagagccacctgctgaccgtcctcgatgggctgctggacaccgactggctcgatggacaacaggacgccgtctggtcagatctggtccagatctccggggacagcgagttcgagcaactcggcgaccactggcgaacgattcacgacgagtactacgtcatcccgatctcggtcaaccttctgaagtaccagggccaaaagcagcgtagcttcagcgaaattgttctcagacacgcccatcaggacgcagatttgaccggcgtcgacgatggcatctccgaagggctgtcatctcagcttgatgttgcctacttcgagaagtggtttcggacgacggatgcatggtctgatcggcaggctcgtgctgaagctgctctcgatggcgtgacaactgaagccagcgactacgagtggcaatcagacggcctctggaaagacatccagaaatatggtgcgttggcagatgtcgtgcttcccaagctcttcgaggaggtcaacgagactcgcgatgggtatacagatctgcagccgtccgacatcgacccagaggaagtagtgggtaggctggaggagttacgaactgagcgggaggaagagctggggaaaccagtcaagctcgtgttgctccttgatgaggtgagtctcttcatcggaactgacttcgagcgactgaccgagcttcagacactcgccgagaacgtcgacgacatcggcgatggcgacattcagttggtcgcgactgcacaggcgaagatcgaagacgttcaaccgaaattcgccgcacacggcgcggacttcagcatcgtcaaggatcgcttcccgcaccgttaccagcttccgagtaagcacgtcggagatatcgccaagcggcgactcttcgagaaatctgaaaagggggatgtagccgttcgagaggtacttgacgaagcatcggtgaagccgaccgaatcgctggtctacaacgagatcaagcagaacacgaaaccaccgctcgacagtatcgacgacgaggagctcgtcgagttctatccgttcctcccgtaccacgctccgctgttcctcgagatactgttcaatcttcgtcaggaggcaagtgacccggcgaagtcaattttctcgggcacagcacgggcgattctcgcgctcatgcacaacctcctccagacgtgggtagatgagggggaggccgaccaggtcatcacactcgtggagttctacgagttggtcaagccggagctccgagagatactcacgcaggatatgcgagtcatcgaaggctcggaggcgaaccgaggaatcgcagacgaagtcgaggacggtgatcttgaggagttcgatctcgacgttgcaaaagccgtgctgctgctccagcacgtccacgacatcgtcccgctcaacgaggggaatattgcggtttcagtgatgtcggatctcaacggacgctcttggatcagtacgcagaatcgagtcgaggaatcgctcggtcgtctccagaagttcatccgaccgatggcggacgagacgggggcgcggtaccgatttgcgacgcaggaagaacgaattatctacgacgatacggaggcgaacgaagatgaccctgactgggatgccgttctgcaagggctggacgagcatctctggggacggattacgcaggatctctcgctcccggagtcggttccctacgatgactctggcgacgagtatcccgtcacgtacgggttcggccttgacggcactgacttcgagactaccgtcgatgctgacggcggactggacgtgacaatcgaagtgcacggtgttcgaccagaccatacttccgagagcgatgctgaggagacgctctactggtcgattgacacggacgggctggatgacctccgaaagcatctcgtcaaatggtgggcactccgtgacgcgatcgcgacacacaacgcaccgcctgctgtcgaactcgacctcgaccgacgagccaacgctgtccggagcaagctcgtcagtgcgatgcagagtgggtcgtacacagtgaaagaccgaacagacatcagtgggctctctacagccgtccagaccgccgtcggcgtggggtatcccgacgacttccacccaatgatgttgcaggtgaccgaggatcgcctgcaggagttggcggagctctcgacagaggatccactccctgcgtgggcgcacacgattcaggtgccatcgtctgacccatctgcaagccaggggaagaagtcgattcagcgtaacgtgatggctctcacgggtcggcagctgaaagaccgtgatgacggcctcaatatgaataccgttctcgacggaatcacctcgaagaagccgttctatgacgaagcccgtcccgcactctatgcaatcatctggggcttctgtcgggagggccggttagtcccagttgacgaagacggaaacacactggaaaattcggttgtcctcgaccaggaccgactctcgacgacgaggttgaaactgcttccccgcgagcctatcgggaagctcctcgaagcgggtggtttcaagaagacgacagaaaccgtcacagatgggctcatcaaccttcaggaagcgaaccagcagctccggtcctcgcttactggactccaggaagacgtccagttggttctcgataccgacgtttactcgagtgctgtctccggaatcctcgaagcctttatcgaggagctgaccgaccgaatctcgacaaccaccgagcgactatccgtagtgagatcacagggtgacggcctcggggacgcaatcgaacagacgaacgaggtacaagactggttcgacgaagtgagagacgtctggaatcgccgactcgcctcactttatcggttcgacgtacaactcacggcgggtaacggacgattcgagtgggccgacgacgatgcacaatcggaaatcaccgcccaacgcgatgccctcgtggacttcgatgggagctggtggacgacagacggctggaaagcgttcgtcgcagacacgacatcgggactgggtacagagctccagcgctcctgggaggcgtatctcgaccagcagggaatttctgaattcgtcgatcgaattgccgaccatccgtgggtgataccggcaccggaactcccaacgggagtacaggtggcgatggagcgcgagtacatcacaccgctacgcgagttgcggcggtggcacgagacggtcgatggagcgattgcgtcgctctcttcggatgacgaagacgcgcttctgtcggctgctgacgacttcgcagacgtcgagccactctccgagaccgtcgaatacgacgtagacgaactggagggtagactcgaccgactcaccgagatcgtcggtgatcgtgggccggacgagatcgatcagatcggcgtgcttccggacgatcggcagaacatcgaccgacggctcgagcgcctcgtcgagagtcgagagctggacatcgatgtgacggactcgggggtgatcatccgatga

SEQ ID NO: 137 - DNA, 3813 bp, Halophilic archaeon
atgagtatcagcaatctattccacagcgacccaacccgacagctcgaggaagtccagaaggtcaatgcccgtgaacgggcagagaccgacgtcgcagaattctacgagacgaagagtgcagagcgtgtcctcaccgaactcggtgacgtcatcgagacacatcccggagaggccgctcgcttcctctatctccacgcgaccttcggatcggggaaaacacacctgctgaagctcatcggtctcgtcgccgataccgagtccgagttcgcccacttgggtaccgaactcgccgaacagtggcctgggttcgacaacctcgcccagtcgatcgagtcgtcacacgtcgagcgtctcaaaccagtgttcctgaatctcctcgatcgggacgcctcgaaggaaccaccgcttccgttcctcatcttcgaggcgattggacgcgaactcggctatccgaccgatcccaactggctgcttgagtgggcatggaccgttgatatggagtacgacggggtctgggatgcgctccagaccaccgagcacgacgggcaaacgttcgaggacgtgctcgaagagcgtgcttcgctgcggcggtggctctacgaagcactcccagcactgtcggagacgacagggaccgagcttgacagtcgtgacggcgtgaaagcgtccatcgagcgagccgaagcagaggtcgaccccgaatcgttcgaccctgctgagttggtcgaacgtgtcgagaccgtgactgcagcactcaatgaagaaggaccgcacaccgaactcctgctgggactcgacgaggttgcgctgttcgtcggtgacagtcggcatcgctatcgcgagttcgaggagacgatggaagcgctccagcacggcccgaacccggtcgtcgtgaccactggccagtactcgcttccagacacacgtgagagcctcatcggcaaaccctccgaggaccactggacacatcagcaagtgccgctcgaaggtgcagacaccgaaatcatcgtccggaaacgctggctgcagaaggacagtgcaggcagttctcgagtctcctcgctcatctcgtcgatgccagatctctcgctggaggcgtattcaccagtcgggagtgcagaccctgacccagttgagtcgtatccgttccgcgagtatgacttgacgctgttgcggaaggtgatgcaggaactgatcacacaaggccgagcgaccgagcgtgactacatccagggtcgtgcgttgcttgtcctggtgcggtcgctgttcacgaagttcggctgggccgatgcggaggagggagccctcgtcacgtgggacgaactgttcgacttgctcgtcgaggagacgacctacgtaccgctgtgggtccaggagatgctcgacaacacgctgattccgactttcgatggggacgaggacgcgtgggaggtgtgtgtctcgaaggcgctgtacctgctgaaccagacgcctgcagtcccggcgacgccggataacctcgggcggctgatgctcgacgacgtgaacgcctcagtggatcagcgggtcgaagaaacccaatcggcgctcaacacgctcgtcgacaagcggaaggtgctcacagagaccaacgaccagggggacgaggtgtacacgctggtttccgaagagcaagagagcgtgcttagtcgggcacagacgaaagccgagcggatatccccgcaccagctctctgcctggctggagacgcgactccgggagggcgacgatttcttcaggagcgacagcagtctccacgaggccggtgtcggcgacaagcgactcgttccgcttcgctacgagtactcgattctcgacccggtgggcagagcaccgaccacggagtacgatgccgtccgaattcgcgtcctcgccgatgaccccgatacggtttccgaccaggtggagacgtggcagaacgtgaacgatgggcgcgacggtggtgaacacatcctcatcgcgatcgacgtccccgaaccgacgctcgacagaattcgcaacgccatcgggatgggacaggtgctggaagaggagaccgagagccacgaggaactcgaacgggaacaccggactgataaacgccgtttggagtcctctgtgagtgacctcctcgagaacgcggccgtccacacggtccacgactatcgtggcgagcgaccgagcgtcctcgacgaagtcgtcgaagaccaggttcaagctgtcttcggttcgacgcggaaggtactctcgcgaccgctcgtcgaagtcgacgacgcgaaggggctggcgaaattcttccggggaagtggtgactggccgcttgcagacagtgacgcagtgatgctgggtgtggatacgtcgagcacagagattgcggacactgggtggtgtcgagcgttcatcgacacgtacgagtcacagaccgcagtggacgtcgagacgctgctccagcagacacgaacagcgaatggggactaccgaggaaccccgcaagaatcgatcgcggcgttgctcatcacgctcgcgacgtccaacgagaaggttgcgctcaagcaggataccgactacgtgaccgacccgacggcaatcggtcggcacgtacggacgaaagggggactcacgtcactgcaggttcggttcggcgtcgatacagtcaaccccaaagagattcgaaaggtcgtgtcgacggtccttggccacgatcccgacggtagcgaccctgacgcgtgggtggccgagcttgcctcgtgggtcgagaacaacagcgtgctggtcaagcggacgttcaagggcgtctcccgagagttcgacgtctccctggacgcgctggagggcgtactggaaccggcgtacagcggcggtgacaccaccacatcggagctggtggaggacagcgtccagtccgaagcggagacgttcgcagatgcacgcaaactctttgctgtcgacgggggagcgaaggcgctctgggaacagttcaccgataccctcgatctgctggaggaactctaccccagtgcgaccattacctcacggatgcagacgaccgcggagagtggatccgtaccgacaaagacgacagtgagctcacggctggcggatgcgactggacaccgcgtcgacgaactcacgtcgcagtaccgtcgggtgaccggagagaggtgtgacgtctctgaccccgaggaaatctgtgtggtgctgaccgaatggatccgcgagaacgagtcggtggtacaggctctactcgacgatgccaccgccacgttcgacggcatctcgttagatgatctcgaagcggtgttcgagatggcgtggaacgacggcgagatcggtgagggtgaactcgttgccgccgccgtgcgtcagcaggccgaagcgtacgagaaggttcgagacctccttgggggcgagaaaaacccgtgggagcagttgcagtcggcatacgacggtctccaggcagagcaaccggactcaccgacgacggaatcagttgagactgtgctcggctcgtcgcggctcccgtcgattcagcgtgttcggcagctgatcgaggaagcgaagaatccgaaactgccgggggccgacgacgacgcgtgggcagaactacagcgcgttgccgaagagctcaggcgggagcttccgaacgccgacgttaccgatgacgtgacggcggcagtcgacgcagacgaccggcccaccgacgagcgagcgacagagcttcttggcgaagcagagaaactgctgagtaggattcgtgcagtcagagacgctctggacgacgttgacgagggaagtatcgtgttgatcgaggagtag

SEQ ID NO: 138 - DNA, 3747 bp, Natrinema pellirubrum
atggtcgacacaacgtggtttgaggacttaccggaggacttcgaggaatcggtacgcatcgaccgcgaggaccaatctgcagacgagaaacgtcaccggaaacaagccatcgagtcatatcacgttacggctgactcccagcggttcctcgaagacttcgtcaaacgactgctcggcgaagcagaggatatgcgtacggggtcaaactactggctctacggttactacgggagcggaaagagccacctcctaaccgttctggatgggctgatggatactcagtggctccaagaccgctccgacgaggtttggaggaacctcgtcccggatgcgtcagcgagcggggacctcgatacgctccgaacccagtgggaatccgttcattccgaatatcacgtcatccctgtctcagtgaacctgctgaagtatcagggtcagaagcaacgtagctttagtgaaatcgttctccggcacgcccaccagaatccgattctcacgggcgtcaataacggggtctcgactggattgtcctcccagcttgacgtcgcatacttcgaagattggtatcaaacgaccgacgcttggccggaacgggaggatcgagctgcatcagtcgtcgagggagtgacaccagaccaaccgcgatacgagtggggaactgacggcctctggaccgacgtccaggagtacagtgcgctgtccgatgttgtgcttccgaagctgttcgagggcgttacggggacacgcgatggctacactgacctccaaccctcggatattgacccagaagaggttgtcagtcgactggaatcgctgcgcctggaacgtgaagcggagcttgagcaacctgtcaagctcgtcctcctgctcgacgaggtgagcctcttcattgggaccgacttcgagcggctcaccgaactacagacactcgcggaaaacgtcgacgacatcggagacggcgacattcagctcgtcgcgacggcgcaggcaaaaatcgaagacgtccaacccaagttcgcggcccacggggccgatttcagtatcgtcaaagaccggttcccacaccggtatcagcttccgagcaagcacgtcggcgacatcgccaaacgccggctattccagaagtcggagacgggcgaggacgcggttcggcgagtccttgacgacgccgacgtgaaaccgagtgagtcgctcgtgtacaacgaaatcaaacagaacaccaagccggcactcgatgcgattgatgatgaggagctcgtagagttctaccccttcctgccgtatcacgcgccgctgttcctcgaaatcctgttcaatctccgtcgagaggcgaacgacccggcgaagtccatcttctcggggactgcccgtgccattctcgcgcttatgcacgggttgctggacgactgggtcgacgagggcagaggagaccatatcgtctcgctggtcgacttcttcgagttgattgagcctgaactccgtgaaatcttaccgcaggatatgcgggtcgtcgagggcgccgaagagacgaccggcatcgctgacgaggtaggcgacgacgaaagtgagcttcaagagttcgacctcgacgttgcgaaggccgtactcctgctccagcacgtccacgaaatcgttcccctgaacgaggggaatatcgcggtcgccgtcatggacaacctgaacggccaatcgtggattagcacgaccaatcgggtcgaggaatcactggatcgactgcagaagttcattcgaccgacgcaagacgaaagtgggcctcgctatcggttcgcgacacaggaagaacgcctcatctacgacgagaccgaggagaatgaagctgaccccgactgggacgacgtcgtcaacaccttggacgaacatctctggaatcgcatcacccaggacctatcgctaccagagtcagtcccgtacggagaatccagtgacgagtaccccgtttcgtatcacttcggactcgacgggacaacattcgagagcagtattgaagccgaaggtgggctagacatcgacgtcgatgtgcagggcgtccgcccagacatagaaccagagcaaactgacgaggacacgctctactgggagatcgacacggatggcctccaagaccttcgcaaacgaatgattgagtggtgggcgcttcgcgacgcaattgcaacgcgtgacgccccaccagccgtcgagcgtgacctcgaacagcgtgcgaacgccgtccgaagtaagctgacgagcgcaatgatgagtggctcctatagcgtgaaagatcggacggacatcggtggtctctcgaaggcgatacaggccactgtcaacgtcgcctatcccgacgacttccacccgatgatgctccaggtcgacgaaagtcggctgcgagaactacgcgaactcgacagcgatgcaccgctcccgccctgggcgcgaacaatccaagtcccctcgtcgaaccataatggtgggcaaggtaaacagacgattcaacgaaacgtaatgtccctcaccggccggcagctgaaaggccgcgacgaaggactcaatatgaacaccgttctcgacgggatcgttgaggagaagccattctacgacgaggcccggcctgctctctgtgcgatcatctggggattctgtcgggaggggaggctactgccaatcgacgaagacggaaacacgctggaggacgaagccgtccttgacctcgacagcctctcgacgacgaggttgaaactccttccacgcacaaacttgagcaagctgctggaagagggtggattcaaagagacaactgaaacggtcgcggatggtctcatccacctccaagaagccaaccagcacattcgctcgaagctgaccggacttcgcgaagacgtcacgctagtcgtcgacaccgacgtgcgaaccgacgaagtcgctggcttactcaatgcgtttgctgatgagctggcggaacgaatcaatactaccgaaaatcgtatttcaaccgtcaagtcacaagatgacggcatcgaggatgtcatcgacgagaccaacgaggcccaagagtgggtcgaagaggtaaccgacgtctggaaccggcgtctttcgacgctacaacagctcgacgcggtactaacgattcgaaaccgccagttcgactgggttgacgacgacgcacaagcctctatcgaatcccgctcatctgcggtctcatcgttcgatggggagtggtggacgaccgatgggtggagtacactctccggagaattagttcccgacctcgcacccgaacttgagaggtcgtggaacgcgttcgttgacgaacgaggcctgcgtgaactagtcagtcgtattgaggagcatccatggattctcccagctactgatctccccgcaggcgtccacgtcgccttcgaaggcgaatacatcactccgatgcgccatctccagcagtggtatgaaaccatcgagagcgcgatcacggtgttgtctaccgatgctgattcagacgacatcgtcgagattactgacgacgtggcgcagttagagccgctcgctgaaactatcgagtacagtccgagtgagctggatgaccggctcgatgaactgtcgtcgatcgttggggatcgtacgccggacgacgtcgatcagatcggcatcgttcctgacgatcggcagaaactgaatcgtcggttggagcgtctcgtggaacagcaagatcttgatatcgaggagactgacgaaggggtgattattcgatga

SEQ ID NO: 139 - DNA, 3834 bp, Natrinema pellirubrum
atgactatcgacgacctcttccacagcgatccgacgcgacagctcgaagaagtacagaaagtcaacgctcgcgagcgagccgagaccgacgtgagagagttctatgaaaccgacagtgccgagcaggtcctcgaaacgctcggcgaagctatccagacccatccaggtgaggccgcgcggttcctctacatccacgcaacgttcggttcggggaagacccaccttctgaagctggtcggcctcctcgccgacgacgaatccgagttcgcctatctgggtgatcgactagccgaacagtggcccgggttcgacgaactccagcagtcaatcacagactctcacgtcgaccgcctcaagccagttttcctcaacctgcttgaccgcgatgcgtcgaaagagccgccgctgccgttcctcatcttcgaggcgattggtcgggatctcggatacccgaccgacccgaactggctgctcgagtgggcctggacactagacatggagtacgatggggtctgggaagccctccgaacgttcgagcatgacgggaagacgttcgacaaggtactcgcagaacgggcgtccctccgcagctggctctacgaggcgttgccggcgatggaagagacgtctggtacggaactcaacagtcgttcgggcgtgaaagcctccatcgagaccgcagaagcggatgtcgatccagaagaattcgatcccgaggacctcgtctcacgggtcgagactgcaacagcggctctcaacggcggcagcaaacggaccgaattgctgctcggcttagacgaggtggcgctcttcgtcggcgacagtcgccatcggtaccgggagttcgaggaaacgatggaagcactgcagcgtgggccgaacccggtcgtggtcactaccgggcagtactccctcccggatacacgggagagtctcatcggtgagccgcccgaagatcactggacgcatcaacaggtccggcttgaaggagcagacaccgagatcattgtccggaagcgatggctccagaagtcggatcccgagggacgcgaacgtgtcgagtcactggtggcgtcgatgcccgatctctcactcgatacgtactcgtcggtgacgagcgcggatccagacccagtcgagtcctatccgttccgcgagtacgacctgtcgctcctgcgggcggtgatgcaggaactcatcacgcagggccggtcgaccgatcgcgactacattcagggtcgagcactgctcgtcctcgttcggtcgctgttcacgaagttcgggtgggcgtcgaaggaggagggctcgctcgtcacgtgggacgttctgttcgacctgttggtcgaggagaccacgtacctcccgctctgggtccaggagatgatcgacaacacgctcgtcccgacgttcgacggtgacgaggatgcgtgggaagtccgcctcgcgaaaggactctaccttctgaaccagacgcccgctgtcccgtcgaccccagagaacctcggtcggttgatggtcgacgacgtcacggcgtccgtcgacgacgtcgtcgagcaaaccgaatcgggactagagacgctcgtcgacaagcagaaggctctcaccgagacgaacgaccaaggcgacgaggtgtacacgctcgtctccgaggaacaggagagcatcctcagtcgcgcgcaggacaaggccgcgaagatctcgccgcatcagctgtcggcgtgggtggaaacacggctgcgggagaacgacgcgttcttcagaagtgacggcagccgccacgaggtcgatgtcggcgacgagcgcctcgtcccactgcggtacgagtactccatcctcgaaccagtcgaccgagccccgtcacccgagtacgacgcgcttcgcgttcgtgtgctggccgatgatcacgatactgtctcggagcagatcgagacgtggcaggacgtgaataatggtcgcgatggtggcgagcacatcctgatcaccgtcgacgtcccggagacgatgctggagcggatccggaacgtcatcgggatgggacaagtgttggacgaggagaccgaatcccacgaggaactcgaacgcgaacaccgtgccgacaaacgccgcctcgaatcctcggtgacggagatactcaaagacgcgtcagtgtacacggtacacgaacaccgtggtgcgcgctcgagcgtgcttgacagcgtcgtcgaagaccaggtcaacgctgtcttcgggtcgtctcgaaagacgctctcgcggccgctcgtcgaggtcgacgacgcaaaggcgatggcgaagttcttccgcgggagcggtgagtggcctctttcggacgcggacgccgcgatgcttggtgtcgacactgtcaccgcagaagtcgcagatacgggctggtgtcgcgagttcatcgagacgtacgaggcacagaaatccgtcgacgtcgagacaatcctccagcaaactcagactgccaacggggactaccgcgggacgccacaggagtcgatcgcggcgctgctcatcacacttgcgacctccaacgaatcggttgcgctcaagcaggatacggagtacgtgtctgatcccgccgccatcggtcgacaagtgcggaccaaagggggactgacctcactccaggtccgcttcggcgtcgaggttatcgatccgaagacggtgcgagaactcgttacgacggtgctcggcgaacagccgtcgggtgatggacccgacgagtggctggacgagctcggccagtgggtcaacgagaacagtgcgactgtcaagcggacgctgaaaggcgccagccgtgagttcgatgtgacgctcagcgccttcgaggcaacggtcgacccagccctcggcggggacgagctttccacgtccgacctcggaagtgaggatgacctcgaaacggtactcgaggaggcgaagatcttcgcgaacgctcgtgaactcttcggcgtcagcgaagacggggcgacactctgggaacgcttcagcgacgagctcgacacgatggcctcgctctatccgaatgcgtcgatcactgccagtatgcgagcgacggcggaaggtgagactgtccccagtgtttcgacagtcgagtcacggcttgaggacgcgaagggacatcgcgtcgacgaaacatcggctcagtatcggcggatcacaggtgagaccgtcgctgactctgacccggaagctatctgtgccgatttaagcgcgtggctccggtcgaacgaggacgacgttcgagggatcgtcgatggtgctactgatgaattcgacgatgtcgtacttggcgacctggaggacgtgttcgaagctgtgtgggccgacgaggaactgtcggaaggtgatgtcgtcgactccgctgtcgtccaacaggccgagacgtacgatcaggttcgcgacctcttcgacgactctgacggttcggcactttggtcgcagctacaggcagccggcgaagagctgcgtgaggagcacccagactcaccgacgacagagtccgtcgagactacgctcgctgcttcacggccaccctcgaagcgacgtgtgcgccagctcatcgagcgtgcaaaggacccgaggccgccaggtgcggacgacgatgcgtgggccgaacttcagatggtcgctgaagagctacgccaggagcttccgaacgccgaggtgaccgatgacgttacggcagctgttgatgctgatgagcgaccgagtgaagaacgtgtgaacgagctactttcagaggcgaagaaggtgctgaagcgtatacagggtgttaacgagcgacttgacgggttggaggacgggagtatcgtgctgctcgaggactga

SEQ ID NO: 140 - DNA, 3627 bp, Planctomyces limnophilus
atgagcagtcccgctttaatcagacacttgtttcgccaggatgtcactcgcgacattcctccggtggtgtattttcacgagcagagtcctggaaaggttcaggacgaagtctcggagtacattatcactggtggttggaacaaagatcatcccaacttcaaacgagtgcctgatggaattcacgagcaatacgtcaggctgctgaacgccatttcccgcgagatggaaaagaatggcggcccctcgctgcctgcagcatggatctccggattctatggctctggtaaatccagttttgccaaactgctggggctgtcgctggatgggcttgaactgcccaatggccagtcgctggccgaagcgctactggcgcgtgacctgtctgatcgagcacaggagtttcgcgacgcctggaagaagctgcggcaactgatcgccgaaccgttcgccgtggtgttcgatatcggtggatttgccagggacaacgaacacattcacacggcctgtgtgcgtcaggtacaaaagcgactcggatactgtgcgaatctgccgttggtggccaacttcgaactgcgtttggaaaaggctggcgaatggacgcggttcctggaggtgtctgaccagatcggtcacccctgggaacaggaaaaggaccagccgtttgccgacgaagtcttctccgaaatcctgcatcacttcgacaaagaccgctacaccaatccgatgagctggatcgacagtcgggccgggacgacggtgaccgactcccccaccgaagcagtctgtgccatcagtgacatgatgcggcttcgcaaacccgacggcactttgtttatcgtcgtggacgaagtctcgcagtacgtgctgtctcacgagcagcgggtcgacaagttgagggcatttgcatctgagctcggtagccagttgaagggcaaagtctggctgcttgcgttgggtcagcaaaagatcgatgaggacgcgggcgacgctttcctcgtctgggccaaggatcgttttccacagcagctccgcgtccatcttgccgccacgaacatccgggacgtcgtccatcgccggttgctgcagaagaccgaagcgggcgcgaaggaccttcgcaagcgattcgagaaacatcggccggatctcaagctctttgcgttcggctgtgaagacgtctctgctgacgagttcgttgaagtctacccgttgctcccaggccaaattgatttgctgctgcaaatcaccagtgccatgcgcatccggtcggctcgcgcccagggagacgatcaggcaatccgtggtctgttgcagctgttgggtgagctgtttcgtgaccagaatctggccgatctgcccgttggcaacctgatcacactcgacacgatttacgagattcaaaaaaccgcgctcgattccgatacgcaggccagcatggcccgcatcctgaacgaaaccgccaaccgtgctcctatgctgcagcgcgttgcaaaggcggtcgctctgctcgaactgattcaggatacccgaccgaccgacgccaagctggttgcccagtgcctgtacgatcgcatggatcgcggcaatcaggtcaacgaagtcacagaagcgctcgaagaactccgtcgtgataaccttcttgccttctccgaaaagctgggctaccgcatccaatcgacggctggtgaggagtgggaacgcgagaaacgtgagattcgcgcttcccgtgaagtcatcagtgaaatcattcgcgatgccttgcagatggtgatggagaaaccggaaaagcccgccttcaaaaaacggccatttccctgggccgctctcttctctgatggcaagggcatggatgacgacaagctggtgcgtgccaaggacgaagccgtcgtctgtgtcgacttccgtttcgcccagcccgatgaacgatcagaatcggtttggattgaacgcagcaacgaagtgaatcttcacgaccgcctgatctgggtgtgcggcgacactaacgacctgaccgatcgggcgcgtgcgttggcccgcgcccgaggaatggccaagcgatatgctccccgccgcgattccctcagtgagcagcgaaaactgctcctgcagcaggaagaggtcaaatccgaaacgctggaatcggacatccaggacattgtggagtccgcctggctggccggtaccatctacttccggggcaagacttacaagccggacgacttcggcagcaagtttgccggcgcactgctgaaggtcgctgaacgagtcatgccgatcctgtacaaggaatttgatccgatcaccctccagccatcggaactggatcagttgctgattcaggaactcagcggtccgtcgacacggtttctcaaggatgaactcggcattctggaactcgatgccggcaaatacgtccccacctgcagcggcctgatccccacgcgcattcgcgaactgatcgaatccgaagacggtgccaccggtgctcatctcctctcgaagttcgctggcccgccttatgcctaccaggccgaagtcattaaagcctgcgtcatagggctgctgcgtggcagcaaaattaaaatcgaagatggcgaagggaacgaaatcaccgcggttcgcgatgccggcgtgcgagacgtcttcgagaagcctaccgcctttcgcaaggctcagttcatcccggtgggagacgacgacatcggtgtgcgggcacgggctcggatctgcaagttctttgatgagcaactcggcacgccgctcgatcgtgaagacaacgcgatcgccgatgccgtggagaagaagtttcatccgctcgcgtccgatctgcgcgacgtcctggtgcggtttgaccgcgtgcccggcaatcgggagaccccgacggaactcacccgactcaattctgctctggaacagtgcctttccaaaatccgtaacacaaaggaaaccctcaagcgggtgaagaagcatctcgacgatctggtcgacggtgtcaagctgcttaaacgctttggggccgaactgaccgaagactcgctgcgcctgcttcgcgatgcccacaacgtcgccacgaatcaggccgcccagttgcgcgaactcggtacgctgaccggccccgcccaggaatgcgccgagcggattgccgaacaactcgcttcgtcgcgtccgtgggtggatgccctggcgattcaaccggatctcgatgtggtctgtcaggcctaccgcgaggaacggactcgtctattggaatggcaggagcaacaggctgaacaggcgcgggcccgtatccggatgcgggatggctacagtacgctcccctcagagaaaggacacaacgtccttcggcccatcaacaactcatgtagcgacaccaccgcggcggccatcgccccggcgctgcgggatctcaaggatccgttcaccgtccggctgcaggccgccgaggagcaggcgaacaggctgctggatgagtatctcagcggaggatcgaagccgatgatcgtcccggtcgatctttcgttgcacaaccgggaaatcaaatcggaagccgacgtcgacgccctggtcgaagagattcgcgaacgcctgctgcagcaactgcggagcggtcagcgaatccggttgttgtag

SEQ ID NO: 141 - DNA, 3621 bp, Anaeromyxobacter dehalogenans
atgaagatccaggacctcttcgtcgccgacgtcacgcgggacatcccgccggtcgtctacttccacgagcagagccccgagaagctccaggccgaggtcgccgagtacatcatcacgggcggctaccgcgacgggcatccgcaggcgcgccggctcaaggcgggcatccacgagcagttcgttcacctgctccgggcgatcgtgagcgagcaggcgaagccgaacggccccgagctgccggcttcctggatctcggggttctacggctccggcaagtcgagcttcgcgaagttgctcgggctggctctcaacgacgcgaggctgccgggcgggaagccactcgtggacgcgctgatcgcgcgcgacgagtcgccgctccggcaggagttcgttgaggcgtggaaggcgctgcgagcggcgctcgacccgatcgcggtcgtgttcgacatcggcggggtcgcccgcgacgacgagcacatccacgtcgcggcgctccggcagatccaggtgcggctcggctactgctcgaagagccacctcgtcgcggcgcacgagctgatgctcgaacgggacggtgagtgggacgtcttcctcgccgcggcggagaagacactcgggaggccatggtctaaggccaaggaggaccagcaagcggacgaccacttctcgcacgtgctctcggtgctgcaccccgagcgctaccgcgacccgatgacctggatcgactcgcgcgccgggtcgaagacgggggccggaaccgccgtgaaggaggtcgtcgattccatcgaggcgatgctgagcatccgcgcgcccgggaaggcgctcttcatcgtcgtcgatgaggtgagccagtacgtgcaccaggacgacaaccggatgctgaagctccaatcgttcgtgtcggagttggggcagcggctgaaaggtgcggtgtggctgttcgcgaccggccagcagaagctcgaggacacgagccaggccgacaacatcggcaagctgaaggaccgattcccgctcccgctccgggtccacctccacccgagcaacatccgcgacgtcgtccacaagcggttgctcgcgaagcggaaggatcgcgaggcgcttctccgcgagctgttccagaagcaccggagcgacctcaagctgaacgcgtacggatgcgaggagattaccgaggaggacttcctcgaggtctacccgatgctccccgggcaggtggatctgctcatgaagatcacgtcgagcctgcgcacccgctcgacccgcgtccagggcgacgaccacgccatacgcggcctgctgcagctcctcggcgagctcttccgcgagcagaggctcggggagcatgaggtcggagagctcgtgacgctcgatgcgatcttcgaggtccagcactccgcgctcgaagccgacgtccagacgacgctcgcccgcatcttcgaccacgccgacgtccgcgacgacgcgctcgcccagcgcgcagcccgcgcggtcgcgctgctcgagctcatccaagagcaggagcccaccacgcccgagctggtcgcgaggtgcctctaccgaaggctcggggacggtagccaggtgcaggcggtggggcaggcgctggagcgcctccgggagtcgaacctcgtcgcctactcggagaagctcgggttcaagatccagagctccgcggggcaggagtgggagcacgagcgtgaggacatcccggtcaccggagagcaggtctccgaggtcgtccggacgaagctgaaggagctgctcgcgatgccggagctgccccgatacaagggctgctccttcccgtgggcggcgctctacagtgacggccggcagctcgccgacgagcgcgtgcagggcacgaacgctaacgcagccgtgacggtggacttccggttcctgcgcgtgaaggacgatcgcacctcgacgacgtggatccagcggagcgacaaggagccgctcacggatcgcctgctctggctggtcggcgatcccggccccatcgagagcatcgcccgcgagtacgcccgctccgaccacatggtgaagcggtacggcgtccgccgcgagtcgctcacgaaggagaaggggcggctcctcctcgaggaggaggcccgctacgaggagctcgagaagaaggtgaaggcggccgtcgccgacgcgttcctcgacggcacgatgttcttccgggggcggcctctcgaggcgcggaccctcggaagcgccttcgcgacggcgctgagcgccgccgcgacccgtatcctccccgacctctacccgcacttcgtggacgtcgcgatctccgacgcggagctgaatcagctcctcgaacgtcacctgaacggaccctcgaacaagttcatggaggggcggctcgggatcctgtcgctcgacgctgggcgctacgtcgcgacctgcgccggcgccgagcccgcgcgcatcctgcagtacgtcgagaacgctaacggcgcgtccggcgcgacgatcatctcccacttcggcggtccgccgtacggctacccggtggacgtggtccgcgcttgcctcgccggcctgctccgggccgggaagatccgcattcgaccggacggggagcccgagatcacgtcggtgaacgacccgggcacccgcgacctgttccggcgcgaccgcgacctgcgccgcgccgacgtgttcccggcgcgggagggagcgatcaccgcccgggacaaggtggcgatcgcgaccttcttcaagacgcacctcgagctcgatctcgagcgcgagaacgacgccttcgcggacgccgtataccagcagttccccgggcggcgggagcggctccgcgaggtggaggccctctacgaccggctgccgggccgtccggcgctcccggcggcgctcgagcggctcgggaaggccctcgaggactgccgccgctcgcggcaggtcgaggagacggtcctcgcgctcaagcggaacctcgacgccctccgtgacggcctcgagcagctcgcgatcatccgcgccgagctgacggacgacgcactccacgcgctcgcgcgcgccgcgcaggtccgagacgtcgagctcgagcagctccggcaggtcgaggcgcttggcggggtcgaggaggacggcagggcgctcgcggagcacctctcgggcgagcggccctggcgcggcatcgccgacgcggcgcccgcggccgcgcgtatccacgagcggtacgtcgaggcgaggagggcgctcctcaaccggcagaacgcggaggcggaggccgcccgcggccgggtcaaggcgcgctcggggttcgagaagctctccgccgaccaggcgcaccacgtgctacggcccgtcgcggaggcgctgttcgacaccgccgcagacgcggtcgcgcccgcgctcgccgacctgcaggcgcgcttcccccagcggctcgcggcggccgaggagctcgcccaggagcggctcgacgacgcgatcgcgaagctcaccgagtcgcaggtcgtgaaactcgaggccggtctgcgtggccgcgagatcaagagccgtgacgagctgaagacggtgctccgtgagctggaggagcggatcggcgccgagatcgacaagggccgccgcattcgcctcgtgtga

SEQ ID NO: 142 - DNA, 3624 bp, Haliangium ochraceum
atgctgatccgcgacctcttcgcctccgacgtcacccgcgacatcccgcccgttgtctatttccacgagcagacgccgcagaagctcgcggacgaggtcggcgagtacatcatcaccggcggctggcccgagtcccatcccaaccaccgccgcgtccccgacggcatccacgagcaatacctgcggctgctcaccggcgtcgccgccgagctcgacaaacccggcggccccgagctgcccaccgcgtggatctcgggcttctacggctcgggcaagtcgagcttcgccaagctcctgggcctggccctcgacggcgtcgcgctgcccgatggcacctcgctggccgaggcctggctgcgccgcgacacctcgcctcgcgccggcgaattgcgcgccgcctgggacgccctgcgccagaagatcgaccccctggccgtggtcttcgacatcggcggcgccgcccgcgatggcgagcacgtccacgccgccgccctgcgccagctccagcgccgcctgggctactgcagcaccgagcccctggtcgccgacttcgagctcaagctcgagcgcgacggcgtctaccagcgcttccagagcgtggccgccgaggtcctgggcggaccgtggtccgaaaaaaaggacaacgccctggccgaggaggacttctcccgggtcatgagcgagctgttccccgacacgtacaccgaccccatgagctggtacaccagccgcgccggcacccacagccgctccgagtcgcccgaggaggccgtgcgcgccatcggcgacatgctgcgctttcgccgcccgggcgccaccctgttcctggtggtcgacgaagtctcgcagtacgttctcggacaccaggaccgaatcgaccgcctgcgcgccttcgccaacgcgctcggctccggcctcaaaggccaggcgtggctgttcgcgctcggccagcagaagatcgacgagggcgccggcgacgccttcctggtgtgggccaaggaccgcttcccgcccaggctgcgcgtgcacctggccaacaccaacatccgcgacgtcgtccacaagcgcctgctggccaagacccacgtcgcccaggaccagctccgcgcgctgttcgagcgccaccgccacgacctcaagctcttcgcctaccgctgtgacgaggtcacccccgaggagttcatcgacacctacccgatgctgccgggccacatcgacctcatcctgcagctcaccagcgccctgcgcacccgttccaagcgcgcccagggcgacgaccaggccatccgcggcctgctccagctcctcggcgagctgttccgcgaccagcgcctggccgagcgcgacgtcggcgccctggtcaccctcgagcagatctacgaagtccagcacacggccctcgactccgacgtccaggcctccatggcccgcatcctcgagcgctgtaccagtgacgagagcggcctgctggtgcgcgtggccaaagtcgtcgccctgctcgagctcatccaggacaccgagcccaccaccgccgccctggtcgcccagtgcctctacgatcgcgtcgaccgcggcaaccgtctgtccgaaatcaccgacgcgctcgaggccctgcgccgcgacaacctgctcggctattcgcaaaaggccggctacaagctgcaatcctcggccgccgaggagtgggagcgcgagcgccgcgacatccccgtggcccgcgagaccatcagcgacgcggtcaaagacgccctcctgcacctgctcgccgggcccgagcgcgcgcgcctcgagggccggcccttcccgtgggcggccgtgttctccgacggccgccgcgccgacgacgccgcgctcatcgacccgcgcgacgaggccgtggtgcgcgtcgacctgcgcttcctcaccgcggccgacgagcgcgaaggcagcgtctgggtcaagcgcagcggcgagagcgcgctgcgcgaccgcctggtctgggtggtcggcgacaccgggcagatcgacagcaaagcgcgcgatctcgcgcgttcccaggccatggtgcgccgccacaaggccgcgcgcgagtcgctggcccccgcgcgccggctgctgctgcaacaggaagagaaccgcgtcgaggacctcgagcgcgagctgcgcgacaccgccgccgagtcgtggctggccggcggcctgtacttccgcggccgcgccctgcctccgggcgagcacggcgccagcttcgccaccgccctgagcgccgtggccgcgcgcatcctgcccgagctgttcccgcacttcatcgccacccaggtgcagcccagcgagctggcgctcttgctcgcctctgagctgtccggcccgccgcccaaattcctcggcgacgagctcggtatcctcgaactcgacggcggccgctacgtgcccgcgtgcagcggcgtggtcgcgcgccgcgtgctcgaacacatcgacagcgagggcggcctcgccggcaccagcctgctcgcgcatttcggacgcccgccctacggctacaccgccgaggtcgtcaaagcctgcgtcgccggcctgctgcgcggcagcaaagtccgcatccagcccgacgccggcgacgagatcacggccgtgcgcgacgccggcgtgcgcgaggtcttcgacaaagaccgcgccttccgccgcgccagctacttcccggccggcgacgacgacatcggctttcaggcccgcgcgcgcatctgcaaattcttccagaccgcgctggaccatccgctcgaccgcgaagacaacgccatcgccgacgccgtcgccgccgacttcccgcccctgtccgagcgcctgcgccacgtcctcgcccgccaccggcagattccccacgcccccgatcccccgcccgagctggccccgctcgacgacgccctggccaaatgcgtggccaaagctcgccagaccaagcccgccgtcaagctggtcaagcgccacctcgacaccctgcgcgagggcgtccagaccctcaacgccatggacgccgagctcacccccgaggccatcgaccaagtgcgcgccgcctttgacgtgcgcgaccacctgctggcccagctccgcgagctcggcgccctcgcgcccgacgatcaggccgccgccgaccgcctgtccgaacacctgcgcggccgcaaaccctggctcgacatcgtcggcctcgcccccgaactcgagcgcctgcgcgccagctaccgcgagcagcgccagcgcctgctcagcgagcagagcacccgctgtgagcaggcgcgcgccgaggtcaagacccgcgccggcttcagcaccctgagcgccgaccaggcccaccacgtcctgcgccccatcgcccaggccctcagcgacaccaccgccgaggccgtggccccgccgctctcggccctgagcggcgccttcgtgcaccgcctgcacgccgccgagcgcgaggccaacgagcgcctcgacgccatcctcagcgagggcgaccggcccgtgatccagaccctgcggctcgagctgcgcaaccgcgagctggccagcgaagccgacctccgcgccctgctcgacgagctcgagcagcgcctgcgcgccgccctcgagaccggcgcccgcatccgcctggtctga

SEQ ID NO: 143 - DNA, 3624 bp, Haliangium ochraceum
atgctgatccgcgacctcttcgtctccgacgtcacccgcgacatcccgcccgtggtctacttccacgagcagacgccgcagaagctcgcggacgaggtcggcgagtacatcatcaccggcggctggcccgagccgcaccccaaccaccgccgcgtccccgacggcatccacgagcagtacctgcggctgctcaccggcgtcgccgccgagctcgacaaacccggcggccccgagctgcccaccgcgtggatctcgggcttctacggctcgggcaagtcgagcttcgccaagctcctgggcctggccctcgacggcgtcgcgctgcccgatggcacctcgctggccgaggcctggctgcgccgcgacacctcgcctcgcgccgccgagcttcgagccgcctgggacgccctgcgccagaagatcgaccccctggccgtggtcttcgacatcggcggcgccgcccgcgatggcgagcacgtccacgccgccgccctgcgccagctccagcgccgcctgggctactgcagcaccgatcccctggtcgccgacttcgagctcaagctcgagcgcgacggcgtctaccagcgcttccagagcgtggccgccgaggtcctgggcggaccgtggtccgaaaaaaaggacaacgccctggccgaggaggacttctcccgggtcatgagcgagctgttccccgacacgtacaccgaccccatgagctggtacaccagccgcgccggcacccacagccgctccgagtcgcccgaggaggccgtgcgcgccatcggcgacatgctgcgctttcgccgcccgggcgccaccttgttcctggtggtcgacgaggtctcgcagtacgttctcggacaccaggaccgaatcgaccgcctgcgcgccttcgccaacgcgctcggctccggcctcaaaggccaggcgtggctgttcgcgctcggccagcagaagatcgacgaggacgccggcgacgccttcctggtgtgggccaaggatcgcttcccgccccggctgcgcgtgcacctggccaacaccaacatccgcgacgtcgtccacaagcgcctgctggccaagacccacgccgcccaggaccagctccgcgcgctgttcgagcgccaccgccacgacctcaagctcttcgcctaccgctgtgacgaggtcacccccgaggagttcatcgacacctacccgatgctgccgggccacatcgacctcatcctgcagctcaccagcgccctgcgcacccgttccaagcgcgcccagggcgacgaccaggccatccgcggcctgctccagctcctcggcgagctgttccgcgaccagcgcctggccgagcgcgacgtcggcgccctggtcaccctcgagcagatctacgaagtccagcacacggccctcgactccgacgtccaggcctccatggcccgcatcctcgagcgctgcaccagtgacgagagcggcctgctggtgcgcgtggccaaagtcgtcgccctgctcgagctcatccaggacaccgagcccaccaccgccgccctggtcgcccagtgcctctacgatcgcgtcgaccgcggcaaccgtctgtccgaaatcaccgacgcgctcgaggccctgcgccgcgacaacctgctcggctattcgcaaaagaccggctacaagctgcaatcctcggccgccgaggagtgggagcgcgagcgccgcgacatccccgtggcccgcgagaccatcagcgacgcggtcaaagacgccctcctgcacctgctcgccgggcccgagcgcgcgcgcctcgagggccggcccttcccgtgggcggccgtgttctccgacggccgccgcgccgacgacgccgcgctcatcgacccgcgcgacgaggccgtggtgcgcgtcgacctgcgcttcctcaccgcggccgacgagcgcgaaggcagcgtctgggtcaagcgcagcggcgagagcgcgctgcgcgaccgcctggtctgggtggtcggcgacaccgggcagatcgacagcaaagcgcgcgatctcgcgcgttcccaggccatggtgcgccgccacaaggccgcgcgcgagtcgctggcccccgcgcgccggctgctgctgcaacaggaagagaaccgcgtcgaggacctcgagcgcgagctgcgcgacaccgccgccgagtcgtggctggccggcggcctgtacttccgcggccgcgccctgcctccgggcgagcacggcgccagcttcgccaccgccctcagcgccgtggccgcgcgcatcctgcccgagctgttcccgcacttcatcgccacccaggtgcagcccagcgagctggcgctcttgctcgcccccgagctgtccggcccgccgcccaaattcctcggcgacgagctcggcatcctcgagctcgacggcggccgctacgtgcccgcgtgcagcggcgtggtcgcgcgccgcgtgctcgaacacatcgacagcgagggcggcctcgccggcaccagcctgctcgcgcatttcggacgcccgccctacggctacaccgccgaggtcgtcaaagcctgcgtcgccggcctgctgcgcggcagcaaagtccgcatccagcccgacgccggcgacgagatcacggccgtgcgcgacgccggcgtgcgcgaggtcttcgacaaagaccgcgccttccgccgcgccagctacttcccggccggcgacgacgacatcggctttcaggcccgcgcgcgcatctgcaaattcttccagaccgcgctggaccatccgctcgaccgcgaagacaacgccatcgccgacgccgtcgccgccgacttcccgcccctgtccgagcgcctgcgccacgtcctcgcccgccaccggcagattccccacgcccccgatcccccgcccgagctggccccgctcgacgacgccctggccaaatgcgtggccaaagctcgccagaccaagcccgccgtcaagctggtcaagcgccacctcgacaccctgcgcgagggcgtccagaccctcaacgccatggacgccgagctcacccccgaggccatcgaccaggtgcgcgccgcctttgacgtgcgcgaccacctgctggcccagctccgcgagctcggcgccctcgcgcccgacgatcaggccgccgccgaccgcctgtccgaacacctgcgcggccgcaaaccctggctcgacatcgtcggcctcgcccccgaactcgagcgcctgcgcgccagctaccgcgagcagcgccagcgcctgctcagcgagcagagcacccgctgcgagcaggcgcgcgccgaggtcaagacccgcgccggcttcagcaccctgagcgccgaccaggcccaccacgtcctgcgccccatcgcccaggccctcagcgacaccaccgccgaggccgtggccccgccgctctcggctctgagcggcgccttcgtgcaccgcttgcacagcgccgagctcgaggccaacgagcgcctcgacgccatcctcagcgagggcgaccggcccgtgatccagaccctgcggctcgagctgcgcaaccgcgagctggccagcgaagccgacctccgcgccctgctcgacgagctcgagcagcgcctgcgcgccgccctcgagaccggcgcccgcatccgcctggtctga

SEQ ID NO: 144 - DNA, 3648 bp, Acetohalobium arabaticum
atgcaggttaaagacttgattaattttgatgaaattaaagatgtaatcgatattgatagtgatttagagaatgaagaaagttgtaaggcccttgtagacaaatatattatttctgaaagattacggggatacttacaagagatagctgaagacttagctcagcctaaacataaatcctgtcagattatcggtagttatggttccggtaaatcacatttgcttgcttttttatctgcactactggacaatcctgatttttcatcctatattcaggatgaaaaagtaagagaagcttttgagagtaatcttaatcggaggtttgcagtagtccaatttgaattgcaagcaggcaggactgatttaagccattatttttatgatcgagtagagatgaagttaagagataagtacggaattgagattccatcggttgatcccgatcaggtatttgatcataaagagaaagtaagagagattttaggtaaggttaaagaagtagatccccagatgggtttggttgtcattattgatgagatttctgactttcttaaacagaaggttaagaaagagaagaagcaccgtgatactcaatttatgcgggtattggcccaggccagtcagacgatggattttatgttaattggatcgatgcaggaagatatcttaactgatccggagtttaatgatgaagctgatagttttggtcggacttcggaacggtatcggatagtgactatttcgaaggaagatatcaaaaaggttgtttcacagcgggctttaaataagagtttagaacagcgagaggagttagaggaattacttactgattatggacaacagattgaagaagtgcacagcaagatagatgaatttatagatctctatcctgtccatccttatgtaattgaagtatttaatcaactgccctactttgagaagcggggcgtaattcagtttactgttgatgaagttaagaagatactcgatgaagagtttcctgcttttattacctatgaccggatcttcgatctaattgcttccaagcatactgttaagagcctggatgaagtagcagaggtagttaaagcaatcgatactttaaatagtaagataccacttttaagagataatttacaggaggatgctcgtcggattgttaaagctctggctgtattgaagctatatgggcagacggccaataacggagcgactccagaggagttggctaatgagctattaattatctctgataagttctctggagctgatcgaattgagatggtgctcaataaactgcgggaagtaacggatggtcagtttattgctaagagtgagaataactactattatattgatctagagcatacgagagattatgatgtaataattaagcgtaagactgaagatttatatgatggagcgacggatgaagagctagttaaagttctaaagagtgtttttgaattggatagtgacagtgactatgatcgagtctatgatgattatagttactggccggataagaagtcctttagatatggttcgtttatctatgatgatggctcttcggaagtagaaaagggagatggtgatttcaattttgtctttgtatctccttatcgagataggactactatcaaacaggatggaagtacggcggttttgaatttagagtatgatgatgagttggatactctacttaaaaaagccgcagccttaacttcattgatcaagaattcgccttatccgaagaatataatgcgttctagattgaaaacttgtaaaggagagttgaaagaaaagttattggataaggtgattaacacggagattgagaatggaaccagttatgctggggccggtgggctactaagtcagcagcctgatacgttaatggagtattactatgagattaaaccggctttgtttggtgcttatttcagtgaaaaatatgataagtatcctaagttagccaatcaattgacgccggagaatattcgaggtgaagtggagcggactattaaggatattcttggtagtggggaacaggttactgttagtaattcacagaatctgcttaaggccttgcagctgttagatagtgataattatcctgatagtaataactctccttatgctaagctaatattgaagaaattgaataacaataagggtaagaatgttaagattgaggagattgtagaagagttagccgggaagccttacgggttgaatagagaattggtctatttaattttagtagtcttgacctataatggagagacgaatttaaagaagcatggtgggaagactgttacagcagcagacttaaaggatgttctatcatcaggtctggatgcttttgatgaaatatcatatattactttggaaacggactttccagttaatgaagtagctaaagtattgagagtattagatataaacccaggtctaattaagcagaagaagaatagaaaggatgctttaaagcagtttaaaaatgaagtaggagatattgagaataagattaatgaagttgatcaacagttaagtaacttaaagataaaggctaagccgaatgaacatatcgaccttgatgctttattggccaaacgtagtggaatagataatattccgattgagaagtttagtaaggttaagacagtaccgggattgaagaagatagtacttgatgattttgaacttgaagagttagaaatcggtttgaagtttctggataactttattgaatttttggctgactttgaagagaagatctatgatccttatattcatctaaaagagtcaatggattttattaaagagtatagaaacttctttgctgatgaagatattgctgctttagaagagattgccgataagtgtgatgagattgttgatgatctatctacgttattagaacatgatgaacggcggattttaaaaggtaagctccagcagtatcagagaaagtatcgggaaatttattatcagacccatgagcagaaggtaggtgctggagttgaatggagtaagctagaaaaaattaagaataatcaggagctgcagcagttgaaggttctaaaggatgtcagaggtttagatactgctgactttaagcggttacagatgaagatcaataagttatcgcgggctaagtgcgatagtttagaagaggagtatttaagcgggaattataagtgtccttattgtcaatttccggagtttgatgcttcaagtttaaaagatatcgatgatacactggatgagatgtgggatgaaatttatgatattaaggatgaatgggaagcacagattttagaggagattaagaattatgaagataatatcaggttattggatcaggcagaaaaggaagtaattgaggagattcagtctgcgaagactttaccggataagatagatagagaattagttaaagcgcttaataatctcttctccgagctagaagagattgaggtatcaggagcagaaattgaagagattatctttgccaatggtggagtattggactatgatgattttgcaaataaattagaagaagtgaaggagaagattttaactcagggtgatagaactaatctcagaattaagagaccagctgatgatagagaagaggaggaataa

SEQ ID NO: 145 - DNA, 3732 bp, Acidothermus cellulolyticus
atgaggtatgcagacctgatccagttcgagccgatcgagtccgtcgtccagcttcgggatgccgatgaggtcacgagcgcgagacagttggtctgcacttatgtcatctccgacgagatggccgagaagctgaccggccttgtgatcccccagcttcagttcgaccagcccgccgataacaaggggctgcttgtcgtgggcaactacggtaccggtaagtcacatctcatgtcggtgatctccagcatcgccgagcacgcggacctgctgtccgccctggacaacgctcaggtggcacaagcagcaagagcgatcgcaggcaagttcaaggtggtccgcaccgagatcgggtacaccactatgtcgctgcgggacatcctcgtcggcgagctggaggagcacctggccgccatgggcgtgacctacaccttcccacacgccagccaggtccccaacaacaagcgggcattcgaggagatgatggctgcgtttcatgccgagttcccggaccatggcctgctcttggttgtggatgagctcctggactatctccgtggccgcccggaccaggcgctgatcctcgaccttaacttcctccgtgaggtgggcgaggtctgcaaggacctgcgcttccgcttcatggcaggtgtgcaggaggccattttcgacagccctcgtctcgccttcgcggccgaaagcatccgccgggtcaaggaccgcttcgaacagatccttatcgcccgaaaggacgtcaagttcgtagtcgccgagcgcctgctcaggaagactggcgaacagcaggccaagatccgcgagcaccttacaccgttcgccaagttctacggccacatgaacgaacggatggacgagttcgtccgcctcttcccggtccatcccgactacatcgacaccttcgagcgcatcacggcggtggagaagcgcgaggtgctcaagaccatctctctggccatgaagacgctgcacgatcaggaggtgccggaggaccggcccggtctcattgcgtacgacagttactggacttccttgcgcgagaacccctccttccgcgccgtcccggacatcaaggcggtgatcgattgtagccaggtgctggagtcccggatcgagcaggccttcacccggccggcgtacaagcccatggcgctccgcatcatccacgcgctctcggtccaccggctgacgaccggagacatctacgcacctctgggcgccacggctgaggagctgcgcgacgcgctctgtctttaccagcccggcatcgaagaattaggtggagacccggccgacgacctcctttcccaggtggaaacggtcctgcgcgagatccacaggacggtcagcggccagttcatctcctccaatccggacaaccggcagtattacctcgatctcaagaagaccgacgacttcgacgcgcttatcgagaagcgcgccgagagcctcgatgcctcccagctcgaccgctattactacgaggctttgaaacgggtcatggagtgtaccgaccagacctacgttaccggctacaagatctggcagcacgagctggaatggctggagcacaaggcggcaagacagggatatctcttcttcggcgctcccaacgagcgctcgacggccgtaccgccccgtgatttctacctctacttcattcagccgttcgatccgccgcacttcaaagacgagaagaaggcggatgaagtgttccttcgcctgaccaacagggacgatgagtttcggatcgcgctgacgaactatgccgcggcgctggagctcgcgtccacctcgagcggccacgccaaagccacctacgagtccaaggccaccggattcctgcgggacctggtgggctggctgcagaagcacatgaccgatgccttcgaagtgacccaccagggacgcaccaagtcgctggtcgaatggaccaagggcaagtccatccgcgagctgtccgggatcgcttcccacgagcggatcaactttcgcgacctggtgaacaccatcgccggcatcgtcctgtccgcacactttcaggaccaggcgcgcgagtatccctacttctcggtgctcatcacaggccaaaaccgcgagcaggcggcacaggacgccctgcgcgctatcgccggacagaatcgcaccaagcaggcgatcgccgtgctcgacgccctggagctcctcgatggcgagcggctcgatccgtaccgctccaagtacgcgaagcacatcctggacatcctcaagaagaaggggcatggccaggtggtcaaccgctcggagctgatccaggaggtctatggtgtcgagtacttcgcaccggacaagggctaccgtctggagcccgaatgggctgtcgtggtcctggccgcgctggtctactccggtgacctggtgctctcgatttccggcgagaagttcgacgccaccaggctgccgcaactggctgcgacgatcatagacgagctggtccccttcaagcacatcgagaggcccaaagactggaacctgcccgcgctcaaggcactcttcgaatttctcgggctgacgccgggcatggcgcagctcgtcacccaaggcaaggaagagccggtccagcaactccagaaagccatctccgcggtggtggagaagctggtcctagtccaacagagcctgcaaagcggcctagcgttctggggcaggaacctgctcgccgaggaggaagcagcccagctgcgcgaccggctcgaccagaccaagtcttttcttgaatccctccaggcctactcctcgcccggcaagctcaagaacttccgctatgacgcccaggaggtgaagcgtcacgaagacggcctgaaggccgtctcggagatcgagtccctgcaggagctggtgagcgacctgggccgggtggcctcctatctctccaccgccgaggcggtgctgcccacggaccacgagtgggtagagcggatgaaggcgacgcgagatgcggtgctcgcgcaagtgtcggacccggcccagcgcacgtccagcgctttccgccagcaggctctgcgcaaactcgctggcctcaagaagtcctacgtgcaagcctatctcgccatgcacgcccgagcccgactgggcgtgaacgaggacaggcgcaagagcgcgttgatgggcgacgaacggctcaagaccctctcgaggctctccaccatcgacctgatgccgcgccagcacctgaccgatttccagaaccgcctggctggcctgaagagctgcttcgcgctcaccgagcaggacctcgacgcatcgccggtctgcccgcattgctccttccggcccggaacggagggcgtgggcgcacctgccgcgaccgtgctcgagcacctggacacggagctggacaagctcctcgacgactggacccagacgctgctggccaacctggaggacccaaccacccgcggcaacctcgacctgctcaagcccgagcccaggaagctggtggatgccttcctcaaggaacgcaagttgcccgacgagctgggcaaggattttatccacgccctgcaggaggtgctctccgggctggtcaaggtcgccgtgaaaaccgaggatctgcgcgcagcccttctcaagagtggctcaccggcgacgccggcggacatgaagaaacgcttcgatgaataccttgacgaactcaccaagggccatgagcctggcaaggtgagaattgtgctggagtga

SEQ ID NO: 146 - DNA, 3792 bp, Anaerobaculum mobile
atgaaatatagagacctaattcaatttgagcccatcgaaactgtgattcagttgcgtgatgccaacgaatttacgaaggcccggcaattagtcagtacgtacgtcatatcagatgagatggcagaaaagcttacgaacattgtgtttccccaactacaattcgatagcccttcggataacaaagctttgttgattgtaggcaattacggtactggcaaatctcatttgatgtcagtaatatccagtattgccgagcatgaaacccttctttctgctttaaacaacgaaaaagttgcgacatcggcgcaaaccatagccggtaaattcaaagtggttcgcagagagataggatcgaccaagatgtctttgcgagatattgtcacattctatttagaggacgctctaaaggatatgggcattacatatacattcccagatgctagccaaataccaaccaacaaacaagctttcgaggaaatgatggcttcgttccaaacggtgtttccggaccatggccttcttttagttgtagatgagcttttagattatttacgtaccagaagggaccaagaattgatttcagatctgagcttcttacgcgaaattggcgaggtatgcaaatatttgcgttttcgttttatagctggcgtgcaggaagcaatttttgataaccctcgtttcgctaatgtggctgaacaacttagttgggtaaagagtcgttttgaacaaatagtcatatttcgaaaggatattaagtttgtcgtggctgaacgattacttaaaaaaacggcagaacagcaggtacggatacgcagttatcttacgcctttcgcaaaattttatggccgcatgaacgagcggatggatgaattcgtgcgccttttccctattcatccggattatatagatgtatttgaacaaattaggataatagagaagcggcaaatccttaagactttgtcttataccataaagaatcttattgcagaagaagtacctacggaccgaccgggaattatagcgtacgacagctattgggctaccattaaaagcgatccgtcctttcgtgctataccagatgttagggaagttatcgatgttagtcaaactttggagtccagggtagaacaggccttcacgcgcccgcaatatagaccattggccattaagataatccacgctctttccgttcatcgactaacgactggcgacatttacgcacctttgggtgccaccgccgaggaactgcgcgatacgctttgcctctatcagccaggcatagaagaactaggaggagaaccagcggacgatttattaactcacattgaaatgatacttaacgagattaaaaagactgtcagcggtcagttcatctcatttaacaaagataacaatcaatggtatctcgaccttaagaaatcagaggactacgatgcgatcattgaaaggagatctgagagcatagatgataatgctttggatcggggctactacgatgcccttaagaacttgatggagaagacagacaatcctacctacgtgactgggtataaaatatgggaacatgagctgttgtggcccgagcgaaatgtcgcgaggaagggttatcttttctttggagctcccaatgaacgctcgactgctgtgccgccgcgtgatttttacatttacttcattcaaccatttgatccgccatactttaaagacgaaaagaaggcagacgaaatatttttccgtttgactaacgtggatgaaaactttaaggtaatgttagctagatatgctgcagctttggatctggcctccatatccagtggcaatgccgtaaatatctataaatccaaggccttaggattttggaaagagactgtcatgtggctacaaaaaaatgccatcaatgtcttcagcgtagtttaccgcggtagtaccaaaagctttgatgaggcattacgctatgtctccaatgcctcaagcgaattaggggcgagagctcaccaggttgcacattatttgcaaacgcctgatacctccagttttggctttcgcgacttggttgatgtcgttgctggcactatgttatctgcgcattttctagatcaagccccagagtatccaagatttagcgtaccgatcacaagtcaaaaccgagaacgggcggtacaagacgctctgcgcgcgatagctgggcaacgcaccaagcaagcaactgcggtgctagatgccctagagttgttagatggcgaaaggcttgatccggccaaatccagatatgcaaagcacatcttggatatccttggtaaaaaaggccatggccaggtggtaaaccgttcagagcttatccagagttttaacgatgtggagtattttgccctggataaaggttatcgcttagaacccgaatgggtcgtagtgcttttggcagctttggtacattcaggggatatagtcctttcaatccctggtagaaagtttgatgcaacggctttgtccgaattggctgcggagccgataagcgaattggtaaatttcaaacatatagaaaggcccaaggaatggaatttgccggcccttagagccttatttgaactgttaggcctgacgccgggcatggtccagctcatcgctcaaggcaaggatgatccaattgtcgagatgcaaaaaaaggtaaatgaatatttggagcgaattgttttggcccaacaaacattacgccaaggcattaccttttggggtgaatatattttagacgaatcggcacaacgggaatactcctcggcacttgaacaaatgaaaagttttttggaaagcttacgagcttttaatacgtctggcaagctcaaaaattttctttacgaagttcaagaaattaaatgttacgaggataatttaaaatctcttttgcaggtcgaatttttgcgggatttactaaacgatctgaaagatatagtttcatatctatctaatgccgaaaagcttatgccaaaggaccacgaatggaccaataaagcaggggaaactaaaacacaaacaatagcctctatcagggaaaaatggatggaagctgcaaaaaatcgactcaattcttgtgattacactttattgtctaaggtacagcaagatttagcagagcttaaaagatcttacatcaatacctatctggaaatgcatttcaaggctagattaggcatggagggtgacaaaaagaaaaatgcactgatgaatgacgagcggttaaaagcactacgcgacttagccaccatagatctcatgcccctttctcaactgagggagtttgaggaacgattggccaacttgaaaagctgttttaaacttaccgaacaagacctcgctacaaagccggaatgtccttattgttccttccggccggcggtagagacgcccctcaggtctgcagttatcgagcttgaatccctagatgagagactagataatttgtttaacgaatggactgttacgttgctaaccaacctagaagacccaacagttcagaataacctcgatttgctgaaaccggaggatcgaaaacaaattgagaaatttatggaagaaagacgattgcccgacgtgctgggcaaggattttattcgcgccatacaggaagttttgtcaggtcttgtgaaaatcgaagtcaagatagaagatttgcaccaagccctccttgcaggcggttcgccggtgacgttggatgaaatgaagaaacgttttgaagcctatttgacagagctcgccaggggtaaagagcccaacaaggttaggatagtattagagtaa

SEQ ID NO: 147 - DNA, 3669 bp, Bacteroides vulgatus
atgaaatatagcgaccttatacaattcgatcctattgacgaaattatcaagttcggacaacttgataacgaagattatcgtgagaaactggtaaagaactttgtttgttctcagacatttgaaaattatattattccacagatttgtggtaaattggatctgaactcaacaacagaaactaaaggaattcagattgtaggtaattatggtaccggtaaatctcatttaatgtctttgttttccattatagccgaaaatgcagactatcttgacctggttcaaagcgaaaaagcaaaagagtggttaaagacaattgccggaaagtataaggtgtatcgttttgaattaggcaataaccaggaattatgggaagtaataacattcaaaatcgatgctgcattagaagaatggggcgtagattatcgcatatcggatgatgacactccccgcacctattctgagaaactagagttaatgctggcagcctttgaggaagtctatccagacaaaggctttatgctggtggtagatgagatgctggcatacctgaaaggaagaagcgaacctgctaaattaaacagagatcttcaagtgttacaagctcttggacagatgagcgaccgtacccatttccgtatggttttcggtgtacaggaactgatttaccgttctcctgaattccagtttgccaaagatatgctgggacatgtaaatgaaagatatgtcgatttgactattcagaaggaagatgtacaattcattgtgcagcaacgactgttgcagaaaaacgaacaccagaaagcacagatacgtaaacatctttcccagttcactactatgtttccacacatgaacaacaatctggaaacatacgtaaacctattccctgtccatccgtcatattttgaaaatttctcactcattcgaataggtaaaagtcagcgcgaagtcctgaaaaccctttcaaaaaagttcagtactatcataaacgacgaggttccgacagataaaccaggtctcatttgttatgattcctattggcaggatatgctaggaaatgtagatttgaatgccgaccccgacgtaagcaaagtaagttctatcacagcactgattgatcaaaagatagaagaaaacttcaccaaaggacttgccccaaagaaggtattggctcacagaattgtttcagcagcagccataaaaatgttacaggcagatttaagccatcccaacggggtttctgccgagacattggcaaatgatttatgccatgtagatattacatgcgaaaattttgacgaacttgtagacttggcattcacacgtgtacttgattctatcgtttcggcaactatcggacagtattttgttaaaggagaaaacaacgaatatcatattcgtatagaaggtggtgtaaactacgaacagaaagtcaaagactatgcagcccaaatgggtgatggccagaaagatgaatatttctacatgttcctttcagaagttcttccggttgaaggtgaaacatatcgcagaaacttcagaatatgggaacatcatatagagtggcaatcacataaatgtagtaggacagggtatatttttatgggtaatcccaatgaacgttctaccactcagccacaacaacatttctatatattcttcatgccgatttttgacacgagcaattcttcaagacctgctgaaaaggatagtgtttattttctgatgaatgatttaagcgaagagctgaaacaaaagattgtgttatatggttctgccctctcgcaagaaggtagtgcaagcacagatgaaaagcctcgttacaaacagttgcgggagaaatattacaaggaagccagaaatatgttcaacaacgagttcctggctaaaatcatggtagaatatataggcgacaagcatcctatgcaaggtatgcctggcgcacaagctgattccaaaatcgatgcagtaagtgccgtcacgtcgtatatcatggaaaaacaatttgagctagaaaatcctcattatcctaagttctcagctttgcagcaacctctaaccaatgaaaacagagaaaacctcttacgttcggcccgtgctaaaattgcatcaccaaccacgataaacaggaatggtgaagctatcttgatgggacttggattatgggaaaacggaaggcttagttccgaacattcagaatatgcccgaagtataaaaaacaagcttgaagccaaaggaggacaagttttgaatcgggatgaaattctggaagttttctatgctgacacgcatgaatatatctcgattgattatcatatcgaagctgaccttgagatgcttgtgcttgctactatggcagcacttggcgaaattgagatagtattgcagggaggaagccgaattaatgccggcaatatatcagatataagtaaactcaatccacaggattgctatacattctccaatgtatgtccacctaagggaataaacatccctcttgtaagggaaatatgtttaggcttactgggtgtggaccgtacaaacgagcttgataatcccaatagcagtatctttgctgatttactggccaaagcttcagagttggagaatattatagtgacacttcagcataaaattcaaggaggatattattttcttaacgatatagaaatcatttcagaagatgatgcccgcaattttgatgtagaattggttcgtctgaaaggtatttgcaatcacatgcagcgctacaacaccaaagccaagatgcgtaacatcgattggccgatagacgttgtaaaaacggccatgaccgaaactcgcagcaaagtgtttgaaactttagacttgatgaaggaactggatggattcagagatttggtttcatatctgcgcattgctctatcaaatgtaaatgataatgatttgaaaacagaaataatctcttccattgacggaatcaaagaagtaataaacaagggaaaacaggcaagagatgcttacaaactgaaactggaagcactcaaagacaggtatgcgacatggtatatggaagcttatctgaaagctcatataagcgaaatagatcatggaaagaaaagtgcggtaatgctaagcaccgagaaacaattgtgtgacatcataaagaatgcttcatttatcaatccttcaagatatgacaactggttgaggaagatgaatctattgaaagtagtaaattcttcagtcaacaagaatgcgattctttctgtacctacatctgtagatggctttaatccatccatgcaaaaagatgaattgccggaactggaagacttaaaagatgaattgaaagaaatctatgcagaatatgagcaaggctttcatgatgcgttggaagaccctaccattctgagaaataaggaaatgcttactcaggaagagagatctaccatacaacagtttattgacggaaatattactctgaatccgcaatatgcacgcatattgattgatattatcaacaagctccagaggagttttacaaaggtagaaatcaatcataacgagatgcttaaaatattctcccgtcctatgactaaacagcaggctcttgatgccttggcagcatatattgataatcatagcagaggacataagccggaggatattcgaataatcgtaaaataa

SEQ ID NO: 148 - DNA, 3693 bp, Caldicellulosiruptor kristjanssonii
ttgaggtataaagatgtaataaattttgagcccattgaaaccttgattcaacttgtagatgctaatgaaaaggaaaaagcgaaaaatttagttaaaacttttgttatgtctgattcaatggccgaggttttgtgcgatattgtcattcctcagcttcaatttgaggaatttaatgataataaaggaatatttgttgttggtaactacggaacaggtaagtcacatttgatggcagttatatcggctattgcggaagacaaagatttattagattatgtaaataatgaaaaatttaagaaagcagcagaaaaaatagctgggaagtttgaagtagtaagaatagaaattggctctgttacaacaagtttaagagatattgttctcaaaagagacattgaaagcgatttgaaaagaagagggattgattatgcatttccctcaatgaatgaaatttctaataacaaggattcaattattgaaatgatggcaaagttcgaagaaaaataccctgaaaaaggatacttaattgttattgatgaattacttgattttcttagaacgagaaaagagcacgaattaaggcttgatttgggatttttgagggaattaggtgaagtatgtaaaaacactcgtgttagaataatcgcaggtgttcaggagtcattgtttgacggtccaagtttttctcatgtttcagataagataatgcaggtgaaagacagatttgagaatataataatcaaaaaagaagatattgcatatgtagtatctcaaagactgctcaaaaaaagtgagactcagaaagcctttattcgagaacatttaaaaaaatttagtaatctgtacaagaatatgggtgatagacttgaagaatatgtagaactttatccaatacatccttcttacatagatgtatttcaaaaggtgcttattgctgagcaaagagaaattttaaaaactatcagccgaaccatttcaaaattgttagatgaagagattcctgaagatgatacggggataatttcttatgattcttattgggactttataaaagaaatgccagctgcaagagccaatcctgacgtaagacaggttattgatgcaagcagtgttctggaaaatataattaacaactcttttcctaagaaagtttacaagaattatgcaattaaaataataaaagctcttagtgtttatagacttgctactggtgacatacatataccgctgggattgacaattgaaaatatcaaagatgatttatgttttaatattcctgatttaccagagaaagaagaagattttttgattaccactatcgagtctataatgaaagaaatattaaagactgttgacaacaagttcatttcatataacaaagaaaataaccaatattatttagatgttgccaaagttggcattgattacatggcaaagattgaggaaaaggctgagctaatagacgatgatgtagtgaacagacatttctacaatataatattgaggctgctgaattgggaagagaaggctgcaaccccttacgttaagggacatagaatctgggagtatgaccttatttgggaagataaaaacatagagaggcacggctatttatttttagggacaccaaatgaaagacctactgcacagccaccgagagatttttatatttactttacaaggctttatgaatttaatgactgggaagataataaacgagacgatgaggttttcttcagcttttccttgcatgatgatacattgataacaaagctaaaaatgtatgctgcagctcatgaactatctgaaggtgttgatacttcgagcagaaattcgtatctaaaatgggcaaccaagtttgaaaaagaaatattggaaattattaataacaacaaaaatacctgttttaatgtcacctataaaggtgaaacaaaatcaatgtttgaaatattgcaagggagagttcccagcaacaagacaatcaaagagcttgttgataaggctgcttctatttgtctttcacagcattttagcaatctttatccagaatatccaaagttcagtataacagttacaagaaataatttaagtgagctcacaaaacaagtactcaattacattgctggcaaaaaaacagatactgctgcgaaaatcttagatgcttttggcttacttgaaaatgaaagaatcaccacaaaaaaatctccatatgcaaagtattttgcagatttagttgcgaagttgccacccggtaaagtgataaatagaaatgagatatttgaaaagtggtatagtgaagaagacgtggacaaaagatttaaatttgaaccaaactttgttgttatgattttagctgcacttatatacactggtgatattgttttaattggagaacagggtaaagagtacaatgcaggcaatcttgacaagcttgcatctaccaatcttgtgaatttaataaactttaagtatattacaagaccaaaggagattcctattaaagtacttgaaagactatttgaactgttagaccttccaccaggacagataaagaattcttcgcagatggaacagggtattgctaatatgcaaagtaaagtagagaatttaattaaaaacactattcagatttcagaaagagtgagcaataacatcttgatatgggataaagaagtttttaaagagagtgaaaagagaaagttcagggaagatttaaataattttaagaattttttagatggtctaaaaagatataataccattgcaaggctaaaaacgtttaatttttcaaaggatgagatagaagaaaaatttgaagcattgaaagtgattgaaaaagtgaaaaaagcacttgattttaaggagcaagttgatgatgttgtaaattatctcaagaatgcagagttggttactgattcggaagaaattaagaaaatgattcaagatatgaaggatgaattgaacaatatattacaagatgttgataagttagatgatttcgtaataaaagactttaaaaacaaattagaaatggttaaaaaggcatatatacaagcttattttgaaaagcataaaaaatgtagattagatataaatggcgatgagaaaaagaagaagatactttcgagcaaagagtttaataacttgagaaaattaaaaagtataaaagacattttcagcattcaaaagtttgaagaaattgaaaagaaattgagttcaataaagacatgttttaacttaattgaagaagagttaaagaagcaaccagtatgtccgcattgtgggtttaaacctaataatgaggaaggaatgtctgcaagtatgctattagaaaaagttgaagatgatatatatactatgattgatgagacgaaggaaaagattttaaaggctcttgacgacagagttgttagtgagaatataaagcttttgaaagaacaagaaagaaaggaaatagagaagtttattgagaaaagagaatttgaagaggatatttcgccttatttcattactggaattaacaatctgatggaaggttttgataaaatagaatttgatgtgaaccagttgaagaattatatctctaaaaaaggtccaatgacagttgatgaatttaaagataccatagaaaagtttatagaaacaatgataaaaggaaaaacaaaagacaaaatacgaattatcgtaaattga

SEQ ID NO: 149 - DNA, 3729 bp, Chloroflexus aggregans
atgaaatacggtgatttgatccagtttgaaccaattgagagtgtgattcagctccgcgatgccgatcacgccgcggcagcacagcggctcgtccaaagttatgtcatctcagaggagatggccgagcgactgataggggtggtgttgcccaaccttcagttcgaccaaccactcgacaacaaaggtctgctggtcgtcgggaactacggcaccggcaaatcacacctgatgtcagtcatctcaagcattgccgagcatgcagacctctgttcggcgttgaccaacgcggcggtacagcacgcggcagcacggatcgccggacggttcaaggtggttcgcaccgagatcggggccaccaccatggcactgcgcgacatcctcgtcggcgagctagaggagcacctggctgccatgggcgtcgcgtacaccttcccggctgccgatcaggtcgcgaacaacaagcgggccttcgaggcgatgatggccgcattccaccagaagtacccagaccatggcctgctcttggtcgttgatgaactgctcgactacctgcgcagccgcaaagatcaagaactcattctcgacctcaactttctccgcgaggtaggtgaagtctgtaaagacctccgcttccgcttcatcgcgggtgttcaggaagcgatcttcgacagcccccggttcgcctttgtcgccgacagtcttcgccgggtgaaggatcgctttgaacaggtcctcatcgcccgcaaggatgtcaagttcgtggttgccgaacgtctgctgaaaaagaccggcgcgcagcaggccacgatccgtgcgtacctcacccggtttgccgggttctacagctcgatgaatgaacggatagacgagttcgtccgcctgtttccggtccatcccgactacattgacaccttcgagcgggtgaccgtcgtcgagaagcgcgaagtgctcaagacactatcgctggcaatgaaggaactgctcgatgcagagatacctacggatcggcccggtctcattgcctacgacagctactggaacaacctgcgccagaacccttcgttccgtgccatcccggacatcaaagcggtgatcgattgcagtcaggtgttggaatcgcggatcgagcaggccttcacccggccggcgtacaaacccatggcactgcgcatcatccacgcgctgtcggttcaccgcctgacgaccggagacatctacgcacccatcggtgcaaccgccaaagagctacgcgatacgctctgtctctaccaacccggcgtcgaggagttagggggcgacccggccgacgatctgctgacgcaggtagaaacggtcatgcgcgagattcacaaaacggtaagcggtcagttcatctctaccaacccggacaacgggcagttctaccttgatctgaagaagaccgccgacttcgatgcgctcatcgagcggcggtccgagagcctcgataacgcgctgcttgaccggtactactacgaagccctgaaacgggtgatggagtgtaccgatcagacctacatcaccgggtatcgaatctggcagcacgaactcgaatggccggagcgcaaagcggccagacagggatacctcttcttcggcgcacccaacgagcgctcgaccgcggtaccacctcgcgatttttacctctactttcttcaaccgttcgagccgccgccgtttaaggatgaaaagaaggccgacgaggtcttcttccggctcaagcaccgagataccggattcgatcagaagctgcgttgctatgctgctgcgttggatctcgcgtccaccgcgagcggtcatgcgaagacgacctacaccgccaaggctgacggattcctgcgggagcttgtgggctggctccaacagcgcatcaccgatgccgttgaggtaacctatcggggacgtagccggttaccggctgaatggctcaaggagaaaaccattcgcgagcaattcgggagcacgtcctccgcgcagaaaaacgtccgtgatctggtgaacaaccttgccggcgccatcctagctccccactttcacgaccaagcgcctgagtatccgtccttttcgatcctcatcacgaaccagaaccgcgcacaggcagcgcaagacgccctccgcgccattgccgggcagactcgcaccaaacaggcaaccgctgtcctcgacgcgctcgaactgctcgatggcgagcggatcgacccaacccgctcgcggtatgccaggcacatcctgagcatcctcaagaagaaggggcacggccaggtcgtcaaccggtcggaggtgatcgaagacatctacggtatcgagtacttcgcggcggagaaaggctaccgtctcgaaccggaatggctggtcgtggtcctggccgggctggtctattccggtgacatcatcctctccattaccggcaagaagttcgacgctaccggcttatcgcaactagccgcgacgaacatcgacgatttggtccgcttcaagcacatcgaagcgccgaaggactggaacctgcccgcgctgaaagcactcttcgagctgctcggactcacgccgggcttggcgcagctcgttacccaagggaaagaagagccggtgcaagagcttcaggcagccatcaaacaaacggtagagcatctggtcatggcccaacagaccctccacagcggtctgccgttttgggggaaggagctgctcacagcggttgaagcagcgcgactgcgcgacgagatggacaaaacaaaaaccttccttgagagtctgcacgtctatgcttcacccggtaagctcaagaacgttcggtacagcgccgaggaggtgaagcgtcatgaacgcggcctccaggccctcgcagagttccagtccttgcaagagatagtgaatgaactcggcccgttggcctcctatcttgccaccgccgcggcagtcctgcccaccgaccacccgtgggtgcagagcatgcgccatgcgcaatccgaggtgcgcgagtggctggaaaccggccggatggaacaccaggaactgcgcacccacatccgccagaaactgacggagttgcaacaggcatacatccgcgactatctcacgatgcacacccacgcccgactgggcgcaaacgacgacaagcgcaagcaggcactgcttggcgaccaacggctcaaaacgctcgcgagtctggctaccattgacctgatgccgcgccggcaactgaccgatatacagcaccgtttagccaacttgaagagctgctttgccctgaccgagcacgacctcgtcactcagccgatctgcccacactgcgacttccgaccgaacgccgagatgatgaacgtgccggcagcgacgctgctcgaccaattggacgccgcactcgacaccctcctcaaggactggacgaacacgctgctggacaacttggaggacccgaccacgcgcagcaacctcgacctgctcaaaccggaggcgaggagcctcgtggacaccttccttaggaaacaaacccttcccgacgatctcagccacgatttcatccacgcgctgcaagagatcctctctgggctgaccaaggttgtggtgaagacggaagaactgcgcgcagcgctgctcagaggcggctcaccggcaacccccaccgagctgaaaaaacgctttgaggaatacctcgccgaacgcaccaaaggatacgaagccgggaaggtgcggatcgtggtggagtag

SEQ ID NO: 150 - DNA, 3732 bp, Desulfovibrio aespoeensis
atgaaatacggagaccttatccaattcgacccgattgagtcggtcgttcagttgcgtgacgcggacaaatcgagcgccgcacacaccctcgtgaacacctatgtcatttccgaggaaatggccgaacggctcacccagcttgtcattcctcagatgcagttcgaccagccggtcgacaacaagggcctgctggtcgtcggtaactacggcaccggtaagtcgcacttgatgtcggtggtctccagccttgccgcagatgcctccctgctggaagggctgaagaacgatggtgtccgcgacgcagcctctcagatcgccggtcggttcaaggtcatccgtaccgagatcggtgccaccaccatgtccctgcgcgacatcctggtggccgaactggaagagcacctcgaaaaactcggcgtggagtatgtgttccccgaagccgggaccattaccagccacaagcgggcctttgaagacatgatggccaagttcggcgaggtcttccccgaacacggcctgctgctggtggtcgacgagctgctcgactacctgcgcacccgcaaggaccaggagctgatcctcgacctcaacttcctccgcgaggtcggcgaagtctgcaaggacctgcgcttccgcttcatggccggtgtccaggaagccattttcgacagcccgcgcttcgcttttgttgccgacagcatccgccgggtgaaggaccgcttcgagcagatcctcattgcccgcagcgacgtcaaattcgttgtggccgagcgtctgctcaaaaagaccaccgagcaacaggccaagatccgcgactacctgatgcctttcgccaaatactacggcgggctcaacgagcgcatggacgagttcgtccggctctttccggtgcatcccgattacatcgacaccttcgaacgggtcaccgtggtggaaaagcgcgaggtgctcaagaccctgtccatgggcatgaaaggcattctcggcaaggacgtgccgcaggacgagccaggcctgatcgccttcgacagctactggaacacgctcaaacagaacgcttctttccgtgccattcccgagattcgggcggtcatcgattgtagccaggtgctggaatcccgcatcgagaacgccatcacccggaaacaatacaagccgatggcgctgcgcctgatccatgcgctgtccgtccaccgcctcaccaccggcgacatctatgccccaatgggcgcgtccgccgaggagctgcgcgatcgcctctgcctgttcgatccgctgatcgccgagctgggcagcgacgagcccgacaaggatctgcagacccatgtggaaacggtcctgcgtgagatccacaaaacggtcagcggccagttcatctccttcaatgccgacaaccgccagttctatctcgatctcaaaaagaccgacgacttcgacgccctgatcgacaagcgggccgaaagcctgggccaggctcagctcgaccgcttctattacgaggcgctcaagcgggtcatggagtgccaagacgccacctatgtcaccggctacaagatctggcagcacgaactggtctggcaggagcacaaggcagcccgctccggctacctctttttcggggcaccgaacgagcgctccaccgccgtgccgcagcgggacttttacctctacttcattcagcccaacgatccgccgcgcttcaaggacgacaaggtcaacgatgaggtcttcttccgcctgaaagtcactgacgaggagttccagactgcgctgaagagctacgcggcggcactggatcttgcagccacctcatcgggacacgccaaggccacctatgaatcgaaggccaacggtttcctgaagaagctggtccagtggctgcaaaagcacatgagcgatgccttcgaggtcacctatcagggccgcgccaaatccatgaccgaatgggccaagggcaaatccatccgcgacctgtccggcctgtcgccccacgagaccatcaacttccgtgacttggtgaacactattgccggtgtctgcctggcaccgaacttcgagaaccaggccccggactatccgttcttctcggtcctgatcaccggcaacaaccgcgcccaggccgcgcaggacaccctgcgggccatcgccgggcagaaccgcaccaagcaggccaccgccgtgctggacgccctggaactgctcgacggcgagaagatcgacccctacaagtcgaagtacaccaagttcatcctcgatgccgtcaaggccaaggggcacggccaggtggtcaaccgcagcgagatcatccaggatgaccacgggctggaatacatgaaccccggcggtggtcggcttgagccggaatgggtggcggtcatcctggcttcgctggtctactccggtgacatcgtgctcgccatcccgggcaagaaattcgacgccaccggcctgcagcaactggccgcgaccggcatggacgaactggtccgcttcaagcacctggagcagccaaaggaatggaacctgcccgcgctcaaagcgttgttcgaactgctcggcatgacgccgggcatggcccagctcgtcacccagggcaaggacgaaccggtgcagaacctgcaacaggcggtgggtaagatcgtcaagcgcatcgtcatgacccagcagaccctgcgcgaagggctctccttctggggcctggatctgctcgcgggcaccgacctggccagccaggccagcggactggacgaggccaagggcttctttgaatcgctccaggcctactcctcgccgggcaagctgaaaaacttccgctatagcgctcccgaagtgctggcccacgaaaaggccgtgaaggcgctggatgagctggacgccctgcgcgagttcatcatggaccacagcccgacggcgtcctggctctccaccgccgaggcggtgctgcccgccgaccatgactgggtggatcgcatgaagaccacccggcaggacgtgctggatgccctcaagcaggccgacctgacagagctggccagccagtcccaaagcatcggggccaagctgcaaaagctgaagaaggattacaccgtcgcctacatcggcctgcacaccaaggcccggctgggcgtgaacgacgacaagcgcaaggcgggactgctcaacgaccagcggctgcaaaccctgctcaagctggccggtatcgacctgatgccccggcagcagctcaccgattaccagaaccgcctggccggactgaaaagctgcttcgccctgaccgagcaaaacctcgacgcctcgcccatttgcccgcattgcgggttccggccttcggtggaaaccggcacggcggcaggctcgcagatgatcgaccagatggacgcccagctcgacgccatggtgacggcctggacctcgaccatcctcagcaacctggaggacccgatcacccaggccaacatggacctgctgaagatcgacgaccgcgagcccttggaggccttcatcaaatcgaaggaactgccggtgccgctggacagcaactttgtccatgcattgaaggaagtgctctccggcctggtcaaggtcaccgtcaaggcgcaggagctgcaacaggctctgcaggttaccgacggcccggccaccccggcggagatgaagaaacgctttgaggagtacatcgatcagctcaccaagggcaaggacccggccaaggtgcggatcgtcatggaatga

SEQ ID NO: 151 - DNA, 3732 bp, Dichelobacter nodosus
atgaaatacggagaccttatccaattcgacccgattgagtcggtcgttcagttgcgtgacgcggacaaatcgagcgccgcacacaccctcgtgaacacctatgtcatttccgaggaaatggccgaacggctcatccagcttgtcattcctcagatgcagttcgaccagccggtcgacaacaagggcctgctggtcgtcggtaactacggcaccggtaagtcgcacttgatgtcggtggtctccagccttgccgcagacgcctccctgctggaagggctgaaaggcgaaggtgtccgcgacgcagcctctcagatcgccgggcgtttcaaggttatccgtaccgagatcggagccaccaccatgtccctgcgcgacatcctggtggccgaactggaagagcatctcgaaaaactcggcgtggaatatgtcttccccgaggcgggcaccatctccagccacaaacgggccttcgaagacatgatggccaagttcggcgaggtcttccccgagcatggtctgctgctggtggtcgatgagctgctcgactacctgcgcacccgcaaggaccaggagctgatcctcgacctcaacttcctccgcgaggtcggcgaggtctgcaaggacctgcgcttccgcttcatggccggtgtccaggaagccattttcgacagcccgcgcttcgcttttgtcgccgacagcatccgccgggtgaaggatcgcttcgagcagatccttatcgcccgcagcgacgtgaaattcgtcgtggccgagcgcctgctcaagaagaccaccgagcaacaggccaagatccacgactacctgatgccttttgccaaatactacggcgggctcaatgagcgcatggacgagtttgtccggctcttcccggtgcatcccgattacatcgacaccttcgagcgggtcaccgtggtggaaaagcgcgaggtgctcaagaccctgtccatgggcatgaaaagcattcttggcaaggacgtgccgcaggacgaacccggtctgatcgccttcgacagctattggggtaccctcaagcagaacgcttcgttccgcgccattcccgaaatccgggcggtcatcgattgcagccaggtgctggaatcccggatcgaaaacgccattacccgcaagcaatacaagccgatggcgctacgcctgatccatgctctgtccgtccaccgccttaccactggcgacatctatgcccccatgggcgcatccgccgaggaactgcgcgaccgtctctgcctgtttgatccgctgatcgccgagctgggtagcgacgaacccgacaaggatctccagacccatgtggaaacggtcctgcgcgagatccacaagacagtcagcggccagttcatctcctttaatgctgacaaccgccagttctatctcgacctgaagaaaaccgacgacttcgacgccttgatcgacaagcgggccgaaagcctaggtcaggctcagctcgaccgcttctattacgaggcgctcaagcgggtcatggagtgccaggacgccacctatgtgaccggctacaaaatctggcagcacgaactggtctggcaggagcataaagcagcccgtactggctatctctttttcggggcaccgaacgagcgctctaccgccgtgccgcagcgggacttctacctgtatttcgtccagcccaacgacccaccacgcttcaaggacgacagggtcaacgacgaggtcttcttccgcctaaaaggcaccgacgaggaattccagaccgcgctgaagagctacgcggccgccttggatcttgctgccacctcatcgggccacgccaaggccacctatgaatcgaaggccaacggtttcctgaagaaattggtgcagtggctgcagaagcacatgagcggtgcctttgaggtcacctatcagggccgaacgaagaccatgaccgaatgggccaaaggcaaatccatccgcgatctgtcgggcatctcgccccacgagaccatcaacttccgcgatctggtcaacaccatcgccggtgtctgcctggccccaaacttcgaaaaccaggcccctgactacccgttcttctcgatcctgatcaccagcaacaaccgcgcccaggcagcgcaggatgccctgcgagccatcgccgggcagaaccgtaccaagcaggcaaccgccgtgttggacgccttggagctgctcgacggcgagaagatcgacccctacaagtcgaagtacaccaagttcattctcgataccgtcaaggccaagggccacggccaggtggtcaaccgcagcgagatcattcaggacgaccacgggctggaatacatgaacccatgcggttcacgtctggaaccggaatgggttgcggttatcctggcttcgctggtctattccggcgatattgtactcgccatcccgggcaagaaattcgatgccaccggcctgcagcagcttgccgcgactggcatggacgagctggtccgcttcaagcacctggagcagcccaaggaatggaacctgcctgcgctcaaggcactgttcgagctgctcggcatgacaccgggtatggcccagctcgtcacccagggcaaggacgagccggtgcagaacctgcagcaggcggtgggcaagatcgtcaagcgcatcgtcatgacccagcagaccctgcgcgaggggctctccttctggggcctggacctgctcgcgggaaccgacctggccagccaggccagcgggctggacgaggccaagggcttctttgaatcgctccaggcctattcctcgccgggtaagctgaaaaacttccgctacagcgctcccgaagtgctggcccacgaaaaggccgtgaaggccctggatgagctggacgccctgcgcgagttcatcatggaccacagcccgacggcgtcctggctctccaccgccgaggcggtgctgcccgccgagcatgactgggtggatcgcatgaagaccacccggcaggacgtgctggatgccctcaagcaggccgacctgaccgagctggccagccagtcccagagtatcggggccaagctgcaaaagctgaagaaggattacaccgtcgcctacatcggcctgcataccaaggcgcggctgggcgtgaacgacgacaagcgcaaggcaggactgctcaacgatcaacgcctgcaaaccctgctcaagctggctggtatagacctgatgccccggcagcagctcaccgattaccagaaccgcctggccggactgaagagctgctttgccctgaccgagcaaaacctcgacgcctcgcccatctgcccgcattgcgggttccggccttcggtggaaaccggcacggcggcaggctcgcagatgatcgaccagatggacgcccagctcgacgccatggtgacggcctggacctccaccatcctcagcaacctggaggacccgatcacccaggccaacatggatctgctgaagatcgacgaccgcgagcccctggaagccttcatcaagtcgaaggaactgccggtgccgctggacagcaactttgtccatgcattgaaggaagtactctccggcctggtcaaggtcaccgtcaaggcgcaggagctgcaacaggccctgcaggtcaccgacggcccggccaccccggcggagatgaagaaacgctttgaggagtacatcgatcagctcaccaagggcaaggacccggccaaggtgcggatcgtcatggaataa

SEQ ID NO: 152 - DNA, 3633 bp, Methanocaldococcus sp.
atggttaaggtaaaagaactttttaattttcaggagattcgtccagtcatacaagtagtaaaagatgatccaaaagagcttgtttcaacctttgtagtttcagataaaatgaagaaagatattgagcttatagttcagaacttaaatgatatccaacatcgttcaatctttataattggtgattatggtactggaaagtcacatttcttgggttttattgtaaatatagcaggagataaatctctaattgattatatacaagatgaagatcttaaaaaatacttaaaagaaaacttagaaaaagatttcattattgttgtatatgagttaaatccaattagacagccatttggactcattttttatcttataatgcaaatgtaccttgagaaaaattacggaataaaaattaacgtcccaaaaacagaggaagaatttaatagcattttagaccataagcaatacataatcgacaatataattaaacctgtaaaagaaaaatttcctgatagagggattatagtcgcatttgatgagttatccgactttcttagacagaaacatagggaggacgttaatcaagatatgcagtttataaggatacttggagaattatctgaaaaagaagatataatattcattttttcaatgcaagaaaatatctttagaagccctctttatgttgaccaagcagatgccgtaagtagagtttaccaaagataccatataatcgaaattactaaagaggacgttgagaaagtccttgcacaaaggatagttccaaaaactccagcccaaattgcaaagcttagagaacttttatcacagtataaaaaatattatgaggattttgaaggaaaagaagatgaatttatcgaactctatccaattcatccgtccgttttacatgcatttaggcaattaccttacttccaaaaaagaggaattttaaaatttgcgatggacaaaataaaggaaatacttgataaagaattcccagcttttgtaacaatggattcaatatttgatgaaatttataataaccctacaatatcaaatactgaagaagtaagggaagttttagatgttgttgaaagattgctatacaagatacaatccattcctgctcttagaaaagatagggatattgcagagcgtataattaaatctcttgcagtatataagttgatgaaacctgaggaaaaaccaactccctaccaaattgcttatgatttaatggttcttccaagattagaatcaatagagataaatgactatatactcggtattataaaaagaattagaagagaaactgctggacaatttttaggttatgatgaaaaggaaaagaaattctatatagatttggaaagaaagattgactacgatgaaataataaacagaaagatttctatacagagtaatgatgaccgcgaatcttacctttttgaatttttgagggagagtttagaactctccagagatgacgtaaaattagaaaggccaagtataaagatttttagaactacagcattctgggaaagtagaaagggattccgtaatggatttataatatttgaaggtaaaaatcttaaaaattccgctaaagaatataaaaatttcttaggaaatgattttgcagtagtggttgtttctccatataagtcagaatcgatttttgaaccatctgatgctaccatattaattaagctaaaaattaaggaatctgaagaaaatctaaagagatattcagcaattaaagcccttattggagatagacagtatgttaatgttatgaaagataaattagctacagtaaaaagaaaattggtagatgaattaacaaatgatatgctaaattctgtaattaactataatggaaaaaatattgttgttggagacttagttggtgaagaagttggagatatctacactattattgaaaagataaaatcaaaattgttggaagattactttagtagagagtatagtgagtatccaaaattctcaataaaaataactccagaaaatattgaagatgttgtgaaaagagtattggaggatattttagcatctccagaccctgaaaattataggaaagataccattaaaatactctcagacttgggattatatagccaaggcaaattgaaaataactgataacccatacatatcaaaaatacaagatttattgagtggaaaaacaaaggatttcaagtcaatccttgaaaaaatgtctcaaaaaccttatggaatacaaaaagagatttcctacatttttgttagtgttctactcataaatgatgagattgaattaaagaaatcaacaaaagatcgtatagggccattagagatacgtgagcttttaaagaaaaaaggtttatcagcatttgatattgttaaatatatagaacctgtttcagaattcccagttaatgaccttcaaaagatatttgatgctttagaattagattcaacaaaaattagaataaaaaatcagagattagatgcattaaaggactacaaattcagagtaagtgaattagaagatgtaattaaaaaacttaatgacttacaatccaagattgataaaataaaaaatttaggatttacagtttctgaggataaaatacaatcattattgaacattgcaaacaataaagagttattgaataaattaaaagaagttaattcactacatgatttcaataagatacacaaaatatctcctgaattaattaaagaatggagagaaagcatagaaatcttaggaagattaacgaacgaccttgagaagataatcccactacttgagtatgcaaaatctgcaaaagacattatagatgcatgtgaggatatattctcagaaatttatgtcaaaaagttgaatgagctatacgaagaggtagttaaaattattgaaagtgataaattacttgatattcaacataggttgcctattccaggaaaacttgaagaatttaagagactatatatcgaggcttatgctgaagcacataaaaggtactttgaaaaagaagagtggaaagaacttaacaaacttctgaattctgaaactttaaaagaacttaagatactctcacaagtgaggtgcataaatggttctatagtagaacaaattgaaaatgaaatttatgaacttcttaagaaaagatgtaatatcactaatccagaacaacacttaacatatatgccagtatgttattgcggattcccaagagattctcctataggtattgatttatcacaaaaagttcaagaattaagtaaaaaaattgatgaattaagagatgaatgggagagagtaattattgaggagattaaaaaagttcaagataaaatagagttcttaaaaccaaatgaaaaagatgctattgaagatattattgctcaaaactcacttggagaggttgatagagagttagtaagtattataaataaactatttgaggacttccaagttgttgaaattagacttgaagaattttatgaatggttaggggagggaggatacctattaactccagaggaactaaaagaaaaatttgaagaatttattaaaataaaagttcctaagggagaaaatgttagggtaaaaattgtaaaatga

SEQ ID NO: 153 - DNA, 3510 bp, Methanocaldococcus sp.
atggttactttggagaagatagagcttaaaaacttcaaatcatttaaaaaactatctttagatattccaaagggatttacagctattgtagggccgaatggtagtggaaaatctaacatagttgatgccatactatttgtgcttggaaaaacctctgctaaaaagttgagagcaaatagattcagcggattaattacctatcacaacggaaagagagcagattttgctgaggtctgcctatatttctcaaatgaaaataatgcctttaatgttaatgcagatagagtggggattttaagaaggataaagagtagtggagaaacagattattacttaatttgggaggaaaatggaaaagaaaaaagaaaaaagatggctaagcatgaggttattgatttatttaggagattggggcttttaggagataatgttatttcacaaggggatttgttaaagattatcaacatctcacccattgagaggagaaagattattgatgaaatcagtggaatagctgaatttgatgaaaagaaaaaaaaggcagaggaagaattaaagaaggcaagagagttaattgaaatgattgacataagaattagtgaagttgaaaacaacttaaaaaagctcaaaaaagagaaagaagacgctgaaagatatattaaattaaatgatgagctgaaagcagcaaaatatgctctaatattaaaaaaggttagctatctgaatattcttttagaaaatatccaaaatgacattaaaaacttggaagaacttaaagatgaatttttaggaaaagttaaagaaattgatgcagagatagagaatttaaagctcagattgaacaacattataaatgaactcaatgaaaaaggcaatgaagaggttttagagcttcataaatcaattaaagagcttgaggttgaaattgagaacgataaaaaggttctgaataactcaataaatgagttaaataaagttgaaaatgagattgaaaataaaaagaaagagattgaagaaactcagaaaaagattattgaaaatagggacagcatcattgagaaagagcagaaaattaaagaaattgaggataaaatcaagaatctcaactatgaaaaagagaggttaaaggaggcaattgctgaaagtgagagtataatcaaacacttaaaaaaatctgaaatggagatagctgatgagatagccaaaaatcaaaatgaactctataaactaaaaaaagaactaaacgacttagagaatttaataaacaggaagaattttgagattgagaaaaacaatgagatgattaaaaagttaaaggaagaactcgaatctgttgaagatgttgatactaaaccattatatttagagcttgaaaatttaaacgttgagattgagttttcaaagagaagaattaaagagcttgaagaaaaaaagaaagaactgcaagctaaattggatgaacttcatgctgaatatgttaaggagaacgcaagaattaaggctttgaaggagatggaagagctatctatggatagggcaattagagagatattaaatgcaaacttaccgggagttattgatattgttgggaatttgggaaagacaaagatcgaatacaaaacagccattgaagtagcggctgggaataggctaaaccatatagttgttaagagaatggaggatgcagttagagctataaagtatctaaaagagaggagattagggagagctacttttctaccattggataggattgagggcagagaggcggagtatttagatgaggatggagttattggtagagccattgatttagtggagtttgatgagaaatatagaagagtttttgagtatgtgtttggaaacacggtagttgttaaaaatatagatatagctaaggaattagccaaaaaatacagaaaggtgagatttgtaacattagatggggatgttatagagccgagtggagctatgattggaggaacttttaaaagtaaggcaaagataaaggttgatattgatttaagcaagctaaataaaatagctgatgaaattatagctattgagagtgagttgagaaatataaaggatgagattgagagattgaatgagataataaagagaagttcagccaaaaaaatggaaattgaaaataccttggagataattaaaaagaacgaaatgagaaagagggagatagctgaaaagaataccataaagataaaagagttggagttgaaaaataaggagattttagaagagttagaggagttaaaccttaaaaaagaagagattctaaataagattaatgagattgaaggcagaataaatgagctgattgaaagaagagagaagataatcaatgagttgaaggagtatgaaagcgatgagaatttaaagagaatgaatgagattgaggatgaattaaaaatcttagagaaagagaaagccaaattaaagaatgagattgataaaggacttactttagttaaagaaatattgattccaaagattgaagagctgaataagaaggtttctgagctaataaataaaaaagccatattggagaagaatatatcattctataaagagagtattgaaaaaaatctatccatattggaagagaagaaaaagaggtatgaagaattagctaaaaatctaaaagaactcaccacaaaaaaagaagagcttgagaaagaaatagaaaacttagaaagagagagaaaagagatattaagaaaagttagagacattgaaaataaaataaatgaacttatggttgaaaaggcaaagtatgagagtaagttagaggaagaggagagaaaactctatctatgtgaaaaggttgatataagtgaggagcttgagaaaaaagacattgaagaacttgagatatatataggagagcttgaaagtgaaataaaaagcttagagcctgtcaatatgagggctattgaagactataactatgttgctgaaagatacaaagagttgatagaaaaaagagaagaatatgaaagagatgagaaaaaatacctccaattaatggaagagcttgaaaataaaaagaaagaggtctttatggaagtatttaacaaggtagctaagaactttgaagaggtttataaggagattggaggaattggaaaattaagcttagaaaatgaaaaaaatccttttgaaggagggattttaatagatgcatctccaaggggcaaaaagcttttaagcttagatgcgatgagtggaggggagaagtcattaactgccttagcatttttgtttgctattcaaaggctaaatccttctccgttctatgtattggatgaagttgatgccgcattggatgtaaaaaatgtctctctaattgctgatatgattaaaaatgcctctaaggacagccaatttatagttataagccatagagagcagatggttagtaaggcagatgttgtttatggtgtttatatggaaaatggattgagtagagttgtagggataagattataa

SEQ ID NO: 154 - DNA, 3741 bp, Methanosalsum zhilinae
atgaaatatgaagatcttatccaattcgatcctattgaatcggtggttcagctacgggctgctgataaatccactgcagctcatcatttggtaaatacatatgtaatttcagaagaaatggcagaacggcttactgatattgtcattcctcaattacaattcgatcagcctatagataataaaggaatattggttgttggtaattatggtactggtaagtctcacttgatgtcagtaatatccagccttgcagaagacgattctttactggattcacttaaacatgatggtgttaaagattctgctaagcagattgctggcagattcaaggttatccgtacagagattggttcaacaacgatgtctttgagggacattctggtagccgaacttgaggagaaacttgacaaactgcatgttgattatgttttccctgaagcgagtgaagtagtcagtaataagaggtcctttgaagaaatgatgactgttttccatcaagtgtatcctgatcatgggctactactggtagtggatgaacttctggattatttacgtagccgtaaggatcaagaactgattcttgatctgaatttcttaagggaagtgggcgaggtttgcaaagacctgcgtttccgctttattgctggggtacaggaagcaatatttgatagccctcgttttgcattcgtagctgatagtatccgcagagtaaaggatcgttttgaacaggttgttattgcacgtagtgatgttaaattcgttgtgtctgaacgtttgcttaagaaaacaacagagcagcaagcacaaatacgtgaatatctgactccttttgctaagttctatggcgggcttaatgaaaggatggatgaatttgtccggcttttcccggtacacccagattatattgatacattcgaacgtgtcaagataatagagaagcgtgaagtgctcaaaacgctttctatcgaaatgaaatccattatggatagagaggtgcctgaggattatcctgggcttatatcttttgatagttattgggatacgttgaagcagaatgcttctttccgttctattcctgaaataagaaaagtggttgactgcagccaagtattagagtcccttatacaacgggcttttactcgacctcaatataagcctatggctttacgtctcatacatgctttgtctgtgcatcgccttacaacaggtgatatctattcaagtttaggtgctacagctgaagagctgcgtgacagtttgctactttttgaaccaatgatcgctgagatgggtagtgatgatccagataaggatcttcaaactcatgtggaaactgtacttcgcgagatacataagaccgtaagcggacagttcatttccttcaaccaggaaaaccgtcagttctatctggatctgaaaaagaccgatgacttcgatgctttaatagaaaagagaactgaaagccttgaggagtcccaacttgataggtattactatgaggcgcttaaaagggtgatggaatctacggattcgacatatgttacaggttataaaatatggcagcatgaacttgaatggcgggagcacagggcagcaaggacaggttatctattcttcggttctcctgatgaacgttctactgcagtgcctcagagagatttttatctatattttatccaggtttttgattacagtaacaaattatcgcgttacataaacgaaaagaactccgatgaagtattcttccgactaaaagtaacagatgaagagttccattctgtcttaaaaagctatgctgcagctttagaccttgcttccacatcttcgggacacgctaaagccacctatgaatcaaaggcaaatgaattcctgaagaaactggtacaatggctgcagaaacatatgacagatacttttgaaataacatatcagggacgaacgaaattgatgaccgagtgggcaaaaggaaaatccataaaaggtctgcctggtttaacttcacaggagaccgttaacttccgcgatctggtcaatactattgcaggtgtatgtctggaaccacactttgcagatcaggctccagattatccaatattctcagtaatgatcactggaaataatagaccgcaggctgctcaggatgcattgagggctattgccggccagagtcgtacaaaacaggctgttgctgttctggatgctctggaactgttggacggggagaagatagatccacataaatcaagatatgctgatttaatccttgaagaatttaagtctaaaggacatggacaagtggtcaaccgtagtgagatcatcctcgacgaccatggacttgaatatatgaatccagttggtgcaagacttgaacctgaatgggttgtagttattctagctgcacttgtgaattccggtgatgttgtgttatcaatccctggtaaaaagttcgatgctacaggccttcaacaattagctgctacttccatggatgaactgatcagattcaagcacgttgaacaacctaaggaatggaatttacctgctcttaaggcacttttcgagcttttgaacatgtcgccaggaatggcacaactcctgacccagggaaaggacgagcctgtacagaaccttcaggatgctgtggggaagatcgttaataggatggtaatggcacaacagattatgagagaaggtatttcattctggggacagaacctgctggttggtactgaacttgccaatcagacaagcgggatagaggatgcaaaaaacttttttgaatcgttacaggtttactctacaccaggaaagcttaagaatttccgttacagtgctcaagaagtatcttctcatgaaaaggccgttcaggcactggatgaactcgaatcattgcgtgagttcgtaatgaatcagagtagtattgtatcatggctgaccactgcagaaacggtactgcctactgatcatgagtggacagatcgcctgagagccacacgtaatgatgtcctgatggatctgcaacaggcaaagctatcagagctatccaataaatctcaggaaataaacacaaagctgcagcagcttaagcaggaatatatcaatatttacagtacattacactcaaggtcacgcctgggtgtcaatgatgacaaacagaagtcagcattaataaatgacgcccttttacagaatttagataaactggcaggtatagacctgatgccaaaacaacaacttactgatttccgtaatcgtttggctggattgaagagttgttttaaccttatggagcaagaacttatctcaaatccggtatgtccacactgccaattcaaaccatctatggaaggtgaagtacaggcgtcaactcttcttaatcaaatggaattacaacttgaccagataactgatcagtggaccacaattcttctgaacaacctggaagatcctgtgacacaggaaaatgtaaatcaacttcttcaggatgatgaaagaaagatggttcaggatttcataattaaaggagagctacctcagcctttgaataatgagtttatacagatagtcagaactgttctagctggtctgcaaaaggttccggtgaaaaaatctgaactgatcgaaaaaatggtggagataggacctgtaagcccggctgagttcaagagtatgttcaatgactatgtggacagtctcacaagaggcaaggatccgaacaaagtacgtattgtgctagaatga

SEQ ID NO: 155 - DNA, 3732 bp, Methylacidiphilum infernorum
atgagatatggagaattgatccagttcgagcccatagagtccgtagtccagctacgagatgcggatgaggccgcaagggccaggcagctggtcagcacctatgtcatctccaacgagatggccgagaggctgaccggccttgtgatcccccagcttcagttcgaccagcccgtcgataacaaggggctgcttgtcgtgggcaactacggcaccggtaagtcacacctgatgtcggtgatctccagcatcgccgagcacgcggacctgctttctgccctgggcaacgcacaggtggcacaagccgcggagcggatcgccggcaagttcaaggtgatccgcaccgagatcggggccaccaccatgtcgctgcgggacatcatcgtcggcgagctggaggagcacctggccgccatgggcgtgacctaccccttcccggatgccagccaggtcgtgagcaacaagcgggccttcgaggagatgatggccgcgttccaccaggagtattcggaccatggcctgctcctggtcgtggatgagctgctggactatctccgcacccgcaaggaccaggagctgatcctcgacctcaacttcctccgcgaggtgggcgaggtctgtaaggatctgcgctttcgcttcatggcgggagtacaggaggccatattcgacagcccccgtttcgccttcgtggccgacagcatccgccgggtcaaggaccgcttcgaacaggtcctcatcgcccgcaaggacgtgaagttcgtcgtcgccgagcgcctgctcaagaagaccggcgagcaacagaccaagattcgcgagcatctcacaccgttcgccaagttctacggccgaatgatcgagcggatggacgagttcgtccgcctcttcccggtccatcccgactacatcgacaccttcgaacgcgtcaggacggcggagaaacgcgaggtgctcaagaccctatcgagggcctgtgagaatctgctcgaccaggagttgccggaggaccggcccggtctcatcgcctacgacagctactgggcgaacctgctcgataatccctcctttcgcaccgacccggatatcaaggcggtgatcgattgcagccaggtgctcgagtcccgaatcaagcaggcattcacccggccggcgtataaggacatggcactccgcatcatccacgcgctctcggtccaccggctgacgaccgcagacatctacgcacctctgggtgccacggccgaagagctgcgcgacgcgctctgtctctaccagcccggcattgagggcctgggcggagatccggctgacgacctcttgtcccaggtggaaacggtcctgcgcgagatccacaagacagtcagcggccagttcatctcctctaacccggataaccggcagtattacctggatctcaagaagaccgacgacttcgacgcactaatcgagaagcgcgccgagagcatcgatgattcccagctcgaccgctactactacgaggccctgaaacgggtcatggagtgcaccgaccagacctacgtcaccggctacaagatctggcagcacgagctacaatggctggagcgcaaggcggcaagacaaggatatctcttcttcggtgctcccaacgagcgctcgacggctgtaccgccccgtgatttttacctctacttcatccagccgttcgatccaccgcacttcaaggacgagaagaaggccgacgaagtgttctttcgcctgaccaaaaaggacgaagagtttcgcaccgcgctgaggaactacgccgcggcgctggacctcgcgtccacctcgagcggccacgccaaggccacctacgagtccaaggccaatggattcctgcgggacctggtgggctggctgcagaagcacatgaccgatgccttcgaggtaacctaccagggacgcaccaagtcgctggtagaacgggccaagggcaaatccatccgcgagctttccgggcttgcttccttcgagcggatcaacttccgtgacctggtgaacactatcgccggcgatgtcctggaaacacactttcgggaccaggctcccgactatccctacttctcggtgctcatcacgggccaaaaccgcgagcaggcatccgaggacgccctgcgcgccattgctggacagaatcgcacaaagcaggcgaccgccgtgctcgacgccctggagctcctcgatggcgagcggctcgatccgaaccgctccaagtacgcgaggcacatcatggacatcctcaagaagaaggggcatggccaggtggtcaaccgctcggagctgatccaggaggtctacggcgtcgagtacttcgcaccggacaagggctaccgtctggagcccgaatgggctgtcgtggtcctggctgcgctggtctactccggtgagctggtgctatcgattcccggcaagaagtttgacgccaccgggctgccgcaactggccgcgacgagcatcgacgagctggtccgcttcaagcacgtcgaacggcccaaggactggaacttgcccgtgctcaaggcactcttcgaacttttcggactagcaccgggcatggtgcaactcgtcacccagggcaaggaagagccggtccagcagctccagaaaactatctccgaggttgtggagaagctggtcctggtccagcagagcctgcaaagcggcctgacattctggggcaggaacctgctcgccgaggagaaagcagcccagcagcgcgaccggctcgaccagaccaagaacttcctggaatctctccaggcctactcctcgcccggcaagcttaagaacttccgctacgacgtccaggatgtggagcgtcacgaatacggcctgaaggttctctcggagatcgcgtccctgagggagctggtgagagagctgggccctgtggcctcctatctctccaccgccgaggcggtgctgcccattgaccacgaatgggtggagcagatgaagaagacccgggacgcggtgctcgtgcaggtgtcggacccgtcccagcacacgtccagcactttccgccagcagaccctgtgcaagctcaccgacctcaagaagtcctatgtgcaagcctatcttgccatgcacacccgggcccggctaggcgtgaacgaggacaaacgcaagagcacgctgatgggcgacgaacggctcaagaccctctcgaagctctccaccatcgacctgatgccgcgccagcacctgatcgatttccagaaacgcctggacggcctgaagagctgctctacactcaccgagcaggacctcgacgcatcgccggtctgcccgcattgcggcttccggcccggcacggaggcgcctgccgcacatgccgcggccgagctcgagcagatggacacggagctggacaagctcctcgaggaatggacccagacgctgctggacaacctggaggacccgaccacccgcgtcaacttcaacctgctcaagcccgagcccaggaagctggtggatgtcttcctcaaggagcggaagctgcccgacgaaattggccaggatttcattcacgccctgaaggaggtgctctcagggctggtcaaggttgcggtgaagaccgaggatctgcgcatagcccttatcaagggcggctcaccggcgacgctggcggagatgaagaaacgcttcgaggaatacctcgatgaactcaccaagggcaaagagcccggcaaggtgagaatcgtactggagtag

SEQ ID NO: 156 - DNA, 3612 bp, Moorella thermoacetica
atggctaagatatgtgagctctttaactttgaaaggatccgggaagtagttgacatagacgccataaccgataagaaggcaatggtggagaattatgttatttccccatccctggaagaatatctggttcatctgttccaggaccttaattccagcacacataaagcggctcagatcattggcggttacggttccggcaagtcgcaccttttggccttcattatctccctgctgaccgaacccgggctggtcaggtctgtgcaaaacgaacaggtgaggcgggccgtggaggccatgaagcgggattttgtggtagttcactgggagctgcagcctaatgatgtaagtttgagcgagtatttctacgatcaactggaaatccaattgaaagagaaatacggcatctcgataaacctgcccacttccggcgtaatcgaccacaaaaagactatcctgcagatactggaaaaagtaaaagaaggccatcccacccgcggcctggtggtagtaatagacgagatttccgactttctgaagcaaaagaccaaagaaaaactcaatcaggatgtccagttcctgcgcgtgcttggccaggcggcgcagagctgcgacttcatgtttatcggcgccatgcaggagcacatttttactaatcccaagtacgtagatgaagcagagagctttggccgggtggccgagcggttccaggtcatcaccatcaaacgcgaagacatcaagcgggtgattgccagacgggtcctcaagaagaccgccgaacagaggctgcggctggaggagctattcagggagtatgtgcactacttcccgcacctgcaggccggccttgatgagtatattgaccttttcccccttcacccctatgtaatccaggttttcagcgagctaccctattttgaaaaacggggcgtgatccagtttaccatccaggaagtagaacaaatactggaccgcgactttccttttttgatcacctatgaccgtatatatgatgaaattgcctccaagcataccgtaaagaatctggagaccgtgtccccggtggtcaacgccatccagaccctggaaagtaaagtagaccttttagaaccacgccatcaggatacggcccgcaagatcattaaggccctagctgtgctacggctatacggaaaaagtgtcaacaacggggccactgccgaggaactggcaaatactcttctacttctacccggcaataggctgatggaagccgccgacgaaatttccttggtgttgaagaacttccgtagagttaccgatggccaatttattaacgttacctccgacggttattattttctggaccttaatctgaccattgattacgaccaggtgatccggcggcgagccgaaaacctgccggaagacagcctggacgaggagatcctgtccatcctcaaagagcagctactcctggaggagggtgcggcacgttatgctttccgggacacttgcgaatggtctggccgccgttctttccgcgaaggcacttttgtctatgaaaccggcaaaggggaagtggtccgggccgacggcgactaccggattgttttcgtctctcctttttgcgccgggaaccgctacccgccagccgaaaactgcgctgtgatcagcggctctctgccacctgaagccattgagcagttaaagctggccgttgcagctcaccttttgttcagggagaactaccagcgtagcatcatggagaaaaaatatgcttcgttgaagaaaaagtttgtggaaatgttcgtgcaggcatggctggaaaccggccaggtaaatattgggaaagcgcaaaagggcatcaaggctttgatagtcagggagtttagcaattttgacgagctctttaccgagatcaaaccccagctatttgaggattattttaatcagaagtatcctaaacaccccaaatttactcagcgaatcacccgcgacaatatcatgggtgagtttggagcggctattaaggagctactcagcaaaggcaacgtccagtccgttttttccagtaccaaatccattctcaatgccctggacctgctcgatgctcagggtaacctttcgactgccaattcagaaatagcagcggctattctggaaaccgctcgagccgctggtgggaaagttgtagcggtggaggattttattaaccgcttccggcagaccccctacggttacgatcggtggatgaccgcttttgtcatcatcgtattaacctacaacggcgagatcgttctcagggctgctggcggcacgcttattagctcttctgaagtgtacgatacattcggatcaggcctggaggctttcgagaatataaagtatcttgctatagaaagcgacttcaatccccagccggttatcaaccttatgctggccctgggtatagacccaggtattactgctaaaatgcgtgtaaccgcaaaacgtaacgaggccttacaagcttttcgcacccgctatctagagattaaggaacagttggactttgttcgaaaaaaactggagaccctggctttgaatgccggtaacatagttgatgttaatggtcttagaaattatcaccaaaaattagcagatatacccattgacaaatttgaacaggtgaaagcgcccaacgatttcaagaaagtggtgtacgacgaggctgccatccagaaaattggagaggcttataagatacttcaggatctggaccatttctacaaaatgtattcggaacggctggaaaaggaggtggagtatgcccgggaagttcggaaagtcgttgaggaatatcccggtttatttctgaccgatggacttaaggaattcctccatgaagcctttgccgtcttggccgattccagccgtctggtgaaccggagcgagctgctgtcgcttttgggcaagttgcagcaggcccgccagaaatatgtgactgcttattatagggcgcacgaaaagtgtgtaggcgaaagggctggctggaacaaactacaagaattaaccgccagccagacctggaaaaacctgctccttttgaagaacgttactgttttaaataagtaccccctagccagagtggaaaacgaaatttcagtgctggctacccagcgctgcgaggggtttaaggttgaactcatcgagaagagccctctgtgcccgcggtgtaattttccaaagagctttagaggcgaaaatatcggccagtggatagctaacctggaggatgagttggaggacatcttcagagagtgggaggaaacaatcctcgctgaggtgaagaactaccaggataacctggactaccttgaggccggggaaagggaattaattctgcaggtaatgaaggccgggaaactgccgccggtggtcaccgaggacctggtggtggccttgaacaaccttttcagagagctggtttcggtagaggtcagcccagcagagctcctggaagcggtgtttgccggcgcccgggtcatggactacttcaccttcgagcggaggctgaatgcctggaagcagaagctggtagccggccacgacctagacaaggtgcgcatcaagctggctggcggggaagcgtga

SEQ ID NO: 157 - DNA, 3822 bp, Nitrosococcus oceani
gtggttaggttacaggataggagatttggacatatcaaaaacatacctgtagaggagaatccagggagggcgcaaatcaaatacggagaccttatccaattcgacccaatagagtcggtcgttcagttgcgtgacgcggacaagtcgagcgccgcgcacaccctcgtgaatacctatgtcatttccaaggaaatggccgaacggctcacgcagcttgtcattcctcagatgcagttcgaccaaccggtcgataacaagggtctgctggtcgtcggtaactatggcaccggtaagtcgcacttgatgtcggtggtctccagccttgccgcagacgcctcactgctggaggagctgaaccacgccagtgtacgcgacgccgccgctcagatcgctggacgtttcaaggtgatacgtaccgagattggagccaccaccatgtccctgcgcgacatcctggtggccgaactggaagagcatttcgaaaaactcggcgtggagtatgtgttccctgaagccgggactatcatcagccacaaacgggccttcgaagacatgatggccaagttcggcgaggtcttccccgaacacggcctgctgctggtggtcgacgagctgctcgactacctacgcacccgcaaggaccaggagctgattctcgaccttaacttcctccgcgaggtcggcgaggtctgcaaggatctgcgtttccgcttcatggccggtgtccaggaagctattttcgacagcccgcgcttcgcctttgtggccgacagcattcgccgggtaaaggaccgcttcgagcagatccttattgcccgcagcgacgtgaaattcgtcgtggcggagcgcctgctcaagaaaaccgccgagcaacaggccaagatccgcgactacctgatgccctttgccaaatactacgacgggctcaacgagcgcatggacgagtttgttcggctcttcccggtacatcctgattacatcgacaccttcgagcgcgttaccgtggtggaaaaacgtgaggtgcttaagaccctgtctatgggcatgaaaggcattctcggcaaggatgtaccgcaggacgaacctggtctgatcgccttcgacagttactggaacacgctcaagcagaatgcctccttccgcgccattcccgagatccgggcggtcatcgattgcagccaagtgctggagtctcgcatcgagaacgcactgaccccgaaaaactacaagcccatggcagtgcgcctaatacacgccctgtccgttcaccgtctcaccactggcgacatctatgcccctatgggcgcatccgccgaagaattgcgcgatcggctctgcttatttgaaccgttaatcacggaaatggggagtgatgagcctgacaaggatctacagacccatgtagagactgtactgcgcaaaatccacacagctgtcagtggacagttcatttctgaaaacaaggacaaccgccagttttatctcgatctgaagaagaccgatgatttcgacgccctgatcgacaaacgggccgagagtctgggccaggctcagctcgaccgtttctattacgaggcactcaagcgtgccatggaataccaggacgccacctacgtgaccggctacaagatctggcagcacgaattggtctggcaggagcacaaggccgcccgtaccggctacctctttttcggcgctcccaacgagcgctccaccgccgtgccgcagcgggacttctacctgtatttcattcagcccaacgatccgccgcgcttcaaggacggcaaggtgagtgacgaggtttttttccgcctgaagagcaccgacgaggaattccaaaccgcgctgaagagctatgcggcagccctggaccttgcgggcacatcctcgggccatgccaaggccacctatgaatccaaagccaacggcttcctgaagaagctggttcagtggctgcagaagcacatgagcgatgccttcgaggtcacctatcagggccgcgccaagtccatgaccgaatgggccaagggcaagtccatccgcgacttgtccggtctgctaccccacgagaccatcaacttccgtgacctggtcaacaccatcgccggtgtctgcctggcaccgaacttcgagaaccaggctccggactatccgttcttctcggtcctgattaccggcaataaccgcgcccaggccgcgcaggatgccttgcggaccatcgccggacagaaccgcaccaagcaggccaccgccgtgctggacgccctggatctacttgacggcgagaaaatagacccctacaagtcgaagtacaccaagtttatcctcgatgcggtcaaggccaaggggcacggccaggtagtcaaccgcagcgagatcatccaggatgaccaggggctggaatacatgaacccgggcggttcgcgtctggagccggaatgggtgagcgtcctggtggcggcgctggtctactccggcgacatcgtgctcgccatcccgggcaagaaattcgatgccaccggcctgcagcaacttgccgcgaccggcatggacgagctggcccgctttaagcacctggagcagccgaaggaatggaacttgccagcgctcaaggcgctatttgagctgctcggcatgacgcccggcatggcccagctcgtcacccagggcaaggacgagccggtgcagaacctgcagcaggcggtgggcaagatcgtcaagcgcatcgtcatgacccagcaaaccctacgcgaagggctttccttctgggggctagacctgcttgtgggcaccgacctggccagccagaccagcggactggacgaggccaagggcttctttgaatcgctgcaggcttactcctcgccgggcaagctgaaaaacttccgctacagcgctcccgaagtactggcccacgaaaaggccatgaaggcgctggacgagctggatgccctgcgcgcgttcatcatggacaatggcccgacggcgtcctggctctccaccgccgaggcggtgttgcctgccgagcatgattgggtggatcgcatgaagaccacccgacaggacgtactggatgccttcaagcaggctaatctgaccgagctgaccagccagtcccagagtcccttatccggaatcggcgccaagctacagaagctgaagaaggattacaccgtcgcctacatcggtctgcacaccaaggcccggctgggggtgaacgaggataagcgcaaggcgggactgctcaacgacccgcgtctgcaaaccctgcgtaagctggccggtatcgacctgatgccacggcagcagctcaccgattaccagaaccgcctggccgggctgaagagctgcttcgccttgaccgagcaaaacctcgacgcctcgtccatctgcccgcattgtggcttccggcctgcggtggaaaccggtgcggccgtggggtcgcagatgatcgaccagatggatacccagctcgatgccatggtggcggcctggacctccaccatcctcagcaatctggagggcccgatcacccaggccaatatggatctactgaaaatcgacgaccgcgaaccgctggaagccttcatcaagtcgaaggaactgccggtgccgctggacagcaacttcgttcacgccctgaaggaagtgctctccggtctggtcagggtcaccgccaaggcacaggagctgcaacaggccctgcaggttaccgacggcccggccaccccggtggagatgaagaaacgctttgaggagtacatcgatcaactcaccaagggcaaggacccggccaaggtgcggatcgtcatggaaggttaa

SEQ ID NO: 158 - DNA, 3981 bp, Nitrosococcus watsonii
gtggttagtttacaggataggaaatgtggacatatcaaaaacatacctgtagaggaggatccagggagggcgcaactcaaatacggggaccttatccaattcgacccaatagagtctgtcgttcagttgcgtgacgcggacaaatcgagcgccgcgcacaccctcgtgaacacctatgtcatttccgaggaaatggccgaacgactcacccagcttgtcattcctcagatgcagttcgaccagccggtcgacaacaaaggcctgctggtcgtcggtaactacggcaccggtaaatcgcacttgatgtcggtggtctccagccttgccgcagacgcctccctgctggaagggctgaaccacgccggtgtccgcgatacagcctctcagattgccggtcgattcaaggtcatccgtaccgagatcggagccaccaccatgtccctgcgtgacatcctggtggctgaactggaagagcatctcgaaaagctcggtgtggagtatgtgttccccgaggctggcaccatcaccagccacaaacgggccttcgaagacatgatggccaagttcggcgaggtattccccgaacatggcctgctgctggtggtcgatgagctgctcgactacctgcgtacccgcaaggaccaggagctgatcctcgacctcaacttcctccgcgaggtaggggaggtctgcaaggatctgcgcttccgcttcatggccggtgtccaggaagccattttcgacagcccacgcttcgcctttgttgctgatagcattcgccgggtgaaggaccgcttcgaacagatcctcattgcccgcaacgatgtcaaattcgtcgtggccgagcgcctgctcaagaagaccaccgagcaacaggccaagatccgcgactacctgatgccctttgccaaatactacggcgggctcaacgagcgcatggacgagttcgtccggctctttccggtgcatcccgattacatcgacaccttcgagcgggtcaccgtggtggaaaagcgcgaggtgctcaagaccctgtccatgggcatgaaaggcattttgggcaaggacgtgccgcaggacgaacccggtctgatcgcattcgacagctattggggtaccctcaagcagaacgcctccttccgcgccattcccgagatccgggcggtcatcgattgcagccaggtgctggaatcccgcatcgaaaacgccatcacccgaaagcaatacaagccgatggcgctgcgcctgatccatgcgctgtccgtccatcgcctcaccaccggcgacatctatgcccccatgggcgcgtccgccgaggaactgcgcgaccgcctctgcctgttcgatccgctgatcgccgagctgggaagcgacgagcccgacaaggacctgcagacccatgtggaaacggtcctgcgcgagatccacaaaacggtcagcggccagttcatctccttcaatgccgacaatcgccagttctacctcgacctgaagaagaccgacgacttcgacgccctgatcgacaaacgggccgaaagcctgggccaggctcagctcgaccgcttctattacgaggcgctcaagcgggtcatggaatgccaggacgccacctatgtgaccggctacaaaatctggcagcacgaactggtctggcaggagcacaaggccgcccgctccggctacctctttttcggggcaccgaacgagcgttccaccgccgtgccgcagcgggacttttacctctacttcatccagcccaacgatccgccgcgcttcaaggacgacaaggtcaacgatgagatcttcttccgcctgaaaggcaccgacgaggaattccagaccgcgctgaagagctatgcggcggccctggatcttgcggccacctcatcgggccacgccaaggccacctatgaatcgaaggccaacggtttcctgaagaagctggtccagtggctgcagaagcacatgagcgatgctttcgaggtcacttatcagggccgcgccaagtccatgaccgaatgggccaagggcaaatcgatccgcgacctgtccggcctgtcgccccacgagaccatcaacttccgcgacctggtcaacaccatcgccggtgtctgtttggctccgaacttcgagaaccaggccccggactatccgttcttctcggtcctgatcaccggcaataaccgcgcccaggccgcgcaggacgccctgcgggccatcgccgggcagaaccgcaccaagcaagccaccgccgtgctggatgccctggagctgctgaacggtgacaatttcgccgggagagaaattggacgcccggagggcgcccgcaggggagccgccatggatggtggctatcaaaagatcgacccctacaagtcgaagtacaccaagttcattctcgataccgtcaaggccaaggggcacggccaggtagtcaaccgcagcgagatcatccaggacgaccacggtctggaatacatgaacccgggcggttcgcgcctggaacccgaatgggtgagtgtcctggtggctgccctggtctactccggcgacatcgtgctcgccatcccgggcaaaaagtttgacgccaccggactacagcagcttgccgcgaccggcatggacgagctggtccgcttcaagcacctggagcagcccaaggaatggaacctgcccgcgctcaaagcgctgttcgaactgctcggcatgacgccgggcatggcccagctcgtcacccagggcaaggacgagccggtgcagaacctgcaacaagcggtgggcaagatcgtcaagcgcatcgtcatgacccagcagaccctgcgcgaagggctctcattctgggggcaaaatatggttctgggttctggcttgggtgttcagggttcggagaactcagaaccgggaactcagaactcagaactcgaaaacgcgaaagcgtttttcgaatcgctccaggcctattcctcgccgggtaagctgaaaaacttccgctacagcgctcccgaagtgctggcccacgaaaaggccgtgaaggccctggatgagctggacgccctgcgcgagttcatcatggaccacagcccgacggcgtcctggcttgctacggctgaagcctccgcaagccgcggttccgagttccgggttacgggttccgagtcaaaaccccaaggactggatctctgggttgatcaagtgaaggccatccggggcgatgttttggattccatcaactcggaactcaaaactcagaacccgcaactcgcgcgcctttcgtccgaagtcggcgaaaaactgaaaaagctcaaacgcgactacatcaaccaatacatctccctccacgcgcgcgcccggctgggggtgaacgacgacaagcgcaaggcaggcctgctcaacgaccagcggctgcaaaccctgctcaagttggccggtatcgacctgatgcctcggcagcagctcaccgattaccagaaccgcctggccgggctgaagagctgcttcgccctgactgaacagaatctggagaccacaccggcttgtccgcattgccaatttcggcctgcggcggaaattggagttctgggttctgggttcggagtttctggttcgcagcaactcgaccagatggatgagcagttggataagatcatcgaacagtggaccaagaccctgctgaataacctcgacgatccgatgactcaggcaaatgtgaacgagctactgcatgaagacgacaagcagattgttaaggctttcatggattcaaaggaactgcccgacccggttgatggcaattttgtgcagaccttgaaaaccatcctcgccggtttgcagaaggtgtcggtcaaaaaagcagatttgttgaaaatcgtctccgaccttggtccatctacgccaaatgaaatcaagcaagcagtcagtgactacgtggacagccttaccaaaggcaaagaccagaacaaagtccgcattgtcctggagtaa

SEQ ID NO: 159 - DNA, 3741 bp, Parvibaculum lavamentivorans
atgaagtacaaagatcttattcaattcgagcaaatcgagtcggtcgttcaactgctcgacgccgaccgtcccaacgaagccaagaagctcgtctcgacgtttgtcatctccgatgacatggccgagcgcattgccaagctcatggtgccgcagctcggcttcgacgaatctgtcgatcacaagggtgtgctcatcgtcggcaactacggcaccggtaaatcgcacctgatgtcggtgctatcgctggtggccgaagacgccgcctatgcgccgatgatccgacaccccaaagtggtggatgcggtcgcgtccatcgcggggcgcttcaaggtgctgcgcatcgaggtcggcggtcttgaaatgccgttgcgccagatcatcacccagcagatcgaacgattcctcaagaaactcggcgtcgatttcacgttcccaagcgctgatcaggaactgaacaacaaggactccttcgaggagatgatggctgcgttcggcgagaagttcccggatcaggggcttttgctcgtagtggacgagttcctcgaatatctgcaatcgcgtcgcgatcacgaactggtgctcgacctagccatcctgcgtcagatcggcgaagtcgccaagcatttgaaattccgcttcgttgcgggtgtgcaggaagccatcttcgatagcggaaggttccagcacgtggccgacagcatacgccgcgtcaatgaacgcttcacgcaaatcctgatcgaccgccaggacgtgagcttcgtcgtatccgcgcgtctgctcaagaagtctgccgaccagcagaataaaattcgcgaatatctgaagccattcgccaagttctacggatcgatgaacgagcgtatggacgagtatgtccggctatttccggtccacccagactatctcaagaccttcgagcagattcacttcaccgaaaaacgtggcgcactcaagaccatcgaagccgcaatgcaggccattctcgatcaggatgtaccaactgatcggccacaactcatcgcctacgaaagcttctggaatacggtcaagagcaaccaggtgctgcgcgccgatcccaacatcaaggaggtcttgcgcgtctctgaagtgctggaatctcgcatccagcaggcattcacgcggccgacctacaaaccgatggcgctgcgcgtcgtcaacggcctggctgtgcatcgcctgaccaccggcggcgacatccacatcccgattggtcctaccgccgcagagcttcgcgattccctgtgcctgttccaacctggtgtcggggatatgcccggcgaaccggccgagaacctgctgtcgatggttcagaccgtgatgcgcgaggtgctgaagaccgtcaacggccagttcatctccaaggccgccgacaccgagcagtattacctcgatctcaaaaaagacgtcgactacgacgcccagatcgataagcgcgccgaagcattgtcagacgacgctctggaccgcgcctactatagcgccgtcaagacgttgatggagtgcagcgacgatcttcgctaccccggcttccagatctggcaataccagatcgaatggcaggaacaccgcgtcgaacgcctgggctatttgttcttcggaggcccaaacgaccgtcccaccgcgcagcccgagcgtgatttctacatctacttcattcagcccttcgacaagggacagcgcacctactcgcagcagccggatgaagtgttctttcgcttgaaagcgcttgacgagggctacaggcgccatctgtcccaatacgctgcctcgctcgacctgggctccactgccagtggcggtgcgaaggcggtctatcagtccaaggcgcaggacgccctgcgcgccatgagcaagtggctgcaagaaaagcagctgaccgcgtttgaagtcacctatcagggcaaggccaagacgctgcaagactgggccaaaggtgtctcactgcgcgaccgcgcgcgcctggggcctgaggagaggatcaacttccgcgacattgtgaacatcgtctcgggcctggttttgtcccagcacttcgccgacatcgcgcccgaatatcccaagttcccggtgctcgtcaccgaggctaaccgcaaatccctgattgccagtacgctgcgcgcgctggcgggcggcacgcgcaccaaggacgctaccgcggtcctcgatgccttggaaatgctcgacggcgaacgtatcgacccggcgagctcccgctacgctcaggaagtgttgaaccgtctcaaggccaagggccatgggcaggtgctcaaccgcaacgaactcgtcgccggtgcgaccgatgtggagtatttctccccggccaagcaccggcttgagcccgatctgctggtcgttgtgctgggcgcactggcctattccggcgacatcgtgctcgcgatcaccggcgacaagatcgactccggcaagctctccttgctggcagaacgctcgctcgatgaactcaagcagttcaagcacatcgaggcgcccaaggaaatcaacctcgcggtgctgcgtgcgctgttcgagttgctcgatctgccatctggcctggcccagaaggccagccaaggcgacaccgaaccggtcatcgcattgcaggaaaagatcagcgccctggtgccgcgtgtgctcagggcgggctccgatctccagcagggcaagctcgccttctggggccagaacctgctgcgcgaggaagaagccaaggattggtacgcgcggctggatgcgctcaagaaatttacagaatccctgtctccctacaacaccgtcggcaagctcaaaaacctgcgcaccacgcaggaagacatcgacatccagaagaaaaatctggacgtgctcgccggcgtcgagcgtttgttggaactgatcggagaattggggggcgccgcatcctatctgtcgcaggcggagatgatcttgcagcccggccacgactgggtgaagcaggccgaagccgcgcgcaaagccctgttcgataagctggcggaggatcgcacagcggaacgcgccgccgccatcctcggcgaaggccgtcagactctcgccgggctcaagaaggattacgtcaccgcctatatcgccagccacagcaaagcgcggctcggcgtcgccgaagagaagacacgcaatgcactgcgccgcgacgaccgcttgttatcgttgcgcgtgctggcaggcgtctcgctgatgcccaccagtcagctcaccggcttcgaggacgcgctcaacggcctgaaaagctgctccgcgctggacgagccgacgctgctcagaacgccggtatgcccccactgccagttccggccatccgccgaacaactggaactgctgcctgccgccagtcgcctgaacaagctggacgacgatctggaccagttgcaggccaactggcagcagacattgctggagaatctggaagacccgttcacgcaggacagcctgggcctgctgccggccgcatcgaaggctctgatcgatgccttcctcgccgcgcgcaagctgccggagcctgtcaccaccgatttcgccaacgccgtgcaggaagcactgtccgggctggagaagatcacggtcaaagcagacgaactgcgtcaagccctgctgcaaggaggctcgcccgccacgccggatgaactgcgcaagcggttcgacgcgctcatcagcgagcggggcaagggcaaggacgcaaccaaactccggttcgtgatcgagtga

SEQ ID NO: 160 - DNA, 3741 bp, Parvibaculum lavamentivorans; identical to SEQ ID NO: 159

SEQ ID NO: 161 - DNA, 3756 bp, Planctomyces brasiliensis
atgtcatggtcgtgccggtgggccaagaatcgacaacgagccattgatggtgagcagatgaaatactccgaactgatcgactttgaaccaatcgaatccatcatcgagttgcgggatgcggacgcccacgataaggctcgcagtctcgtcgagacgttcgtgatctcggatcggatggccgagcaactcaccgaaatcgtcgtgccgaatctccagtacgacaagcccgccgacaacaaaggcgtcctcatcgtcggcaactacggtactggtaagtcgcacctgatgtcgttcatctcggcgctggctgaacacgaggatttggctgacgcctccaagaacaaagatgtcgtgaaagcggcgaaggaggtcaccgggaagttcagggtcgtccgtaccgagattggctccaccacaatgagcctgcgggacatcatctgcggcgagcttgaagatcatctcgctgacatgggggtgaagttctcgtttccacccgccgagaaggttcggaacaacaaggatgccctcaacgagatgatgggcaagtttcacgagaagtacccggaccacggtctgctgatggtcgtggacgagcttctcgactacctccgcagccgccatgaccagcacctagtcctcgacctgaacttcctgcgggagatcggagaggtctgcgacgatcttcgtttccggttcgttgccggtttgcaggaagctctgttcgacaatcctcggtttcagtttgtggcagacagcgtgcggcgagtcaaagcccgttttgcgcaactccgcatcgtgcgagaagacgtggcgtttgtggtgtcggagcgtttgctcaagaagaccccggagcaacaagctcgcattcgagaacacttggagaagttcacgccgctctacgacacgatggcggaacggatcgaagaattcgtcaggctgtttccgatccaccccgcctaccttgagcagtttgagcggatcacggtcgcagagaaacgtgaggtcttgaagaccctgagcgtcgagatgcgtcagttgctcaacaaggacgtgccaaccgaggaaaccgggctggtcagctacgattcgtactggcgattccttctcgatgatgtctcgcttcgcacggacccggatgtcaaggaagtcatcaacaaaagcaacgtgctggagagccggatcaaacaagccttcactcgcaaagcctacacaccaatggcgctgcggctgtgcagcgggttgtcggttcaccgtctaaccaccgacgacatccatgccaagatcggcccgaccgccagcgagttgcgtgatgacctctgcctcttccatgaagcgctccctgagaagaacagcgacttcctgcggacgacggtcgagtcctgcctgaacgagatcgtcaagacgatgagcgggcagttcatcacgcacaacaaggagaacgaccagtattacctcgatctcgaaaaggacatcgactacgacaccgagatcgaaaaacggtcggagagcttgtcacctagcgaactcgaccgctattacttcgacgctctcaagcgagtcatggagtgcgccgaccagacctatgtcaccggctaccgcatctgggaacatgaagtcgagtggcgagaacacaaggtcacccggcgaggctatatgttctttggcgctcccaacgaacgatctacggcacagccgccacgagatttctacgtctacttcatccagccgttccaaccaccaaagtacaaggacgacagtctgggcgacgaggtattcttcttcctaaaacacccggatgaagagttcgaccgggcattgcggctctatgcaggcgcacgagcgatggcgtctcaggcaggcagcgctacaaggaagaattacgaggacaaaggcgatctccatctcaaggccctgacgaattggctgcgccagcacatgctgactgcctttgaggtcgcccaccaaggcgtctcgaaaaagatggtcgagttcctgaaaggccatcgcacggggaacatgaccgtgagcgaactggtcaacctcgtcggttctgtggcgctcggcccgtgctttgaggaaaagtatcccgagtacccgacgttctcggtaacaatcacggcctccaacctcgacgatgcggtttcggatgccatccgttccttggcaggcggtctgcggacgaatattgccacggctgtccttgacggtctggaactgctcgacggcgacaagattcgaccccacgaatctcgctatgccaagaaagtgttggagaagctggagggcaaacccaaaggtcaggttctcaaccggaacgaactgctcgaagagcaatacgcaaacgtcgaggttgagattgaatacaggctggagccggaactgctggttgtggtcctcctcggattggtccacagcggtgacgtgacagtcagtctcgtcggcaagaagaaagtcgatgctgccagcctcagtgactcagggaagacgccggtcgaggagttctgcaagttccggcacgtcgaacgaccgaaggacattccgctgtcggcgctggtcgccttgttcgagcttgtcggcctgtcggaaggtttgattcgcaatcccaatactcgggaagaggccatcaagcagcttcacgacaagacaagcgggatcgtgaagcgagtcgtcgtttccaaacagcacgcacaatcgggactgccgtgctggggccacgagttgattccagtcgagaagcgggaagagtaccgaaaacgactcgacgaactgcaaggtttcttggagaagctgcaagcgtacaacacacccggcaaactcaaaaacttctctgcttccgtggaggatgtaaaagctcacggggccgacttggaactgctcgaagaactcgaaggcacaagcgcactcgtgggtgagttgacgccgctcacatcgttcctgacaaccgccgaggccgtgcttcccagcggtgactcatggaccgagaaatcgaagaaggttcgcagcgagtggcagcctcagttgctcgatgggtcgaaacgcaacgacccgagcttccggcagaaactccttcaagcgatggagaagtgcaagaaggactatcaggaccactacctgtcgctgcacaagaagactcgcctcggcatcaacgaggatcagaagaagcgagacttgctcaaggacgcacgcttggagcgactcaacaagttggcgggcatctcgcttctgcatccggggagcctcaccgatctgcggaatcggctggccgaactcaagccgtgcttctcactcgtgaaggacgacttgggaacaaacccgatctgcccgcactgcggcttccgccccacggatgaaaagacgggaccatcgggatcggcggcactcgatgccatcgatgaggagatcgacaagctgctggatggctgggtcgagactctgctcaacgatctatccgatccgaccgtcgagaagagcatcgaactgctcgacgccgaccagaagaaggccgtgaagaaggtcatcaaggaccgagccttcccggacaagatcagcaacgaactgatccaagggattcagaatgcaacgtcggggctgacgccaatcaccgtcaagtcttcggacctactcggctcgctgagcgacagcagcgctccctgcactgtcgaacagttcaaaagtcgcttcgaggaattcgtacaggagatgacccgtggcaaggatgtcgccaagattcgcatcatcattgaaaaaactgactga

SEQ ID NO: 162 - DNA, 3681 bp, Syntrophothermus lipocalidus
gtgaagtacgctgacctcatacattttgaaccggtcgaaactatagtgcagttacgggaagctgatgccaaaagcagggccggggagttggtaaaaagctacgtgatctcggaacggatggccgagcagattacggaagttgtctttccgcagcttcaatacggccatccccaggataataaggggcttttgatcgtcggtaactatggtaccggcaaatcgcatttaatgtcggtactatctgctatagccgaatatccagacctggtcacggagatacggcatcccgctgtggccgcaaaagcgcaggctatcgctggcaagttcaaggttgtcaggaccgagatcggttccaccacgatgtctctcaggaacatcatttgtgccgagctggaagaacagctggctaatctcggggtgaaataccgttttcctgaagccgataaaattaccaacaacaaagacccttttattgagatgatgaacgctttccaggaagtttacccggatcacgggctcttgctggttgtcgatgaactcctggactacctgcgcacgcgcaaagatcaggagctaatcctcgacttaaacttcttgcgggaaatcggggaggtttgccggctcacccggtttcgcttcgtggccggggtgcaggaagccatttttgacagcccgcgctttcagtttgtggctgaaaccctgcgccgggtcaaagaccgttttgagcagatacgaattgtccgtgaggacatagcctacgtagttgcccagaggttactgcgcaaggatgacaggcagaaggctctcataagggagcacctgcagcgtttcaccaaactatacggcaccctggccgagcgcatggacgaattcgtcgttcttttccccgtgcatccggcatacctggaaacttttgagcgggtctatgtagccgaaaagcgcgaggtgctgaaaaccataagttttgccatgaaaaaactcctggacaaagaagttccggaaaatgaccccggcctcatcgcttatgactcttactggcaaaacttaaaggacaatccttctttccgcagcgacccggacattcgcgaagtgattgagaagagccaggtactggaataccgtgtccagcaggcctttacaaggccgcagtataagcctgtggccctccgcatcattcacgctttgagcgttcaccggctgacaacaggagatatttacgctcccataggggtcacggctgaagaactccgcgacgacctctgcctttacttgcccttgccggaagaggatgccgagtttcttaaaaccattatagaatcaatcttgcgcgagatcttaaggacggtgagcggccagtttatttctttcaaccaggacaacggccagtactaccttgacctgaaaaaagacatcgactttgattctctaattgagcagaaagcggaagtcttgacccccaaccagttggaccgctactattttaaggccctcgcccgggccatggagtgccccgaagccacgtatgttcccaatttccagatttgggagcacgaaattgagtggcgcgagaaaaaggccacccggttagggtatttattcttcggggctcccaacgagcgttctaccgcccacccgcccagggacttttacctctattttctgcagccctttgacccgccgctttttgaggatgagaaaaagcccgatgaggtgtttttccggctggtgcagcgtgacgagaactttgaccgtgcccttaagttctacgccggcgcctgcgagatggccagcacggcttccaaaggaacgcggcaggtctatgaaaataaggccaacgaccagctgaaaaagatagtcgaatggctgcggaacaacatcaccacggcttatgaagttacctaccggggagcaactaaaaaattcgtcgagtggattaagcacagtgccacttctcatgcctcggttcgggatctggtgaacatggtgggttccctttgcctggcgccctacttccgggagctggcgcccgaatacccggccttctccatcctggttaccgtaaagaaccggcctcaggctgcccaggaggcgataaagtggatcctcggcagcatcaggaccaggcagggggcagccgtcctcgatgccctggaacttctggacggagataagttaaggccgcaaaattcccgttatgccaaacacatcctgggacagctggacaaaaagggcccgggtcaggtcctcaaccggggcgaaataatagccgagtttcgcggtgtggagtacgaaacccgtttcagattggagccggagtgggtggtcgtcatcctggcgagcttgatctacagcggcgatgttactttaagcattccggggaagaagatagatgcttccaacctggaggagctgggcaaaattcccctggaggaacttattaagttcaagcatatcgagcgtcccaaggacctgcccctcggtcccctacaggctctgtttgaatttttggggctgccgcccgggctgatcgtcaatcaatctactcgtgaagaaggggtaaggcagcttcagaaagcggtggatcagctcctggagcgcaccgtgcaagcccagcaggtgatacagcaagagttatctttgtggggtatttctttgtttgatgagaaaaataaagccggtttaagggataaactggcaagtttcaaaggatttctggaattactccgggtttttaacactcccgggaagttgaaaaacttccgctactccgagcgggatataaataagcagaagacgtaccttgccaccctgaagagggttgaagagctggccggcctggcaagtgaagtccagcctctgctctcctacctcagcaccgccgaagccgtgcttcctgcggatgccggttggacggtaaaagcccgggagcggcgtgaagagctcaaggcaaaactatccggcctggacgaagcatccgaccccagcctgcgacgggaactcgtgcaggtgctggtggaactcaagaactcgtacattgagacttacctgcaggcccatgccagggcccggttaaatgcgaccggggatcagaaaaaatccgaacttctcaaagatgagcggttgagcaaactcaacaggctggctggtatagagttgatgccccgggcccagcttacggacttccaaaaccgtctggcggagctgaaaacgtgtttcagcctcaccagagaggatttggaaaaaacgcccgtctgtcctcactgcagctaccggccggcacaggagcaaattaagctgccggctgacgcggcgctcaggcggttggaggaagacctggaaagactgtgcgaggattgggaaaggacattgatcgccaacctggaagacccgacggtaaaggaaaacatctatcttttgaagccggagcagcgaaaagcactggatcaggtggtcaaagaacagcagctgccctacacggtggacgcatcatttgtaaaggccgttcaggaagtgctctccggcatggaaaaggtttcggttaccgcagccgacttaaagaaagctttgactcaaggcggaacgccctgcacagtatctgagtttcagcagcgctttgaggattatatccggtctctcacgcggggcagggacccgcagaaggtaaggatcgtcctggaatag

SEQ ID NO: 163 - DNA, 3582 bp, Syntrophothermus lipocalidus
gtgtaccttaaacgtttagaactgaaagggtttaaatctttcgccgagcgaaccgaaatcgaatttatgcccggcgtcaacgtcatagtcgggcctaatgggtgcgggaagagcaacatagtagacgcgatcaggtgggctttgggcgagagtaacgttcgccacttgagggggcagagaaacgatgatgttattttcagcggtacggataagaggcgtcccttgggcttagctcaggtagacgtggcaatagacaactgcgacagggttttaccccttgactttgccgaggtaagcgttaccaggaaagtacaccgctcgggtgagagcgagttttatattaaccgggttccggcccggttgaaagacgttcaggatctttttgcggggacaggtttgggtaaaaaagggtactccattatcggccagggagaactcgaacagatacttaacctcaaaccttttgaccgccgtcttctgcttgaagaagcttctggtttaataaagtaccgacaccgcatggaggaagctgaaaccaagctggcggttatcaaggaggatatggccagggtcgaaaagatgctgtctgatctcgaaggcaggctggaagtactggcagagaaggcctccaagagccggcgctaccgcgaacttgccggggaactccggaacctagagcaaaacttgctggcttccgcgatcgaacggttataccgcgagttgcaggattacttgggcgaacgcgataaggtaaaggcagagctggcaaaagcaaggactttgattcaggaaaaggagcaggaactggccttgctcaaggcgaagacaggcgaggtcaaagagaatttgtccttctacaacgaggagcgacaccggttgcagtccgagttgcagcgctgcgaggccgagcttagattgtcggccgagcgcctcatgaatgcccggcagagacgggaagatttagccggtgaggaagcaaactaccagggattgctggccaagctggaggaaaatataaggctgggcgaagacaagctggcaaaggaggaggcagagttaaaggctaaagtagagagcctgcgagaagtggagtcgagggtcgggcaactggaaaacgtgctggctgattataaccgcgattacgaggatttgcggaccgagttgatagaaaaactcaaggaggagactgaggataagaaccagctgactgtcttacaggagcggttgaaaaggctggaggaccggcttgaacggtgtcaggaggacctgaagcagaaagaagcccacgagaaagagcttgaacaggctgaaagccgaaccagggaaaaactaaatgaagcccgggcccggctggatcactggcagcgaaaaaaaaccgacaccgagaaggcacatgatcgggctttgactagtgcgaaagaaagagagcaggaccttgcccggttacaagctgaactttataaagcggaacaggaactcaacttatatttcgatgaagaaagggacggcaggacctatccggaggcagttcgagcggtcatgcgggcagccagggacaaacagtacggtttgaacgggatactaggggtggtaggggacttgattgaggttcctccgggtttggaggccgcggtagaaactgcccttgggcgcagcattcaagacatcgtggttaggtcagagaaggatgctcgtcgggccatcgagtttttgaaagaaaagaagctgggcagggcgacttttctgccgctggacttgttgagggttagtgacttgccgcgagataaaatccggagagcagagaaaatgccgggagtggtgggatgggggcatgagttggtcgattatccggcgggatttgaaaaggttgttaagtatctgctggggagggtggtagtagtagagaccctacaatcagcggtgaaggtttaccgtgaatcagggttaccggtaaagctggttactttggagggggaggtactgacgtacaccggtgctataaccgggggaacagtcagcaaccgatctgttcagcattttaggaggaagaactgggctaagcaacaggctctagtattggcggagaaacagaaagaatgcgagcttttgctggctcagctggagaacctgagaagcactgcagcggagctggagcgagggctccaggagattaggcagcaagaagaagaactgaaactggaagagaagatgttaatgctggaattggagaatgcttgtggggaacgggagaggttgatacaggccatcgacgacctgcggtatgagaataaaggctacagcgccgaaatcgattccctgcgggagtcgatgaaggatgtggaggcgcaataccaggctgcagcagaccaggctcgccgtttgtcagatagagtggaggaaataaaacaggggcatgaagaaatgttgcgcgagtacgaggttctgaaggaacgaaccaagtcttacagggagtttgtcgcaggcaaagagcatgaaattgaaagcttaaagcagaatctcgttcagctggagaagataaaagcctcgtacctacaggctctggataagtgtgctcaagaaaagaaagccttggccgtcgaaatggacaggcaagagtcactgcaactggagttaaaaacgcgatgcgacggctttcaagaaaaaatgggccaactgaggggagaaatggaaaccctggtccgggctataaccgggctggaggaggactcacgcgggatagaaaagaaactgacggaagagaggcagtgttgcagacagttggaagagcagtcccgggtagtggagctccgcatagcccgaagggaagcagatatggaaaaccagatcaaattgtgggtcgatagttatggtgaggaatacgtaccgggaagcgggattattctggacggcgagaaggagagggaggccaggcaaagaaaagaggttctaaccaagcagcttgcagaactggaaccggtagatcacggagcggaggcagaatacgaagagattcgggccaggtacgattttcttaacaaccagtaccaagacataaccgaggccaaaaacgccatttacgcgctgcttaaagaaacgagggcagttctttcctctcaattcgtggagttcttaaaaggtgtctcgcagagctttcaccacacctttctggcaatgttcggtggaggcagcgcctttctaaactccaacggggccatagaggatttggacagcggggtagaaatagcggtgaagatgccgggcaagcgcaaacagttgctggaactgttgtccgggggggagagggctcttacatgcatcgcttttgtgtttgccctgctggcacttcgacccagcccgttttgccttttggatgagatcgacgccgctttagacgacgtgaatttggcaaggtttgccgggttcttgaaaagattatcccaggatatccagttcattgttataactcaccgtcaggggaccatcgagatcgggcaggctttgtacggaataaccatgccggaagagggggtatcgcgagtgctttcggtgaccatggaagaggcagaggcgctcgccgggtaa

SEQ ID NO: 164 - DNA, 3666 bp, Tepidanaerobacter sp.
gtgaaatacagggaacttgtcagttttgatccggtagaatccgttataaaattggtagaagcagaccagcctcaggaggctatgaggctggttaaaacttatgtaatgtcagatagtatggcaaaaacattaaaagacatagttattccccagctgcagttcgaaaattcctttgataataagggtatatttatcgttggcaactatggtacgggtaaatctcatctaatgtcagtactatctgccgtagccgaagataaaaagatgcttgagctggtaaataaccaaatatttcaagaagcagctcaaagcattgccggcaaatttgaagtcttgaggtttgaaatcggcacttcaaagatggaccttcgagacttagttatagggcacctggagaaagatttggcaaaaagaggcatcgactaccgtttcccatccatggaggaagcctctaatactaaagattaccttttagagatgatggcactatttcaagaaaaatatcctgataaaggttatttgatagttgcggatgaatttctggattatcttcgaggccttaccgaacaaaaagtagtccttgcgcttaattttctccgcgaaatcggcgaaatatcgaagagctgtcggctacgtttcatagcaggggttcaagaatccctttttgacagcgggcagtttgcatttgttgccgactcacttagacgtgtaagggatagatatgaacaagtagtaatccggaagcaggacatatcttttgttgtatcagagcggatactgaaaaaagatgaacggcaaaaggcgtggatacgagaacacctgaccaagttttcccatctatattcaaatatggctgatagattggaagattatgtaaatctatatccaattcatccggcgtatatagaaatcttcgaaaaagtttacatagcagaaaaacgagaggttttaaagaccataacacatactatcaaaaaaatcttagacaaagatgttcctgaaaacgagaccggaatcatctcatatgactcatactgggagtatataaaggaaaatatttccgtgcgctcagaccccgaccttcgggaggtagtggaaaaaagcagtgtattagaagaccttatactaaaatcatatacaaggcctcagtaccgacctatagctctgcgaatcatccacgctctaagtgttcacagactaaccactggtgatattaatgcacccattggcataactgtcgataacatgaaggatgacctttgtatatatacacctatgcctgaagtagaggaaagttttttaaagactacggtagaaacagcggtccgggaaatcttaaagaccgttagcggccaatttatctcttataaccgagataacgagcagtactatctggatttaaagaaagatatagattatgatgcaaaaattcaagcaaaagccgatttcatggatgatgatatgctcaataaatactattatgacgcactgcttaaggtattgaactgggaaaggcctgaacataaaaccggccgaaggatatggcagtatgagattatttgggaggagaagaaggttgagcgatatggttatctgttctttggcgctcccaatgaacgcactactgctcaaccccctagagatttttacatatattttttacgcccatatggcaacaacgtctatcaaggtgaaattgagaaagatgaggtaatatttgaattcataaacagagatgaaaaagttgatgaatatataaagctgtatgctgcttctatggaacttgcgatggtatcctcagcagatagtaaacagacttattttaaaaaagccgaaggttatctaaaggcaattgttcagtggataaaagaacatgtcaaggagtgctttatagtaaagactgccggcgagcaacagactatacaatactggctaaaaggtaaagctgccgaagagcataccgtaaaggaatttgtggatatgactgcttctgcatgtctttcgacttattttaatgataaatatccttattacccaagattttatacacaagtaacacgcgagaatatgaaagaactttttaaagcaggattaaactatcttgccggaagaaaaaatgaactgggtgccaaagtgctagattctctggggcttttggaaggtgatatgattgcaccggaaaaatcaatttatgcgcgccgttacatcaagcttttagaaaatttgccggaaaaacatgtgctaaacagagaagatatcttagaatatttaagtgaagttacacttgataaagaatttcaattagaagatgtatgggtcacattgatactttgcgcattagtatatagtggtcatgctactttgaccatttctggacatacttttgatgctacaaaaatggaagaaatagctgccgccaatcctgcagatttgattttattcaaatactgtcaggtgccggaaggtgtccctgtaaaaatattaaaaaaacttttcgaagggttggggctgccgcctggtcaaataaccaatcccaacacgcgagaagctgccatagaaaaaatgcttgttcgagcagaggaattgaccaaaagggtaatcgaaacacagcaatttctcataggtgatttggcactttgggataaacctgcaatagatgaagatacaaaagaaaactataaggaaagcttaaaaacgctaaaggatttccttgatgccataaaacaatataacacccccgcaaagttaaagaacttcaggttttcagaagacgaggtagcaagttccttagctaacattgaaataatgcaagaaatcttgaatataagggattttaaactaaaggttgatccttatgtatcctatcttacacgtacatgtatgatacttaaagatgataagtggaatcaaaaagtccaaaaggtccgaggtgaagcactagacaaggtacaaaagccgcaggaactgacagatacgtatatcaaagaatatgtaggtaaacttcaagcactgaagaaagaatatatttctatttatatcaagcttcataaaaaatatcgcctggatttaaacggcgataagcaaaaacaaaagcttttagaaagtagattaaaacataatctggatatgcttacttgtgttggtgatttaatttatccaaaaccctatgaaaaaatgtgcaatagacttttgaaattgaaaacatgttttagcttaattgaagatgatattaatatgagtccattatgcccccactgcggatatacacctgatgaagatgagcagccggtatttggagtggtggaagccattgagaaatctatggaagagctatttttccaatgggaaaagatagtccttgagattttagaagatgaaaaagtaaaggagaacattgctttactagataagcctcaacggcaagctttagagagtattacccaaaatcagcggcttcctgataaaatcgattcacagcttgtttcaacgattaatatactaatgaagggtcttgataaggtagagattaccactgaagatttggtaagggcaatatttaaaggcggaccggttactgtatctgatatgaaacagcgcttgaacgattatattgatgagatggtaaagggaatggatgtcgatcgtgtgcggataatgctgaaataa

SEQ ID NO: 165 - DNA, 3819 bp, Thermanaerovibrio acidaminovorans
atgagatatggagacctgatccaattcgagcccatcgagtccgtagtccagctacgggatgccgatgaggccgcaagcgccagacagctggtcagcacctatgtcatctccgacgagatggccgagaagctgaccggccttgtgatcccccagcttcagttcgaccagcccgtcgataacaaggggctgcttgtcgtgggcaactacggcaccggtaagtcacacctgatgtcggtgatctccagcatcgccgagcacgcggacctgctttccgccctgggaaacgcacaggtggcacaagccgcggagcggatcgccggcaagttcaaggtggtccgcaccgagatcggggccaccaccatgtcgctgcgggacatcctcgtcggcgagctggaagagcacctggccgtcatgggcgtgacctacaccttcccggatgccggccaggtccccaacaacaagcgggccttcgaggagatgatggccgcgttccaccgggagtatccggaccatggcctgctcctggtcgtggatgagctgctggactatctccgtactcgcaaggaccaggagctgatcctcgacctcaacttcctccgtgaggtgggtgaggtctgcaaggacctgcgcttccgcttcatggcgggtgtgcaggaggccatcttcgacagcccccgtttcgccttcgtggccgacagcatccgccgggtcaaggaccgcttcgaacagatccttatcgcccgcagggacgtgaagttcgtcgtcgccgagcgcctgctcaagaagaccggtgagcagcaggccaagatccgcgaatacctcacgccgttcgccaagttctacggccacatgaacgagcggatggacgagttcgtccgcctcttcccggtccatcccgactacatcgacactttcgagcgcgtcacggcggtggagaagcgcgaggtgctcaagaccctgtcgctggccatgaagaagctgctcgaccaggaggtgccggaggatcggcccggtctcatcgcctacgacagctattggacgaacctgcgcgagaatccctccttccgcgccgtcccggatatcaaggcggtgatcgattgcagccaggtgctggagtcccggatcgagcaggccttcacccggccggtgtacaagcccatggcaattcgcattattcacgcgctctcggtccaccggctgacgaccggagacatctacgcgcccttgggcgccacggccgaggagctacgcgacgcgctctgtctctaccagcccggcatcgaggacttgggcggagacccggccgacgacctcctttcccaagtggaaacggtcctgcgcgagatccacaagacggtcagcggccagttcatctcctccaatccggacaaccggcagtattacctcgatctcaagaagaccgacgacttcgacgcgctcatcgagaagcgcgccgagagcctcgatgcctcccagctcgaccgctactactacgaggctttgaaaagggtcatggagtgcaccgaccagacctacgtcaccggctacaagatctggcagcacgagctggaatggctggagcacaaggcggcaagacaaggatatctcttcttcggcgctcccaacgagcgctcgaccgccgtgccgccccgtgatttctacctctactttatccagccgttcgatccgccgcacttcaaggacgagaagaaggccgatgaagtgttccttcgcctgaccaacacggacgaagagtttcggaccgcgctgacgaactacgccgcggcgctggacctcgcgtccacctcgagcggccacgccaaggccacctacgagtccaaggccaccggattcctgcgggacctggtgggctggctgcaggagcacatgaccgacgcgttcgaggtgacctaccagggacgcaccaagtcgctggtggaatgggccaagggcaagtccatccgcgagctgtccgggatcgcttcccacgagcggatcaacttccgcgacctggtgaacaccatcgccggcatcgtcctgtccgcacactttcaggaccaggcgcccgagtatccctacttctcggtgctcatcacgggccagaaccgcgagcaggcggcacaggacgccctgcgcgccatcgccggacagaatcgcaccaagcaggcaaccgccgtgctcgacgccctggagctcctcgacggagagcggctcgacccgtaccgctccaagtacgcgaagcacgtcctgaacatcctcaagaagaaggggcacggccaggtagtcaaccgctcggagctgatccaggaggtctacggcgtcgagtacttcgcgccggacaagggctaccgcctggagcccgaatgggctgtcgtggtcctggccgcgctggtctactccggtgacctggtgctttcgattcccggcaagaagttcgacgccgccgggctgccgcagctggccgcgacacctatcgacgagctggtccacttcaagcacatcgagcggcccaaagactggaacctcccggcgctcaaggcgcttttcgaactgctcggactcacgccgggtatggcgcaactggttacccatggcaaggacgagccggttcaggaactgcaagcgaaagtctccaagtatgtcgaggaaattgttcgcacgcagcaggcattgaaagacggcctgcatttctggggacagagactctattccgactcggaactcgcaacccgcaactcgcaactggaaacgacaaagtcgtttctggaatccctgcaggcctacaccacgaccggcaagctcaaaaactttcgctatgacgcctcggaagtgaccgctcagcggagtgggctcgaatcccttgccgaaatcaagtcgctcgaagaactggtggcggacctcgggtccacagcttcatacctctcgacggctgaggcggtcctgcccaccggccacgagtggatcgacaaaatgagcgccgttcggactgaagtcctcacggcggtcatgagtcatgggtttcgggtctcgggtcaaaaggacgcgggactcagtactcgcgacccgcgacccgaattgcagcgcaagctcaccgacctcaagaagtcctacgtgcaagcctatctcgccatgcacacccgggcccgactgggcgtgaacgaggacaagcgcaagagcgcgctgatgggagacgagcggctcaagaccctctcgaggctctccaccatcgacctgatgccgcgccagcacctgaccgatttccagaaccgtctggccggcctgaagagctgcttcgcgctcaccgagcaggacctcgacgcatcaccggtctgcccgcactgcggctttcggcctgcggccgaagcggtcgcgggtcacgtgtcaggtgtcgcgggtcaggactcgcgactcgggactcgcgactcgagactgatcaacgccgccgcggtgcttcaacagctcgatgaacaattggacaagatgctggctgaatggactgcggcgttgatcaccaacctggaggacccgaccacccgcggcaacctcgacctgctcaagcccgagcccaggaagctggtggacgccttcctcaaggaacggaagctgcccgaggagctgggccaggatttcattcacgccctcaaggaggtgctctccgggctggtcaaggtcgcgattagacctgaggatctgcgcgcagcccttctcaaaggcggctcaccggcgacgccggcggagatgaagaaacgctttgaggaatacctcgatgaactcaccaagggcaacgagcccggcaaggtccgaatcgtactggaatag

SEQ ID NO: 166 - DNA, 3684 bp, Thermoanaerobacter brockii
atgaggtatggtgagcttattcagtatgaaccgattgaaactgttataaaacttaaggatgcagacaagatcgatgaggcaaaaagacttgtcaaatcctttgtagtatcagaagggatggcagatagtattattaatatttgtataccccaattacagtttgatgaaacaattgacaataagggtatatttatagttggcaattatggcactggtaaatcccatttaatgtctgtaatttcagcagtagcagaaaataaggaaatgttagattatatttcacatgaagagctaaaaaaagagatgggaaagattgcagggaaatttaaagttttaagatttgatattggggctgtaaatacacctttaagaaatataattacgaaagagatagaaaaagaccttgccagatatgggatagagttttattttccaccgattgataaggttacaaataacaaagaagcttttatggaaatgatgagtaaatttgaagacaaatttccggacaaaggctatctcatagtggttgatgaattgttagattttctaaaagcaaggaaagaacaggaattgattcgcgatttaacttttttaagagaaataggagaaataacaaagtctacaagattgagatttatgacgggagtacaggagaccctgtttgataatccggcatttaatgctgttgcacaaactgtattaaagatgaaggacagatttgaacagttaataattaaaagggaagatatttcctacgtagtatctcaaagattattaaaaaagaatgacagacaaaaagcatggataaggagccatttagagaaattcagtccgttgtataaaagtatttccagcagaatcgaagaatttgtggaattatatcctatacatcctatgtttatagaagtatttgaaaaaatgtttattgtagagaaaagagaagttttaaaaacaatatcacatcttatgagagaactgttagacaaagatgtacctgaagatgagcctggaattatttcttatgattcttattggaagtttttaagagacaatccttcattaagggcagagccagatataaagagagtagttgataaaagcgttgttgtagaagatttaattgaacattcctttacaagacctcaatataaagatgctgcattaagaattgtacatgcattaagtgttcataggtttactacaggagatatacatacatctgttggtataacagttgaaaatattaaagatgatttgtgtttatatataaaaatgccagagatagaagaggactttttaataacgactatagaaacaataatgaaggaaataatgaaaacattgagctggcaatatatttcatacaatccagacaatcagcagtattatcttgacatggtaagagaaggtataaattatgatgcaaaaatccaggaaaaggcagaattattatcagatgatacttttaacagatactattttgatttgcttataaaggttcttgattggaatgctactttaaaacaaaaaaatatgagaatatgggaatacagtcttatttggaatgagaaaaatgttaaaagatatggctatcttttcatgggatatcccgatgaaaggagtacagctcagcctccaagagatttttatatttactttttgcctccttttgttgaagctaattataataaaaaatatattttaaatggaaaagaagatgaagtgttttttgaatttattaatgcagatgaagaaataatagagaaaattaaaaaatacgctgccgctatggaattaagtgaattatcctccagtgaccagaaaaaaatttatgaagataaagctaatggttttcaaaaggatattactaaatggataagagataatgtgtcaaaatgttttaatgtttcttataaaggagaaacacaaagtataatctattggcttaaaggaaaaacagctaattatgatactattaaaagttatattgatgaggcggcttcttcttgcttatcattgtatttcagtgaaaaatacagtgaatatcctacattttacacaaaaatcacagaggcaaatttaaacgaagtttttaaaagtgcaatgaattatttagctggcaagaagacagaaacaggcaagaaagtattgcagtcttttgatttaattttaggggatgatattgtacccgaaaattcaaaatatgctaattattttttaaatgaattatataaacttccaccagggaaagttttaaatagagaagatattatagagaatgtaaacggtgaggatattgataaaagattcaaattagaagtgcagtgggtggtccttttgctctgtgcacttgtgtacagcggagatataatcttgaggataaaaaataaagtttatgatgcaactacaattgattctcttgctaatatgaatgtcggggagcttgtagattttgatagttttgagaggcccagagatatacctgtcagagaattaaaaactctatttactttgttaggcttgccatcagggttagtaaatgcaagtcttagcaaaccagaagaagctataaggcaaatggtttcaaggagtgaagaactggctaaaaaagttgtaactgttaatcaatttgttgtttcaaataaaactatatggagcaaacctgtatttgatgagtttgaaataaaaaattataaagatttgctcaataattttagagattttcttgacagtttaaaagcctttaatacccctgggaaattaagaaactttaagtatgctgaagaggagttaaaggaaaaattcaagacactggagacagtaaagaagatagaaaaaataattgattttaaaaatgaagtagaagagcttgtcaaatacttgtcctctgccgaacagcaattacccgaagaaattgaattaaagcagaatataaatgcaatgaaaaatgaagtagaaagatttacaaaggaaattgataataaagaaagtgaagatataaaaaggctgacaagggaattagaagaattgaaaatagagtacattgatttgtaccttgagtatcataagaaacacaggcttgattataatggagatgagcgtaaaaagaaaataatggcaagtgatctgtttaataatcttaagaagcttaaagatgtaggaatatttcctgttaacaaatttgatgagattgaaaaggtattggcttcattaaaaacctgttataattttggaaaagaaaatataaaaacagaagtgctatgtcctaattgtggatacagtataaaaagtggcgaagttcctgtgtttggaaaattggatgaaattgaagacaaaatagaaaatttgtataaggaatggactaaaattttattagataatattgaagatccaatgattcaagaaagaatggaaattttgaataaagaccaacaaaaagttatacgtgactttttgaataaaaaagaattgccggagaaagtggataatctgtttgtatcagcagtaaaagacttaattgctggtcttgaaaaagtagagattgaaataaatgagtttatttctgcgataacctatgatggacctgtaacagtagatgagtttaaaaagagatttttagaaaatgtcgattttcttataaaaggcaaagataaggacaaagtaagaattattataaaataa

SEQ ID NO: 167 - DNA, 3684 bp, Thermoanaerobacter italicus
atgaaatatggagatcttattcagtatgaaccgattgaaactgttataaaacttaaggatgcagacaagatcgatgaggcaaaaaggcttgtaaagtcctatgtagtatcagaggggatggcagatagtattattaatatttgtataccccaattacagtttgatgaaacacttgacaataagggtatatttatagttggcaattatggtactggtaaatcccatttaatgtctgtaatttcagcagtagcagaaaataaggaaatgctagattatgtttctcatgaagagttaaaaaaagagatgggaaagattgcaggaaaatttaaagttttaagatttgacatcggggctgtaaatacacccttaagaaatataattacgaaagagatagaaaaggaccttgccagatacgggatagagttttattttccaccaattgatgaagttacaaataacaaagatgcttttatggaaatgatgagtaaatttgaagacaaatttccggacaaaggctatctcatagtggttgacgaattattagattttctaaaagcaaggaaagaacaggaattgattcgcgatttaacttttttaagagaaataggagaaataacaaagtctacaagattgagatttatgacgggagtacaggagaccctgtttgataatccggcatttaatgctgttgcacaaactgtattaaagatgaaggacagatttgaacagttaataattaaaagagaagatatttcctacgtagtatctcaaagattgttaaaaaagaatgacagacaaaaagcatggataaggagccatttagagaaattcagcccgttgtataaaagtatttccagcagaatcgaagaatttgtggaattatatcctatacatcctatgtttatagaagtatttgaaaaaatgtttattgtagagaaaagagaagttttaaaaacaatatcacatcttatgagagaactgttagacaaagatgtacctgaagatgagcctggaattatttcttatgattcttattggaagtttttaagagacaatccttcattaagggcagagccagatataaagagagtagttgataaaagcattgttgtagaagatttaattgaacattcctttacaagacctcaatataaacacgctgcattaagaattgtacatgcattaagtgttcataggtttactacaggagatatacatacatctgttggtataacagttgaaaatattaaagatgatttgtgtttatatataaaaatgccagagatagaagaggactttttaataacgactatagaaacaataataaaggaaataatgaaaacattgagctggcaatatatttcatacaatccagacaatcagcagtattatcttgacatggtaagagaaggcataaattatgatgcaaaaattcaggaaaaggcagaactattgtcagaagatatttttaacaggcattattttgaattgcttataaaagttcttgattggaatgctcctgaaaaagtaccaaacatgagaatatgggagtatagtcttacttggaatgagaaaaatgttaaaagatatggctatctttttatgggatatcctgatgaaaggagtacagctcagcctccaagagatttttatgtttactttttgcctccttttgttgaagctaattataataaaaaatatattttaaatggaaaagaagatgaagtgttttttgaatttattaatgcagatgaagaaataatagagaaaattaaaaaatacgctgccgctatggaattaagtgaattatcctccagtgatcagaaaaaaatttatgaagataaagctaagggttttcaaagggatattactaaatggataagagataatgtgtcaaaatgttttaatgtttcttataaaggagaaacacaaagtatgatttattggcttaaaggaaaaacagctaattatgatactattaaaagctatattgatgaggcggcttcttcttgcttatcattgtatttcagtgaaaaatacagtgaatatcctacattttacacaaaaatcacagaggcaaatttaagcgaagtttttaaaagtgcaatgaattatttagctggcaagaagacagaaacaggcaagaaagtattgcagtcttttgatttaattttaggggatgatattgtacccggaaattcaaaatatgctaattattttttaaatgaattatataaacttccaccagggaaagttttaaatagagaagatattatagagaatgtaaacggtgaggatattgataaaagattcaaattagaagtgcagtgggtggtccttttgctcagtgcacttgtgtacagcggagatataattttgagaataaaaaataaagtttatgatgctactacaatagaggcgcttgctaatatgaacgttggagagcttatagaatttgatagttttgaaaggccaagagacatacctgtcagagaattaaaaaccctgtttactttattaggtttaccatcagggttagtaacagcaagtcttagcaaaccagaagaagctataagacaaatggttgcaaagagtgaagaactggctaaaaaagttgtaactgttaatcaatttgttgtttcaaataaaactatatgggggaagcctatatttgatgaatttgaagtaagagattataagaatttgctcaatagttttagcgattttcttgatagtttaaaagcctttaatacccctgggaaattaagaaactttaagtatactgaagaggagttaaaggaaaaattcaacatattggagacagtaaagaaaatagaaaaaataattgattttaaaaatgaagtagaagagcttgtcaaatatttggcttctgccgaacagcaattacccgaagaaattgaattaaagcagaatataaatgaaatgaaaaatgaagtagaaagatttataaaggaaattgatactaaagaaagtgaagatataaaaaggctgacgagagaattagaagaattgaaaatagagtatataaagttatacatggaatatcataagaaacacaggcttgattataatggagatgagcgtaaaaagaaaataatggcaagtgatccgtttaataatcttaagaagcttaaagatgtaggaatatttcctgttaacaaatttgatgagattgaaaaggtattggcttcattaaaaacctgttataattttggaaaagaaaatataaaaacagaagtgctatgtcctaattgtggatacagtataaaaagcgacgaagttcctgtatttgggaaattggatgaaattgaagataaaatagaaaatttgtataaggaatggactaaaattttattagataatattgaggatccaatgattcaagaaagaatagagattttgaataaagaccaacaaaaagctatacgtgactttttgaataaaaaagaattgcctgacaaagtggataatctgtttgtatcatcagtaaaagacttaattgctggtcttgaaaaagtagagattgaaataaatgagtttatttctgcgataacctatgatggacctgtaacagtagatgagtttaaaaagagatttttagaaaatgtcgattttcttataaaaggcaaagataaggacaaagtaagaattattataaaataa

SEQ ID NO: 168 - DNA, 3684 bp, Thermoanaerobacter pseudethanolicus; identical to SEQ ID NO: 166

SEQ ID NO: 169 - DNA, 3684 bp, Thermoanaerobacterium saccharolyticum
gtgagatacggtgatcttgtacattacgatccaattgagacaataattaatttgaaagatgctgatgatgaagaaaaagcggctgcccttgttaaatcatatgtgatgtctgataatatggcagaaaatattattaatatatgtatttcacagttgcaatttgatgaaacaattgacaataaggggctttttatcgttggtaattatggcacgggtaagtcccacttaatgtctgttatatcatcaattgccgaaaatgaaaaattactaaaatttgtaacaaatgataagtttaaagatggcatgaggaggatagctggaaaatttaaagttttaagatttgatattggctctacagacatgccattgagggatatagttttgtctaaagttgaagaaaatattcatcagctgggaattgagtacaattttccgcccatgaataaagtagcaaataacaaagactcgttcatggaaatgatggctctatttgaagagaagtatccaggcaaaggctaccttattgtagttgatgagctttttgacttcttaaaaacaagaaaagaacaagagcttattaaagacttagcctttttaagggaaattggagaaataagcaaatcaacgaaaattagatttatgtctggcgtgcaggaatcattgtttgacaatcccggctttcaatttgtagcaaggacgatattaaaagtaaaagataggtttgagcaaataattataaaaagagaagatatatcatatgtcgtgtcagagagaattttaaaaaaggatgaaaaacaaaaggcatatatcagaagccatcttggaaaattttcaagtctatataaaaatatggctgaaagaatgaatgagtttgtagacttgtttcctattcatccagcttttatagaagtatttgaaaaaatttatatagctgaaaaaagagaagttttaaagacgatcacgaatcttataaaaaatataattgatgaagaagtagcagaggatatgccgggaatcatatcttatgatgcgtattgggattttattaaagacaatatgtctatgaggacgaatccagatataaaagatgttatcgataaaagcagtataatagaaggagcaattttgcgctcttttccaaggccacaatacaaagatagtgcaataaagattataaacgcattaagtgtatataggttggctacaggcgacatacgaacgccaattggaataacagttgataacataaaagatgatttatgcttatttataaggatcccagaatttgaagaagatttcttaaggacaacaatagagacaataatgaaagacataatacgaactgtaaatggccagtttatatcctacaatcaagataatcagcagtattacattgatatggtgcgagttggaatagactatgatgttatcatacaagaaaaggccgaaaaactagacgatgatactttaaatcgctattactttgaaatattgctaaaggttcttgattggaacgtgaaagaatatgtgccaaattttaaaatctgggaatacagcttaaaatggcttgataaaaatattgagagagatgggtatctctttatggggtctccagatgagagatcaacagcacaaccaccgagagatttttacatatactttttaaatccatattcaatagataataggaaatatattgaaaatgggaaaaaagatgaagtgttttttgaatttactaattacgatgaaaagctggaaagtttgttaaagtcttattctgcatcaatgattttatatgatagttcagcaaatgacggcaaggctatttatagcagcaaagctgatggctttatgaaagaaatagttaaatggataaagacaaatataggaaattgttttagtgtttcacataatggagttacaaagagaattttggacatggcaaggggtacaaaaagagaagacgagacgataaaagattacatagattttgttgcttcatcttgtttgtcattttactttgctgataaatatccagattatccaaagtttaaagttattataacgagagataatagagaagctatgtttaaatatgggcttaattacattgcggggcaaaagtctgagcatggagcaaaaatacttcagacatttgacttaatcgacaatgatggaaatataacagttgaaaattcaagatatgtaaaatattttcaggatatagtgaatagcttgcctgaaggcaaagtcttaaaccacgatgatatttttgttttggaaaatgaagttgaaattgatagaaagtttagattagacggagaatgggtagctctcatactttgcactttagtgtataatggagaaattgcaattactgtaaacaataagaaatacgatgctactatgctatctgatttagtaaagttagctccaaatgatattgtcaacttttctttttgcgatagaccaaaggggattccgattaatacattaaaaagacttatggagattattgggctgccaacaggaactatttcaaatccagaaaagcaggtagaagcaattaaagaaatgaataaaaaatttgatgaattaattaatgaagcgcattctgtaattcagtatgttacaagcggtaagacgatttgggataagctgttatttaatgatgctgagaaaaagtcatacaaagatgaattgaacggttttatatcatttttaaatactcttaagaggtttaatacgccagggaaattgagaaattttaggtattctaaagaagacattgagagagaatttgctgcattgaagttgataaatagaattcaaaaaataatgaattttgttaatagcattgatgcttacgtagtatacatatctaaagcttgtttggtgttggtagataataatgattggattaaaaaagtggaagatgttaagcaaaaaatagaagatacgattaaaaatatcgataatgtagatctgaatgcggctaaaaacgacgtaattaatgagctgataaatattaaaaaagagtatatcgatatatactttgatgagcatagaaaacacagactagactacaaaggagacgagcataaaaagaaaatactaaatagcagcaagctttataatctcagaaagctaaaatcaattgatatacttagtggttcagaattgactgcaatagaagaagagcttggtaaaatcaattcatgctttagtttgacaccacaagatttagaaacagaagtccaatgtaaatactgcaagtataggtatggcgacaaaaatgagttattggtatacggaaagttggatgagatagaaaataaaattgatgagatttataaaaactgggaagaagaattacttaaaaatattgaagatcctttaataaaagataatataaattatttaaatgatgatcaacagaagtgtattaatgagtttattgcaagaagatcgctcccagaaaaaatagacaatttatttttatcgtctataaaagaccttttaaaaggacttgataaagtagaaatagattctaaagagtttattgctaacataacaggcaatggtcctgtgacattggacgattttaaaaataactttatgaaatttatagaaaataaggtgaatggcaaagaaaaagataaagtaagaatcataataaaatga

SEQ ID NO: 170 - DNA, 3684 bp, Thermoanaerobacterium thermosaccharolyticum
gtgagatacggtgatcttgtacattacgatccaattgagacgataattaatttgaaagatgctgatgatgaagaaaaagcggctgctcttgttaaatcatatgtgatgtctgataatatggcagaaaatattgttaatatatgtatttcacagttgcaatttgatgaaacaattgataataaggggctttttatcgttggcaattatggcacaggtaagtcccacttaatgtctgtcatatcatcaattgctgaaaatgaaaaattactaaaatttgtaacaaatgataagtttaaagatggcatgaagaggatagctggaaaatttaaagttttaaggtttgatattggcgctacggacatgccattgagggatataattttgtctaaagttgaagaaaatattcatcagctgggaatagagtacaattttccgtccatggataaagtggcaaataacaaagactcgcttatggagatgatggctctatttgaagagaagtacccaggcaagggctaccttattgtagttgatgagctttttgacttcttaaaaacaagaaaagaacaagagcttattaaagacttagccttcttaagggaaattggagaaataagcaaatcaacgaagattagatttatgtctggcgtgcaagaatcattgtttgacaatcccggctttcaatttgtggcaaggacgatattaaaagtaaaagatagatttgaacaaataatcataaaaagagaagatatatcctatgttgtatcagagagaattttaaagaaagatgataatcaaaaggcatatatcagaagccatcttgaaaaattttcaagtctatataaaaatatggccgaaagaatgaatgaatttgtagacttgtttcctattcatccagcttttatagaagtatttgaaaaaatttatatagctgaaaaaagagaagttttaaagacgatcacgaatcttataaaaaatataattgatgaagaagtagcagaggatatgccgggaatcatatcttatgatgcgtattgggattttattaaagacaatatgtctatgaggacgaatccagatataaaagatgttatcgataaaagcagcataatagaaggagcaattttgcgctcttttccaaggccacaatacaaagatagtgcaataaagattataaacgcattaagtgtatataggttggctacaggcgacatacgaacgccaattggaataacagttgataacataaaagatgatttatgcttatttataaggatcccagaatttgaagaagatttcttaaggacaacaatagagacaataatgaaagacataatacgaactgtaaatggccagtttatatcctacaatcaagataatcagcagtattacattgatatggtgcgagttggaatagactatgatgttatcatacaagaaaaggctgagaaactagacgatgatactttaaatcgctattactttgaaatattgctaaaggttcttgattggaatgtgaaagaatatgtgccaaattttaaaatctgggaatacagcttaaaatggcttgataaaaatattgagagagatgggtatctctttatggggtctccagatgagagatcaacagcacaaccaccgagagatttttacatatactttttaaatccatattcaaaagataataggaaatatattaaaaatggaaaaaaagatgaagtgttttttgaatttactaattacgatgaagaactggaaagtttgttaaagtcttattctgcatcaatgattttatatgatagttcatcaaatgacggcaaggctatttatagcaacaaagctgatggctttatgaagaaaatagttaaatggataaagacaaatataggaaattgttttagcgtttcacataatggagttacaaagagaattttagacatagcaaggggtacaaaaagagaagatgagacgataaaagattacatagattttgttgcttcatcttgtttgtcactgtactttgctgataaatatccagattatccgaagtttaaagttactataactagagataatagagaagctatgtttaaatatgggcttaattacattgctggacaaaagtctgagcatggagcaaaaatacttcagacatttgacttgatcgacaatgatgggaatataacagttgaaaattcaaaatatgcaaaatattttcaggatatggtcaatagcttgcctgaaggcaaagtattaaaccaagacgatattttcgttttggaaaatgaagttgaaattgataaagagtttagattagacggagaatgggtagctctcatactttgcactttagtgtataatggagaaattgcaatcactgtaaacaataagaaatacgatgctactatgctatctgatttagcaaagttagctccaaatgatattgtcaacttttctttttgcgatagaccaaaggggattccgattaatacattaaaaagacttatggagattatcgggctgccaacaggaactatttcaaatccagaaaagcaggtagaagcaataaaagagatgaataaaaaatttgatgaattaattagtgaagcgtattcgacaattcaatacgttactagtggtaagacaatttgggataagctgctatttaatgatgctgagaaaaagtcatacaaagatgaattgaacggttttatatcatttttaaatactctcaagaggtttaatacgccaggaaaattgaggaattttaggtattctaaagaagagattgagagagaatttgctgcattgaagatgataaatagaattcaaaaaataatgaattttgtaaatagcattgatgcttacgcagtatacatatctaaagcttgtttggtgttaacagataataatgattggattaaaaaagtggaagatgttaagcaaaaaatagaagatacgattaaaaacatcgataatgtagatctgaatgcggctaaaaacgatgtaattaatgagctgataaatattaaaaaagagtatatcgatatatactttgatgagcatagaaaacataggctggactacaaaggagacgagcataaaaagaaaatattaaacagtagcaagttttctaatttaagaagactaaaatcaattgatatacttaccggttcagaattgactgcaatagaagaagagcttggcaaaatcaatacatgctttagtttgacacaacaagatttagaaacagaagtccaatgtacacattgcaagtatagatatggcgataaaaatgagttattggtatatggaaagttggatgagatagaaaataaaattgatgagctttacaaaaaatgggaaaagacattgcttgaaaatattgaagatcatttaataaaggataatataaattatttaaatgatgatcaacagaagtgcattaatgagtttattgcaagaagatcgctcccggaaaatatagacaatttatttttatcgtctataaaagaccttttaaaaggacttgataaagtagaaatagattctaaagagtttattgctaacataacaggtaatggtcctgtcacattggacgattttaaaaacaactttatgaaatttatagaaaataaggtacaaggcaaagaaaaagataaagtaagaatcataataaaatga

SEQ ID NO: 171 - DNA, 3684 bp, Thermoanaerobacterium xylanolyticum
gtgagatacggtgatcttgtatattacgatccaattgagacgataattaatttgaaagatgctgatgatgaagaaaaagcggcttctcttgttaaatcatatgtgatgtctgataatatggcagaaaatattgttaatatatgtattttacagctgcaatttgatgaaacaattgacaataaggggctttttatcgttggtaattatggcacaggtaagtcccacttaatgtctgtcatatcatcaattgccgaaaatgaaaaattgctaaaatttgtaacaaatgacaagtttaaagatggcatgaagaggatagctggaaaatttaaagttttaaggtttgatattggttctacagacatgccattgagggatatagttttgtctaaagttgaagaaaatattcatcagctgggaattgagtacaattttccgcccatgaataaagtggcaaataacaaagactcgttcatggaaatgatggctctatttgaagagaagtatccaggcaaaggctaccttattgtagttgatgagctttttgacttcttaaaaacaagaaaagaacaagagcttattaaagatttagcctttttaagggaaattggagaaataagcaaatcaacaaagattagatttatgtctggcgtgcaagaatcattgtttgacaatcctggctttcaatttgtggcaaggacgatattaaaagtaaaagatagatttgaacaaataatcataaaaagagaagatatatcctatgtcgtgtcagagagaattttaaaaaaagatgaaaagcaaaaagcatacatcagaagccatcttgaaaaattttcaagtctatataaaaatatggcagagagaatgaatgaatttgtagacttgtttcctatacatccagcttttattgaagtatttgaaaaaatttatatagctgaaaaaagagaagttttaaagaccatcacgaatcttataaaaaatataattgatgaagaagtaccagaggatatgcctggaatcatatcttatgatgagtattgggattttataaaagacaatatgtctatgaggacgaatccagatataaaagatgttatcgataaaagcaatgtaatagaaggagcaattttgcgctcttttccaaggccacaatacaaagatagtgcaataaagattataaacgcattaagtgtatataggttggctacaggtgacatacgaacaccaattggaataacagttgataacataaaagatgatttatgcttatttataaggatcccagagtttgaagaagatttcttaaggacaacaatagagaccataatgaaagacataatacgaactgtcaatggtcagtttatatcctacaatcaagataatcagcagtattacattgatatggttcgagtcggtatagactatgatgttatcatacaagagaaagctgaaaaactagacgatgacactttaaatcgctattactttggaatattgataaaggttcttgattggaatgcgaaagaatatagggcaaattttaaaatttgggaatacagcttaaaatggcttgataaaaatattgagagagatgggtatctctttatggggtctccagatgagagatcaacagcacaaccaccgagagatttttacatatactttttaaatctatattcaaaaaataatagaaagtacattgaaaatgggaaaaaagatgaggtgttttttgaatttactaattacgatgaaaagctggaaagcttgttaaagtcttattctgcatcgatgattttatacgatagttcagcaaatgatggcaaggctatttatgacaacaaagctgatggctttatgaaggaaatagttaaatggataaagacaaatgttggaaattgctttagcgtttcatataatggagttacaaagagaattttagacattgcaaagggcacaaaaagagaagacgagacgataaaagattacatagattttgttgcttcatcttgtttgtcactgtactttgctgataaatatccagattatccgaagtttaaagttactataactagagataatagagaagcaatgtttaaatacgggcttaattacattgcagggcaaaagtctgagcatggagcaaaaatacttcagacatttgatttaatcgacaatgatggaaatataacagttgaaaattcaagatatgctaagtattttcaggatatggtgaatagcttgcctgaaggcaaagtattaaaccacgacgatattttcgtcttggaaaatgaagttgaagtcgataaagagtttagattggacggagaatgggtagctctcatactttgtactttagtgtataatggagaaattgcaattactataaacaataagaaatacgatgctactatgctatctgatttggcgaagttagctccaaatgatattgtcaacttttctttttgtgatagaccaaaggggattccgattaatactttaaaaagacttatggagattatcggtttgccgacaggaactatttcaaatccggaaaagcaggtagaagcaataaaagagatgaataaaaaatttgatgaattaattagtgaagctcattcaacaattcagtacgttactagcggtaagacgatttgggataagctgctatttaatgatgctgagaaaaagtcatacaaagatgaattgaacggttttatatcatttttaaatactcttaagaggtttaatacgccaggaaaattgaggaattttaggtattctaaagaagagattgagagagaatttgctgcgttgaagatgataaatagaattcaaaaaatattgaattttgttaatagcattgatgcttacgtagtatacatatctaaagcttgtttggtattaacagataataatgattggattaaaaaagtggaagatgttaagcaaaaaatagaagatacgattaaaaatatcgataatgttgatctgaatgcggctaaaaacgatgtaattaatgagctgataaacattaaaaaagagtatatcgatatatactttgaagagcatagaaagcacaggctggactacaaaggagatgagcataaaaagaaaatattaaacagcagcaagctttataacttaagaaagctaaaatcaattgatatacttagtggttcagaattgactgcaatagaagaagagcttggcaaaatccattcatgctttagtttgacacaacaagatttagaaacagaagtccagtgcatacattgcaagtataggtacggtgataaaaatgagttattggtatatggaaagttggatgagatagaaaataaaattgatgagatttataaaaaatgggaagaaaaattgcttgaaaatattgaagatccttttgtaaaaattaatatagggtatttaaatgatgatcaacagaagtgtattaatgagtttattgtaagaagatcgttcccggaaaatatagacaatttatttctatcgtctataaaagaccttttaaaaggacttgataaagtagaaatagattctaaagagtttattacttttataacaggcaatggtcatgtcacattggacgattttaaaaacaactttatgaaatttatagaaaacaaggtacaaggcaaagaaaaagataaagtaagaattataataaaatga

SEQ ID NO: 172 - DNA, 3684 bp, Burkholderia thailandensis
gtgccaaaactacgcgagatatttgacctgccagagcaggttcaccagggcgactttgttctccgcctaacggatggcttgagtgcccctgcggaaaccgtgcgcgactatatcgccacgccccagttggtgaagtgcttcgaccaggcgcttggggtagtcaagggcgcgatcgatagccgaatgagcaagggcgcgtacctgcacggcagcttcggttccggtaagagccacttcatggccatcttgtcactggtgttgcgcggcgacgccgcggcccgtggtaagcccgagttggccccggttgtgtccaagcacaacggctggacgcagggcaaaaagttcttggtagtgccattccacatgatcaatgccgagacgttggagtcagcgctcttctcgggctatgcggagctcaccgctcgtttgcacccggacgcgccaagccctggtttctatcagagcgaaggcatgctcaacgatgcgcagaagttgcgcacccagatgggtgacgaggtcttctttcgcactctgaatggcgcagccggcgcggcctctggcggcggctgggggcgcgtcacgcagacctgggccgccgctcgcttcgaggccgccctgaaggtaccgcccggaagccctgagcggttcaaactcgtcggtgccttgacacgcgcgttctatggcagcgtaagccatttgtccgcctcgcagcgcgagatgtacacctcgctggacgagggcttgtcggcaatgtcacatcatgcaaaggatctgggctacgacggcattatcctgttcttggacgagttcatcctgtggttggcaagccgtgcggcggatgtggcttggatcgcccgtgaagggcaaaaggtcgcgaagttggtcgagtcgagcaacgctgaccgcccgacgcccatcatcagcttcatggcccgccagcgtgatttgcgcgaactggtcggtgagcacatgcctggtgccgagcagttgtcgtttgccgatacgctgcagtattgggaggcccgtttcgacaaggtgaacctggaagacaggaaccttccagagattgctaagaagcgactgctgcgcacgcgcgggcctgcagaggatgcgctgctcaagggagcgatcaacaagcttttgggtagccagcccgaagtgctgcaaaccctgttgacccgcgacggcgatcagcagatgcttcaggacctgtacccctttacgcctgcactgatccaaaccctgatcgctgtgtcgtcgatgctgcagcgtgagcggacggcgcttaagctgatgcagcagatgctagtcgacaaggccgacgcgctggagattggtgacgtgatcccggtcggcgatctttttgacgtaattgccgatggggatgagccgttcacccatggcatcaagctctttttcgagcaagcaaagcagctctggcggcggcggttgttgcctattctggagacccagcacggcgtggcttgggaagacatcgaatctggaaaggccgacttcaagaaagcggcggccttgcagaacgatgcgcggttgctcaagactctggtgttggcggcactggtgcccgaagtcgaagccctgaaaaacttaaccccgacaaagctagctgcgctgaaccacggcacgattcgcacgccggtgcccgggagtgagggcatcaccgtgctgactaagctcaagcgctgggcgggtcaggccggtgaaatcaaaatcgcggacgattcgccgaatccgatcgtgtccgttgaggtggccaaggtcgacactgacgccattttggccaacgcgatggtgtttgacacgcagggaaaccggcaggcggaagtcaggcaattgattaccgacggcttaggattggccgatgcaggctccagcctgctgccgcccgagatggagatcagttggcgcggctcgaggcgcgcggcggagattctgtttggcaatgttcgtgagcaatccttcgacaccctcaaggggcgagaaggaacgtggcgcatcctggtcgatttcccgtttgaccaccaacccgagcacggcccacaagacgacgtggccaaaatcaacggattcctcaacgaagggagggttggccgctcgatggtgtggctgccgtctttcctttccccgaatacgcaggaccagttgggccgtttggtggtcatcaatttcgtcttgcgtggcaacaacttggaccaatacgccagccagctgtcgcaaacggatcgcgagcaagcgcgcgtgctgctcactaaccagcgtgatcaacttcgtcagttcattcgcaactgcctgtacacggcgtacgggctcaacagcgtcgcccaggaagcactggaccccgcgcaaaccgtcgacgagcattactttagcctggacccctccttggttctgcggccacccgtggcggccaacttcaaagacgcgttcgagaaactcgcggaacaagcgctggactacgaatttccagcccacccgcactttgacgccgaaccacgcccgattgctgtcaagcgcctcgctgatctgatggtgctggcggctcagaagcccgcccatcgtgttgaactcgaagcctcgcttcgcgacgacgcaaagcgcattgcacccaggctcgatctggctgaggtcggcgaggctgcgctgcagcttcgtgacgactggtcgcagcattttgctagacagattgcgcagcaggcaggacgcgagcccacggtgaccgatctccgccgctggctggatttgcccgatcgacgcggtctccgcgaagacctgcaggaccttgtaatcttgacctggctggccaagagcaatcgctccttgtaccgcttcgggcaaccgttcaaaggcgaaatcggcaacgtgccgaacgaatgcgaggtgcgtgagcaacccttgccgacggtggtcgaatgggacaaggcgaccaaactcgcaggcgaaatgctggacccggcgatgtccacactttatcggtcagcacctgggctagtcgagttttcgcgtgccgcgcgcaagcgcgtggccgatacggcagcccacctgctgaactatctgcgggtggtcgaccagttgatgactttagtgcagacggatgtcgtggccacgggagaacctgccctgcgcaagctcggcgccacgcggctccgagattggttcgctgcaatggagtcctgcagctcggagatcgacctcgtcaatatggtgtcccggctggacttcagtgctgaggaaatcgccgaagccaaggccgttctgggtggcgtccagacgctggcgcgggtcgaggccaaacactatctggtcaacagtgtgcgctcgattgcgggcggcagcagcgagtttgcgccacgggccaaccagattctggaaagcctcgctcatgccgtgctccgttacgaatacgtcgacggcctgcaagttgccgttgtgcagtttgagcgcgatgcaggaaccctgatggccgatgtcgccaatcgggctacgccgccgagcccgcagcctcaacccgcttcggagccaggcatgaaggctcctcagaaaattgagtacacccgattgacgaagaccgacgccctcaagacactggccgacgcgcggatgctgcttgaggagcttggcgagatcagtgtggatattcagatcgtgatccgggaacaggaatga

SEQ ID NO: 173 - DNA, 3648 bp, Candidatus Accumulibacter
atgacgctgattcgtgaactgataccgatccccgagcgggtccatcaaggggactttgtcctcaaactgtccgatggcgtccgggccgcggacgaaacactcggcaattacgtggtcacgccgcagttggcacaggctttcgacaatgccctggccttcatccagtcggcactggcgacgcgccaaagcaaggcagcctacctgcatggcagtttcggttcaggcaagagccatttcatggcggtgctgaacctgcttctggccggaaatgttcgcgcccgctcgatcaaggaactggccagcgtcgtgaccaggagcaacgcctggaccgagggcaagaagttcctgctggttccctatcacatgatcggtgcccgcaacatggagtcggccattctcggcggctacgccgaccatgtgcgcagcatccaccccgatgcgccagtgcccggcttctacctggccgaggggctgtttcgcgatgcccagcaactgcgggcgcgcatgggcgatgacgccttctttggcaaactgaacgaacacgccggcagtgccgacggctggggcgagctttccggcggttgggatgccggcagcttcgaagcggcgatgctggaatcacctcggggtgacgagcgtagccgtctggtcggtgacctgatttcgtgtttttttagcgcctacgcctcggtggccagcagtagtggcggtggccagggcgaggcgtttgtcagcctcgacgatggactcgccatcctttcccgccacgcgagcgaactcggctacgacggtgtaatcctcttcctcgacgagctgattctctggctggcgagtcgggcagcggacgtcgcgtttgtcagcagcgaagggtcaaagctctcgaaactggtcgaggcagccaatgccgatcgtccggtgcccttgatcagcttcgtggcgcgtcagcgcgacctgcgcgaactggtcggcgacaacatggccggcgcgatgcagatgcagtttgccgacgtgctcaagtactgggaggcgcgctttcacaagatcatcctggaggaccgcaacttgccggtcattgcccaggcccgcgttctcaagccggcgaccgaatcagcccgtcaggtgctggacgcggctttcgaggatttcgccaacaggtcgaggacggtgaccgacacgctgctgacatcgaacgccgaccgcgagatgttccgactggtctacccgttcagcccggctctggtgcagaccctggtggcggtgtcgagtgtgctgcaacgtgagcgcacagccttgaagctgatgctgcaactgctggttgaccgccgcgacgaccttgaactgggccagatcatcccggtaggtgacctgtgggacgtgatcgtcgatggtgacgagcccttctcggacgccatgcgtctgcatttcgacaatgccaagcgcctcttcagccagaagctggtgccgctgctcgaacggacacatggggtcgtctggcaggatctgcgcaacccgcaggcccatgctgcggtcgaccctgtgcgggcacggaatttccgtaacgacgcccgcatcctgaaaacgctgctgctggcggccctggtgcccgaggtcgagtcgttgaaggccctgacggcgcagcgacttgccgccttgaatcatggctcggtgaagtcgccgattcctggccgcgaggcgcaggacgtattgaagaggtgtcgtgactgggcgggcgaagtcggcgaactcaagatcaccgacgagcagaatccggtaatctcgattcaggtcaccggggtcgatatcgagccgatcgtcaaaggcgccgaggggcacgacaacactggcaaccgccggcgcaagattcgcgagatgctgttcggcgaactcggcattccggatagcaacgagctgtttacccgtttctcgttctggtggcgcggcaccctgcgcgaggtcgaggtactgtatgagaacgtgcgcgaactggccgatgatcggctacgcgggcgtgaaggggcgtggacggtcattctcgacttccctttcgacgaacccaaccgcaccccggccgatgatcttgcccgcctggaccgctacaccggcgaaggctcgcagacgctggtctggctgccagccttcctttcggaaaaggccctgaaggatcttgggcgcctggtggtgctcgactacatcctgacgggcgagcgtttcaacgactacgccgcgcatctggcgcaagtggaccgggcacaggcacgttccctggccaagaatcagcgcgatcaactgcagcagcgcctcaagcaatacctcgaggtcgcctacggaatcgcccaggatccgcgcgaagccgtcgaccagaagctcggagtggccgaccagttccgcacgctcgaccggacattccagccgcaggcgccggtgggcgccaatctgcgcgagggattcatcaacctgctggaccagttgttcacccacaggtatccggcacacccgcagttcgagaccgagatcaggatcgccgtgctcaagaaggtcgaggcggagctggttcgggcgcttgaggacaaagaccagcgcgtgcatgtggccgatcgcgcgctgcggcaattgacgcttgcagtggtcaatcccctgcgcctgggcaacatgggtgcgacccatctcgcgctggagaatcactggcgcactcatttcctgcaaagacaggctgcggatggtgaccccggcgcgccgatcacggtcgcccgaatgcgcaaatggatcgacgatccgagcccgatgggcttgctgccggaagtccagaatttgatcatccacgcgttcgcagcgatgaccaatcgttctttcttcctgaacaacggcccctatccgccgacgcttgaaaacacaccgaacgagcttgagttgcgcgagcaggcactgcccggtgaagacgattggaaagtggcgatccggcgcgctggcctgttcttcggactgacggtggcggaatcgttgaatgcgggcaatgtggcccgactgaaggatcagttgaccaccgaagcaagcgccaggcttgctccgctgcaggattacgccaaggcactggccgtgaagtggcggagtcttggcaatgccggacgggattccgatcggctcaggacagccgagggtgctgcggctctgctcctcggcatgacatccgccaatgccgacgtgatcagcacccttgcgggcgcggcaatggcgacgacagaggcagcttacgggcagaccataggcaaggcgaaagcgcttgacgaggctttgaagacgacagactgggaactcttcaccgccgtgatcgcgctcgtggatcaccgccgggttgccgcccaatcgatgcgggaacggctggcggagatactggcgagtgacgagcatgcaattggcctgaaggcggccctggccgagcaaaagaacaaggctttgaagctgctgactgacgcgccgccgaggccagagcctgagccaccaaaaccagggactcgagtcattcgcgaagaggtcaagaaggacctggccgtatccgatgcgatcaactctcttgatgaaattcgtgcggaacttgtgaaggatgccgactaccgactgagcatctcgtggaaaatcacgaagaagggctaa

SEQ ID NO: 174 - DNA, 1371 bp, Corallococcus coralloides
atggctgtcgtccctgaatcagcagccatcgtgaatgcgctccgcagcggcctcgtgccgaatgtggggctcgaacacttcgcgaccggcctcgacgcgctcgttggggcggtcaacgaggacctcgacttcgtcgccggcggcaagggcctgtcgaagtggattcgcggcgagtacggcaccggcaagaccttcgccgcgcgctacctgtgcgcgaaggcgcgcgagcggaagttcgcatcttcagaggtacagatctcgatcaacgatacaccgctccatcacctggagacggtgtaccggcgcctcatcgagaagctcgagacagcagccgacgggcccaacgcgttccaagccatcgtcgaggggtggctctatcaggtcggcgacgaggtcacgcgcctgcgcggtatcagcgaggacgaccctggcttcgccgacgcgaccgagcagcggctcgaggacaagctcgccgacctctcgaagcgtaaccccgccttcgcgcaggtgctccgcgcttaccatcgagcaacgcacgagggcgacttcgccaccgcacagggcctgctcgcgtggctcgcagggcagccgcacacggatcgctccgtgctcgcagcggcgggcgtgaagggcaaggtcgatggccaggcgtcgctgacgttcctggccgggctgctccagttgctccggcagtcgggctacgccgggctcgtcgtcgtcctcgacgaggtcgagaccgtgcagcgcatgaacacgcagacgcgcgagaagtcgctaaatgcgctccggcagctcatggacatgctcgcgaaggaagagctgcccgggctgtacctggtggtgacgggcacgcgcgacttcttcgagggctacaagggattgaaggcgctcgcgccgctgtaccagcgcgtgcaggtgaacttctctgaggactctcgcttcgacaacctgaaggctccgcaggtgcggctcacgccgttcatggacgaccgcctgctcacggtaggcgctcgcatccgcaacttgtaccccgcgaagaatccggcgcgcctcaccgagcgcgtcagcgacgcgtttctccaggggctcgtgacgcaggtcacggcgggcttcggcggcaaggtggcgctggcgccgcgcatgttcctccgcgagctgatcgacgtgatggaccgcgtcgacatccacgaggcctacgatccgcgcgagcactacaagctcgagctcgacgacggaaagctcaccgccgaggagctcgccgccaagcacgggcgccccgtcgaagagccgcccgaggagcccgaagagccgacttcaaacgacagcgagggaccgcccccggctccggcgcggaaacggctggacgggtag

SEQ ID NO: 175 - DNA, 3627 bp, Corallococcus coralloides
atgactaccatcaccgaggccttcgagcttccgcgtcccgaggacatccgggcgatggggttcgtcgtcaaactgcgcgaactggatcccaactccgaggaggtcgagcagctcgcgcgcgactacgtcgtcacgcccgccgtcgagaaggagctgccccgcatcctcgacgatatgaagcaggtcttcgagcgcggcgaggagtatggccggttcatccacggcagcttcggcagcggcaagtcgcacttcatgacgatgctctcgctgctcgtcgagggggcgctgcccgcctggaagaagttccgcccgttgctcaacgcccatcgcgacgcgaaggcaagcaagggcggcgaggccagcgaccacgaagcgtggctcacgaaggccggcctgctcgtcgtgcgcatccacatgctctcggtgcgcggcaagagcaccggcttcgaccgcgctgtctacgagggcttcaacgcggcgctcaagcggcgcggcaaggcgcccttcgagttcctcaacgtcgacgccatcttcgaagaggtccgccgcgaggcgaaggagtacggcgaggtcgtctggaagcgcctcgagaccgagggcatcgtcggcgggcgcgaagacttcgaggcgctcgccgcaggttcgattcaggccaaggagcgtttcgcgcgcgcgtggctcaagtacaagggccgcgacgcctccgacgctggcatcgacccgcgctggagtgagggcctgaatcgcatggccgagcactccaaggcccagggcttcggtggcatcgtgctgatgatcgacgagttccttctctggctcgccgagaagagcggccaggagttcgttgccgagatcaacaacctcaacgtcatcgttgaccacaacacggggcagcgaccgacacccgtcttcgtcttcgtcgcccgccagcgaaatctccaggagttctttccggacctcgtcgacgagtcgaagatccacgagcacctcgaccaccacgcgaagcgcttcgagattacgaagctgcaggacgtcgagctgcgccacatcgtgcgcggccgtgtgctccggccgaagaaggccggtgaggtgaaggccgcggtcagctcgctgtcggagaagcacagcaaggttctgcccgcgttgctggcgggcggcgacctcgactacgtgcgcgacgtctatcccttccatccggccctcattgagatgctggtagacgtcacctcgctcatgcagcgcgagcgttcggcgctgcgcctgctctacgagttgctcgtcgtccactatccgaagctgcccctcggggaattcctgccggtgggctcggccttctctgccatcttcccggagtcgggcgtcgaggcgagcaagaaggtggagctgatgcaggatatccaccaccagtactactcgcgactcgcgccggcgatggcgaagatggccgaggagggcggcgccgaattcaacgacgagcgccgccgcgcgctcgaccagctcgtgaagacggtgctactcgccgaggtgtcgccgcggctgaagcagggtggactcaccattgaacggctcgtgcagctcaacgctgtcgacgtcgaaggcgagaccttccgtggtcaggtgcgtgtggccgaaacggacctgctcgcgctctcgcagcgcgtgcccgacctgcaagtggccgggcagggcaagaccgcgctcgtccggtacgtgctggggcgtgtcagcctcggcgagatcctcgggcgcgcgcgctcgaaggtcgacaaccctgcccagcgcttcagggtgttctggctcgcgttgcgcgaggcgctcggcgtcgctggcaccaagggcttcgaggacggcgggcccaacgagggggattgggacctctcgtggcggcgcaccaagcggcgtgggcgcatcaagctcggaaacgtgcgcgagatgtcgtacgaagacttcgcacctccggacggagcattcaagatcctcgtcgactacccgtgggacgagcccgggcacacggttgacgaagaccgtctgcgcgcgaccaacgtccgtaaaaagcagggcctcttgcacacggtctgttggctgccgcgtcacatgagcccgaccgagcttggcgtgctgaccgagctcgcggcggtgcgttacctgctctccgaggccgggcaggaagatctgcttgagacgctcgggtcgcaggacaagagcaaggtgctcgaccaagcgggcatccgccagaagacgctcgagggccagctcgaggatctgctcaaggaggtctacgtcaggcacggtgagttcttcgcactgatctcggacgtggactcgagccgcccgcgcgagacgctcgcagaaaaccttgagcacatcgcggcgctgctcatggaccgtcgctacccgcagcacccggctttcctcgccgagccgaagaagcaggacctcgagtcgctgctcggctggatggtcgatgccggcgaaggcagcgtctcagtcgcgtacgacgagaacgtcggcaaggtcctgaagaacctcggccagccgctcgaactcgtgaacctcgggcagaccaaggcgtcgctgcggctcgactcccgttacatcaaggacgtcctccatcgcaccgaccaggactcggtgtcgtggtcgccaatcgccgatcacctgcgcgagacgtacgggttccagccgctgcttattgacctcttcctctgcttcctctgccaacgagaccaccgcgcgctggaagacatcagcggcgagcccgccgatgtccgcatcggcatgtcgcaaacaacgcgcatccggctccagcgcggcaagctcgtgagcgccgccgactggcaccggctgcgtgacctaggcagccagctcttcgaggtcgcgcgtcccgccgcgcatcgttcgctgcaggggcaggaccgcttcacgaccgagctgcgcacaaggggacaggccaagcgcaccgtactgcaggcactgcacacgcgcctcgttcatctcggcgtccagggcggcgaccgcctcaaggagctgtcgaccgcgaacacgcgcctcggcccgcttgcgcagaccacgaccgacagccacaaggtgctgagcgagctgctccccgcgtggcccgacgatgcgtcggacgcgctgcgcaccctcgtgcagcaggccgagacacttcgtgacgctctcgccgagttgaacgagcacgcgcgagggaacctcaaggcgggtgtgaaccacctcgtcatcggcagtgaggtgagcggacacctgcgcgcgctcgacagccgcctcgaggcggcgcaggccgagcagccgctgacgaaagactgggtcgcgacctggaacaagaaggcgcaggagctgatcaagcgcctcatcgagcagccgcagtccccgcagccctcggttaccggtggtggcgtgcagccgcccgccatcggtggtggcgcccagtccccgctcgtcggcggtggcactgcggtcactccgcgcacggtgttgctcaagaagcgcgtgaacccgaccgacgccgacgccatctcggacttcctggccgaggtgcgcaaggcgctaactgagcaaggggcgaagccgatcagcgtagtacttgtccgtacggaggaattcgagtga

SEQ ID NO: 176 - DNA, 3915 bp, Corynebacterium variabile
atgggaaagttcaccctccccggggcatcctccgccgcccccaccctcggcgagatcttcgacatccccgaatccgccggagacaccttcgtcctcaaactgtcggactcggtcagcgaccacggcaagctcaaggccacgatcgacagctacgtcatcaccgacgagatcgccggcaacctcaacgccgccctcggctacgtcgaccgtgccctgaccaccggaaacaaccagggcgtctatctcaccggctccttcggctccggtaagtcccacttcatggccgtacttttcgccctgctcgccgcagagcccgccacccgggacgtccccgaactccagccgctgatcaccgagcacaccggcaccggccacgccatcggccgcaacctgctccagctgcccttccacttcctggactccacctccatcgaggacacgatcttccggggctatctcaaacacctcgaggccctgcacccggaggccccgctgccggtgctgcacgcttccgagggtctgttcgccgatgcggactccacccgggcagccatgggtgacgaaaacttcttcgcccgcctcaatgaggcccactccgggcccgagggtgtgcgcacccccggcgctgcttgtgcgtcctcccctgccgggtcagctgcccccgccgtcaccggtggcgtcgacttcggtgcactcatgggtgctgccggagtggataccgccggggccaacgactggactgcggcgtcctaccaggtcgcccgggccaccacggccagtgaggcgcagcgacgcaacctgtcctccgccctcaccgagaccctgttcaccgcctaccggacgcactcccagtggatccccctggccgacggtctcgccgagatcgcccggcatgccaagtccctcggctacgagggtgtggtgctcttcctcgacgagctgatcctctggctgatgttccagcgctccgcggaactgttcaacaacgaggcccagaagctcaccctgctggtcgagtccgggcagggtcagctcgccgtaccgttgatctccttcatcgcccgccagtacgacctcgccacctggaaggattcctcggtcgaggccggccgggagctcgaggcccgccggcagtccttcaagcaccaggagggccgcttcaacgacatccagctgggcagccggaacctgccgatgatcgcgcacaagcggctgctgcgtcccctcaacgattccgccgaaatgaagctttcccgcgcgttcacggacctcaaactcaacggggacgtgatgaacgtcctgctggacggggtgaacaccgacgagaaccaccaggcgtccgacctggagcggttcaagctgaccttccccttctcccccgccctgatcgacaccctgatcagcctctcctcgatcatgcagcgcgaacgtaccgcgctgaaggtcatggagaccatgctcatcgacaagcgcagttcgatgaccatcgacggggtcatccccgtcggggactccttcgactacctgctcgccggcaacgagaagatgggcaatgacgccgcccaccgcttcgccctcggcaagaagttctggaacgacaagctccgcccgctgatcctcaagacccacaagctgcccccttccacccgtgacgaggacatcaccgacacccccgccggtgccgaactgcgcatcggcaagaccctcatcctctccgcgatcgccccggaagtccccgcgctcaagcagatgacggcgtcccggctggcacatctcaaccacgggtcgatccgtacgcccttccgcggcggcgatgtctccatggtgctgaagatcgtccggacctgggccgcggagttccccgaggtcatcatcaccccgggtgtgaagaacccgacgatcaccctcaagctcgaagacgtgccctgggaggccgtcatcgcccaggcccgctcgcaggacaccgaagtccgtcgggcaaggaagatccggaccctgctcgccgatgccttcggcatcgcctcggtcgaggccggcgccgacgggtcctacgcccggaccgtcacctggcgcggtaccgaccgcaacgtcgagttcgtcttcggcaatgtccgggaccgggctgacctgcccgaccatttcttcacccccgggttcgagggcaccctgcgcatcatcgtcgacgtccccttcgacgagccggaccactccgtcgccgaggaccacacccgcgtcaaggcgctggccgggtcggtgaccaccgccccgttcaccgcgatctggctgccgcacttcctgtccgccgagcggatggagaagctcggcgaactggtcatcatcgaccacgtgctcaccgagaacgggtggcgggactacacccagaacgtcgccgccgacgaccgggaggccatccggcagatgctcaagcagcgtcagctgacgttgaccaaccagctcgtcctctggttggaggaggtctacggtgtcgattccggtcaggagttcgccatcggccaggagccgctgaagaccctcgaccccgcactgaccgtctccaagccccggggtgcgtccctggcggacgccacagacaacctcatcaccaccctctacgaccagaagttccccgaccacccgcgctacgagacggaccggtccctgacccgggcagacttcggcaaggtcgtcgaagtgctgcggaccgccgcggcggacgcccagggccgcgccgacatgcctgcggacgcccgcaaggcgtgccggacgatcctgccagccctgggcatcggctcggtgcacgagtcccacctggtgttcaccgcggacaacgccgggacggtcatcaacaccgggatcccccagcggctgcgcgccaacggtctggacctcactggtccggtctccgtcggtgcggtggagtccgcggtcggtgagatcaacccgaacgccgggttcaccgacctcaccgaggacctctacgtctgtgcctgggcggcgatgacgaaccgctcctgggtcgaccattcccgtgagatcgaggccccggccttccgcgacctcgactaccgcatggagctgcgcccggtggtcctgccggacgccgccgagtgggataccgccctcgagatcgccgggcggctcttcggtgtgctcaccgggtcacactgcaccgcggcgaatctgcggtccctgcagtccgccgtgctcgagcaggtcgaggagcagcgccgggatgcttccctgtactccgagaacctcggcgcggtacagggcgccctgggtgtgtccacggtgacgaagcggtcccggctggccgacgccacctccgcgctgctggagacgcttcaccgggatggggcgaatgccctggcactggtcacccacctggctgccgcccgcaccgcggacgaccggatcctgggggcgaccgtcgacgaggccatcgccgggttggccaacgcgaagccggcggcgaccgcgctgaagcggctcaccgccaacggatctgtcgccctgaccgtgccggccgcctacgcccgcagtcacgccgacggggatgacctgggtgccgccgtgctcctggcgaacctgcgggacgccctcgccgaccacgagttcaccacgccgacgacctctgccgtggaccggttcttcgccgaccgtgcccggtgggaggctgcgatggcggcggtcccccagccggtccagcctggtccggatcctgtcgtgccgccggtccagccgccggtcgcgccccctgttgtcgagcagccggaacccggtaaggagaccgggacggtaccggtgatcgacgaggagatcaccaccgagtccgtcgcgtccttcggggcgcagctgtccgagctgctcaaggccggccgtcgggtccgcgtcaccgtcgaggtcatcgaatga

SEQ ID NO: 177 - DNA, 3684 bp, Frankia sp.
atgaccctgatctcggaactcctcgacatccccgaggccgtgtacccgggggacttcgtcctcgacctgtcccgcggcgtgacccagatcgatcgcaccctgcgcgagtatgtcgtcacccccgagctggccatccggttcggggaggcgctgggtctgatcaagagcgcgctcaccgacggcagtagcaaggccgcctacctcgacggctcgttcgggtccggcaagagccacttcatggctgtgctcggcgcgctggcgcggaaccaccccggggcccgggcgatcggcgagctcgcccctgtcatcaccgcattcgacggtgacgtcatcggcaagcagttcctcgtcgtgccgtatcacctcgtcggcaagacgtcgctggaggaggcggtcctcggcggctacctggcgcacgtccgcgcgctgcacccggacgcgccgctgcccgccgtcctcatcgacaagccgctgctcgacaccgcggtggcgttgcgcggccaactcggcgaccaggcgttcttcggcctgctcggcggcggcgaccggagctcggctgccgacccgcgctggggcacgttgaaccacggggcctgggacgccgaccggttcgagcaggcactgaccgccgctcccgccgcgcaggagcgccgcgacctggtcggcaccctggagaaggcgctggtcgggttcgccgagctcgcccggggcgccgccaccggctacgtcaacatcgacgacggcctggccgcgatcagccagcatgccgccggcctcggctacgacgggctgatcctcttcctcgacgagctcatcctgtggttcgccaccaggatggccgatcacgcctgggtggcgaacgaggctcccaaggtcgccaagctcgtcgaggcggccaacgccgaccgaccggtgccgatcatcagtttcgtcgcccgccagcgggacctgcgcgagctcgtcggcaccaacctgcccggcaccgaacatcttgccttcgccgacagtctcaagtggtgggagggtcggttcggctcgatcaagctctccgacaacaacctgccgctcatcatgtcgaagcgggtcctgcggccgcgcagcgatgccacccgggcacagatcgacacctcgttcgccgcgatggaccgggtccgagcggacatccgggccgcgctgatgaccgcccacgccgaccgggccgcgttccggctgacctatccgttcagcccggcattcgtcgagacgctcgtcgcgctgtccgggttcctccagcgggagcggaccgcgctgcgggtcatgcagcagctactcgttgaccagcgggacaccctgcagctcggccagctcgtccccgtctccgacctgttcgacgcgctcatcacggatgcgtcgccgatcagcggcgagctcggcgggctgtggcgcaacgcgcagaaggtctacggcgagatccgtcggctcatcctggaaagccacgggctgaccgaggaaaccgtcaccggggtggccccgaaacacgccgtgcacatggacgaccggatcgccaagaccctggtgctcgccgccctgctccccgaggtcccgtcgatgcgggatctcaccgcccgccggatcgtggccctcaaccacgggtacatccggtcgatggtgccgggtcaggagacgggcgcggtcacccaggtcgtccgcaaatgggcggcccggctcggcgcggtgcaggtcagcggggacgacgcaagcccgctcctgtcggtgcggctcgaaggcgtcgacatcgagggcattctggagaacgccaagggggccgactcgcccggcgaccgccggctgaccgtgcgaacgctgctgttcgacgcgctcggcgccacgaaaccggagggtatcgaccgcgcgacgatcgtcaccgccacctggcgcggcaccaaacgcaacgtcgagctcatctacggctatcttcgcgaccccggtgacgtgggcgacagcatgttcacgcccacccacaacggctggcggctcgccctcgacgtccccttcgatccggacgaccactccccggccgaggccctcgaccgggtctcgcggctgcgggacgcgctcccagcgcgcaccctctgctgggtcccgcggcacttcaccgcacacacccaatggagcctgggccgctacctgcggctggaatacgccgtcgggccgagcttcgaccaactcgccgggcacctgtccgacaatgaccgggctatcgcccaccagcagttgaccgcgcagctcgaccagctgcgcagccaactgacgaacgcgctgctgcaagcctatggcctcgtcaccccggacgagacggtcgtcgatcccgcgcacggcgggatcgacatgttcgtcagcctcgaaccgggattcacgccccgggtccccgccggtgccgccctgcgccccgccttcgaaaacctgctcgaccaggcactgagctgggagttcccggcccacccccacttcgacggcgaggtgcgcccgggtgacctggcaaaagtgcacgcccaggtgcgccgggccatcgaacatcccgagcaccggatcatggtcgaatccagcgagcggcccgtcatgcggaaggtggccaacccgctggggctcggcgagcagagcgaccagtacttcgtcctcggccaccactgggaacggcacctcggccgaaagatcatcgaggccgaggcggcgggccggccggtcacggtcggagacctgcgtgcctggctggacgagccgaagcggatgggtctgccccaggagatcgcggaccttgttgtgctggtcttcgccgagcagaccaaccgcggcatcctccacggccggccgctcgacgtgagcatcccgcgcccgctgcccgcggacgcgcgcgttgtcgccgagccgctacccgatcgggacacctgggaggaggcccgcggccgggcgcacgccctcttcctgatcactgacatcaccgaactgtgtaccgcgcgcaacgtcgccttgctggccactcgggtacgatcagccgtcgcggaccggcttccgaaggttcgcgcgctgcacgcggccctcatccgccgaggaccgaccgtgctccgggacggcaccgacccggcgacggaacgagtccggatcgcccagggcgcgctgcgtctctgtgcggacctggcgaccatcaccgacaatctggccctggtcgagcggctcgccgccttcgacctccccgcggtcccgctgcacaccggtcggagcctgaccaccgccgccgatctcgacgcggccatccgggaggtggactggaacatcttcaccaccgtggccgactggggacccgagcatccgcggggcgcggaggcagccgcgttggtgaccgagctcgccgcggtctgggcggccaacgagtacgtccagcacctccagccggcgctcaccaaggcggacaggaaggctcgcgggttgctgctggaatggagccgacgggtctcccgcccagcgagcagaaccggcaccatcaacccgccgggcgtggccacaccgggcgtggcgacaccgggcggcgtggcaaccagcggcgcccgcgaggtcgatcaggactcggttgccgagttcacgtccacgctcgcggcgctcaccgcccagggctggcggatcaaagtcacctggcaggccgtgcggtga

SEQ ID NO: 178 - DNA, 3942 bp, Frankia sp.
atgaccagcccgtcgcccctgccgctgctgcgcgaggtcatcgacatcccggagcggacgtccgacagcgacttcgtcctcaagctcaccgagggcgtcaccgacgccgccgcgacgatgcgggactacgtgctgaccgaccggctggtcggcaacttcgacgaggcgcttggcctgatcgcgcaggcggcgagcaccggggcgtcgaagggcgtctacctgcacggctcgttcggctccggcaagtcgcacttcatggcggtgctgcacgcgctgttgcgcggcgagccggccgcccggagcttcgacgaccggctgaccgacgtcctcggcaagcacgacgctgacctggccggcaagaagttcctgctcgtcccgttccacatgctcggcgcgaagtcgatcgagcagcgggtcctcggcggctacgccgaccagctgcgcgccatgcacccggacgcgccgatcccggcggtgcaccgcgccgaggcgttgctagacgaggcccgcaacgtgcgggccagagtcggcgacgccaccttcctcgtcgagctgaaccacgcgggctccggaagcggtgacgaggacgactggggcgacgacgcctcctggaccgcggccgagctggacgcggccctcgcgccgggcgcccaggacacggccatccgccgccaactggtctccgacttgctgtcgacctggttcgcgaacaccttccgcgacctgcgcgaggacgccgagggcttcgtctcgctggacgccggcctcaccgagatcgcccggcacgcgaaggacctcggctacgacgcggtcattctcttcctcgacgagctgatcctctggctcgcgaacaacatgggcgaccaggcgttcgtctcccgcgaggtccagaaggtcacgaacttcgtcgagggcgggttgggcgcccggccggtcccgatcgtcagcttcatcgcccgccagcgtgacctgcgggagctagtcggcgaacaggtcgccggcgacgtccgcctgagcttcctcgacgtcctgaccctcgcagacggccgcttcgataagatcatcctggaggaccgcaaccttccgctgatcgccaaccggcgtctcttgaaaccgttgaacgccgacgccgggaaggcgatcgagaaggcgttcgagacgacggcgaaggtccgtgccgaggtgtgggagacgatgctcggcggcagcgcccagatcggcgccgaccgggacgcgttccggctctcctacccgttcagcccggcgttcatggagaccctcgtccacgtctcctcggcgctgcagcgcaaccggaccgcgctgaagctgatgcgccagctgctcgtcgaccaccgcgacgacctgcgcctgggccaggtcgtcccgctcggcgacctgtgggacgtgatcaccaggggcgccgacacgccgttcaccgacgtgctgaaggccgagttcgacgccgcccagaagctctacgcccgccggctgcggccctacctgctcgacgccgagggcctcgacgaggacgcgctggcccaggtccgccgcgccagggccaccggcgccgccgtcgacccgacgctggccaccaaggtccgccggttcaccgccgatgaccggctggtcaagacgctgctgctctcggcgctcgctccgagcgtcccggcgctgcacaacctgacgccgcggcggctctcggcgctcaaccacggcagcatcaccagcccgatcccgggtggcgaggccgggcaggtcggcaagaaggtcgagcgctgggcgggccagttcggcgagatcaagtacctgcccgtcgagggcggcgacccgggcgtcggcctggagctcgtcggcgtcgaggtcgaaggcatcctgaactccgccgtcggctacgacagcgccggcaaccgccgcgctctgatccggcggctgctggtcgaggagctgggcgtcaccgtcaccggcgacgcctacggtgacaagctcgacctcgtctggcggggcagcaagcggaccgccgaggtgatctttggctcggtgcgcggcgcggagctgcgtgacgaccagctcgcccccgtcgaccccgagtcctggcgactcgtcgtcgactacccgttcgacgacgccggcgagccgcccgtcaacgcccgcgcccgcgtcgagcggctgcgcggtgccggcgtccagcaccggaccgtctgttggatcccggccgatttcaccgccgcgcggctggccgacctggggatgctcgtccggctcgaccatctgctcgccggcggcgggcaccggttcgacagccacgcccagcatctgagcgccgacgaccggcagcgcgcgcgcagcgtcctgaagagccgttacgacgcgctgctcaccaagaccaggacgacgctgcgctcggcctacgggctcacgtccaaggacgagcacgacgtcaccgcggatttcaacgaccatctgcggtcgctgtggcccggcctgaacccgacgctgccgctcggggcgtcgtttcgggaggcggcccgtcggctggccggcgacctgctcgccgaccagttccccggccaccccgacctggaccccgatcagaccggggtgccggtcaagctcgcggatctcaagctggtcctcggctacgtcacgaaggccgccgagtccgacggcggctccgtcgaggtcgcccgcggcgaccgggggccggtgcggcggatcgctccggcgctcgggctcggcgtgatgcacgaggtccgcttcgagctgggccgcgagtgggtcgaccacttcacccgccgggccggccaggccgccgctgacggcgggcccggctcggctggctcgggcgcggacgagctgcgggtcgtcgacctgctgcgctggatcgacgagccgaagcctcgtggcctggacgacaacgtcgcccacctggtcgttgccgcgttcgccgagcagaccgaccgggcctggtaccggtacggcggcctggtcaacccgccacccgagctgaccgcgatcaccaaggacatgacgctgcgcgagcagccgctgcccgaccaggccgagtgggagaccgcgggcgaacgggcccaggctctcttcggggtgcggccaccggccctgcgccggggccggctgctgcgcgccttcaccgaggagctggtcgccaaggccgagccccgccgggcgcctagccaggagctggtcggcgccctggaggcacgcgcgttcgagctcggtctcgacctgcgcaccgggacagccgcggccgggcgcagcgccggcggcacgaccgaaggccggctgcggaccgcgcgggccgctcgcgacctgctctcggcgctggacgacccgaaggccggaccgcagatcgtcgagcgcctcgcgcgggccgacctcgccggctcgccgaagcggctgctggtcagtatgagccacgccagcgaggtcgctgcggcgatcagggccgcgccttgggacgagacgtttggcgtcatcgccggcctacccgagccgtacaaggccgaggcgcaggagatcctcggccggatccaggccgccggcgccgccgacgaggtgatcaacccgctcgccgcggtgctcggcaacgcccgcgccgaggcgaccgccctgctccgccgcgccacccaggcggccgtcgcccccgtcgcgccgaagccgcccatcaccgggccgccgccggtcggcgttccggtcgtccctggtccccggccaaccgccgggagtgttccgatcacgatccccggacctggcccgggcctcgccgcggggggaaacgccggctcaggtggcgtcacgggagccggggctccgcggcactggcaggtccgcgctagtgacctggacgaggcactcgccgagctgcgtgcccacatcggcgaccggccgggccagatcgagatcgtctggcggccggagcggtga

SEQ ID NO: 179 - DNA, 3579 bp, Haliangium ochraceum
atgcgcatctcggacgccctcgacatccccgcgttcagcgacctctcggagttcatcgcccgcatcaacgacagcgacgagcgcgtgatgcagagcttgcgcaccttcgtggtgcccaagaacctcgagaccaagctcgaccagctcttgcgcgcggtcggccacaacctcgaccagaagcgcgacatcggccgctacatctacggcaccttcggcagcggcaagagccacctgatgaccgtgctggccaagatgctcgagcacgacgagaccgtgtacgacgtgggcgatgaggccctgcatcggctgcgcgcccagcacccctggatcgaccgccactcgcccctggtggtgcgcgtcaacatgatgggcaagcagacgctggtgtcggctctgttcgaggcctacgccgaggcgctgccgccggacgcgccgccgatcgcgttcaccgacgaggacgaggtgttcgcgctcatcgataaagacgccgagcgcctgggcggcatggacgcgttgctcggacgactggtcgaggacaaggccatcccctcgctcggcttctacgagcgcatgcgccagggcacgccgagccagcgcctggacctggccgcgcgcctcgacacctggcgcaaccacggccgtccggtgcggcccgaggacctgtgggtggacgccgacgagggcttcgcgcgcatcgcgcgacacgccaaggacgccggctacacggccatcgtctggctcatcgacgagctggtcatctggatccgcggcaagagcgccgaccagtacgtgcagcagatcaacgacctctcggcgctggtcgatcacgaccagaccagcgcccggcccacgccctttttcgtggccgtggccgtacagcaggacgtggccgagacctgcccgcaggacctgtccgaaaaaggcttccgcgagcagctcggcttcatcggcaaccgctttcagccgcgcctcgacctcgaggaccaggacctgttcgaggtcacctcgcggcgcgtgctcaagcccaagcaagagcacgccgaggcctggcgccaggccgtggcccagaccttccagaagcaccaggccgagatccgaaaactctcgggcgagatcgagccggcgcaggtgcaggcgctgtatcccttccacccggcgctgatgcgcgtgctggtcgatgtcacccaggggctctcgcgcaaccgctcggccatgtcggcgctgtacgggctgctgcacgccgagcgcgacctcgaggtcggtcacttcatccccgtgggctcgctgttcgacgtggtgttcacgcgcgacagcgtcgaggacgcgcgccagcgcacccagagcgtgttggcccaacgcctggccgaggccgcggagtcgtacgagcggctcgagcacaagctcgaccaggcgtccgaagaagtatcggccgacccggtcgagctgcgccagctcgtcaagaccgtgctcctgtgccagctctcggaccgcgactacttccgcaccgagccgctgtccaagcgggtcaaggccagctttctcctgcacctcaaccagcgcgacatccaggccagccatccgcggctggggctgtcgaaggtggtcaagctgttccgccagatcgacagcaccgaggtgaccctgggcgagggcacggacccgtcgatcaagatcctgaccgaccgcgtcgactcggacgcggtgctcaaggcggcgctggccgagatgcatcactcggcgcgtttcgcctacatccgccgggtcattgaccaggtgctgggcctggggctgggcagcggcaaggagatcgcgctcgacgtccccggttggcgcggcaccaagcggcgcgggcggctgctgctcgagaacgtgcgcacgctgtcgtacgcgggcaagcagaaccagttcgaggccggcgagagcgagtttttgatcctggtggactatcccttcgacgaggatcccaccaagacccgccaggacgatatccagaccctgcagcgcgcgcgctcgcaccgccggcagtggacggtcgcctggctgccggcgcattttcagcgctcggagctgagcgcgctcgaccaggccgcggccgtggacatcatccgccaggacaaggcgcgctttctcgagcgttacaacacccgcgacgccgacaagatcagccgcgcgctggagctgcatcaggccaaacagcgtcagctcctggaagacgccgtgcgcagggtgtacatcgacgagggcgaggtgcacgcctgctccgagctgctcgactcggtgacgcacgcgggcaaggacatcggcaaggtgccgcaggggctggccaaagacatcctcgacgtgcgctatcccaaccacccgcagttttcgcgtcgggtggtcgcgcgcgacctgcagaccctggtcgacctggtcgtgcgcgcggcggccacgggcacggccgacaacctcaagagcagcgacatggacctggtgcaggccttcgccgtgccgctggagatggtctatcccgggcagaattcgatcagtcggcgtgcggacgggcgctacctgacgcgcgtccacgggctcttgcgcgacggcgagcggacgcaggcgcgcgcgctgcgcgatgtcctgagcgccgacgtgcagagcggcgacggcttcggcttcaccgacgaggtggtgcagttcttcctgttctacctgctgcacgccgagggctacgaggcgctgaagaacggcagcctcacggtgcgcgtgtttcgcgacctgccgtccgacttcgagctgaagaaagccgacatggtcgagcacgcagagtgggacgcggcgctgcgcgtcgatgcggcgctgtttggcggcagcaagcgcgccgatattccctcggtccccgagcaggccaagctgtcgcgcgaggtcgaggcgcaggcgcgcgagctgcgctcgcggctcaccgagctcaagagcgcgctgggcgaggtgctggcctggaccgggctgaagctcgaggacagcgaacgggcgcgcacgctggtggcgctggagagcacgctggtggcgctgggcgagcagcagggcaacgccgagcgggtgcggcgcctggccgagctggacaaggcgtccgacaccttgagcgcgtttgcgagcgtgatccgcagcgtggaggccgagcgcgcggcgctcgattcgctgtccagccagcaggcggcgtttaccattgtggccgagcgcggcgacgacgccgagcgcgccgccgtggtgctggcgctcaagaaccgcctgcgagcacccgtgagcgcgccgctggccgacttcgcccccggctggcaggccgaggcacagagctgcttgcaggcgatcgtgggccggacgccgtcgccgccgccgtcggtcgcggaggcggggcccgaggtggcggcgcaggatgcggagagaggtgggggacgcgtgctcacccgccgggcctccggggtgtcgcgggccgcgctcgcgaaggaactcgcccgactgtccaaagatgctgtgcgtgagctcggtccggacggggacgatgcccacttcgacatcgagatctcgctggtgcggaggcgctga

SEQ ID NO: 180 - DNA, 1335 bp, Haliangium ochraceum
gtggacacgcgaacggccgacatcatcatcgaatcgctgcgcgctggcgaggtgccgcaggaggggctcgagcacttcgccaccggtatcgagcggcacgtggccgccttcgatgaggagttggggcgcatcgccagcggacgcggtcgctatcgcttcctgcgcggcgagtacggtgccggaaaaaccttcttcttgcgctttctcggcgcgcgcgcgcgctttcagggatacgcggccgcctacgtgcgcgtggcctatcccgaggtgccgctgcacaagccggtggagctgtaccgagccatctgcgccggtctgggcgtgcatcgcaaggccgagggcggactgcaggacgtgctcgaccagtggctgatgcagctcagcgagcgcgtagccgaccccgcgctcggtcccggcatggcgcccgatcatcccgactttgcgcgggcgctggaagaggagtcgcggcgtatgctcggacaggtggccgacgccgcgccggcttttgcccaggcgctgagtgcgtacatccgcgcgtcgatgaacggcgagtacgacctggcgcgcgccctgctgcagtggctcgccggcgatcccaaggtggccgcgcaggcgcggaagcaggcgctgctggtcggcaagctcgacgcctccgacgtgctcggtatgctgcgcgcgctggcggccgtggtcacgcaggccgggtacaagggactggtgattttgttcgacgaggtcgagcgtctggtgcgcctgccgcgcagcgatagtcggacgcgtggactggagctgctgcagaactggatgggcgcgctcgacgccgggcaggtgccatcgaccttgctggtcgtcgcggggacgacctcgttctttgattcgccccggggcgtgtccatgctcgtgcctttgcagcagcgcatcggcgtgctcgacgatggtccgtttcccgatatgggcgcggtgcaactcggactgccggcgtttgatgaggcgcggctggtggccgtgggccgccgcgtgcgcgatctgttcgacgagctgtatccgggcgttgctgcgcgggtctccgacgggtttttgacgcggctggcccgcgatgtgggcggcgcgttcggcggcaaggtagagatcacgccgaggcgttttttgcgcgaggtcgtcggcgtgctgagccgcgcgcggcagtatcaggagtatgtgcccgagcagcactacgcgtttcagctcgacgacgcgggggcgccggtgctgtcgtttcaggagcgcgcggtcatcgaggggcgcggcgtgcgcgaggtcgaggaggagacgctgccggacgagctcgacctgtga

SEQ ID NO: 181 - DNA, 3720 bp, Microlunatus phosphovorus
gtgagcgcgctgctgcgtgacgtcatcgacatccccgagcatgcgggtgcagaggactacgtgcttcggctgaccgacagcgtcggcgccggccacgcagtggctgcggtggacaactacgtggtcaccccggccctcgccgacgccttcgagcgcgcgctggccctggtggcagatgcggtcaccagccggatcagccgcggcgccttcctgaccggctcgttcggctccggcaagagccacttcatggccgtactgcacgccgtgctgcgccaggaccccgtggcccgcgccaagctcgagctgcaaccagcgatcggctcggtcgacccggtgctgcgtgacaggacgatcctgccgctggccttccatctgctgggagcggagtccttggaggacgcgctcttcggtggctacctgcggcagatccgagccctgcacccgaccgcgccgcttcccagcctgcaccagtccgacgggctgctggccgatgccgagcgaatgcgcgacgtcttgggtgaccaagagttcttcgcccagctgaacggaacggacagcgttggcgacggtgtcgacgagtggtcggcgctgctcggctccggcacctggaacgccgacagctacgcccaggcgcgtgctgccagtcccgagtccccgcaacggcagtcgctggtgtcggctctggtcgagcggttctaccagtcctacgtccggcaggctcgctacgtcgacctggacaccggcctggccgcgatcgccgcacacgctcaggcactgggctacgacgccgtggtcctcttccttgacgagctggtgctgtggctggccttcgccgtccaagatcgggagttcttccggcgtgagtcgcagaagatcaccaagctggtcgagtccgggatcggacaccgacccatcccgctcgtctccttcgttgctcggcagatggaccttcgccgttggttcgccgacgccggcgccagcggagccgagcaggatgcgctggatcgggcctttcgtcaccaggagggccgcttcgcccagatcgcactgggcgacgacaacctgccctacgtcgcccagcagaggctgctgcgacccaagaacgacgaggggcgccgcatcttggacgaggcgttcggtcgcatcagtcaccgagcgggtgtctgggacgtgctgctggacggcatcaacaccgacgagcagcaccgcggcgctgacgaagccgcgttccgacagacttaccctttctcgccagcgctggtctccaccttgcgatcgctggccagcgtcatgcagcgggagcggaccgcgctcaaggtcatgcaacagatgctggtggatcggcgcgacacactcaccgtcgacgacgtcattccggtgggagacacgttcccgtacgtggtgcagggcgcgcagccgctggatcagaaggtggcggcgctgttccgctcggccaacaccttgtatgccgacaagttggagccgctgctgcgtgagccgtacgagctgaccgaggggcaattggacggtcgcgagccactcccggccggcctggtggccaaccaacggctggccaggactctgctgctgtcggcggtcgcaccgaacgtgcccgcgctgaaggggctgacggcctccagactcgcctccctcaaccacggctcgatcgtcagcccgctgcctggcaacgaggccactatggtgaccagccgcgtccgcgactgggcccggcaggtgcccgagatccacctggacagtgacgtccgcaacccggtgatccggatgcagctgtccgacgtcgactacgagtcgatcgtcgagaaggccaagggggaggacaacgagggccgccgccgggagctgatcaagtcgatggtggcgagcgggctcgggatcgagcttggcccagaagacgtccggggcgcgtatgtccaccagattgtctggcgaggatcccgccgtgacgtggacctcgtgttcggcaacgtgcgtgatcctggttggctctccgacgagcagttccagaaccggccgaacacctggcgggtgatcatcgaccacccgttcgacgaggcgggccactcctggttggaggactccgagcggttggactcgctgatctcccgcgagcgccatgcgcagaccatcgtgtggctgcctcgcttcttcaccgaggagcggatgcgcgatgttcgtcgtctggtgatcttgaactggctgctggacggcagcggtgaccggtggacctcccacgcagatcatctgagtgagaccgaccgcgtgcaggcgcgggcgattctggagtcctcccgcaccacgctgcggcacacggtcgagcgagccatccaggtggcgtacgaggcagcagccccgactcggtccggcgacgtcatcgatgacgcgcacgagcgggtgctcacctcactggatcgcggcttcgatccgcagcgcccggtcggtgtcactctggccgcggctttcgccaatctgctggagcaggcgttcgacgcgacttatccggcgcatccacgcttccagccatccgacatcgaggttcggccccgcgatctgaaggccgtctacgagcacgtcgagcgtgcgatggccgatcccgaccggcgggtgccgctgcagggcgatatcgctgccgtccgccgggtggccaatccgcttggggtcggtcacgccgccgagacccacttcgtgttcggcgacgaccgactgcagccgtgggcggcggagttcgagcgcgagctgggccgacgaggcaacgccactgggcctgtgaccgtaggagaggtcgagcgctggatcgagagcatgaccccgcccaacgggctccgatccgaggtcaagcacctcatcgtgctggcctgggcggcactgcggcggcgcgcctggttcgcgtacggagcgcctattccggcacctgcgccgggcgctctccgtccggagatggagatgcgagagcaggccatgccggagccgacggactggtcggtggctaacgatcgggccgggcggctgttcggtaccaccggggggcggcacctcactccccaggccgtggctgatctggcgcagcgggtcaaggaggcggtgcaggctcgctatcaggcggtgcaggatctggttccggcagtggagcgggcgtacggacgtgttgatcttgatgccggtggcgccggtcagcgcctggccaccgccaagtccgcggccgagctcacgcaggtgctgcgtcacctcgacggggtcgacctcatccgtcggctcgccgtggccgatgtcggcaacgagaccgccttggcccggtccatgtctactgccggcgccgttgcctccgcgctcggccagttccgttgggaacggttgcggccgctgcaggacgctcaacgcggcgagggtccccgagcagagcaggccgctgacatcctggaggacgtgcgacgcagcctggagtccgacgagatggtggtcggcatcgtgggcgcgctcgaacgggcggagacggccctgttcacttggctgaccccaccgactcttccggattctcccgtgcggcgccaggatcaggagcagcagcggcggacccacccttcggctggccgccgaaccctcgctgccggggacagcccggtcgctgtcgtctcggagctgcaggctgtccgggacgcacacccgggcagggcgatcatcgtggaatggcacgtcgaggaatga

SEQ ID NO: 182 - DNA, 3807 bp, Micromonospora aurantiaca
gtgacgctgctgcgcgacctgatcgacatcccgacgtccgtcggcgaaggggacttcgtggtgaaggcggccgagggtgccgacctgcaccggtacgtcgtcaccgaccagctacgcgacaacttcgctacggcgttgcagcggatcggccacgcgatcaccaccggccgctcgcaggccatgttcctgcacggctcgttcggctccggtaagtcgcacttcatggcggtgctgcgggagatcctggcgcacaaccccgaggcccggaagatcaaagggctcgagggtccggtggtcgcggccgattcctggctccccggccggaagttcctcaccctgacgctgcacatgctcgacgcgcgctcggtcgagcaggcgatcctcgaaggctatctgcgccagatcaccgccgcgcatccggacgcgccagtacctgccgtacaccggtcggatgcactgttggacaacgcagcggggctgcggcggacgctgggcgacgacaagttcttcgcggcgctgcgtggtggcgccgccgcgcccggcgcgggcggcctcggcctggccgcgatgcgggcccaggccgaggggtggaccccgcagcggtacgcggaggcggccgctcagccacccggcacgaaggaccgcgacgcgctcgtcagtgcgctcacccagacgttcttcagcggcgcggtgcacagcgccgaatatctcgacctggacagcggcctcgcggtcatcacccggcacgccaagtccctcgggtacgacgggatcgtcctcttcctcgacgagttgatcctctggttgtccggccgcatcgccgactacacgttcgtcaacaccgagggagcgaagctcaacaagctggtcgagtccgcagacgcggcccggccgctgccgctgatctccttcgtcgcccggcagcgcaacctggaggagttcctcggcccgcaggtcggcggcacagagcgggaagcgctggcacacgtgatgcgcagcgtccagggccggctcggggagatcgtcctcgccgacaccaacctgccggagatcaccgagaagcgcctgctgcaccccaacgacgaggcggcgcgggcggtcatcgacaacgctttcgccgctgtccggcacaaccgcgaggtgtgggacatcctgctgctcggcgcacagtacggcgacgccggcatcggttccgacgccaccgccttccgccagctctacccgttctcgccggcgctggtggccaccctggtcgcgctgtcgcaggcgttgcagcgcgagcggaccgcgctgaaggtgatgaccgaactgctggtcgagcggcgggacacgctgaaggtcaatgacctgatcggggtcgccgcgctcttcgacccgctggttctgcacggcgaactaccggatcgcccgaagctacgccagcagttcgacgccgcccgcaacctctatctgcgcaagatgcgcccgctactgctcaccctaaacggcatcgacgacgagcgggcagcagcacacacccagttccagctcgacgacaagctggtcaagaccatcctgctcggcgcgctggtgcccgaggtgccggcgctgcacaacctgaccgcggccaagttgcacgcgctcaacttcggctcgatcgcctcgccgattccgggctacgagaacaccatggtgctcacccggctgcgcaagatctcccaggacgcgggagaactgcacctcaccgacgaccatgacccggtcgtgtcgctcaagctgcacgccgtcgacttcgacaagctgctggacctggtgccgcacaacgagacctcggccggcgtacggcagcaactgctccgcgagctgatcagcgcggagatggggctgaccggcaccgaggggagccacggtgagttgcagcacccccgcgagtggcgagggcggcggcacgtcgtacaggtcaagttcggcaacgtccgcgacccgctcacgatgccggtcgccgcactgatcgctcctggcgaatcctggcgagtcatcatcgactacccgttcgatccgcaggacttcccccgcaacgcggaccgggcccggatcgacgagctgccgcgtggctccaacacggtgttctggctaccgctgtacctgaccgacgacatgatgagccgggtcgcccagctcgcaaagatcaactacttgctcggcgtgggtggtgccggagagcggctcaacacacttgccgccgactggccccaggccgaccggcaacagggtcgcgtttacctgctgcagcgtcagacccagctgcgcgacggcctgatcaccgcgctcaagcaggcgtacggggccgcgactccgcagccctccgacgtgcattcggacagcgtcggcgtgctgcacacactggccgacggcctgcgcgtcggcgacccgaggggcgggacgctcgccgacgcgttccgcaacctcaccggtgagttgctggagtggtcgtacccgggcacccccgcgctgccggtcgacgagaagccgctcgcccgggccgacctgctgaaggtgttcgaatacgccaagcgcgccgccgccgaccccacccacggcgtctccatcgactccccggcagaccagaagacgctgcgccgaatctgcaacccgctgcagctcggtgaggtggtcgaccaccgctacgttctcgacatcagcacctgcttctggagccggcacctgctgcaggaggcggcccggcaggactaccgggaccgctggccggtacacgtgttgcgcaagctgctcgacctgccgaaggcgcgcggcttcgatcgggaactgcaaaatctgatcatcgcggtcttcgcgttcgagcagcagctcagctggtacgacaacggtggcaagatcagcgtagcggcggtcaacggcgtggaggaccgcttcgagctgcgccacccaccgatgccggacgacgagacctggaaggcggcggtgagcttcggccaacccttcttcggcgaggtcctgccccggttccgcaatccggccaacctgggcaccctggccggcaccatgcgccaggtcgcgaaccggtacgcaggcgacgccggccaactcgtcgtgaaacttgatgagaacgccgagcggctcgggctcgacccgcacgccgagaccggtcggctggccaccgcccgccgggttgcgcagttcctctccgaggtagcgcaggaacccgacgacgtggtgctcgtcgcggtggtcgccgagggcgagccgcgtctcggcggtatggacggccacgctgcgagtcaggtgttcaagcaggcgcggcaactcgttgatgcgcttgctgcggctcagtggtcggtgatcgacgccatcacccggcgtgcgtgggcacaggaggacgcgcgcgcccggctcatcatcgaccggctccacgccgccggacgggacgagcagcacggtacggacctggctgaggcgctgcggcaggcggtcgacgcgtcggtcgagatgctcgccgcacaacggatcactccgcacccgcttccgccggcgacacccatttcgccggatccgacgcaacgggtcgttccgtccggtggtccggcaccagtggtcgacccgggacggccggacgtcaggccggcgattccgaagcctcgggagaacggcagcagcgcgctcgccgacccggacccgatgactggggaggcggtcgtgcacgacgcggcggccctggaaaaagttgtcggagagctcaggaaagagatctccgcaggtcgccgggtcatcatcagctggcgtgccgaagcgccggagcggcagtcgtga

SEQ ID NO: 183 - DNA, 3693 bp, Mycobacterium gilvum
atgagcaccttgcttcgtgatgtcatcgacatccccgaacgcgtcggcagcgacgactacgtgctgcggctgaccgacagcaccgatgacgacgcgcacatcgccgccaccctggacgcctacgtgatcaccgagtcgttacgcgagaacttcgacgcagcattggatctggtggccgatgcggtcaaccagaacacctcccgggcggcgtatctgaccgggtcgttcggctccggtaagagccacttcatggccgtgctgtacgcgctgctgggcaaccatcccgcggtgcggacatcgaagttccaggcgctcaccgggcactacgacggcgagttgaccggcaagaagctgctgcggctcacctaccatctgctcggcgccacgtccctggagcgggccgtgctgcgcggctacgtcgaccagatcacccggctgcaccccgaggccccgctgccggcggtgcacctgtccgacaaactgctcaccgacgccgagaacctgcgcgacaagatgggtgacgagcagttcctggccgggctggccggcagtaacggcggcggcggtggtgatccgtggggcgggctgatcggcggtggctgggatctgcctcgctaccggggtgcgctggccgccggcccggaggatcccgaacgtcgggaactggtgtcggcgttggcgggcagctacttcgggtcgttcgccgagaccgccgactacgtcgatctggatcgcgggctggtggtgatctccgagcacgccaaggcactcggctacgacggggtggtgctgttcctcgacgaactggtgctgtggttggcgttctcggtgcgcgacaccgagttcttcgcccgcgagtcgcagaagatcaccaaactggtcgaatcgtcggggcgccagcgcgccatcccgctgatctcgttcatctcccggcagatggacctgcgcaagtggttcgccgacgccggggcctccggcgccgagcaggacgccctcgaccgtgccttccagtaccagcagggccgattccgtgagatcgaactgggcgatgacaacctggccgaggtcgcccacgcccggctgctcaagccgaaagacgaagctgcccaggagatcctgaacaaggcgttcgccgacctgacccgcagcccggaggtgtgggaggtgctgcgcgacagcctcaacgccgacgacaaacaccgcggggcctcggaagccgaattccggctcacctacccgttctccccggtgctggtatccacgctgcgcaacctgtcctcggtgatgcagcgcgaacgcaccgcactcaaggtcatgcagcgcatgctggtcgaccgccgcgacaccctgaccgtcgaggacctgatcccggtcggcgacgcgttcgactacatcgtcgagggcagcgaacccatcgacagccacgccaagaacatgttcgacgccgcccacgacctgtaccgcaaccggctgctgcccacactcctagacaagcacggggtgagcaccgaacaactcgacaccgaccccgactcggtgccgcgcgggttccgaggccaggaacgcatcgccaaaaccctcctgctgtcggcgatcgccccgaatgtgcccgcgctgcgcgacatcaccgccggccgactggccgcgctgaaccacggctccatcaaggcgatggtcgccggcggcgaggcccgggtggtgctgggcgtggtgcgcgactgggcgcagaaggacgccccggagatcagcgtctccgacggcgccaacccggtgatccgggtgcagctcgccgaggtcgactaccagtcggtgctggatcgcattcgtgccgaagacaattcgggtcgtcgccgcgcgctgctgcgccggctcatccaccaggcgctgggcgtgggcaccgcccaggacgatctgggcggggcagccacccgcaccgtcatctggcgcggttcgcgccgcgaggtcgacatcgtgttcggcaacgttcgcgacgccgcctcgctgcccgagcaatcgttcgacgcccggcccggcacctggcgggcggtggtggactacccgttcgacgaggccggtttcaccagcgccgacgacatcaaccgcatcgaccggttgctggccggcggcgaccggcacaccgtggtgtggctgccgcggttcttcaccgagtcggcgatggaggacctggcgctgctggtgaagttggactggctgttcaccggcagcggagaccgctggaccgagaactccgatcacctctcggccaccgaccgcgcccaggcgctgggcatcctgaagaacctggagagcggcacccgcaccggcttcgacaacctgctcaagcaggcctacggcatcgaaccggccgacgcgaagcgcatcaccgccgactcccagcagttcgacgtgctgacctcgctcagccgcgacttccagccgcagctgccgccggcggcgaacctcgagaacgcgttcctgaacatcatcgaccaggcgttcagcgccacctaccccaaccacccgcagttcgatcccgccgacagcgaggtcaccgcccgcaacttcgaaaccgtccgcgattacgtcgagcaggccagcacccaccgcgacggccgggtccccaccacccccggcgccgaccgcaccgcggtgcgccgcatcgccgggccactgcgcgtcggcaaggccaccgaggaccacttcctgttcgaccagacctcgttcgactactgggccaccgaactcgaccgggccgcccaggccgccgacccggtgaccgtcggcgcgctgcaagcccacatcgacgtgctgtccccggcgtgggggctgcggccggaggcccgcgatctggtggtcagcgcctgggcgctgctgcgcaagcgggcctggttcgaggcgggcagcgccatcaccgcgccaccgctgggccggatgcgtcccaacatcgaactgcgcgccgaacaactccccgaacagcaggcctgggacgacgcccgcgcccacgccgccaaactgttcggctacaccatggcccgcacctacctcaccggagccaacgtcgccgacttcgccgcgcaggtccgcacacacgccaccgaagtgggcaccaaactggggcacctggtcgacgaactgcacgaggcctacggcaggttggacgccgtcgccggtgccgacgaccgactgaccgccgcacgggcgctgcacgacgcggccgacaccctgtcccgcaccgcgggaaacgtcgcggtgatcgacgccctcgcagctgtcgagctgccggtggcattggagacggccggacagatcggcgccgacgcaccccgcgacagcgtcacgctgcgcaatttcaagtggccgctggtggaggtgctcaagaccggcgcccgcaccggtggcgatgtcggtgaccgggccaacgccatctggaagtcgctgcaggaggcggtgtcgatcccgggccgctcgctgtctgacgacttgaccgccgccgaaggcaaactggtgacctgggtggtcgaacgcgaaccggtcacttcgccgcctcctcccccgccaccaccgccgccgccagtgaccgaacgcgaccgggtgctgcgcaacactgacgacctcgccgggctgcagagcgagatcaccgcggcgctgcaggattccggcaagaaggtgcatgtgcgctggtggctggaatga

SEQ ID NO: 184 - DNA, 3909 bp, Nocardia cyriacigeorgica
atggaccagcgcccactgctgcgcgacctcatcgacatcaaggaacacgtcgccggctcggactacgtcctcaccctcgccgatgcggtcaccgaggaaggctccacgaaagctgtagaggactatgtcctcaccgaccgcctactcggcaatttcgacgaagctctcgcgctgatcaagtccgcgctcgacgggaacacctccaagcccgcgttcctgcatggctcgttcggtgccggtaagtcgcacttcatggcggtgctctacgccttgctctccggcaacccggtggcccgttcccgcggcgagttcgatccggtcatcaccaagcacgactggctgctgtcggacaacaagaagttcctgatggtgccgtatcacatgatcgacgccaaggcgatggagcaacgggtgctcggcggctacgtcgagttcgtccgcaagaagcacccggaggcaccgattcccccggtgtatcgcacggacgcccttttcaccgacctgcgggcactgcgtgcctcgatgggcgaggatcgtttccttgctgtcctcaaccaggatcaggccggcgaggacgacgaatggggtgagtcgaccgcgttctggactacccagaaggtcgataccgctctgtcggcatcggaatcgcatgacggtggcggcctgaacctggtgaatccgaccacgccgccggagctgcgcgccaagttggtgcacgacgcgggcacccatctgcttccggggttcgctcagcgcgccgccgaggacgaaagcggattcatctccctcgatgccggcctcagcgtcattgccgcgcacgcgaagtcgctcggctacgacgcgattatcctgttcctcgacgagctgatcctctggctggccagcctcatccacgacgagaaacgcgtggcgcgcgaggccagcaagatcaccaacttccgtgagggtggtgatgctcgccgagcgatcccgatcgtctcgttcatcgcccgccagcgcgacctgcgcgagctggtcggtgaagagctcgcgggtgctgcggaatcggcgatccaggatgcgctcaaccatgcctccggccggttcgacctgatcagcctcgaggaccgcaaccttccacaaatcgctcatgctcgattgttgaagccgcgcgatgccgccgcgcgcgcggagatcgacgccgcgttcgagaagaccaagaagctcggaccgaaggtgtgggacacccttctcggttccgacgagagcaccaccggcgccgacgaagcgtcgttccggttgagctacccgttctcccccgcgttcctcgacacgctggtacatatttcggcggccctgcagcgttctcgcaccggcttgaaattgatgggccagcttctcgccgaccaccgcaacgagctgcgcctcggcgatctggttccgctgggcgatctctaccagcagctcacccggggcggtgaccggccgttcgtcgccgacaagaaggtgctcttcgaagccgccgacaagctgtacaagacgcggctgcgtccgtacctgctcagctcgtgcgaggtcaccgaagacgacatcgacgcctacctcaaccggcgcgagaccatcaccgatccgaagctcgccggcaactgcaagaagttcgtcggccagaaccgtcttgcctgcacagtgttgctcgcggcactcgcacccagcgttccagcattgcgcgacttgaccattcgccgcctcggcgcgctcaaccacggttcgatcacgaccatgattcccgggcgggaagagggcgtgatcaaggatatgatcggcgagtgggccgctcggttcccggagatcaaactcaccggtaccgacgtaaatcccggtgtgcgcctcgagctgtccggcgtggacgtggagctggtgctcgccaacgcacaggtcaacgacaacccatcgaaccggctcgcactcgctcgcgacctcctcgccgaggaattcggtctcgatcgcgccaacggccggttcgatgccgatgagctgcggttcgtctggcgcggctcgaatcgcaccgtggaagtgatcttcggcaatgtcagcgacgaagacgccctgcccaaccatgatctacagcccacgtacgaggggctctggcggatcgtcgtcgacctgccctacgacgagggcctgctcgggccggtggaggacgccgaccgtatccggcggctcaagcaggagcagggcggcaaccatccacgcacggtggcatggttgccgtcgcatctgaccaaaccgcgctgggaggatttccggcgcctgctcgtggtcaccaaggcgctcgctgacccgtaccggttcgatacgcaatacgctcagcatctcaatcccgacaatcgggccagcgctaagcagctattggagtcccagcgcgaaaccctgcgcaagcgggtactggccacgttcaaacaggcgtacggcttggcagaacgcaaacccgacgatgtgaccaacgatttggaccagctgttccacccgctgcccgatatcgatggcctcaccatctccatcggccagtcgatgcacgacgccatccgcacgctggcgggcaaactcctcgcccaccagtttccggagcacccgaacctggacccggacggcaccggcaccgccgtcaagcccaccgatgcgaaaaccattctcgcgcacgtgaaaggggcagccgaggcgcgcgataaccgcttcgaggttccagcgaaggaccgtgcgctcatgcggcgggtggctgaacccctcggcctgggccagcagaaggaggcgtacttcgagctgtccaggcggtgggccgaccacttccgcaagtcggcgcagaacgcgggcagcaccggcgacttgtcggtgatctcgctcggcgactggatcgacttgcctcagccgcgcggcctggaaccacacatcgccaatctcgtgatcgcgtccttcgctgaaatggacgacaggatctgggtacgtggcggcgtgccgatcgacacgcccgaactcaccaagattcacgccggggacgcgctgcgcacccagccgctaccgagcgaatcggattgggacacggcccgaaatcgtttcgaagtgatcttcggcgagaagccgccgacactgcgacgcggcgggccggtgcagctgttcgcccggcagatcagcagctccgcgacgaagtaccacgacgctgcgacccgactggtcgaacagttggagaagcatgccgagttcctcgggctcgacgacaacgaacccagcgggcggctcgcgctcgctcgtcgctcgctcgccctgttgtcggcgctcgtttctaccggtggcggcggctcggcgggcgccaagaagaccgttgaagcgctcgcccacttcgacctcgccgaggtgaacgcggaccgctatgccacctcgatcaaatccgccgagaatgtgatcgcggcgctaactcatgctgcctggcgaaatctcgaacaagccagtttgctcggacccgaaggcgccgcactgctggactctttgcggaacgtcgcccgatccgaccagcgctccgccgatctggccgacgcgctgcgcagcaccgatgccaagatcaccgcgctgacgacccgcaaactccgtgaggaggacgagcgcaagcgtagggaagcatctccaacaccgatctcaccgatatccgaggggaccacgagacgcaccgccgaagcggatgatgtcgacctcgggacccgaacgagcaatccgccgctcgatggcagcacaccgcagagcacgcggtccaggcgtcggtccggcaaatacaccacaactgctcgtgatgcggtggccaagttctctgccgaggtggccgagctcgccgagctggaacccggcgcctcggtcgaaatcctgtggcgggtcatcgaatga

SEQ ID NO: 185 - DNA, 3723 bp, Polaromonas naphthalenivorans
atgaccctgctgaaagacctgatcaacattcccgagcgcgtgcaccaaggcgactttgtgctcaagctgtccgaaggcgtgacccacgcggacgccacgcttcgtgactacgtggtgacgccgcagctggtcgatgcctttgaaaacgcgctgggcttcatcaagcagtcggtcgagtccagcggcagcaaggccgcttacctgcacggcagtttcggctcgggcaagagccacttcatggccgtgctgaacctgctgctggcgggcaacacgcaggcgcgctccatccccgaactggccggcgtggtggccaagcacggctggacaaacggcaagaaattcctcctggtgccctaccacatgatcggcgcgcgcgacatggaaagcgccatcctggggcaatacgcggagtttgtgcgcaagctgcacccgagcgcgccggtgccgggtttttacctggccgaagggctgtttggcgatgcccagcgcatgcgcgagcagatgggggatgcagccttttttgccaaactcaatgaagccggtggcggcgctggaggcaacagtggcggtgacaacgcgggctggggcgacatcgacagcggctgggatgccacccgctttgaggcggccacactcgaagcgcccaatggagaagagcgctcgcgcctggtgggcgacctgatcacccagttcttttcagcgtaccgcagcctggccggcgggggcgagtcgtttgtctcgctcgacgatggcctgagcatcatgacccggcatgcccaagccttgggctacgacgccgtgatcctgtttctcgacgagctggtgctgtggctggccagccatgccgccgatgtcggctttgtgagccgcgaaggcaccaagctggtcaagctggtggaggcgaccaatgccgaccggccgattccgctggtcagctttgtggcccgtcagcgcgacctgcgcgacctcgtgggcgagaacctggccggcgcggtgcagtcgcagttcagcgatgtgctccgccactgggaagcgcgctttcaccgcatcacgctcgaagaccgcaacctgccggcgattgccgaaaagcgggtgctgcgccccctcaacgaagcggcgcgccagattctaaaagccgagttcgagaagatcctggcggtgcgccgcgacgtgctcgacacgctgctcaccacatcggctgaccgggacatgttccagaaggtctatcccttcaccccggccttggtgcaaacgctcattgccgtctcggccgctttgcagcgcgaacgcacggcattgaaactgatgatgcagctgctggtcgatcggcgcgaagatttgcagctgggccagctgatcccggtgggcgacctgtacgacgccatcagcgaaggcgacgagcctttttccgaaggcatgcgactgcattttgacaatgccaagcggctgtacaaccagcggctgctgccgatgctggagtcccagcaccaggtaacgctcgaagccatgaagctcggccaggcggactcgacggcggccagaaatctgcgcaacgatgcgcggctcctgaagacgctgctgctggcggccctggtgcccgaggtcgagtcgctcaagggcttgaccggcgcccggctggcggccctgaaccacggcaccttcaagtcgccgattcccgggcgtgaagcgcaggacgtgctgcgcaaatgccgggactggtcgtcgcagattggcgagatcaaggtcaccgacgaccagaacccggtggtgtcgatccaggtcacgggggtcgatattgagcccatcctgcgcgccgccgaagccatagacaatgccggcaaccggcgcaagaagattcgcgagtcgctgtttgccgagctgcgaattcccgacgacggagccttgttcacgacctacggtttcacctggcgcggcacgcaccgcgaggtcgagctgctttacgaaaacgtgcgcgagatgaccgacgaccgcctgcgcggccgctcgggcgcgtggaccgtggtgctcgattttccatttgacgagcccaacttcacctccaacgacgacattgcccgcctgggggactactgcggcggcgacaccaagacgctggtgtggctgccttcgtttttcagccacaaggcgctggccgacctgggccgcctggtggtgctggaccacattttgtccggcgagcgcttcgagagttacgccacccacctgagctttgtggaccgggtgcaggccaaggccctggccaagaaccagctggactccttgcgcagcaagctgcgcagccagctggaagtggcctttggcatcagcaccgagccgcgcgatgcggtgacccaggtgctcagcgcggatcagcagttctgctcgctcgaccccaccttgtccccgcgcccgccggtgggcgccagcttcaaggaagcgttcgaagccctgctcggtcagctgttttcgcaccagtaccctggccatccagaatttgacaccgagatcaagccaggcgtcattcgaaaaatctggcctgagatgcagcgcgcgattgaagcgcctgaccgccgcgggctggtgcccgattcagccactcgccgtttggtgcgctcggtggtgtttccgtgtcagctgggacaaatgggcgagacgcatttgctggtgcaagaccactggcgcgcccgctttgcgcaaagccatgcgcgcgatggcggcggcgcgatgacggtagcgcaattgcggcgctggatcgacatgcccacgccgatgggactgccgctggagctgcaaaacctgatcatcctgagttttgccgcgatgacgaaccgccgcttcattttgcgcggcggcccggtcgagcccacccttgacagcctggccgatgagctggagttgcgcgagcaagccctgcccgatccggcccactgggcgacggccgtcaaacgcgccgcctcgctgtttggcttgatagtgtcgcaaacgctcaacgccggcaacgtaggccgcctggtggacgaggtgcgccgcgaggccggcaccaaacgcgaagcggtcggcaccctggtggcatctgtgcgggaccgcgccacgcgctacggtgcctcgatggcaggacgggtgcgcaccagcgaatcagcccaggcgctgctggcgacactgcaggcggccagcgacgccgaactggtgcaggccctggccagcgcgagcgtcgagacctcggaagcggccgtcgggcgcagcatggggcaggccccgcaggtggcgcaggccttgagcaatgccaagtggagcattttcgattcgatgcgcaacctgcaagaccatcgtcaagccgcagcagcgtcgatcctgagccgcctgacggaggtgcttggcagcgatgagcatgtgattgcgctcaagccccggctggaagagattgaacgcgatgcggtgcatttgctgaccatggcggcgcccacaccgccggtgccgccactgccaccgcagccgccgatcatctcgcccgtgcccttgccggtcattcccgacccggcgccgtttacccgcaatggaaccccgccttcagcagccgaattcgtggatggcgatgaaaaaatgggcctcggtaccgacgaagccgcatcgctcttgaaagacttgcaggaacggcttcaaggcgaccctggactcgagctgagtctgagctggcggcttgagcgccggagcgcgcagccatga

SEQ ID NO: 186 - DNA, 3858 bp, Saccharomonospora viridis
gtgagcacgaacgaggtgtacctgcgcgacgtcctcgacatccccgaatccgtccacgccggggacttcaaagtcgaactcaccggaggcttcacccaagtcgaagcccgcgtcgccgaatacgtcgtcaccgaccaactccggcaagccttcgacaaagccctgtccatcgtgcgcgccgccgtgcgcgacggcacctcgcacgccgcctacctgcacggctcgttcggctccggtaaaagccacttcctcaccgtgctgcacgccgtgctcaacaaccaccccgcggcacgggccaaacccggcctgcaacccgtcatcgccgaccacgacgactggctgcgcggcaagaaattcctcatggtgccctaccacctcgtaggcgccaccgacctcgactccgccatcctcggcggctacgtcaacaccgtccgctcactgcaccccgaccagcccaccccgcccgtctaccgggcggacgccatgctcgacgacgcccgccgctaccgtgaagccagaggcgatgacgcattcgtcgactggctcagcatcggcgccaccacgcccgtcccaggcacacccgacgaggacgacgacctcgacctcgacatacccgacgacaccggcatcaacgacaccggatggaccagcgaacaactcgaccgggcattcaccgcacccgccggcgacccggttcgcgaccggctcgtccaagccctgctgtccggtcccatgtcctcctacatccgcggggccagcggcgacgccgaagcgttcctccccctggagaacgggctgtcgatcatcaccaaacacgcccgggacctcggctacgacgggctgatcctcttcctcgacgaactgatcctgtggttgcaggcccacatgagcgaccgccagttcgtcaacaaccaggtcagcaaactcgtcaaactcatcgaatccggcgacgccggccgagtgctgcccatcatctcgttcatctcccggcagcgcgatctgtccaaactcgtcggtgaggacgtcaccggcgccgaggtcaaagagctcgaacggcaggtcgaatacctcgccgggcggttcgacaccgtgcccttagaagacagcaacctgcccgccatcatcaaagaacgcgtcctcaaacccaaacccggcggccgggagatcctcgacgccgcgttcgccggcatcgaatcggccaaacaagccgtccgcgacgtgctgctcgacgcggacggagccaccggcgccgactggcaggacttccgcgacgtctacccgctctcacccgccctgctcaacgtgctcatggcgttgtccggtgcactacaacgtgaacgcaccgggctgaaactgctgcaggagatgctgcgccgccgccgcgacgacatgaaagtcggcgaactcatccccctcggcgacctgtgggacgtgctcgccgacggcatcggcgaagccttcaccgaccggctacgccgtgaggccgaagccgcccaacgcttctacaccaaagcccgcgcctggctggtcgaacgccacggtggtgagcacacccaacagttccgcgccaccgaccgactcgtcaaaacgctgatcctcgccgcgctcgcgccgcaggtgtccgcactcacccggctcaccggcagccgactcgccgcactcaaccacgggtcgctacgcgcccgcaccgtttcggccggctcgctcgccgtcaccaggctgcgcgaactccaggccgaattcggcgaactacgccacgaaggcgacgaggaccccgtcttccggctgcaactgtccgacctggacgtcgaaccgtacctcgacgcggtcggcgaacaggacacccccggcgcgcgccgcatctggatcagaaaacagctgtggagccagttgggggtcaacgacaccgacgacttcgtgtcggaaaaagagatcgtctggaagggcacccggcgcaccgccgaattcgtgttcgccaacgtgcgcgacgaacgtgaactgcccgacgtgcagttcatgcccagcacccccggccgtatccggttcatcctcgactacccgttcgacggctccggcgactacacaccccggcacgatgccgaacgcatccaccggatgcgccgcgacgacatcaccgcggccaccatcgtgtggttgccgcacttcttctccgcgcagaaatccgcccagctcggacgccttctgaagatcaaatacctgctggagcgcgaccggctcgacgactacgtcagaaaccgctccgccgacgaacgggtcaagatccgccaccagctcgaagcgcaatgcgacaccctggaaaaccagctcgccgccgcgctgcgtcagctctacggcatcgccggcggcgacgacaccaccgtcggcgcgcccgtcggcgaagacggacacgtgatgtcgctgtaccccgaccacaagcccagactggccggtggtgcgggattcgaatacaacgcgttgaccctggccgacgggttgttcgacaagctctacccgaagcatccgaacttcgaccccaccggcaaccgcaaggccatcaccctcggcgaactgcgcacggtcctcgactggatcaccaaggccatggaggacggcagccgacgagtggtggtggaccgcaaccacctcgccctcgtgcgcaagatcgtccacccgttggagctcggtgaggtcagcgacggaccgctcaacgtctccgccgaatggcgacgccgcatcgaacaagccgccacccaacacggggtgaccggcgacctgcgtgtggaagacatccgctcgtggatcgccgacctcggctacaccgggctcgacaaacccgtggtcaacctcatcatcgccacctacgcgatgctggccgaccgcacctggaccctgcacggcagcgtgctgcggcaaccacccgaactcgacaagatcggaccgggtcacgccctgcgggcccagcaactgcccgacgccgccgagttcgccaccgcccgagaccgagccgccgtgctgttcggaatcgtcgtgcccgacaccctgttcgcccgcaacgtcagccggctcgccgaaggtgtgcgcgccaaggtcgcggaactggagacaccggtcaacggggtgcgacggatgttggaacggcacgccgacacactcggtctcacccaccggcccgacgcgccgagagtggtcgccactcgggacgcggccgacctgctcgcccggctgtccggtgccgccgaggacaccgatctggtgaaccggctcgcgaaagccacctacggtaccaacgacaccgtgctcgccgccaccatggcggccgctccccggttgctcgagtcgttacgcgacgtcgaatggtcgctggtgtcgtccgtgcaaggcttcgcaggcaggggcgacctcatcggcaaccgcgccgacgcgctgctcgacgaagtcggacacgccgccgccgaggacgagttcgccgtctcgctcgcgcccgtgctcgaacaactccaatccaaagccgtggccttggtcagcgatgcggcccgactcaccgccgtggccactcctggccccgtcagtcccgtccgcacggacacggagaacacatcgagcggacaggccgccggagccgacacggtgagtctcaccgacaccgggcagcccggtatcagccgccacgaacctgaaccctcggccaccccgtcccatcgcgcaccgcgccgcctgcgggccagtgccgcggaacgcgacctcgccgcgctgctcgagggcgtgcgtgacgagatccgcgactacgcccgtgaacaccccggagcggagatcgagatcctgtggcggacggtcgggggagaggacaacgcggaatga

SEQ ID NO: 187 - DNA, 3822 bp, Saccharopolyspora erythraea
gtgagccagacgtttctgcgcgacgtcatccacatcccggagtcggtgcactccggggacttcaaggtcgagctttccggggggttcggcaagaccgccgagagggtcgagcagtacgtcgtcaccgaccagctgcggaccgcgttcggcaaggcgctgtcgatcgtgcgggccgcgctgcgcgacggcagttcccatgccgcctacctgcacggttcgttcgggtccggtaagagccatttcctgaccgtcctgcacgcggtgctcaacgacgacccggccgcgcgggcgaagctcggtctgcagtccgtcattgccgacaacgagtcgtggctgtccggcaagcggttcctcatggtgccgtaccacctggtgggggccaccgacatcgactcggcgatcctcgggaagtacgccgaatacgtacgcatcgaacacccggacgcgcccgtgcctgcggtgtaccgatccgatgcgctgctcgccgacgcgcggcgactgcgcgagtcggtcggtgacacgaagttcatcgagatgctcggggagtcctcacagcccgccaagtcgggcagcggtggcatcaaggacgtgccgaacctcaagcggaagccgtcctcttcgtgggagtcgtccacactggacgctgcgttcgccgcgccggtgggtgacgggaatcgggacgcgctggtgtcggcacttttgtccgggccgatgtcgtcgtaccagcggggcgccagcggcgacgagaaggcgttcatccccctggaagacggcttgtcggtcatctcccggcacgctcgcgacctcgggtacgacgggctgattctcttcttggacgagctgatcctgtggcttcaggcgaagatgtccgaccagaagttcgtcaacgagcaggtgcagaagctcgtcaaactcatcgagtccggcaacgccgaccgggcgttgccgatcgtttcgttcatctcccggcagcgtgatctttcgcagctcgtcggcgacgatatcgccggcaaggacgtcaagaacctcgaagcgcaggtgcactacctggccgagcggttcgacaccgtgtcgctcgaagaccgcaacctgcccgcgatcatcaaggaacgcgtgctcaaacccctgccgggcggtagggagatcctggacgaggcgttctcgacgatcgagtcgagcaaggccgccgatcgcgaggtgctactcgacgcggacggcgccaccggggcgtcgtgggagaacttccgtgaggtctatccgctctcgcccgcgctactcaatgtgcttgtcgcgttgtccggggcgctgcagcgggagcgtacggggttgaagctgctgcaggagatgctgcaccggcggcggaacgacatgaaggtcggggagctgatcccgctcggcgacctgtgggacgtgctcgtcgacaacagcggtgacgcgttcaccgaccggctcaagggcgaagcagctgcggccacccggttctacgcgaagtcaagagcgcacctcgaagcaaaatatggttcgggcagccaggatttcgtcgcggtcgatcgtctcgtgaagacgttgttgctggcggcactcgcgccgagtgtgtccgcactgggccggttgaccgggcagcggctggctgcgctcaaccacggctcgctgcgctcgcggacggtgcaagcggggtcgctggtggtgtcgaagctgcgggacctgcaggctgatttcggggaactgcgctccgagggcgacgaggacccggtattccggctgatgctgtccgacctggacatcgagccactgctggaccaggtcggtgagcaggactcgctcggcgcgcggcggatctggaccaagaaacacctgtgggccgagctggggatccgcgacgccgacagcagagtcgccgagcgcgaggtcgtgtggcgggggactcgtcggaccgccgagttcctgttcgccaacgtccgcgacaccagcgaattgcccgacgccgacttcgcgccgagcgtgcccggacgggtccggttcgtattggactatccgttcgatgatcctgacaagtctcctgctgacgacgccgcacgagtcgcccggctgcggcgggacgagcacgcgccgacgatcgtgtggctgccgcacttcttctccacccagaaggctgcgcagctcggccgactgctcaagatcgagtatcttctggagcgggaccggctgtccgactacgcgggcacgctgtccgaggactcacggctgaagatccgccaccagctgcaggccaacgccgacaacctccgcacccaactcgtcgccacgctccggcagctttacgggatcgcgcaggtcgacgagaacgcggtgggccggcacgtcggcgaggacgggcacctcatgtcgctgcagcctggccacaagccgaggccgtacggcggggccggtttcgactacaacgtgctcgcgctggccgacgggctgttcgacgtgctgcatccaaagcacccggacttcgacgtcaaccgcaaccgcaaagcggttacgaacgccgaactgcgcaccgtgttttcctggatcgcgcaggccgctgagaacggcggtcgcgccgtcgtcgacgcgaagcaactgccgctggtgcgccgaatcgtgcaccccctggagctcggcgacgtcgctgacggtcctcttaacctgagctccgagtggcggagacgtatcgaacaggcggccgcgcagcacggcgtctccggcgactaccccgtcgacaagatccgcgaatggatcgaggaactcggctacaccggtatggacaaacccgtgctgggcctcgtgatcgccacctacgctctgctggccgaccgggcgtggctcatcaacggctccccgctgggtgagacaccggacctcgacaagattgggctcggccactcgctacgcgcccaggaactgcccagcgccgaggagttcgcgcgggcgcgcgagcgggcggccgtggtgttcggagtaaagatcgcggagacgctgtctgctcgcaacgtcgggaagctggcgagcgcggttcgagtgccggcgaaatcgtccgaagaggcgttgtcgcaggtccgccacgcgctggagaggcaccacgcgaagctgggcattgcaggggacgcgccacggatcacctcgacgctggacgcgtccgatctagtggcccgtctggtgcgtcgagcggacggtgacaccgcgctcgtgcgcgagctggcggcggccgagtaccgcacagccgacgcgtcgcttggatcggcgatcacgtcggctccaagcctggctacggcgctgacgaccatcgaatggcagcttgtcgactcggtgcggtcgttggtcggtggcggcgacccggtatcgaaccgagcggaaggactcgtcgaccagctggcggaggtcgcctcggctgacgaatggacgcgggatctcgcgccggtgttgcaagagttccggcccgcggcgttgcagctgttggcggacgcgttggaacgggatcggcggagcaaggaggcggagcgggagaaggccgggcccgacgttccgaacccgccgctgccgccagctccctctaaggccgatgacatcgccctccccgataacgggagaccgtcggtatcgggaacgattgggcacccgaccgagcagagaaatccgcggaccaccaagcgcgttcgggcgagcgccgtcgaggaccgcctcgccgagttcctcaatcagctcaaagacgagatcggtgaacacgcggccgcgcaccccgacgacgaaatcgagatcacctggcacgtcgtccgtgacgaggaagcgcgatga

SEQ ID NO: 188 - DNA, 3657 bp, Saccharothrix espanaensis
gtgaccaccgccgcgtcgggttccgcgccgctgctgcgtgaactcatcgacatcccggaaggcgtccaccggggcgacttcgtcctcaagctcaccgagggtgtcgacagcaagcgcgacgacgcgctccgcagttacgtggtcaccccgcagttgcgggtggcgttcggcgaggcgctgaagctgatcaagtccgcgctggacgagcacagctccaaagccgcctacctgcacggctcgttcgggtcgggcaagagccatttcatggcggtcctgcacgccctgctcgacggtgactcccgggcgctggaccgacccgacctggccgaggtcacgacccggcaccggtggctgggcgagaagcgcttcctgctcgtcccctaccacctcaccggctcggagagcctggaggccgcgatcctcggcggctacgtggaccacgtccgccggtaccggtcggacgccccgattccccaggtctatcgggcgcaggggctgctggaggacgcgcggaagctgcgcgagaagctcggcgaccagcagttcctctccggtttccccaacgaggccgacaccggctggggcgatctgggcgcggtgatgacgccggagaagctggacgaggggttcgacgcgccgatcggcagccccgcctccgacaacctgatcaccaaggtcgtccaggcgtacttccccaactacgtcgactccgtgcgcggcgcggccagcgcgttcaagcccttggaccagggcctgtcggagatcagccggcacgccaagtcgctgggctacgacggcatcgtgctcttcctggacgaactggtgctctggctcgcgggcaagatcggcgaccaggcgttcatcagccgggagaccgagaaggtcgccaagctggtcgaagccggcgacgcccaccggcccgcaccgatcatcagcttcatcgcgcgccagcgcgacctgcgggaactcggcatcggcgcggaccgcaccggcgcggaactccagtccttccacgaccgcctcaaccactgggacggccgcatcgagaagatccccttggaggaccgcaacctcccggtgatcgcccgggaacgggtgctgcgcaggctgcccggcggcgaggagcaggtgcggcaggcgttccagcgcaccggtgccctgcccggatcggtgcgggacgtgctgctgggcagcggggacggggactcgttcgagcgcacctacccgttcagcccggcgttcatggacacgctcgtgcacgtgtcgtcggccctgcaacgggagcgcacggcgctgctgctgatgcggcagatcctggtcaaccggcgggacgacatcaagctgggtcaactggtgccgctgggcgatctgttcgacgccgtcgcggacggcgccgaccagccgttcaccgagcagctcaagcacgagttcgacgaggctcgtctgctctaccagcgcaccctgcggccgatgttgctgcgtgaccgcgatctgcgcgaggagcaggtcgccggtcaggccgcggtcgggccggcagtgctgcaggcattccgcagcgacgaccgcctggtgaaaacgctgctgctggcagcgctcgccccggacgtggacgcgctgcgcgacctgaccgcccggcggctgaccgcgctcaaccacggcacgatcaccacccccatcccgggccaggaagtcgccgaggtggtgcgcaggctgcgcagttgggccagccgggtcgccgaactccaactcggcgagggctcggacccgagcgtgcggctgaacctggtcggcgtcaacgtcaacgccatcctggaacgggtcacgacgctcgaccagcagccggcgcgccgcaggctcgtgcgggaactgctgttcaaggaactgggcgtcaccgacaccgggaccaccccgatcgagcacccggtggcgtggcgcggcagcaggcgggtgctggagatcgtctacggcaacgtgcgggaccagcaggacctgcgggacgacctgttcgagccgtcttacgacgaccgctggcgactgctgctggactacccgttcgaccccgacagcccctcggccgcggacgactaccaccgggtggtccgactgcgcgcggagaagggcaaccggtccgccgtcgcgtggctgcccggcttcttcacctcggacgtgctggacaagctcggccggttgatcaaggtcgagtacctgctggcggaccgggcccggctggaggagcacacccgcacgatcggagcagaggaccggcaacgcgcccgggacctgctgggcaacctgcggacctcgttgcactcggagctgaaggaagcgctcaagaacgcctacggcctggtgaccaggccgaaggaggagatcgtccaggactggcacgaccacctggtgagcctcgacgccaccgtgacgccccgggtggacgccggccgctcgttcgccgaggcactgaagtcgctggtcgaccaggtgcactcgatgacctacccggaccacccggacttcgacccgcaacgaaagggcgacctcgtccgggacgcggacctgcgcacgacgctcaccatcatccggcgggccgccgacgcaccggagggtcgggtcgaggtcgaccgcccgcatcgcgaggcgttgcgccggatcgcccacccgctgaagctcggcgaggagcacaacggaccgttcgtgctcagccgccactgggcggacgagttggagcggcgggccgcgcgggagcacgagcaggacgccgacctgccggtgcgcacggtgcgcggctggctgcgcgacctgggcatggaacgccgggtggagaacctcgtcatcgccacgttcgccgaactcacgcaccgggcgtggcggcaccgcgaccgcctggtcgacccgccggagagcccggaagcagtcgccgacgacatggtgctgtaccggcaggcgctgccgacccccgagcagtgggaccgggcctgcctgctcgccgccgcgctgaccggcaccgacctccgcactgcggtgatctcgccgcgagcggtggcccggttcgcccgcgtggtcggcaagaaggtcgaccaactgcggctgcctgccgtcggtctcgtcgagctgctcgaccagcacagcggacgcctgggcttggaccgctcggcttcccggggccgctacgccacggcggtggccgcgagcgacctggccatcgaactgcacaccgtcacggacccgaccgggctggtcgccgcggtcgcggcggccgacctgcacgacatcgagccgatggtgatcagccgatcgctggagaccgcggaagacgtgtccacggccctgcgcgccgcggactgggcgatcttcgagatgctggacgacccgactgcggccgacatcgcggccgagctgcgtcagggtgtgaacgccaacgagcacgcgacaccgctgcggcgtgcgctcgaccaggcgaagcgccggctgatcgcgctcatcagcaagccgacgccgccgcctccgccctcgccagaaccgactccgctgaatcccggtggcggtgtgcaccaggcgaccggcaggctgaccgacgtgatggcggagctgacgaggttcggcgaggagcaccccgacgtcaccatcgaggtgacctaccggatcgtggaacgcggatga

SEQ ID NO: 189 - DNA, 3708 bp, Singulisphaera acidiphila
atgcccgagcggctcatcagcgagcttctgatccttccggagcgagtccgcaagggggacttcgtcctcaacctctccaaaggggtcaccgatccaaagaagacgctcgaggactacgtcgtcacgccccaactcgtcgagtgcttcgacgacgccctgggattcatcagctcggccgtcgacgcggtcaacagcaaggcgtgctacctgcacgggagcttcggcgcaggtaaatcccacttcatggccgtgctccacctgctcctgaagcacgacgccgacgcgcggtcgttacccgatcttgccaaggtctgcgccaagcacagttgggtcgagaacaagaagttcctgctcgtgccgtaccacatgatcggcgcccggaacatggagacggcgatcctcggcggctacgtcgatcacgtgatggaggcccaccccggcgcccccctgcccggtgtctacctggccgacgagatcttcaagaacgccgtacagtaccgccagcggctcggggacgagaagttcttcgaggacctgaaccaggggcagaaaaaccccggcagcgcgggctggggcaagatggccaagggctgggatgcaccccggttcgaggccgcgatggaagcgcccccgtccagccaagaacgcagccggctggttggcgaccttgtccaatacatcttccccgccttcaaggggatcgctcaggggaaggacgaagcctacgtcgacctcgatgtgggcctcagcatcatcagcgctcatgccaagtcgcttggctatgatgccctgattctgttccttgatgagttgatcctctggctcgccacccactcggccgacctgggcttcgtccagaccgaggggaacaagctggcaaagctggtcgagtcccgcaagtcggaccgccctgccccgatcatcagctttgtggcccgccagcgggacttgcgcgatctcatcggcgacaacgtgacgggagtcgagcaactcaacttctcggacgtgctcgctcactgggagggccggttccacacgatcacgctcgaagatcgcaacttgccgctcatcgcccagaagcgggtcctgcggcccaagaacgacgtgtgtgcggccgagctgaacgaggccttcgagaagacggcccaggtgcgccaggagatcatggagatcctgctcaccagggaatcggaccgggcgatgttcaagcaggtgtatcccttcagcccggccttgattcaggcgctggtcgcggtgtcgagcgcgttgcagcgggaacggaccgcgctcaagatcatgctccagctcctggtcaatcgccgggacacgctccggctcggcgacgtcatcccgctcggcgacctctgggacgtggtggcgcacggcgacgaggcgttcaccgacgtgatgcgggtgaacttcgagaatgccaagaagctctaccaggccaagctccggcccttgctcgagcagcagcatcaagtcgacctggaggtggaccgggagcgggcagcggacagcgaggaggttgcggcccgcctgcggctgttcgagaacgacgatcggttgatcaagagcctgctcttgtcggctctcgtccatggggtcgaggcgctcaagaacatgacctgcatgcggctcgccgcgctcaatcacggctcgatccgatcgcggattccgggccgggagcatcaggtggtcgcccagaagttccgcacctgggcggggatggtgggcgagatccgggtcggcgaggagccgaccaatccgaccgtgtcgatccagctctcgggggtcgacaccgaggggatcattgaggccgcccgggtctacgacaaccccggcaaccgccagttcaagttgcggcagatgctgttcaagtcgatgaacgtccccgagcaggacgagatgtatatctcgcacgccttcgtctggcggggaagtcggcggtcctgcgacgtgctgttcaccaatgtccggtccttgcccgacgactcgctgcgctccggggatgagtggaagctggtcgttgacttcccgtttgactccgaagggcactccccgatcgaggatctggatcggatcaacaagttccggaacaaaaaggagaagccgcggaccctggcgtggctcccctcgttcttctcgcctcgaacccagacggagcttggcaagctggtcatcatcgagaggctgctcctgggcaacaacctcgaccagtacgcccagcacctctcgctccaggaccggcagaccgcccggctattgctccagaatcagcagagcgccttgtctcagcgactcgtccaggcggtggaagcggccttcgcgatccgctccgagccgaccccgggaacgctcgacgactcctacgacatgtcggagtcgcatttccagtcgctttacccgacgctcgtgctccagcggcccgtcggggcgaacctcggtgaggccctcgagcatctgctcgaccaggccttaacgcaccagtttcccaagcaccccaagttcggccaggagatcaagcctgggaaggatctccggcaggtgctggaggtctgccaggaggcgacccggacgcccgacggtcgagtcttcgtcgaggataaggccgtccgccagaagctccgcaatgtctgcaacccgctcgagctcgggacgatgtccgagacgcacttcgtcctcacgaacttctggaagagccacttcaatcgcttgctggcggcgtccgaccaaacccaccccacggtgggcgaactgcggaagtggatggaccaacccgaggaacgcgggctccctcgtgagatccagaacctgctcatccttgtctatgccgatcaaaccaatcgttcgttcatgcgctacggcgggaactacgcgccgagcctggacgacctgcccaacgagctggaacttctggaacaaagccttcccgacctcaaggattgggaagggtccgtgacccgcgtggccgagatcttggggcacgcggtctccaagctcctgaacgcctcgaacctggcgacgctgacatcgaaggtaaacgagagcctcaaagagtaccgccccgactgcgatcgactcgccgaccggctccaggtcgtgctgagtcacctcaacctcgctgagggcgacgtcgctcaagcggatcgggtgaaaaccgcgaaggccgtccgagagttcctcgcctcatgcgacggaaaagaggccacgaagctggttggggccatcgcccgagccacgctggaaacctcgagcacggcgatggggaagagcctcaagtcggcggcagcggtcttgaacagcctgaacaatacgcgatgggatctcttcacggcggtctcggacatccacggcgatcgggctgacgaggcggcaaggctcatcaaggatgtcgtcacctggctgaagaccgacgagcacgcgctggcgagcggactggcctccaagttgtccgacgccgaggggcgggccatccagttactcacgcctcccaaggtggctaagccgaagccaccaatccagcctgatcccaaacccactccagcgcctggcccgaagcgatggacgccgattgggtcgggtcagcaggatcgaatgaccgcaaaggattgggactcgaagtctcaggaattgcttgagaaattgaaggcgaatcctcgctctcgcctcacgatcgactggacgctcgaggaggagtcggaatga

SEQ ID NO: 190 - DNA, 3648 bp, Sorangium cellulosum
atgaccgtcctccacgacctcctcgacctccccgcccaggtcaccaagagcgccttcgtcgtccgtctcgtcgagggcgtctcgcaccccgacgcgctcctcgacagctacgcgatcacccccgacctgcacggctcgttcgatcgtggcctcgggctcgtgggcgcggcgctccgtgaccggcgcaacatcgccgccttcgtccacgggagcttcgggtccggcaagagccatttcatgggcgtcctcagcctcctgctcgcgaacgacgcccgcgcctggggcgagcccgcgctccacgacctcctcggcaagtacgagtgggtgaagacccgcaaggtcctccgcctccacttcaacctgatgggcgcgcgctcgctggacgagaaggtcttcgccgagtacctcgtgcgcgtccgcgagctccaccccgacgcgccgatcgcgccgctcttcgaggaccaggcgctcttcgacaacgcccagggggtgcgcgagacgctcggcgacgcggcgttcttcgaccggctcggcgcgtccgccggcgccgacgcgcgctgggggaagaagggcgcggcggccgcctgggacgcggcacggttcgacgccgcgcgcgagagcgtcgacccggaggagcgggcgcggctcttctcggcgctggtgaagacgctcttccccgccttcgcggcgcagaagtcccagtacgtgagcttcgacagcggcctgccgcgcctcgcccagcacgcggcggcgctcggctatgacgcggtggtcgtcttcctcgacgagctcatcctctggctcgcgagcggcgcctcgaaccgcgagtggctgaacctcgagatcggcaagctcgcgaagatggtcgaggggcagagcgacgaccagaagatccccatcgtgaccttcgccgcgcgccagcgcgacatcggcgagatggtgggcgagcagtacgccggggcagacgccgaggcggtcaaggcggcgctgaagtggtgggaagggcgcttcgacgtgctcaagctcgaggaccgcaacctgcccgcgatcgtcgagaagcgcgtggtccgggcgaagtcggacgccgcgaagcgcgcgctcgacaccgcgttcgaccggctccgcgcctcgctcgggaacgtcgcctggggcacgctgctcggcgagatcggcgacgagaaggggttccggcgggtctatccgttcagcccggcgcttgtcgaggcgctggtggcgatgtcccactacctccagcgcgagcgcaccgcgctcaaggtgctggtggagctgctcgtcgagcacctcgacgacttcgagatcggcaaggtcgtgccggccggggacctctacgacgtgctcgccggaggcgaggagccgatggacggcaccatgcgggagcgcttcgcggcggcgaagcggctctacctgaacgagctcctgccggtgatccagcgcgcgaacgagacagggagcaaggagcgctgccagcgggagcggagcgaccaccccgtcaccctcggctgctcgaactgccgtgaggcccgctgccgcgccgacaaccggctcgccaagacgctgctcctcgcggccctcgtcccgaacagcgcggtcttccggggcctcacggcgtcgcgcctggtgcagctcaaccacgggaccctgaagtcgccggtgccgggcgccgaggcgcagcaggcgctcgggcggatccgggcgtgggcggccgagtgcggcaaggtccggatcggcgagcagccgacggacccgaccgtgagcatcgtgctcgagggcgtcgatctgaagccgatcatcgacgccgcgcgcggctacgacagcagcgggacgcggcgggccaagctccgggagatcctgttcacggcgatcgggatcgagctgggcgccgggccgatcgtgcacaccgtcccgtggcgcgggaccgaccggatcggcgccgtccattacggcaacgtgcgcgagatggacgacgggacgctgcgcgccgagtcggggcacgatttcaagctgatcatcgattacccgttcgacgatccggggcgcacgccggccgaggacgaggcgcggctgcgcgcctacacggagcgctacccggagacgccgacgatcgtctggctgccgagcttcttcgcggagacgccgcagcgggacctcgcggatctcgtggtgatcgagcggatcctcgagggcgacaactggaagacgcacctccagaacctgcgccccgacgaccagtcgcgcgcccgggcggagctctcgagcctggccgcgcagaagcgcgagcgggtgaagcgcgcgctcaacgcggcgtacggcctggcccgggtcgagccgggcatgctcgacgcgggccggacggtcgaccagcacttccacgtgctcatgcagggtttccggatctcgacgctcgtcgtggcgacgatgaaggacggcgtgatcgaggtcgtgggccagctcctgcacgagctccacccgcgccatccgcacttcgacatccgggtcacgaagggcaagctcacggcgaacctggagcagctccagaggctctacgaggcggaggggcagcgcctgctgctcgcaaagaccgagcgcgacgtcctctacttcgcggagaagctcgggctcgtgaacgtgaacgacggccaggcgaccttgcagccgctgcggttccaggaggcggagaacgcgctccgcgcgcaggggatcgacacgccgaccgtggcgcaggtgcagcgggtgttcgacacgaagggcgtgctcggcctcacgcgcgaggtggaggacttcctggtcctagcccacgggatcgcgacgggacgcgagctcatgcggctggggacgccggtgcgggacccggtgctcggcaagctcggcgaggatctggagctgccgaagccgccgatgccggatccggtgagcttccagagggcgctcgagcgcgccggggtgatcttcggcgtgagcctgggcggccgggcgctccacgcgcggaacctgcgcgcgctcggcgacaagctcggcgcggcggtggcgaaggcgaccgcggatcgcgcgaccgaggtggcgggcctcctggagcgacggagcgcggccttcttcgatgaaccgcacgggccgccgccgcggctcttgacggcgcgcaaggtggcggagctgctcggcgggctcggcggcgatccgttgaagcaggtgacggcgctggccgcgctggaggtggcgcccacgtcggagacggcgatgcagcggcacctcctggccgcgcgggcgaccgcggagtgcctcgccgacgacctcgtgttccagagcctggaggcgttgcgcgggcacgacgagccggaggcgcaggcgatgctcgccgaggtccgggagacgctcgagaaggacgagctccagaaggcgctggcgacgccgctgcgggcgctggccttgaaggcgcagcagtgggcgcggaagacgcggcgggcctcgtcggtcccgccgcccaccggcgaggtggtgggcaccggctcggcgacgacgctcgacgagcttgaggcagagcgggcgcggatgctcgaggcgctgaagaacgccgggcccggggggcggctggtgctcagctgctcgtggaaagtggtgcgggagaagccgtga

SEQ ID NO: 191 - DNA, 3885 bp, Streptomyces coelicolor
atggcccagccgcccctcctccgcgatgtcatcgacatcaaggagtccatctccacctcggacttcgtgctgtccctcgccgaggcgacgacccccgcgggcgcccagcatgcgctcagggactacgtcgtcaccgagcggctgctggagaacttcgacgaggcgctggccctcatcaagtcctcgctcgacggacaccgctccaaggcggcctatctccacggctcgttcggttccggtaagtcgcacttcatggccgtgctgtacgcgctcctcagcggcgaccaggccgcccgtgcccgcaccgagttcgaccccgtgctgaccaagcaccagtggctgagcaccgacggcaagaagttcctgctcgtgccgtaccacatgctcggcgcgaaggccctggaacagcgggtgctcggcgggtacgtcacacacgtcaagaagctgtgcccggaggccccgaccccgcaggtgtaccggactgactccctcttcgccgacatccgcgccatgcgcgccaacatgggggacgaagccgtcatccgcgccctgggcaccagcggcgcggacgacgccgaggaggacgagtggggtgagggcttcgcctggaccccgcagctcctggacaccgcgctcgccgcggaggagagccacgaggcgggagtccacctcaacctcaccaacccctccaccccggccgagctgcgcgccaagctggtcaacgacgccggcaccaacctcctccccggcttcacccagaacgccgccgaggacgagcacggcttcatctccctggacgccggcctgtcggtcatcgccgagcacgccaagtcgctcggctacgacggcttgatcctgttcatggacgagctgatcctctggctggccaccctcatccacgaccagaagttcgtggcccgcgaggccagcaagatcacgaacttcgtggagggcggcgacgcccgccgcgccatccccgtcatgtcgttcatcgcccgccagcgcgacctgcgcgagctggtcggcgaggaggtgtccggtgcggcggagtcgtccatccaggacaccttgaacctggcctccggccgcttcgacaagatcaccctggaggaccgcaagctcccgcagatcgcccacgcccgcctcctcaagcccaaggacgccgaagcggcccagcaggtcgacgccgccttcgagcagaccaagcgggtcggcccccaggtctgggacaccctgctcggttcggagaagggcaccaccggcgcggacgcggagtcgttccggctgacgtatcccttctcgcccgccttcatggacaccctcgtccacatctcctccgcgctgcagcgctcccgcaccggtctgaagctgatgggccagctcctcgccgaccaccgcgacgagctccgcctcggacagctcgtccccgtcggcgacctctacccggtgatcgcgcagggcggcgacaagccgttcaccgacagcctgaaggtcgtcttcgaggccgccgacaagctgtacaagaccaagctgcggccctacctgctcagctcgtacgacatcaccgaggacgacgtcgagcagtaccgcaaccggcccgagtccctcaccgacccgaagaagctcaacggctgccggatgttcaccggcgacaaccggctcgtgtgcacgctgctgctgtccgcgctcgcgcccagcgtgcccgcgctgtccgagctgaccatccggcggctcggcgcgctcaaccacgggtcggtcctcgcccccatcccgggtgccgaggtcggcatcatcaagaacaaggtcgccgagtgggcggccaggttccccgagatcaaggagaccggcaccgacgccaaccccggcgtccgcctcgaactctccggcgtcgacgtggactccgtcatcgccaatgcccaggtcaacgacaaccccggcaaccgcgtcgccctcgcccgccgcctgctctccgaggaactgggcgtcgaacacggccagttgagcgatcagctcggcttcacctggcgcggcaccgcccgcaccgccgagatcgtcttcggcaacgtcgccgacgaggacgagctgcccgaccacgacctgatgccgcaggaggagggccgctggcgcatcgccatagacctccccttcgacgagggcgagtggggcccggtcgaggacgtcaaccgcgtccagcggctgcgcgaacgccagcagggcgagcgatcccgcaccatcgcctggctgcccgcgcacctgtccgcgacgcgcttcgccgacttccggcgcctcgtcgtcatcgacaaggccctcgccgacgagcaccgcttcgacacccagtacgccggccacctcaacgccgacaaccgcagccgcgccaaggggctcctcgaaacccagcgcgaggcgctgctcaagcaggccaagggcgctttcaagcaggcgtacgggctcgcccagaagcaggccgccgacgtcgtgcccgatttcgacgaccacctcgtcgcactgcccgacgtcgacggactcaccctgtccttcgggcagagcctgcacgacggcatccggcatgtcgcgggcaagctgctcacccaccagtacccggcccaccccgacctcgaccccgacgccaccggcaccgccgtcaagcccgccgacaccaagaaggtgttcgcccacgtccgcgccgccgccgaggcacgcgacggacggatcgaggtcccggccgccgaccgcaagctcatgcagcgcatcgccgggcccctacgtctcgggcagcagaaggaggcgtacttcgagctgtcccgctactggggtgaccacttccggcagctcgcccgctcccagggcgtcaccggggacctttccctgatcacgctcaccgactggaccgaccggcccgacccgcgcggcctgcccgacttccttgcccggctcgtcgtcgccgccttcgccgagatggacgaccgggtgtgggtgcgcggcggcaccgtcctcgaccccgcgcccgaactggccgcgatcaaggaccacgacgcgctgcgcagccagccgctgcccgccgagtccgactgggacaccgcacgccagcgcttcgagacggtcttcggggcgaagccgcccgcgctgcgacgcggccggatggtcaaccagttcgcccgccagatcatcgaggccgcccgcgactaccgggaccacgcggccgacctcgtgcaccagttggaggcccacgcctccttcctcggcctcgaccagaccgccgacaccggacggctcgccctcgcccgccgctccctgcaactgctggacgccctcacggcggaggccggcaagggcgcggccggggcgaagaagacggtggaggccctcgcctccttcgacctgggtgagaccagcgccgaccggtacgggacctccatcaagaaggcccgcgccgtcgcggaggccgtcgcctccgccccctggtccactctggaactcgccgccgggctcggccccgagggcgaagcactgcttgactcgctgcgcaacgtggcccgcgacgaccagcgcaccgccgacctgcgcgacgccctcgcccgcacccagcgcgaggtcgtcgccctgatcaagcgcacccaggccgccgccaccccgccgcccgcgcccgccgcgtcgcagcccacggcgggggacctgtccctggacaccccgaccagcgacccgcgcatcccctatacctcacaggagacacccacctcctccggaggcgccgggacggcacggacgtccggtggccgccgcacgaccgcggcccgcgccgtcaccgacctccaggcggagctgtccgacctggccgtgcgccaccccgaggccaccatcgagatcacctggcgggtcgtcgaatga

SEQ ID NO: 192 - DNA, 3900 bp, Streptomyces griseus
atggtccagcagccgcccctgctccgcgatgtcatcgacatcaaggagtccctgtcgacctcggacttcgtcctccggctctcggaggcgacgaccccggccggcgccgagggcgctctgcgggactacgtggttacggagcggctgcgggacaacttcgacgaggcgctggggctgatcaaggcggccctggacgggcacacgtcgaaggctgcctatctgcacggttcgttcggttcgggtaagtcgcacttcatggcggtgctgcacgccctgctgagcggtagccccgccgcgcgggcgcgtgccgatctcgacccggtgctgtccaagcacgagtggctgggcaccgacgggaagcggttcctgctggtgccgtaccacatgctcggagcgaaggccctggagcagcgggtgctcgggggctatgtcacgcatgtgaagaagctgcaccccgacgctccgacgccgcaggtgtaccggacggacgcgctcttcgacaccatccggtcgctgcgggagcgcaacggggaccggttcatcatcgacggcctcgcgtcctcggaggccaccggtggtgtcgaggacgacgagtggggcgaggcgttcgcctggcagccggagctgctggacaccgcactggccgccgaggaggtccacgagtcgggtcaagcgctgaatctggtgagcccgtcgaccccggccgagctgcgcgcccggctggtggaggacgcgaacgcgcacctgctgccgggcttcacgaggaacgccgccgaggacgagcacgggttcgtgtcgctggacgcgggcctgtccgtcatcgccgagcacgccaagtccctcggttacgacgggttgatcctgttcctggacgagctgatcctctggctggcgacgctgatccacgaccagaagttcgtggcgcgcgaggccagcaagatcaccaacttcgtcgagggcggcgacgcacggcgtgccgtgcccgtggtgtcgttcatcgcgcgccagcgtgacctgcgcgagctggtcggcgaggaggtgtcgggggccgccgagtcgtccatccaggacacgctgaacctcgcctccgggcgtttcgacaagatcacgctggaggaccgcaacctgccccaggtggcgcacgcgcggctcctgacgccgaaggacccggagtcggcggcgctcgtgaacgccgagttcgagaagacccgcaaggtccgccaggaggtctgggacaccttgctgggctcggatcggggagccgacggggtgggggccgacgaggagagcttccggctgacgtatccgttctcccccgcgttcatggacaccctcgtccatgtctcttccgccctccagcgcaaccggacgggtatgaagctgatggggcagctgctcgccgaccaccgggacgagctgcggctcggggacctgatcccggtgggcgatctctacccgctgatcacggccggtggcgacaagccgttcaccgacagcctcaaggtcgtcttcgaggcggccgacaagctctaccgcaccaagttgcgcccctacctcctcgccacgcacaacgtgtccgaggaggacgtcgagcagtacacccaccggggcccggacagcatcgccgacccggacctgaggggtcgggtcaagatcttcgtcggggacaaccggatcgtgggcaccctgctgctgtcggcactggcgcccagcgtgcccgcgctctccgacctcacgatccgtcggctgtccgccctgaactacggatccgtcgtcgccccgatcccgggccgcgagtacggcatcctgaagaacaagatcgcggagtgggcggggcgcttcccggaaatcaaggagaccggcaccgacacgaacccgggtgtccggctcgaactgaccggtgtggacgtcgactccgtcatcgccaacgccaaggtcaacgacaacccgggcaacaggcaggcgctcgccaagcgcctcctgtccgaggaactcgccatcgagcacggccagttggccaacagggtgcacttcgattggcgcggtacgagccgtagcgcggaggtcctcttcggcaacctcgccgacgaggaggagctgcccgaccacgacctctcgccgaacgaggacggtctctggcggatcgtcgtcgacctcccgtacgacgagggcgagtacggtcccatcgacgacgtcaaccgggtgcgacggctccgggagaggcagcaggacggcgagccgtggcgtacggtcgcctggctgccggcccacctctccgcccagcggtacacggacttctgccgcctcgtcgtcatcgacaaggccctctcggacgagcagcgcttcgacacccagtacgccggtcacctgaacgcggacaaccgtgcccgcgccaaggggctgctggagacgcagcgggagtcgctgctcaagaacgtgaaggccgcgttcaagcaggcgtacgggctggcagagaaaaagcccaccgacgtggagctgggcttcaccgagcatctccagtcgctgcgggacatcgacgggctggtcttctccttcggccagtcgatgcgggacgggctgcggcacgtggcgggcaagctgctcgccgaccagttccccgagcacccggacctggacccggaccacaccggcatcccgctgaaggcggccgacgcccgcaaggtcttcacccatatccgggcggcggcggaggcccgtgaccaccggaccgaggtgccggccgcggaccggaagctgctccagcgcatcgcggggccgctgcgactcgggcagcagaaggaggcgtacttcgaactgtcgctcttctgggccgaccacttccgtcagctcgcacgggagcgtggagtggccggcgacctctccctcatcaccctcaccgactggaccgacctgccgcagccgcgcgggctccccgacttcctcacccggctgatcgtggccgcgttcgcagagatggacgaccgggtgtgggtgcggagcgggatgcctctggaccccgcacccgagctgtcgcagatcaaggaccacgacgcgctgcgcagccagccccggccctccgagcaggactgggacacagctcgccagcgattcgccacgatcttcggggagcccgctcccacgctgcggcgcggtcgcatggtcaaccagttcgcccgcctgatcatccaggccgcccatgcccacaaggactacgcgatcagtctggtgtccaagttggaggagcacgcgggattcctccggctcgacagcaccgacgaggccgcgcggctgccgctggcccgccggtccgtcgagctgctgacagctctcggccagagcgccgggcagggtgcggccggagccaagaagacggtggacgcactggccgccttcgacctcggacaggtgagcgcggaccggttcggttcctccatcacccaggccagggacgtggcccgcgccctgaccgacacgtcctggaccacgctggagctggcggtcaacgaagggcccgaggggcaggccctgctggactccctgcgcaacgcggcagggagcgaccagcggaccatcgacctgaaggacgctctcgcccgcacccagcgcgacgtgctggcgctggtgaagcgcaaccgggccgctgccacttccccgcccccggccccgccggccactcccagcgcggacgaggtaccgctcaacaccgggaccagccacccgcccgttcccactgaccgggtcgcggagcccgcccagagcgcctcgcggagccggcggtcgggcggcgggcgcacgaccgcggcacgggccgtggccaagctccaggcagagatcgccgacctggcggcccgtgaaccgggaaccgcgatcgagatcacctggcgggtcgtcgagtcatga

SEQ ID NO: 193 - DNA, 3786 bp, Thermobifida fusca
atgacgacatcccaccctgccgccagcggcaagcggttcatcggcgacctcatcgaaatccccgaagcgatccacgacggcgacctcgtcttcaaggtctccgaagggaccgggggggtcgacgaggagaaacaagcccaagcgatccgcgactacgtcgtcaccccacagctcgcccgcaacttcgacgaagccctcaccaccatcaaaggtgcgctcgccaaaggccagtcccgcgccacctacctcaacgggtccttcggctccggtaaaagccacttcatggcggtcctccacgccatcctccgccacgaccctgtcgcccgcggcctgccgcggatgcccgacatcctcgccaaacacgacgactggctggcaggcaagaaattcctgctcgtcgccagccacctcgtcgacgccgaatccatcgaagccgccatcctcggcggatacgtgcgcaccgtgcgccgcctccacccagatgcctccgtcccacccgtctaccgggccgacggactgctcgccgacgcacgggaactccgcgcccgactcggcgacgaaaaattcatcgcagacctgccgaaccctagaggagccacggcatccagtggatggggcaacacgccctgggctgctcactcgtggacttctgaaaaactcgacgaagccttcaacgttcccgccggaaccaccgaccctgaacaggcccggctccgcaacaacctgatcagcgccctcctcggcagccacttcaaacgctacgccgacgtcgtccacggcaaaggcgaagccttcgtcaccctcgacgaaggcctgtccctcatcagccgccacgctaaagaagaactcggctacgacgctgtcgtcctcctgcttgacgagctgatcctgcgcttcacccgattcctcggcggcgacgaggcacgcatcaacgccgaagcgcagaaaatgtccaagctggtggaatcctccgagtcctaccggcccgcccccatcatcagcttcgtgccccgccagcgtgacctgcgcgacctcgtcggcaccaacgtcaccggcgccaccggcggcctgttcgacaccctcaaatactgggacggccgcttcggccacatcaaactcgacgacagcaacctcagcgaagtcgtacggcaccggctgctgcgccccaagaactctgaggctgccgcggaaatcagcgccgccttcgagcgcatggtcaacacccgccccgaagtgcgcgacaccctcctcgactcgtccggcggggaagccgacacctgggacgacttccgcgccctctacccgttcagcccggcactgctgcacgtcatggtcgacctgtccgcggccctgcaacgccagcgcagcgccctcaaactcatgcagcagctgctcatcgaccaccgcaccaccctgcccgtcggccagctcgtgccgctcggcgccatcctcgacgtgctcgttgcgggggaagacaaacccttccacgaccggctcagcgtcgaatacgagaaaatccgcaacttctaccgcgacaaggtgcggccctggctgctcagccgccacaaactcaccgaagaaaccgcagccaacctcgacgtgcgcaacccgttccgcgccgaagacctgctggtcaaaaccatgctgctggcggccctcgtgcccaacgtgcccgcgctcaaagaaatcaccgtcagccggatgatcgccctcaaccacggcatcatccccgcgcgacgcaccggacaagacatcgcgcggaccgccgcgttcttccgggaactcagcgcccaattcggtgaagtccgcgtcggccccggcgacaaccccaccatcagcctcaacctgctgcgcgtcgacaccgaatccctcatgcgcagcagctaccacgccgccagcgaccaggccatgcggcggctgttcaaacgcctcctgtgggaagaactgggcctcgaaccggacgccacccgcacccacatcctgtggcgcggcaccctgcgcaccgtggaactcgacttcggcaacgtcaggtccgaagactccctcatgcgtcagcggttcgaaccggaagaccccgcggcgatccggatcgtcatcgactaccccttcgacgaaggcacccacagcccggccgaagaccggcagcgcgtccaggtgctccgcgaagaattcgacaacccgcccgccaccctcgtctggctgccgcacttcctctccgaaagccggcaacaggacgcgcgacggctcctcatgatggaatacctgctccaagacggcgttattgaagaaaaagcgcccgactggagctccgacgaccgccgcgaggcctacaaccagatcgacaaccaggccacccagcttcgggaacggctccgcggcctgctgcgcagcctctacggggccaccgaacccgacgacaccgaagtcggcgaacgggtcacccaacacgttgaagcgttcctgcccaacgtggacatcgccatcgaagcgggtagccagctccgcgacgccctccaacgcctcgccgggaaactcctcgaccacctctaccccgaacaccccgacttcactgcgaccagcggggcccggcgggaagtgcgccgcagcgacctcaacgcggtcctccacgctgtggagaaagccaaagccgacaggttgcagcgctacgagccggaaaacaaaaacgagatccaggcgctgcggcgcgtcgcgcaaccgctgaacctcgccacagtcagcgaagtattcgtgctccgcgatacgtggctgaccgcgctcgacgacgcggcgcgcaccgaatacgccgacatcaccgacatcaaagtccgcgacctgaagaagtggatccgcgaacgcggcgacggcaaaggactccccgacgacatcgtcgacctgctcgtcctcgtctacgcgatccaatccgaccgggcatggatccgtgcgggcagacgctacacccaggtcgcgatcggcagcctggaaggcgacattgtgctgcgccgccagcccttgccctcggaagaggacttcgcgatcgccaaccagcgggccaaactgctgttcggcctggaaccccagcctgtccgcaacgcgcgggccgtgcagcggcttgctgaacagctcaaagaaaaaagcgttgactggtttgccgctaccgagagtctgctgagccagctccagcggcacaccgagatgctcgaacttgacgaagaagccccgcggctgcgcaccgcgaacatcacctacgacctgctaggacagatccgcggccaaaccgaagacagcacgctgatcaccgcactcgcccgcgccgacctgcccggagacgctgctgtctacaaggtcagcatggaaaccgctgccaacgtggcggcagcactcgacggcgcgcactggaagttccttcgcaccctggagaaaatcgccaaaggcgcaggcgagcacgccccggaggctaggagactactgcaagagctcagaacagtagcgcgccacaacgagcagcaaaagaagctcgccaccgcgctcgaccagatcaccggcgaggcgatcgcgcttatcgaaaaaagcgttgacccctccactcccggcggtgaaaagaaggacgacttctctggccccagaccggtcacgcctcctccgccgccttcctacaccaacgccgaaaccaccatccgggtgtcacccggcgaggacccggccgcggccgtcgctaacctgcgcagcaggctcaacatccctgaagacaccgaacttgagatcatcgtgcgggtggtgcgccgatga

SEQ ID NO: 194 - DNA, 3717 bp, Thermobispora bispora
atggcgactctgctcaaggacgtcatccacatccccgaggagctgagcgcgaacgacttcgtgctcaagctcagtgacggcgtcaccgcggtcgaggagacgctggcgagctacgtcgtcaccccgcagctcgctgaggcgttcgacgccgcgctgtcgtacatcaaaggcgcgctggagaagggcaggagcgacgcggcgttcctgcacggctcgttcggctccggcaagagccacttcatgtccgtgctgcacgccgtgctgcagcacaacccgcacgcccgccggcttgacgggctcgccccggtcatcgccaagcacgaccactggctgtccgggcggcgcatcctctgcctcacctaccacctgatcggggcggagtcggtggaggcggccatcctcggtggctacctggagcagatccgccggctccacccggacgcgccgctccccgagctgcacaccaccgacggcctgctcgccgacgccgaccggttacgcgagcggctcggcgatgaggcgttcttcgccggcctcggcggagggggcgcgcagcccggctggggcaccctcgccgcaccgtggaccgcggactcctacgagcgggcccggaacgccccgatcggggaccccgaacgcggccggctggtctccgccctcgtgaactcctacttctccggttacgtccagaccggggcatacctggcgctggaccagggcctcgaggtggtcagcgcccacgccaagcagctcggctacgactgcgtggtgctcttcctcgacgagctggtgctgtggctcgcctcgcgcagctcggatgtggcgttcgtcagcggcgagggcgccaaggtggccaagctcgtcgagtcggcggccacccgccgggccgtgccgctggtgtccttcgtcgcccggcagcgcgacctgcgcgacttcctcggcccgaacgtacccggggcggagaagtacgcgatcggggagacgttccgctggtgggaggatcggttcaacaagatcactctggaggaccgcaacctccccgtcatcgtcaagcggcggctgctgcagcccaagccgggtgccgaaggcgtgctggaggccgcgttccgcaaggtgacccgggagcccaagatctggaacgttctgctggagggcctggacgagtcatccgacgccgacgcgttcgagcggacctaccccttctccccggcgctggtctccacgatggtggccctctccagcctgttgcagcgggagcgcaccgccctgcgcaccatggccgagctgctgcggcgaggccgggatgagctgaccgtcgacgacatcatcccggtcggcgatgtctacgacgtcctcatggactccggggtggtgccgctcaccgacgagatgaagcagcgtttcgccaacgcgcgcgccttgtacgaggagaagctgctgccgcggctcctcgaccggcaccggctggccactccggaccatgcgaaagggctgccccgcacccacccgttcgtcaccgacgcccgcctggtgaagaccgcgctgctcgccgcgctcgccccgaacgtgcccgcgctgcgcgccctcaccgcgcagaagctggccgcgctcaaccacggcacgatcgccaccccgctcaagggaatggaggcggcccgggtgctggcgctcttccgcgacctggccgcgtccggggtgagcgagatccacctgtccgacgacccggccaacccgctgatcagcattcagctcgccggggtggactacgagcgcgtcctcgaccgggtccgccaccaggacagcaagggggagcggcgccgcctgctgcgcgagctggtcttcgagtcgctcggggtgaccggggcgaaagccgagaccctcggcggcacctacacccactccttcgtctggcggggcacccggcggacggtggacatcgtctacggcaacatccgcaacgccgatgagctgccgaactcggcgctgatggccgaaggagaccgctggaagatcatcatcgacttcccgttcgatgaggccgggcacgggcccaacgatgacatcgcccggttcgagaacctccagcgcgagggcgtgcgcagccggacggtggcctgggtgccccagttcctcaccgaggcccgggagaacgatctcggtgagctggtctgcctgcgctacctgctcgcctccgacgaccgctacgagcagaacgcgagcgacctgtcggtgcaggaccgcgccaccgcgaaggtgctgctgctcaaccgcaagagcaccctggagaccaagctcaaccaggtcatccagcaggcgtacggcgcggccaagcccgagcctgccgacatcgacctcgatcgcgggcacagcgcgtacttcgccacgctcgagcccggcctcgagctgggcgctccggtcggggcgcggctcgccgactgcctggagcacctgctcgaccagatcctgtcggcgcagtacccggaccacccgaacttccccggagaggtgcgccgctccgacctgaccacggtgctgcgctacctggagctggcggccgcggaggagtccggacggatccccgtggatcccaaggaccgggaggtgctgcggaaggtcgcgaacccgcttcaggtgggggaggcgctggagaacgccttcctgttcacccccgacaccttcccctggcgcaagcacctcatgcagcgtgccgcccaggaagggctggaccaggtgatcagcgtcgggaagctgatcgagtggctggacgagccccggccgcgcggcctggacgccggcacccgtggcctcgtcatcgccgcgttcgcgctcatggaggaccgcgagtggtaccgcgccggggaacgggtccccatgccctcgccggagcggatcgacgcgagctatgagctgcgcctgccgcgcctgcccgacgacgccacctggcggcgcgcggtcggccgcgcggccaggatcttcgaggtgcacgtcaccgagctgaagtcggcggccaacgtccgccggctcgccaccgaggtacgcgaccaggcccggcggctgcaggagccggcgcgccggctcgtcacggccctggagtcccgtcgcggcgtgctcgccctgcccgaggacggcggccggctcgccaccgcccggagcgccgccaccctcgccgcgaccctcgccgcggagcccgacccgaccacactcgccgaggcactcgccaacgcgccgctcgccgccggcgaggaggtgctcgggtacgcgctgcggaccgccggtgaggtgctgaaggcgctggacgacatggactggggcctgctggacgcgatcgcctcgatcggcgacgacccgcgggccgcggacatcctcgaccggctgcgcgcggctgccgggaacgacgagttcgctgagcgtctcgccccggcactggcgctcgcccggcgcacggcccagatgctcctggcgagccgcgtccagccgcagcccggaccgggcaccggccccgagcagccgatcaccagcgccaccctcggcgcggccgcgagcaccggcgtgaccgcaaccgcccagtacacggctcaggccatcgacgaccgcggcgcaggcgggcggatcaccgtgcccgggcggcggatcgacgaggccatccgcgagctgcgtgccttcgccgcggcgcaccccgacacggagatcaccgtcacctggagcgagcggaagtga

SEQ ID NO: 195 - DNA, 3684 bp, Hahella chejuensis
atgatcttattaaaagacctgatcaccataccggagaaagtgcaaagcggggactttgtactgaatttatctaccggtttggaacccgctgctgttaagcagactttggatcagtatgtggtaacaccacaattggcgcgcgcctttgaggatgccttaggttttattaaatccaccatcgagggcaaccaaaaccgtcaaaaaggcgcgtatttgcacggcagctttggtagcggtaaatcccactttatggccgtgctgcacttacttttgcaaggcaacgcggaagcgagagcgattaacgaactggcgccagcggttaacaaacacgacgattggttacaaagtaaaaatattttactggtgccttaccaaatgattggcgccgccagtattgaagccggtgtgttgggtggttatgccaaatacattcacaaacaccaccccgaggcgcccatacccgggttttatctcgccgatggcattgttaaagatgccgaaaacctacgcgcaacaatgggtgatgtcgctttctttcaagcactgaataaaaatgggcaaggtggcggggaggattccggctggggcgatatcgacagtggcagttgggagttagatagctacaccttggcaatttctgctaacggtaaccgcgcagatcgttcgcgtttggtgggcgatctggtgcaggcctttttccagtccgtaaccgaggccgccaaaaccgatgaccagggctttgtcgattttgatgaaggcttgctgattatgacggaacatgccaaagcgctgggttacgatgcggttattctgtttttagacgagctgattctttggctcgccagccgaatttcagacgaaaaatttatcgccaaaaatattcaaaaagtggtcaagttggtggaagccagcgaacccagggcgttgccgatcgctagttttattgcccgccagcgcgacttgcgtgagtttgtgggcgaccagtatacgggtgcacagcaagacagcttaagtgacgccttaaaatattgggatgggcgctttcataccattaagctggaagacagaaacttaccggtcattgcacagcgccgtttgcttcgccctgtgagtgaatctgcaaaaattcaggtagacagcgcctttgaaaccatggacagcaaaatgaaggaggaaatcttcaatattttgctgaccaaccaaggcgacagagaacaatttcgctcgctgtatcctttcagccccgcgcttgtgcaagccttggttgcgctttccactgcgcttcaacgtgagcgtaccgcgttaaaagtgatgttgatgttactcgtacagcaacgagatacgttggagttaggcaatgttattcccgttggagatttgtacgatgtcatcgcatcggaaacgaaacctttctctgatgctatgcgacaacaattcgaaaacgcaaaaaccttgtttgagcgtaagcttataccgctgctcgagtccgatcataacctcaagtacgctgatttcgattctatacccgacacagattctgcaaagcgggcattcaataatgaccttcgtctgattaaaactctcttgctctctgctttggtgcctgaagtggaatgcttcaaacagctcacagccaataaactcgcggcgctaaaccatggcaccattaaatcacccatcccaggcaaagaggccagcatggtgctctcccgttgtcgtaaatgggccggccaggtgggcgagatcaaaatcagtgatgacaccaaccccaccatcgccttgcagttatccggcgtggataccgccagcatcttggagcaagccaactcttacgataatgacggcgcccgccgcaagctggttaaagatatggtgttcgccgcgttgggtgtgcaagaaaccgatgatatgttccaggagactacgcacaagttcacctggcgtggcactacgcggacggttgaagtgctgttttacaacatccgcgaaattacggacttcactctattcgaagcgcgcggtgatgactggaaagtgattgtggactttccgtttgatcgcgataaccacacggtttcagatgatcgggcgcgcattcaagaatacgaatcacacagtagccccacacgtactttgtgttggttgccatactttttcagccaaacggcgcaaaaggatttgggcaccttggtgcggttggagtatgtattaaaaaccgatgaccgatttagttcctttagcaaacatctgagccctgtggatcgaggtcaagcgcgaactttactcgaaaaccagcgcagtcagttgcggcaacgcattaaggactatttgctgggcgcgtatggcgccagtgaacgaatctctggctcattggatgatggtgcaggaagtttagattctcaaataatctctcttgaagaaggttttaagccgcgacttccatttggcagcaccttaggcaaagcctttgaaaacctactagggcaagcgctagagcaccaatacccagagcacccggaatttgattcggaaatcaaactcacggatttgggtaaagtatttgaacaaatacgccgagccatttttgcgcaaaatcatcgcattgatgttgaaacgcccatgcggcctttaatgcgctctatcgcacagccattaaaactcggtgaaatgcatgagcgccattttatttttaaacccgattggccgaatcagctgacgagagggctagcaaaacagcagcagacaggagaggccattacggttaagcgcattagagaagctattgatcaacctagtccgaaagggctgcccgagattgttcagaatttactgattcaaatattcgcagaatttggtcagtacgcttatagcttccatggcggtagctatgatgtcaccctgaaagatatgcccgacaaccttgagttaatcaaacaggatttggctgaacctgaccaatggcaaaagggttcccataatgctgctgaaatcttcggcattaccgtcagccccttgagaacggccaacaatcaaaacgagctgcaaaagcatattcgcgaggaaattcgcagttgcttaccgaactgcgaatctttggctcaacacatcagtaagcgactcgactggcttaaacaacccttaactggaaatagaattcgtaacgctcagtatgcgttggaagtgctgcgtgaattgcaagccgctgagggcgccaccctggtaaaggtactagccggtattaagcctataaccaatttactggccttgggcaaaagcatgacgacggcgggtagcgttgtgcaaaccattcaagacaacaattgggagttgctggaaacggtatggaatggcaatgaccctgctggcaaggccattagacaacgagtgtgtgatgcactggcggcggatgaattggtgacggcgctgtcgccggccttccggcaagctcagcaagatgcgacgcggttaatcgcccagaatactccgcccgctctgccagaacctacaccggagccgaagaatcccaaggtgcgagtgattaaacaggacaataaaacaggcctgaatcgagatgccgccaaggcattatttgcagaaattgaaggtgctatgagtaccggcgagactttagagttgagttatcgcattctccataccgatgattcggcaggtggtaacagctga

SEQ ID NO: 196 - DNA, 3363 bp, Aciduliprofundum sp.
atgaggtatgaggaaattatagggttaaatgattactttcaacctgtttatgatttagaaaatgaaattggaacatactggaagcaatttatccctaacgaaaaattttataaagtgctatcagaaacaataaactcgcttgaaagtagcaaacctgaagaaagaaaatcaatatggcttcagggagcttatggcaccggaaaaagccacgcaaccgctgtagtaaagcacattctttttgatgatcttgatgagataaacgatttcattgaaaatctggaagaacaaataaagtttaaaataaaaaatttccgtaaaaataagagggcttttccagttgttttaaaagggacatcctctattattgataatagaacctttgcattggtacttgaaaaagcagtaaagaatgccttaaagaaagaaggtattgaactcaatacaaaaactgattttgataaaatgattaaaaaattaaaaagtgatgagataaattgggaaaaaatttttaaaggaacagagttagagatttatgggaccaaagaggatataatttctaagcttcaacagggagatataaccatattaagaaaaatagagaacatactttcacaaaagggtattcacttctctactgaaaatattgcaaactggttggtagaagtacaaaatgaactaaaaaataaagaaattgcggattatttagtaatttattgggatgaattcactggaattttggaactgcctaaatctggtctattattgacagaattgcagaatatagcagaactatctatcaataaaggtgtttatttgtttgttgtcgcccatagaaaaccctaccagacaaatatttcaagagatgatgtagagaaagttcttggaagatttaaagtattggattattcaatggagcctataaccacttaccacattatcaacgctgctattaagaaaaaagatatggacaaatttacagagattaaagataaatatatggattcagtcaaatctttaatagaggaaattaccggaagtgaaggaacacaagttcaaaaatccttagagagtcttttcccaatccatccttatactgcatatttagcaacttttatagcaagaaatataggttctacagaaaggagcattttcaattttttgtatgatgaaagaagtggtttcaagaaattcataaaggaaaatccaggagagaaaggaaggatatttttaacagtggattatctttgggactttttctatgaagaatttgaaaggatgggaagtgaaaaagtttattctgtgttggaaaaatttaaacttcataagagcattttggaggagaaaggtgatgaatatttgtctgtgtttaaaggtgcacttcttctaaactttctttacagatttgtagaagttggagaatcttctcttgtagttccttcggagaagaatataataaatctttttgctggcgctattgaccggaagtatttaaccagcattctatcattcattgatgacaagcaaataatcaataaaacaccagataacttatacttaattacaagttcagggttaccttcaagagaagttgaaaccgaaaagaataagataaaaagtgaatataatacaattgatagaatactcaataggaagcaagaaaaagaactacaagatactattagcgcttccgtaaatagagttgtcgagttcatgataatggatgctagtttaaatgaacatttaataagaagaaaaatagaaaaagccttccaaaaagattatacaattcacttatgtttgtttttaggaaaaagtgaacaagaattacaacaaataaaaaacatattgaaggagatctctaatgatgatctcagaaatataatttttgttgtatctgaagcaaccttagacgacaaaacatttaatagattcatagaatacaaagcaagggcaatagttgcagacaaacataattatccagaagagagaaatataaacgaggaatatgcaagaaagattattgataactggatgaatcaagtaaaatctggatatattgagtggttcttgcagaatgaaagcggtaaagaattaatgagtcagtttagcagaaagataaacgaagaattatccagaaagatattttcctatggtttagaaaatatagatgggactcaaaagaacagaaacatttggacatacaaacgatctaaaacttctgctgaaatatttttattcgctaataacagaaaggatatagaagaaaagacatctaaaggtccggaaagatatttacgggagatcattaaagacaacaatggggaatacatcgtagatataaatctaaaaataaaagatgatgtttttgaaaatcaccctctaaaaaagatgtatttagaaatacgaaaagtctttgaaaaagaaagagatagcggagtatttaatctaggagatgctctaagattcctcaccaaaccaccatatggattataccccaatatgattaatatggcagcaattggctttttaatgagagaatatattggtaaactttttgaggaaggaacaggaataccaattcaaaaagaggtaatgagagataaaatattgactttgtttgattactgggaaaaaggaacgcatggagagaagttggaggttcgttttgggacagaagatgaagaagaacttattgagattttgaaagatttatttaaacttaaagacgttagaagtttgaatgatgcaagatggaaaataagagaatgggttaaaaaacaaggatttcctatatgggtattcaaattcgcagagaatataaatgaaaatactaagaaagctatagatactatttttgaactcgttcaatcaattgatagagatcttacgtatgaaaagataaaggattacctaaatactatagaggacgtaaagtatgatcttgacattttaatagaccgagaaaatccgggggagttgtttaaaaagtggttgaaatgtattgaaggagttgaaatttcatctgaggatataggagaggttataggctacattaaaagaaatatgcaggaagaagttgcttcttggacagaagataaagttagagagaaagttaaagattgggatagagagaagcttaaaaaacagattgatgaattggaatactctaagcgggacgatgggataaccacttctcaacactataaattccattcgcatcccatatctgaagaaaaggtgaaaaatattaaacaacaaatagagagctattctgcagagaggctcaaagaaattttaattaaactgatagatgaacatcctgagattatagagacaattgaaaaatatctggagggatcctga

SEQ ID NO: 197 - DNA, 4164 bp, Anaerobaculum mobile
gtgtggcgatatagcgatttcttggctgtaagggaagactttattccagtgttctctgaagaagtagataaaaatcacagggaggactggaagtttttcatcccccatgatcagatgaagacattattggacaaactaatgattgctttagaacgagcgcatggcggagataagcgctctatatggcttaccggagcctacggtacgggcaaaacttatgcttcctttgtgattaagcacttactagaggatgaccttgaagttattgaagagtattttaaaaaacatcaaattctgacgcctttatggcagcgcttcaaggcactgcgtcaaaagaagccttacttggtgatttaccgttcggcgtctgggcatattacttcaagccgcggtttaatgatagaaatacaacaggcgattaaagagcagttacgagcacatggctattctaacgcattcagcgaaagccttatggatcaacttgtgagcaaattaagtgatccaagcggcatatttaattgggaggcagcttttgttaaatatcgtgggcgatttcggactgttgcaactgctgccggtgtaattgagcgccttcgcgctggcgatgtgaaacttggagaacaagtagctgccgtgttggaagaagaagggttgactttagctgattctcctgctgctgtcaaggcttggatcaaagaggttatcgaagccaacgaattgcaaggcataatattcatctgggatgaatttacagaattcttcacgaataacgtacctgttacgccattgcaagagcttgcccaagcaacagcggacatgcccttctacctcatccttataacccaccgttctctgaatcaatttacgcgcgtagatgaggagactagaaaaaagctgcttgatcggtttcacaattgtcagctagaaatggttcctatcacagcatataagcttatttctaatgttatcgagataaaacctgattataaaagagaatgggaggataagttggattccctctgggatcaagtagaaaaagcagtacttcaaattcatgttttgggagaacaaattaataaggaagagatcaaacgaatgattcctattcacccgtatactgcctatctcttagccacaatttcatcgctttatagctcaagtcaacgcactttgttccaatttttaaagacagatccacccggctcatttcaatggtttattgctaattatcctcagaattcttggtattggttaactcctgattatttatggcaatacttcttcgaggatgttagagacgttaatatcggcaatgtcgaagcaataggcaaccttcttggttattacaattccaaaaaaagcgacatgaacgaggaagaactgagggtatttcgtctaatgctattattgcttgccttatggaaccaaacccaaggcgttcactccctgcttaagccgaaactatctaacataaaaaacatgtttcttgggaccgaactttatcaaaaggtcaaagaaatagctgacgagctttgttcgaggaatattatgtatgccgtatcaataggcaatgacttagaatacataataccaacttctaccatagatcaaaacaagttaaatgaatgctttagatgggtcgaaaatgcttttaatttcgaaaaagttgctaaggaaaaggactctgatgttggttttgcatctaaaatcgttgggttactttctctgtcaggtgcaaccaaacttcgccatccaattcaaatattttcggccaaagaattcaagtctcggcgcgaacgcctacttcaaggggttgataaaccatatgagataggagtaatttttttggttgcccaagaagagggagatttggctggttctgaggtcgtggctgctgaggttagcaaggcctgtccacattattgcatactgatcagtcaagttgcctttggtgcgagagactggaaagattggctagattcccgttctcattgtagatattatcaggaagcaaaagaggataaaatgcagaggtattacgatattaagtccaaagacattgtagataaatggcttaatatggtccgcataggtagaattcgtgccttttttaaaggacagcaggaagaactggatggttgtcaggctgttacgggttatctagaagatattgttaactcggtctttccctatggtccagaaaagttgagtaaggttgctactctgtatgcccaatcgtggggaaaggctggtgcagagataggcttaggaatagcgcataacattcaacagccatacaaaaatgtggtaaacgaactccaattgctagggttttgggaaggcaaggtgtccgttcattcagatcatcctttgagcaagatgcaaagagttgtggatgagttttttaacactaatgatcatgtcaatttaaaacaattatgggaggctttacaacagcctccatacggccttatgccttcgcctattggtatcttgatttttgccttccttttacgtaaatatgccaatggttattattattccgacggcaacaattctttcccgctaaatcccaataagcttgcagaacttattgaacaggttatgaaggggttcaaattttccgaaaactacacgattagaaaaatgtctattgatggcgagcgtttttgtcatattgcacgcaacgttttttatttaacacaagaacaggcatcttatcccgaagaggcgcgcaaaaatattcgaaagatagtttccgaattgggtttcccattatggacccttatatattacatcaagagagcatcatcaattggttcagctaatcatattattgaagcggtgaaaaaacttaatgagattttaactttcaccaaggacgaattggaagaccgggatatcaaggggttagtagatgtcgtcaacccagtgtgccatgacctgtcaaagatgattaacagggaaagaatgcaggaaggtatgcggagtttttgggagatttataatccccaactgatctcgctcatggaaaaactgcgcttagaagtttctcatgttatgaataaattgcgaatcctgctcaatgaggacgcattcttgtggaccgaagaaagcgttaaagaaaagttacccgaagtagtcacagagcttgatctcgtggatgcattaaactgtcttttaggagtgaagagacaggatctaaatgaacttcgtaactatttccgcaacaactggttcaagggcaaactgccacttatttggtataaagaaggtcaacctgatgagataggtaccctcatagaatatctttatgaactgatttatcgcccaagtcagggcataaaggttaacagatcggaagatatacgtcgctatagcagtcaattggcgtcagttttaaataaaggcccttttgtggtaggggttttagttcagaaatatacgggtcataccttaagcgatgccgaatctgaagcgctgtacaatgaactgtccgatctttctcaagcaagtgaagatgaggctagatcagctatagtgcggaccttaaataatcaagtccggcaaaagaagatagcgcagcttcgacaacgttggcaagagcttacgggctcggaatctccagagagatggagtgaggaaagaggcgtccctattcaatggatgttggaaggcaaagatcatcatgtattctttgagtgctacgataacattcataaactggctgaaacggatatagataaattgatagaacatctttctcatcacgctgctgagtttgtcaatctccaagatcagcaatatgtttccgataggtttatacgggtgatcgctggtgattatgccgagctggtgcttgaggcaaatatggccgatcaactgcaggcctatattcgtaaaactttagacggaaacatatatcgctggcccatgctgttaagtgagatacatcaattggtgcgtaagtgggtaaccgaaaattatcgttctacagcctaccccaaaatattaaaggtcatcgagaccataccaccagaggagataaagcaactaataatacaattagctgccgatgacgctcttgttgggaccaaggtattagcttctatatccaaagtcgaaacgaaaccgcgaaagatgaagtggggattcctccgatga

SEQ ID NO: 198 - DNA, 2814 bp, Candidatus Desulforudis
gtgagcggctggctctatacggattacctggaaatcgaccagcagttcgtcgacgtttacaccgaagaggtcgatagacagcatgccagggcttggcagtcctatattccggaggcgaatacgcgggcgctgctggaacgtatttgggggatactggagcggaggtcgccgaagccaccgtttatctacggcccatacgggacgggcaagacgttcaccgcttttctcattaagcacctcttggaagacgccttagacgagatagagcccttttttgccaaatattctgccatcaaagacctctggcctcggtggcgggcgctcagagagcgaggcccttacgtagtggcctatcggtctgcggctaccgatgcgagttcacccttccggctggtgtacattgtgcaggaacggatcgcgcaggccctgaaggaaaaggggtacagtgctacaacgacagagaccataaggtcggcagtgctgcgaaagcttaccaattcggaatcgacctttatctggccgcgggcttttgagaagcatcgccatcgttttaaggagttcacgaagccggaagaggtgatcgcgcggcttacggagacaggcacggagggcgaaacacttggcctcttggaccgcgtaaggcggacgttagaagacgaagacattgtggtgctacgttccgctcaggaactaaagtcttggattaaagaggttatcgttcaaaacggcctacagggactcctctttttgtgggacgaattcacggactttttcaaaattcccggggcaccggtcgacctggtgcaggaactagcgcatgcagcagaggacacccatttttatttcgggctcattactcatctggccccagacactatactcaaggtcgacgaggcatcgcggcgcaagtttctcgaccggttccaccgtcaccaccttgaacttgcggaagtgacggcctaccgcttgatgagtgccgtgctccaggtcaagacagaaaggaaagctgagtgggagcggaaacacgaaacgctgtggaacgaagtgggaagggccagctcgttggttatcatgctgcagggcgaaacgaaggaagacctgcgcaatgttgtgccgatccacccttgtacggcattgactttggcgaacatagcccggctgtttagctcgagccagcggacgctgttccggtttctccgggaggaacggccggatcgtttttgctttccccgctttctgcgggagtacccgcgtgacggctggcgctggctgacggcggatcacctctgggattacttctatgccgatgatgacccggagtatcccgaggaaatccgccgtttcatcagacactatcgtgccaacgtagaaaaaattactgacgaggtcgagtgccgtgtatataagctcgtgcttctctttgaccttttgcaccgcaggctgcctgtgtcagaggaaagccaattttcatttaagccaacgcgtagccgcgtgcaacgcgtttttgaaggagtgcttgacggggagcgtgctgttgcggcgttaaactctttgtgtaaacagcatctgttgcagcgctatagggtgggccaaaacgaagtctatgttctgcctctgtttgcggtcgacgacagaaagataagggagatcaaagatagaatcaagcagaccaacccgtttcgctcattgacaaaaacaaacggcgaatttggcaggttgatagctgactcctttcaggtcaacccgcctctgggactgcgtcaccagatgtgcacggtggcggctgacgagttcttaggtaggcgggagcgggttttgccgccggaaagtttaaagccgtaccaggttggcatcgtaatggtgctcccgttcggagagggtgaggttgcaactgccagggagacagcgcggcgattgagttctgaaacgccgcgggtaatctatgcagttgctgggaaggagtttgcggaatcacggtgggaacgttgggttgagcagagggcgctggcggaacatgcgcgggaaagaggggaaagcgagggagagcgatcgtacagggagatggcgaagatattggtagaggaatgggtgcgagatgttgtctcccatggtttccaaatgtacttccgcggtgaggttgacttcgtagcaacgaaagagggctacgaggagtatctagaggaagcggttgaaaaactctatccgttacgtccagaacgcatctttcccagggaaacgttgtatacgggatctgccggtaagcaggcagcggagatagggttagggctggttcagaacccgcaggcccctttcggggaggccgtagataaacttaggggcgatgggctttgggataataaagactggccccaggagcacccactcgcgggaatgagggctgagttgagaaatatgctcaggaaccgagaagagataaacctgctaaaagcctgggagatgttgatgggagtgccgtatggtcttataccgtctcggatcggtattatgttgttcggcttcctgctgcgtgaatacacagaggggtattattattgggacggcaaccgttgcgagggtttaaatgcaagcacactggcctctctgatagataatgttgttaagcagaaacggggtgcggaagattacgccattcgccggatgcttccggctgaagaggaggcgtgccgtcttctgcgcgagattttcgacctgtcttttgaggaagctcgctatctgcggactgccctcgttcggctgcgcgagcacttcaggctgttgggctatcctttatggtccctgagttacgcgggctga

SEQ ID NO: 199 - DNA, 4260 bp, Coprothermobacter proteolyticus
gtgagatactcagagattttggggctttacgaaaacttcaagccagcttatgacctaactgatgaaatcaagaatggctggaaacagttcattccagtggattcttttattgacctgctaagtagttttttggaggctttagaatcgtcggatccaagaacaaagagatccatttggcttcaaggtaagtatggtgttggaaagagtcacgctacaagcgttgtaaaacacctgctgtgggacccgtgggaggacatagaagagtttgttgaccaactaggcaatgttaaacctcagctacagaaaaaattggagaacttccgtcataggaaccgtgtatttccggttgtccttaaaggtagtggttctatcaatgatggactctcattcaagtgggcaatacagaatgctgtgaaaagagcattgaaccaagaagggttagacattacaccgttaacggagtttgagcaatacaagaggcacgttcttgagcaggaaaaatacgggcatgattgggacgtattcctaaatgagaaaccgcagttgcgggccatggtgggtaacagagatggactaataacagcacttgaacatggtaacgtagaggtgctaaaggctttccgtaaggctcttggcgatgttctgttgcctactgcggatatcgaaacatggcttgaagaagttgtaaaggaattaaaagcgcaggatgttgcaacttctatggctatttattgggacgaatttacgtccgtattggacatacagagaagggctcctgaaatactcacactactgcaaaacatcgccgagaagacattctcatcagacatatatttgttcgtggttagtcatagggatcctgaacaaattgcttataccgaagacgagaaaaaggttctcgacagattcattagcaaaacttacagaatggaagaaattacaacttacgatatcattgcccatgccatcaagaaaaaagatccggagcagtggaaaatactaagggatcagtgtttacggaacacatcaataactaacctcatactaaggctaaccagtactgatggggccgatatcaagagaatagtgagcgatgtatttcccattcatccttacacggctttcttggcagccaaactggctgaccatgtaggttccgcggaaagaaccatattcagctttttgtacgatgaggaaaagggattcaatggtttcatgaaggaataccctaaggagttccatggaagtacggaatactttctcactgcacccacgctatgggatttctttgtagaggaatttgagaactcagaatcagaaaaaatgcgctccattctacaaaagttcactcagtacaaagatgatcttgacaataggggctccgcctatggcgccgtatttcgcgttattctcctgctaaatgttttgtacacgtttgtgggtgggagctccgccatggctggagttaacctactcttgccctctgaagaaaacataagaggtgcttttgcagggacgaccttagaagaggcagttacggatgtattaggttatcttgtggacagagaaatatttgatttgactgctgatgggctttacgaggtggctgttagtaatttgcctgaggatgaggtaaagaaaaagaaagtagaatttggtaagaaatacgaggacgtctcaaaactcattaaagaatacgacgatctttacaataatttgctgtctggcttacgcaagaacgtgctaagggagttggatatcggaatttacggggctaattcccgaaactatgaagtgaaaaaagtactacgcgaggattttaaaaagccatatgctctgaaagttgccatttttgttgggagatctgaagatgagcttaggaacatagagagcgtcattgacgaaattatgaagactccgcaagaatctaatccgcatagcgtggtttttgtggtagctcggaataccctgggcgaaaaggagtttgacaagttcataacatacaaggcgaaatcggctgtggcaagggaacatgggtacgaatcagctattgaaaatgagaagtgggcacgcaagttcgcagaaaactttgctagttccatagaaaaaggtacagctatggttttcagtaaacagggcaagcagaacgtgagctttagttctctgcccacagttctaaacaaccacagtaaagatatctttgaatttggtttggaaaacatagaagaccttacacagaataagaacatttgggagaagaaaagggcagaaaaattggctcagattttctgtgctgctcaaagctatgaggatctagtgcaaagaacaagaaacaatgccaggtacaacatgatcatggccatgttcaggacaaatggggaatacattgtagataacaagctgtttttgaaaaaggacttgacggatggtgaccacccactagtaaaaatatgcaaagaagtagaacgagcattagagaataacagaggatccactttcagtttgcgagctgtcctgggtttcttggcttatgaaccgtacgggctttatgcgaacgaggtaaacaccgctgctcttgcttttgccttgcgtccttacataaacaaaatattccaggcaaacagcggaataaaaataacgcccgaccaaatgggtagcaaggtggtaaaacttctagattctttcgataacggtggggttgcttcagatgagcttcgtgtcagacttggctccgaagaagagagctctttagtaagtttgcttaccaagctttttgatttacaagagaatgaaaacttgaccaatgtgagatggggtgtaagaaagtggtttactgaaaaagcaagagtgccagtgtgggttctaaagtatgtggatgagctcaaaggtctggataacgttaaagagaatactaccaatttcatcgtaacggtgattgataagctggtaagctcgcctgacagtgaattgaaccaagaatcgatttcaagtttttataaattgctgcaaaggtttgagccatttctcacacgagctttggacatagaaaagcttaatagagcatttgaagaatggcttcaacagcaagacgacgttgcgactgtgttgcccgatgacattccatctgttaaagagtatttgactcgcaatatgcaggaacaagtagcactttggaaagaagacaagttgaggttacagctacaaaaatggggccaggagaaagaagcttcagaaacagaaaagcaactggcgaaaataataggcaagattttcaggcttgaggaagacttgccggaggtgggtacgactgtaaaagcggtccgccaaaaaataaacaacgaagtaggttatcctatctggctgtttaagtatttttacaatgatgaagacttcagtgatgcagttatggcactcaacactttggtagttagtagtgaaggttctggcgccatgtttgattacggtaaatacgttaacttgcttaggggcaaggaagacgtactggcaagcaatttcagtcccgttgtgggttcgaaggcactcagtatttgggcacagcgatgcaattgtgataccactgctaatgttggccaagacttagtgcggctggctggaggcgaagtttggaaaataacagaagaccagttacgtgaagttattactattaaggacttcctccttactacggcgcgtttattcggactcgaatcggttagcaacatgactgatttgagttctggaatacaggaatggttggacagagttggttacccatactggttttttgaaaagatcgcacaagattctaatttaagaagtttactgtctgacattgccgatgttgttaggagtgcaggttcaaagcaagacgctgagcacttagggaatttagccaaacgaataaaagcttctgagccccagctgaaagagcttttaaccccagaaagcgctagcttgtacatgaagattttgttggaggaaagctttagcctatatgacttggacgatgctacagtgaggcagttgttacgagaagtaaggcaagtactgaaagatactgatttttactggaatgaagagaagtttaatgaacaactgaaacgacgaattgacgttttgaaaggtgaacaaaagaagaacaaactaagagaaaccatagagagcggctctcacgatcttaaagagataatgttacgcctgattgaggaatatcctgaggtttgtgagtggctagtgcgtgaacttgggttaggtgaataa

SEQ ID NO: 200 - DNA, 4698 bp, Cyanobacterium stanieri
atgcaaatcagcgaattagtaagagttaatgaagaagcaatattagccaatgccgttaactttggtatgatggaagatgaagaaaaaaacttgggattatgtcaaggatttgtctttaattatgaatccataaatcccaaagcatctacattaggagtattagaagcaattcaacgcagttatcgcagtcgtaatgaggcaaatattcatttatttgtacaagattatggtagaggaaaatctcattttgctttagtaactgctaactattttagacagtcgatagaaagtcaagaaatacaaggaattttagaacaagttagaaaagcatcgattaataatccgggtattgttgaagatttagaagcctataaacgcagaaataaaaaacatttagtgatttgtttaagcggtgaagaaatggatttacgaaagtcatttcttaaggcaatcaataaaacgttaatggaagaaaatataactgatacattggctcaagaattttgtcaaaaacccttaaattatcttaaaagtttagatgcacaacagcaacaggtagctaataattttattgaaagtaattatccagaattaggagatttagataatattattgaatctttaactaaagagaattatcgtttaattccccaagtaaaagaaattagtaaacacctcaatcaaggatttgccatcgactttgaaaccgacttaaatgtagaacaaattttggagaatttattgcaaaaattatgtttaggagaaaatgccccttatgcaggaatattaatcttatttgatgaattaaataactatttacaatcttgggcaagagatgcgatcgcatctgggggattaaccttacaaaatattactaacatttgtgagaattataaaggaaaaattgccctagtttgtttcacccaaatacgccccttaaaatcagtgccaaataaatcggcagacgactataaaaaacttgcctcacgattagaaatagcagaaagcacctatgagcctatttccagtttagaattagtaattaaaggtttattagtacaacaatcccatcaaccaatttggggtgaatttatccacaaatggggtaatactttattaggtaatagccgtcaaagttttgagacaagaataacatattatcgtgaaagaggttgggatttacaaacatttcataggaacattaccttagatagttttcctttacatcctttaactacttatctcctttgtaaccttgattttactcaaggaagaacggcaattcaatatattaaagaagatgttaaaaatttcattttaaatcaacctttagaaaggaataatttactaaattgtctccctgcaatttctctcattgatgcctttagtgatttttctcaaacagaattttcccgttatcatgctgaatataaaaaaacctatcaatcaatttctttttctataactaccgaagaagaaagtattttaaaagctatttttctattctatattagtggcaataaattacataaacctaacaatcaaaaccatgccataattcttagtgagttgagtggtttatccgagacagaaacctcagaaactttaaaaaaattatccctcgaaagacaagttatttactataatactggggataacacttatcgcttttattcgggtagtaacttattagaaattcgccaacaaatagaagaagaagccgagagacaaccccataaatggacagttaatttacctgttaaatactgtcaagacaatattgataaatatttaagaagtcaatacattgaggctttaacttttatcgaaaaaaataaactcattaacggtgaatggtattttgaaaataagttttacactatcgaagaatttgaacaggcattatcaggatataaaaccttagagaatacagaagccaagggaatttttgcccatattttagcggatagaattgaagatttacaggatttaaaataccgtattaatgatttactttctaaatctcaaaataaacacttattcgccgtagctattcccaataaaactgtgggagatttacctcgtgaattgtttatgattgatattatcagaagaaaaactgataagcaagaatcaggcactgcttacaatcaattaaaacaagatttagagcaaaaaatagatagagaaatcagagaaattttagtatcctgtgactattattgcctttatcaagataagttaacagcacaggaagaaaaacaacctcaagcaatcattagtttactattaaatgagctttattcctttgtacctccccttgcaaaaaatgataaaatggcattaaaaagtaatccagctaatactattattggttatgccataaaactattaatacaagatgagttaaaaccacaaaattttcctaatgcctcctataataatttaattagtcctgtatttattagtaattggggtttattaaaaattaataatcaaaaatactcaattcaactcccttcacaacgcaatgttagacaagcatgggataaaatttcagagttaacagacttgggaagtaaagaagaaaaaaccactaaaatagaagatatttggaaaactttatctaagcctccctttggctataatgaatatacttttaccatgctttttggtgcatggctggggtatcactataatgaagtaaaaataagtggtactttcggcattccccaaagaaaaaaagaacatatttcctataatattcaaccggtaaaaaaatggacagaaaccaatatttttgataaaccaaaagactttgtcaataaatggattttaggcaaaagtaaaagcccacaaattatcagacacaaaccgattatttgccctgaaattccctcaagtgttgactataatcaggctaaagagttaatcaatgagattgacaattttattcaatctggagaaggagaaaaatataaaaaagatgaaataaaaattaaaagagttcatttattagatggtataaaaactattgataataattttgaaatagtagaagaagctgaaaatttatccaatgatgctaatattgaaaaattaatttcattttatttatctttacaagacgaattaactccaaaacgagttattaatctagttaattattctgattctaataaggttaataattctcatccagtttatgttaatcctagtgaaaatcaaaaagagcgtcaacaaaaagtaagaatattaattaatgataaaattaatgactttgttgatgagttaactcaacgctcagaaaagatgaaaacagagcaagaattagggcgttatcaaggagaattggaaaatactaaagctaaaattagtgaagttgacactttaccttctcatttaattgagcttttaaattatgccctcaaaactgctgaaactaatattaaaaatatacaatatcaagaaaatattaaacagtgtttatctgatattgaaagacgatgcagagtgttgagtgataatgctagtcaaaaagattatcaagatgctctacttgatattgaaaatttagcagaagaaacaattattattaaagaaaatccaagatatattgatattattaatgagataaaagataagaaaaattatttagagcaaaaaatacaaatttggcaggagagagttaataatattagtaaaaatcaggcttttttcttatctcaagaaattaatagcttaaaaaatcgctttactgatatagaaagttgtcaaaaaatagagaatcttttacagcaacttaatcctataattttggagtggcaaaatgaagaagaagcggaaaagcttaagcatcaagaagatgaaaatattctacaacaattaagaatcaaaacaccttctttattaaaaaatatttctgaatgccaagatgcgatctcacttattaataatttaagagaaaagctaaattatcctgacagatttaaccaagaaatcgaacaattaagggaaaatcttaatcaatatatttctgagtctgataatcagttagataaactagaagtcactattcaacatattaatgatagtcaaaaattagataagtttaacaaggagttaataaaatcagaaacaatctgggaaaaatcatcagaatatctaagatgccagagattacatcaagatattgacaacttgagaaatctattgaaaattattgaatatcaaagaaataatgatttaaaagactatgaaaatagtttacaacaattaaaccagtggcgtagtaatgtaactaatatttctcctcatatagaaactaaatatcagtctatatctcatcagttgacaactaaaattaatagaattcgtcaacaaaaatctgagagtgcgatcgcatggctaaatcaattaaatccccagtataatttactgctagaaaattcagagaaattactagatgaaaaattaaaatgtgccaacaatcttcttaaagaaatagattgtaattataatcaatatcttgattgctttgaagaaaaagaggaaaaacttattcaagaatatcgaaacatatgtattgaaattcaaaatgaaaatacagaaaatcaaattatagttttatttcaacaacttactcttgaaaataagcaattattacatcataaattagaacaatatttgaatgaatag

SEQ ID NO: 201 - DNA, 3498 bp, Cyanobacterium stanieri
atgaatttatcttcttattttactttacaacgtcgttatggtcgttctatcaatttagaaagggattttaatgatttatctgctttggatggttatgttttaacggataaatctgtggaaactttaaagcgagttttgttgggactaagtggagaaaataaatataattgttggactttaacgggggtttatggtactggtaaatctgcttttgttcattttctaatttctttattagctaatcaaaaaagtgaagtaaaaagaaaggctttagagatagtaaataaccatataaatgatgatattattcttagtaatattcctgatgatggcatggtaagggcgatcgccgttagtcaacgagaggcgattagtttaactattattcgggcgttaattaatgggttaaaggatgttggtggtaaattatctaagcagtttattgcttctttacaggacttagaaagccgtattaaggatagtaaaatagtccaaaatactgccataattagtgttattaaagatattcttttacaaacaaaaaaagatattattttagttattgatgaactaggtaaaaacttagaatatgccgtttataatcaaggggcagaggatttatatttattacaacaattagcagaattagaagcagttgaaggtaagagaatttatattttaggtatcttacaccaagcctttaccgaatatggacaaaggttggctactattcaacgtaacgaatggtcaaaaattacaggaagatttgaagatattgcttttactgaatccacagggcagatgattaggttaatagctgaagctattaccccaaattttgatgatgtttttgagaaaaaaattgaccaatatagtagtcattggaatcaaacattagagccaattttaaagttagaaaaaattgaagataatttaattaaaaatatttatcctcttcatccccttagtgccttaattttaccagttttgtgcgtaaaatatgcccaaaacgatcgcaccttatttacttttatcacatccgatgagcctttttctttcaaaaagtttttagaggaaacggttattaacgatgatgacttacctaccctcaaacttgatcaaatctatgattattttatctcctccgtgggtatggggttaacaagggtggtaaatttccaacggtgggtagaaatctatgatttaatcaatgatgccaaacacctcgatgaggatagtttgcggttgttaaaggcgatcggtttgctaaacttagttagtattacaggtattactagggcaacccgtgatttagtcgcccatagtctttgtgatggagaggatgacgataaatttaactattggcaagaaaaaattgaacagttattaagacaagggttaattacccatcgtaaacaaattgatgagttgagaatctgggaaggttcagactataacattgattatgaattagaatcctatttaaaacaagagcagtctagtttagccaaacttttatccccattacgccctcttaaacctatcattgcgcaacgacatagttatcaaacaggcactttacgttattttgaaagacattatctcgatgcctcttttgattgggatagggtggaatgtgaagataattcggcggatggttggttaggttattggttggaggaggaaattccccctacttttcctcaaaaaactgtcaatggtttacccattatcgtcattactaccaataacttacaggttttgcgattacaagcccaagaatttagcgctttgaatcggatgaataatgaggcgaaggagttgcagtcggatggggtggcaagaaaggaggtgcgttatcgtcttatggaggcgcaaaaggctttagatgaaactttgaatagtgttttcgattttagtcggggggagtgtcgttgttggattgggggagagttaacccctgtcaaaagtgtaggggagttgaatggttatctttctcggttgtgtgatgagacttttgttgatactcccattctctggaatgagttgataaaccgtcgcaatcttacttctcagggtagtaaggctagaagggagttaattacagcgatgattaaccactctagtttacctaatcttggtttttcaggttatggccccgaggtgacgatgtattattctttgttacgggaaacgggcatccatcgctctctttctttgaataaaaatagcttagaatctagtgacagcaaggattgtgtaatacatactaccccccccgacatagatgttacaaacttagaggatgaagagtggggtattcatgcgccgacgggtggggataatcctaatatagataaagtgtggggtgcgatcgcccttttttgtacatcagccaccgaaaatccccaaaatattgcccaactatacgaaattttacaactacccccctacggagtaaaagaaggcatcatccccatcattcttaccgccgtattactgtattacaaagaagaagtgggagtatatcaagatggtacatttataccagtattaggggaagaacatttagaattattagtaaaaaatcccgaacgttatgcagtaaaatactttgccatagaaggattaagggcagaagtattccaagaattagaagctatcctgcgtaacccccaaaccaaagccaaaagaaacattcgtaacgccaccctcctaaccgttgttactcccctatatcaatttgtcaaacaacttccccgttataccctgcaaaccaaagaattaaaccccacagccgtaagcattctaaccattttacaaaaaaccgtcgaacctgacgaactattatttaaacaactacccgaagcctgtgacttaccccccatcaccagcaacaaagaaaaagacggcatcaccgccaaacaactaaaaacaaacctgataacagcattaagagaaattaacctcgcctacgaaaatctgttgagtgaatgtcaatccttattatattcagcctttggggtgagaaacgaagccacaaaactcaggcaagacttacgcataagggcatcttaccttaaagataaatgtgtcgaaccaattttaaaacgttttacccaagcagtatgtgatgaaaccaaaaacgataagcaatggttagaggctttgatgatgattattgccgataaaccagcagaatcttggaaagatgaagatgttaatttatttcagagtaaactagctgaattatcccgtaaatttaccaacctagaagccatccaaggggaagtaaaagtaaaaggtgaaggattatccgccagaaggattaccgttacccgcagtgatggggaagaaaccaatcatatgatatggatagatagtcaacgagagtcggaggtaaatcaaaaagttgaggagattttggctatgttacccaaggataaacagttaagggagactattcttgcgaaacttacagagaagattttaaactaa

SEQ ID NO: 202 - DNA, 4131 bp, Denitrovibrio acetiphilus
atgagcaataaatattttgaatatttcgaaattgatgaagactattttccgcaagtcaatgattcaacaattcaagagaaacctgattgttggaaaaagacttttcctcatcaaacattcatagacatgctaaaaaacatggagcgttgtctagcaagacaagaaaaacgctccctttggatagaaggagcatacggaacgggtaaatctcagtgtgcatatactttaaaaaagctccttgaagttccggaagatgattttaggaaatattggaacggatttaaggctcttgaaaaccaaaaggatttgatggaaaagctgattgggcataagcataatggcatagttactgcttacaaatatgcttctggcggcatcaactcacctcgtgacttgtttttggcaatccaagaagaggtaaagaatgctttagttgcaaataaacttcacactggagaaaatacccttaaagaaagtgttattgcatggatagaagaaccatctcataaaaggattttcgatattctactagaaaaacctgaatggaaagctacgttcacgcaatcatctgccgatgatgttttggatgcgctttgtaaaaacagtgaagtaaagcagcttatggagaatatattccgactggcagacaaagaaggcattacagcattgaacattgatgcaaacaggctcattgcttggttatcagatgtaatggataaaaataatgtgaaaattgttctaatatgggatgaattttcggattattttaaaaataatcgtgatagtctttcagaattccagaaaattgcagaactagttaattctaaaccattcttttttgttgttgtgacgcacgaatcgggtcagctttttactactgctgatacgacatggacaaaagttcgtgaccgctttgtatcttcccaaatctctttaccggacaacattgcatttgagctcattggtcatgctttaaatgttaaaaatgcagctaaagaaccttgggctaaattggctgatgacttgaatggtcgtgtcagctcatcacgttcagcggttatgaaagttacaaaaatatcagaacctcatgtaatgaaagacattatgcctcttcatccaatggctgcattgcttctaaaaaatattgcttcagcgtttaaatcaaaccaaagaagtatgtttgactttataaaatcatccaacatagatgatgttaaagcttttcaatggttcattcaaaacacaggtccttacgatgatcatccacttcttactgtagatatgctttggaacttcttttatgagaaaggccgtaattccctcagttctgatatacgagttatattagactcgtttcagcatcaacaagatttgcgagatgatgaaaagactgttttaaaagcagtactcataatgcaagcgattgaccagcggttaggaggtacaattgatctttttaaagctacggaacaaaatataagctacatatttgaaggcattgactcaggacttgatgtggcatgcaagaatatcgctaaacaacttgtttcaaagggcattttagtcaatacccctatttctggtggaagatatgtttattctgcggccgtactagcaggtgaccaggtaaaaattgatgattataagaaggacatacgtaaagggacaaatactgccaagcttgttacagaaggagggcttgcttcagtactttcattaactccagcattaaagttgcgttacgagattgaacctggttcagggaagattactcctgttaccataaatgattttactcgaacggtaaatatactacgtgataaaacaagcaattggaaatttcacgcagttatagcgttcgctaaagatgactctgaggctgcaagttttcgtaaacaaattaaagatgttatctctgacaagcaatatgaaaatattgtttttatagatgcactttcgactcctttaggtttggaaagttttgaccagtacgtggattattctgctatggcgatgtattataacgggaataacaactctgaatctaaggaaaataccgacaaggcaaaaagagtattagaccaagattggaagaaccgcatttataatggacaattcatagtgtacacatactctaatcaagagggtgaaaaatttggtaatgctcaaggtgttgcaagtattcttcagtctattgttactagacgttttccatttgcttttgacttcatcaaagggctaactgaaaatcaacttaaactgactccagctataaaacaaagtgcaaagtctggtattactgaaaatacgagcggagttgttgttggaatagaaaagcacattttgcctaccgtttggaaaactgagaaatactgggatgttcagacctctcttccaatttctaagattaaagtagaaactgacaaattgataaataaggctttcgatagagatggccaggtacccattggtgaaatatatgattttttagaaagccagtatggttttgcccaatgtaatttgtctgcatttatagcaggcttcttgttaaaagagtacagtattgaaccattccggtatagtgattctactggcagtcatgaaacaatgacgcatgataaacttgctgagatgatagggaattatgttggtaaattaccgaagccaacatatgttgtgaaaatgacccctgaagaaatggctttttatgagttgactgagaaagcttggaatattccatccaacacatgttcttcctctggacaagcagtacgtatgttaagctctaggatgaaagccttacagttgccagtatggtgcttatctgaggttgatgaaaatggaatatttaatgttgtccaaaagtatattgattttgtgcaaaaagaaggcaacgaagcccacaaattagctattgaaatagggaaattctcgataagtaataaaaatcttgctgaacaattgtctatacttatcactagcgaaaattgtcaaaagggtatgcgaaagtttctcgcttcatttgaaagtgggaaaattttagccctagcaaaagagataattgtggatgaaaatgttgttcttgcagatattcgtgagttatttgatgtaaaacattcttgcctttgggatcaagggactggtgaatatgaaatccgcaagttgctaattgattatagtattgtcaaagaaacaaacactatacttaatagtaacgctcattcactgtctgaagcatacaaagagtggcgtgataagttaaggtttattggtatttcttatgaaatcttaaaatcaaaattcccttcaattacacatattttggatgttttgctaaagatatgtcaacaaactgaattattgacagaacaacgcaaaacattttattcagagatcaaggcacatggtgcagaaatccgtgaattgttaaataacgacaaaaagatatttgctgaggtctatttaccgtaccttgaagatttaagtgataacgatatcagtgaaataaagagtaaattaacaacaggaatgtacgagttaccaaaaactgattgtaacactaaagttaaatctgtagcagaagaatttcgtaaaggacaactcaagactaagcttcataatctatggaaagctaaaactgaaactaaagatccctacgagtggtcttaccgttataaagtaccaattttatgtatggttgaagaaaaagagtttggaactgcaaaaaaagcattcgaaactataagaagaagttctcctagtgatattgaaattaaagattctctagactttcttgaatcaacgaatctttttaaggttttgtcagacgaaaaatcaaggcaagaagtatttgagagagaaattattggtgagtatattagccttctttccagtgagagagtattaggggctcttgaacgcatgtctattgagccatatgattggtatattaatccttcagtaaagaacacaatcagaaatcttgctgaggcggaatataatgcaggcggaagtgacaaggccttaagcaagattgatagtatggacgatgcgcagttaaaacaatatcttaaacgactagtcaaagacaatatgactgtgggagttgagattattgcaagcgagggttaa

SEQ ID NO: 203 - DNA, 4209 bp, Desulfitobacterium dichloroeliminans
atgaaatactattcggactattttgtagtcccgcaggactacaaagcgaatatgacccgcgaggcaattaatgagacgcaagagacgtggctcaacttttacccgcacaagaaattcgcggaatttcttgaaactttgcttgacgggtttaagagcaatctttcaacgtggttgtatggaaactatggcacaggcaaaagcaatgctgcactcgtaacgcaaaagctgtttatggacgatgctgaacgagttcatagctggtttaggagttgtgctgatgcgctctccgatcgagaagcactcgaaaaagacttgtttgctcatcggaatgaaggaacgtttgtcgtttatgactacaacgcgtccggtgttggcccgaaagaggattttcttgtccgcttggaaaaaggtattgttgctacgctgagagagcgaggcctgaccgtaccggcgaaagcgaaccttgacagtataattgaacggctaaaacgcgaggctgatcatttttttacaacgcgcgattcaatccaaagcgaactcgcctatctacataccggtattactacagttgagcaacttactgaattgttaaataaggagcataaaactgcagatgctccaactaggctgttaggcgatgtgcaaagggtattccatgaagactccatctttcttaacattgatgtgccaacatttagaaaatgggttgctgcaatcttgcttgaaaacaatttatcgcgcatcgtctatatttttgacgagttttcggagtttattgacgagaacagagcacatttaaagacttttgaggatgtaacggaaaaccccggcataaatcactttttccttgttccggttactcatcttgaaatcacggcgtttgtagctgagggctctgaaaacgcacaaaggtcaaaagaccgcttttatcgccgcaagttacagatgcccaacgatactgcatttcgccttgccgcccatgcgatgaagccattggcagaccccgagacggacccgatatctgtcgcagaatggaaaactgaaaaagacaatctctatagtgcaatatcggatattgcagggtatttcaatactaccgatccttcttcagaggattatgttagccgccaatcgttttatgacgtactgccgatacatcctatggcagcatttttattgaaatttctatcagaatcgacgcggtcgggtcagagaagtatttttgattaccttaaaggaagcgctaacggacgtgagttccaagattttatccgcacggcaggaccgagcgttgcaaataagcaatttttaactgtggattacttgtggaagtatttcatagatcgtgaggatttgggaattaacgaagagattacgtccatccgttcggaatatgagcgcataaagaatcgcgagttttccaatcaaacgaatgacgctacggaaattcgtgttctcaaagcggtattgttattctgcctacttgacagacttaatccagatggacatgagcgattaaggccaactgtaacaaacatcgaactgtctttcagaggggacggcgcgcttgtcaacgttggagaaattgtgaaagatttggcagaagatagacactgtttctcagtcgtgaacggtcacatcgaattgtttgccacatctgtaggcggggcggatttacaaaagaaaatagcagaacaagaaaataaattccacgacttgctatccccaaaagttgcgtcaatgcttgaagaacacacaaaaagcacaagggcatctcactcagcccatcgctttgaaattcgcgtctcagatgcaattcatacaacactgacaaatatcacctcttctgtaagagatagatatagcgttggactaaataaggataacgcttctgtttgtctatggtttgttatagccagaaatgaaaaggaacagcttgaaataactgaaaaaataaaaagcattctttctcatctccatgaccaccgtgtactgatgtttacttttccgacactttcgttctgtcacaacaatgtgaatttatggaatgattacatacggcagtatgctcagtatttgctcgaaaacgacggcggagcgaagacccagattaaaaattcctatgaacgattggagcgcgaatggtttgatgaaataaagaaacaaagcacaatcattaagatgcattctattcaatccgggcaagttgtgtcctcagacacttattggagtgcttttaagcaacgtatctcagattatgttcgcaagacattaccgaattgtgttgattacttaacacaatatatatcggcattcgatattcgtggtttgaaggaatgggcattgtcgggaatacaatttgataactatgcaggaaaaagcaaacagcttattaacattttcaaagcacagagtattactgatgatgaaaattggtttgcacagaaccccaaacaccccctgtccgaaattcacgcgctatttgaaaagaaaattgcaaacagcattggcaaaggcggtcaactttccgttcgtagggtgtatattgagttacaacgcgctccgtttggcatgcgttacaatgctctcagcgcctttgtcctcggctttactctccgcaatattcttacgaaaaactttcagtggactgacggcaaacttacacgcccacttgatgcggacacgcttgctgaaattattgaatccgtagtcaaaaacgacgggaatgaaaatatgaaaggcgaaaaagtgatttgtcgtctatctaaagaagacaaagcttttattgaaaaggcgccgcaaatgtttggcgtttcctcaattgcagatgcgactattgagattgttcttggacaaattcagaacagcatacaggacatgtccgggcgcgtaccgctgtgggttttaccagaatatatccgttctgtcagtgaggaaaaagcagacaagattgaggagattttgaataacgtatgtatagcgttttccaccagttcgaaaggcaaaacagaggaacgttcaaacgcggttagagatgttggtacggctattttagaatgcccagatattgtagatgtaatcgcagactatatcaagtcagaaaattttgtaacggcttttgacctttatattgataagacgaacttagcacttgccgaacttgcgaaacgcatcggcgatgtctcccacggatacagccgcgccatacgggaaaaagctagtgaggcggcgggatggctatggaaacaggctgacatcagcaaagaagtcgacgaaatgttctgcgagtatgaagtaatagaacttgcaaagccgttactaggctttacggactttataccgtataagcacgtatttgaggcgttgcgttcagccattatgcagacaaactgcctgcccaagtcgatgattgttaccgcatatcctgcgctttcgatgtttttgtcagtattgcagcaaagcggttcagtatacgatatcaagtccgcactattacagtattcagaaatcatagcaaagctgttctttgattcaacaaaagcagaagcgcttgaaattgtgaaaaaacgcttgaatggcgcggagatttctaatgatgaattgcgcgacatacttggtggtatgccaagtgggttcggtttggatgaacccacgtttctaaacggtctacgcgccaaaattgaggataatgccaagcaatccgttgtttccaagctcaaagctgaatggttacgactatcctcaggcgtaaaaacaccatttgaatgggccttaagtaatggaattccagctcgttttctacttggtggattaccacaaagcgacgatatcctcaaagctatagagcagcctgaaactttcgcggcggcaaaacttgcggaactgcttgacactctccaagagataactccgccgagcatagtggaatgccaacaagcatttcttgcggaaactgtaccgacgcggtatgcaaaatttaatatcagcctcgcctctctccttgaatttttgcgtgagatatacggcaaacagccgaacttctggtcgaagcagccggacatttcagagtttatccgtagccaatataaaggaatgctcgcgccacaggttgcagaaaaaatccgcaaccagtcttctgatgaactgaagcaaaagcttctcctattagcacaggaaaacgcagaattaggattgttgttttgggagtga

SEQ ID NO: 204 - DNA, 4170 bp, Geobacter sp.
atggcatgctacaaagactatttcgggatcaggcctgattatgcgccgtgcatgacactcgcggacataaataagacaccggagacctggcttggattctatccgcacgattcgttcgtggatattttgcgtttgctgctcaagagtttagagggcggaaataagacgctgtggatcacgggagcgtatggcactggcaagagccatgcgtcgctggttctgcaaaaactgttcacggatgacgatgcacgcgtccagaaatggctcgcgctacgcaaagcgcagatcccggaacccgtacgtgaggggctgctggcgcggcgcggggaaaaaacgcttgtcgtctatgatgtcaacgccgacggtgttgacgcgaagaatcagttcctaatgcgcttgcagcgcggtatcacaaaagcactggtctcgggggggcacacgattcccctgaaaggcaaactcgatgaagttattgagcgcatccggcaggacgagccgtatttctttgcaaaacgcgacacgatgcaggcgcggctttcgcacctgaacgcgggtatcaaaacagccgattcgctggagaagaagttacgggatgcaaatcaggaagctgggcttgtcagcgacgcaatgcgggttttggccgcgcgacacatttttttggatttgaacgcggaagattttcttgcgtgggttgatgcatccttgaaagcgaacggactttccaagttggtatatatatgggacgagttttcgtcgtttatggaacgcaaccgtgcggaattaaagacgcttgagcagctggcagaagccgcacagttggggcggttttatttcgtaccggtgacccacacggatatttctgcgtatgtggcagcaggatccgaaagcgccaaaaaagcgaacgaccgattcatgttcaaacagcttgacctgccgaacgagactgcgctcaaactggctgcagacgcctttgtcgtcaagccagagaaggccgtggagtggacgcaagaccgggacgagctttggcgcagtgtgaatcgcgtggccgagaattacatggtagtcaacaacgcaggcatcgatgctgccgatttcaaggggatcctgccgctgcacccgatggccgcattcctgctgaagcacctgtcggtggcgattggatcaaaccagcgaagtatgttcgagttcctgaacggagaagagttcagggtattcattgagaagggtggattagaggtagccggtcatcagttcctgacggtggaccatctgtggcggtatttcgtggaacgggaggatcttgggactgggcaagcagtgcaggaagtgcgagcggagtatgcaagacgcgaaaaggatctgcagcctgatgagcagcgcgtattcaaggcggtgttgctattcggcttgattgaacagatgcaggggacaggccatccgctgctaagcgtgacgaaggaaaatattcagcgcagcttcgagggtgacggtgctttgcagggtgtggatgcgatcttaagggatttggagcagaagcactgtttcactattgtagacggccgctgtgagcgtttccgtgatcgctcagactcgaaagaaattgaggaaaaaaaagctgcgttggatggtaagtttgctgaatatgtgttgaaagatacagagacggaactggttaaacagttgaaaggtgtcaactatggcggtcgttttgatgtccgtgcggcgagcgtcaacggcctttcagcatcaaacatagcgagacgcgagtcttttggtgagactgggaaccgagtgcttgttcagttcattttggcgcgtgatgagcaagaacaattgcgcatacctgacaaggcgagagatttggctaaacagttcaaagaccagcgaatgctgttcgtgacgctgccggaagtcagtttctgtcgtgatgataaaaaatcatgggaaagcttcaaggaaaattttgcccgttctgcattggcagaaaagtccggagacagcaccggcaagaaggtgtttgaggcacaggtcagcaaggccaaagagaagtggaatgaaaaagtgacgagtgccgctgccaaactgatcgtgtacaaacccaatccaaccggggagcctttcgttgacgaagtgacgtggggacaattgaaaaaggattggctcactgactatgcgaagcagacattcgaggcgtatacggacgatctgtccggctttaacatcaaagcatttgaagttccgccacgtgacttgcataggtgggctctggcgggcatggagtttgatgggtatgcgcccccaggcatgtggaagaccgtggtggcaacatggcagaagagcggcattaccggcgaggatgcatggttcgatgcgaatccgaaccacccgctgacgcagttgcgggtcaagtgcaaggcatggcaggataacacggtgggtgctggcaatacctgctccatacgcaaactttacatcgatttgcaacgtccgccttttggactgatgggagtgccgcattcggccttcgtgttgggctttgtgctgaaaacatggttgactggacggcgcaacttgcaatggtcggacaacgtgacaagcaaagcccttgaccgttcaacgctggcggaaataatcgatgcagtagtgaaagacgatggcgccaacgccatcaaaaacgagaagctaatctgtcttctgtcgaaggaggaaaaggcgttcatcgcacagagcagcgtgattttcgagaccagcacacttgtggacggaacggtggaggcagcgctgaacgcagtgaggacacggttggaactgattgctgagcgcgtgccgctgtgggtgctgcctgaatatatctgttcacaagctgagccgagcgcggaagagatgggtaaagtcatcgatgcgctatgcgcagtgaacggtatcagttccaaaggagacaccgagactcgcggcacgaaggtgaaggagatcggcgctatacttctggcgacgccggggctggcggaggctctggccaagtatatgaaatcgacagtgtttgatgaggcgttccaacggtatgtcgataacgccaagccagagttgaaagcggcggcggaacgcatgggcgatttgtcgcgtaactactgcaaggcgattaaaaaccgctttgcggcgacgagcggctggctctggaaacgaggcgatgccgagtctgttctggaagaggtttactggcaaacactgtgcgccgaacatatccgcgggctggctggttcatcaggatacatgaacttcgaggatgcgctgtgccgcttacgcaacgcggtactgagtgagaacaaggtcccgactgagttctgggctaagaagcatccagcgttgcagcgcttctttgagttgctcaaccggccgttgttgtccggcgaggacgtgaaagcctttggtgagatcctagaacagcaaaatggggttatctgcgaagtgttctttgacgtggcgcaagcgcggcaatttggagcgatgctggaaattttcggagaaatttggcctatggcgcctgccgaaagtcgcgagctttacaacaccttcccgtcaggcatggcactagcagatgctcagacttttaaggcacaaggacgcgacaagatagaggaatactgccggacgctggtttccaagctggtagctacactatggcgccaacatacagacacggaatcacctgtcgaatggagccgcaaacactcactgcccgccgaatgtgttttggcggtagacgatgccaagggcatcattgatgcggtcgcgaatccgggaggtgtatcggcggaacgtttgcagaccgtgcataacgaacttgaaaaagagggcgcatttgtagatgtggccacggcgggtgaaaagtttctcgaacgggtgctgcctgctcgctatcaaaagttcgggttcagtgtccgagacctgggcgattggttgtgcaaaaatttgagtgacacaccgagccgatggctgacgaacggaggacttcgcgaagccgtcgaggcgttcgtgaagcagggatatgacagtcatgcgcggaagcaggccgttgagaaagtgaacacgctctccgatgccgaggctaagatgctgctccttaagatgattgatcaaattcccgatgtaggactttcggtgctggagtaa

SEQ ID NO: 205 - DNA, 3402 bp, Prevotella denticola
atgccatatagtaaaatagtgacgcttagacaaatgcgtcccgcctataatattaaggaggagagcaatggagaatggaaattttttattgctaacgatcagtttaacgaagttttgcaaaaagtaatcagtgccgtacgtaataatgatgcagacaaccataagtcgatctggattgctggaacatacggtacgggaaagagccatgctggtgctgtcattcaacatctgttgtgtgaccccatagaagatattcgtgattatgtagaggatgaatataagaaagaaaggtatgatattttgcgcaacagcctactacaactgcgagagaagaagcgtctttttcccgtaaatatgtatggctatcagaacattgctcatgaggaggacctatcactccaaatgcaacgtgaaataaaacgtgcgctttcagcagcaaagattgatatcacagtacaaacggactttgatatgtatgttcaacatgttgagaatcaaccacaattttgggaaaaccttatagaacagagtgctcagcttgcaagtgtagcccctgatactaataaactgaagcaacgcctgagagcggctgatacagatgtgcttgaaagtgtacgtcaagctttgcgtataggtggttatgatattcgtttacagagcaataatcttaagcaatggatatttgaggtgcagaatgcccttcgagagaaaactgattacaatggtttattgattatttgggatgaatttactgaagtaatgacctcaagcataggaacccgtttgttagtacaacttcaggaacttgcagaggctatgatgaatgcagagaatgactcttatttcttgtttatatctcacccttctgcactaaatacacttaaagaagaagaacgcgaaaagaccaaaggacgctatcactatataatctacaatatggaaccagtttcggcattcaaaattatgtcgaaaaagtttgagattgtaaattataccttgtacatgatgcgtcaggaccgtttctttaacatccatccagaattattggagatgttcagcaccaccagtactgatactgaacagacgatagaaaatataaaaaatttatttccactacatccagcaacagcaaatcttgcaacctattatgcacgtgaagcaggatccagcagtagaagtgtatttgaatttctggccagtgatgccgtgcgcgagttccttgatgatgacgaagcttataaggaagagcaaaccattacagccgattatctatgggactatgtgcaagaattctttgaaagtgatagtactaaatttggtgccgttactgaaagatataatagtcaccacttagctgtggaaagtcaaggtgattgttatttgaaagttttcaaaggtatcctattacttaatgctcttaacaatatagccaacaacgatactgttacacctagtgaagagaatatcaataatcttttctctgggacaaaggaacaagacgatctgcccaccattcttgatttttttaatgctaaaagcattattcagcgccagccaaacggcaatttttccattctattcacagccctgccaggagatgaaatacaaaaaataaagcaagaattaaaaacttcgagtttcttgtttaccgatcaagtaattaagttcggtagtacagcctccaatatttttacacgaaatttatcacaagtggcacgcccatatgcattccaattttttggcatacaaggtaatgagtataccctaatgaatcaaatagcaaatgcgaagaaacagacccagccctatgaagtctttctcgctattatggtagctcgcaacaatcaagaacttttgcttttgaaagagattgcagagaaaaattgcaaggatgagcgcttcactaccatttcttttgtcgttattgaggcaataatgggtgataaagaatatgaacgtttcatcgaataccaagcaaatgcacagtgcgcacaaagtcatggcttacctcagcagcatcagacatatgccaagcaggctgctgaaatgatacaacaatgggttaataagatgcgtagcaacattatgacattctatctcaatggtgatagtatgaccattgttggtagcaagatgaccagcacaatcaatggcagtattgcaccgagtattttcacgagtggtcctgaatcattagaaaccatacgaacaaaatttagcgcaacttactggaaaaaagcatctgtgaaggctacagttgatgccgtgttaagttacaatacgaagcaagatattatagataagtgtggaggtcccgctcgccatgtggagttcttgttacaagacagcgtagatgataacttgcaatggaaggacaccatttctcccaatcatccgctgaagaaagtctgtgactatgtggatgaatggctcagtggtcgccatactagcaagaatcaaagctttaatcttggtgataagctcgtaggcttaacagaagcaccttttggactcttccagagttatgcgccaatggcaatggtagccttcgccatgcgcaagtatgtcaatattatctttgatactaacggtaaacagcgtactgctcagcatcttgtagaggatgttgtcgaattattcaaagcatgggaaaatggtaagacaagcaacaaactgaattttatattcgagagtaaggaagctggtcgagtttgcaagagtcttattagaatgttcaacttgaataaactgaagggctattccgacatcagtagtctgaaagatgctcgctgggctgtacttcatgtgtattgtaaggagaaaggctatccactttggtcattaaaaaatatcgaagaatgttctcctgaaataaaggaattcatagacaatcttatgcgtgtagtgagtgatcccgaaagcatgaaaaatccaagtttgctggaaaatacaatcaacggatacgatactttaaaaacagactttggtaatttactcataccatctgcaaacaacttccataaaggctttgtcatatatatgcagagtattgacaacgtaaatgtaatggacgaggaagtggaagaagcactaaaatatctccacgagcatttggaaagtgaagttggactatggacagaggaagaagtgaaagacaaattgaaagattggcgtatatctaaagttacgcctatagttcagcccgcatcaacttctaatccttctactattatagatgactcttctgtagatacacctgcggttgattctgaagagttaaaaaagaagcgtaataaagctatcaaccgtataaacaatagtgaagatctgcgtcaagctattgaaaatatgattaccgaagaagatagtttcgttatagatatattgttgaaatatgtataa

SEQ ID NO: 206 - DNA, 3372 bp, Thermotoga petrophila
atgaggtatgaagaaattatagaattaaatgattactttcaaccggtttatgatttggaaaatgaaattggaacatattggaaacaatttattcctaatgagaaattttataaaatgctatcggaaacaataaactcacttgagagtagcaaccctgaagaaagaaaatcgatatggcttcagggagcttatggcactggaaaaagccacgcaactgctgtagtaaaacacattcttttcgatgaacttgatgagataaatgatttcatcgaaaatctagaagggcagataaagtttaaaataaaaaatttccgtaaaaataatagggtttttccggttattttaaaaggaacatcttctgttattgataataggacccttgcattggtacttgaaaaagcaacaaaaaattccttaaagaaagaaggaatcgaactcactacaaaaaccgattttgataaaataatcacaaaattaaaaagtgatgagataaattgggaaagagttttcaaaggaacagagttagagttctacgggaccaaggaagatataatttctaaacttcaacaaggggatgaatatatattaaccaagatagaagaggcactttcacaaaaaagcattcacttttctactgaaaatattgcaaactggttggtagaggtaagaaacgaactaaaagataaaggaattgcagattatttagtaatttattgggatgaattcaccgggattttggaactccctaaatctggtctattattgacggaattgcagaatatagcagaactatctatcaataaaggtgtttatttgtttgttgttgcccatagaaaaccctatcagacaaatatttcaagagatgatgtagagaaagttcttggaagatttaaagtgttggattattcaatggagcctgtaactacttaccacattatcgacgctgctattaagaaaaaagatatggacagatttataaaaatcaaagatgaatacatagattcagtgaaacctttaatagaagaaattacaggaagtgaaggaacaaaagttcaaaaatccttagagaaccttttccctatccatccttatactgcatatttagcaacttttataggaagaaatattggctctacagaaaggagtatattcgaattcctttatggtaaggctggagcggaaatcagcttcaagaaattcataaaagaaaatccagaagaaaaaggaaagatatttttgacagcagattatctctgggactttttctatgaagaatttgaaaggatggaaagtgaaaaagttcatgccgtgttggaaaaatataaactacataagaactctttggaagagaaaggtgatgaatatttatctgtgtttaaaggagttcttcttctaaaccttctttacggatttgtggaggttggggaattttctcttgttgctccttccgagaagaacataataaatctttttgctggtgttattaatcagaaagatttaactgtcatcctatcattcattgatgaaaagcaaattatcaataaaacaccagataacttatacttaattacaagctcaagtctacactcgagagaagttgaaactgagaaaaataagataaaaaatgaatatgatacaattgacagaatacttaatggagagcaaaaaaaagagctacaagacacgattagagcttccgtaaatagagatgttgagttcataataatggacgctaattcaaaagaatatctaataaggagtaaaatagaaaaagcctttaaaaaagaccatgcaattcacttgtgtttgtttttaggaaaaaatgatcaagaactacaacaaataaaagatatattaaagagtatttctaatgatgactttagaaatataatttttgttgtatctgaaataattttggataataaaacattcaatagattcatagagtataaagcaagggcgatagttgcagacagacataattatactgaagagagaaggataaacgaggaatatgcaaggaaaattattgacgactggatcaaccaagtaaaatctggatacatcgagtggttttttcgggatgagactggtaaagaactgatgaatcaatttagtagaaagataaacgaggaattgtccagaaagatattttcctatggtttagagaatatagctagaactcaaaagaatagaaacatttggacatacaaacgatctaaaacttctgtcgaaatatttttattcgccaatagtagagaggatatagaagaaaaaacatctggaagtctagaaaaatatttacgagagattataaaagataacaacggagaatacatcgtagatgcaaatctgaaaataaaagatgatgttcctgaaaatcatcctctaaaaaagatgtatttagaagtaagaaaagtctttgaaaaagaaaagagcaacggagtgtttaatctaggggaagctctaaggttcctgaccaaaccaccatatgggttatacctcaatatggttagtatggcggcaattagctttttaatgagggaatacatcggtaaaatttttgaggcgggaacaggaataccaattcaaaaagaggtaatgagagataaaatactaaccttattcgattactggggagaaggaacgcgtggagaaaagttggaggttcgttttggaacaaaagatgaagaacaacttattgaaattctgaaagatttgtttagacttgaagatgttagaagtttgaatgatgcaaggtggaaaattagagaatggattaaaaaacaaggatttccgatatgggtattcaaattcgcagagaatataaatgaaaatactaaaaaagctatagataccatttttgagctcattcaatcaattgatagagagctcacacatgaaaagataaaggattatctaaataccatagagggcttagagtatgatcttagcaatttaataatccgagagaatccgaaagagatgtttaaaaagtggttgaaaagtattgaaggaattgaaatttcgtccgaggatatagaagaggttatagactacattagaaaaaatatgcaagaagaggttgcttcttggacagaaggcaaagttagagaaaaggttaaagattggaaacttaaagaattacttaaaaaccagcaaaaagaatcgagaagccctaagcagggtaatgaaacagccaccccccgaaataattcaatatctgaagaaaaggtggaggatattaaacaggatattaaacaacaaatcgaaagctgttccgcagagaagatcagagaaattttaattaaactgatagacaaacaccccgaaatcgtaaaaacaattaaagaatatctggaggaggattaa

SEQ ID NO: 207 - DNA, 1710 bp, Planctomyces brasiliensis
atgactgaagacgagaaagatttgatcgctgatttattggtgaagtgggaagatgccttcgaccaagggcgagagattttggcggaggagctttgcactgattgtccgcatctgacgcagacggttcgctcgaagatcgagagtctaaagacgacggcgtggacaaagcgtgatccggcccggcctctcgatgaggccgaagttgcacgggacgacacaggaaccgtgctggccgaccggtatcgtctcgaacaactactcggttcgggaggttacggtcaggtctaccgagccagcgatacgaagctgcatcggcaggtggcggtaaagattggacaccatcgcacttcgtccgacctcctacttgacgaggcccgacgagtcgcaaggtgccccaagcatccgggcatcgtgagcgtccatgactgcggtgaacacgagggacgagtcttcctcgtgttcgagtacgtggcggggcgaagtctcgccgaggtcgtgcgaacgaaacggccctccacgtcggaggctgtccaactcgtcgccacagtcgccgaatcgttgtccgccgctcacaagctgggactggttcaccgtgatttgaagccggaaaacatcctgctcgacgaggccgggaatccgttgatcgccgatttcggtgttgcttgtacgctcgatgaagctgcaaaaggaagagcgggaaccagcggcacgctaccgtaccagtcgccggaaatcctctccggtgatatgcagcttctcgatggacggtgcgacatccattccctcggtgttgtgctctatgagttgctcagcggtaagacgccgttcccggccaaagacaagacagagttgcgggaacagattctcttccgccaaccgacgccgcttcgagaagtcaacaagtctgtgccggaagaactcgatgcgatctgcatgaaggcgatggcaaagcatcccggcggcagattcgaaacggtcgatgacttcgccgccgctctgcgaaactggctcgacaactccgtgagtcaccgccgttggcttcgcttcgtcggactggccgtcgccctgtgcatcatcgtgctgacggcgatttggtacttgacgagaccaaaccctgagtccctgatccaagatggcctactacacttcgatggccgcacacgaatcgtgaccaacgtagatcggacgctacccgtgacgctcgaagtttgggtcaggcccgatccttacatcgatgagaactgccagttcatcatcgggagcgacatctccggcaagtacggcctcggtctcgccatctgcggctcgatgctgagcgtcgaatacgtccgaggaatggtcaattcttccgcagccgttccaccaaaccgttggtctcacttggctgcggtgttcacagagaatgaaacccggctttacctcgacggaaagctcgtccaaacggcccccggatcaaaaccgggaggcgagacccggttcgtcatcggcaacgtcgggcagaacaacctgatcagcttcttcaaagggcagatgaggtcagtgcggatttcggagggcgagcggtattcaggcgagtttgagccgccatccgaattcgccagtgaggaatcgcccctgcttttgatttccaagcctcgtatcgaagggaattcaattcggacagcgagtggaacggtcgtggggacggtcgagtacgtgaaggaacattga

SEQ ID NO: 208 - DNA, 4203 bp, Burkholderia thailandensis
atgagtgggcgttggaaggcgatttcgccgtctcagtttccgtgggaacaggatgcgctggactttgttcagcgcgcgctaccgaaccgcgagccgtttcgcgcgtacagtaacttcgagtttgtcgccgacgacgggagcatcaacgaagttgatctgctagttatctcgcgctacagcatctttcttgtcgagataaagagtcgacctggcgaagtcggcggcgattcgcacacctggatctggcgggacggtgggagagagtacttcgacgataaccccttgctgttgaccaaccgcaaggcgaagaagctcgcgtcgctccttcgcaagcaactgactctccagaagcgccgcacaccctacatccagtccctggtctttttgtcggaccctgcacagcgctgcaagcttacgggtcccgcgcgtgaaaacgtgcaattgcgtgcggatattgtcggcaaactattcgatgagacagcccctgtcaccagtgcgcagcccatcgaccgggatttggcgacgtccatcaaccgggctctggaaatcgttggcattcgcccgcctcagcagagccggcgtgtgggtgactaccagctcgaacaggtccttgccgagaccgactttcaccaggactggctggccaagcacgtatcactgaataacctttggcgacgagtccgactttacaccgccaagcggacgctcagtgctgcgcaacgcgcggtgctggtcgacgcggctcgccgagagtttcaattgcttgagggtatacgccatccgggcatcctgcgcgcattggatttcattgacagtgagcatgggcctgccctgatctttgagtacgaggaaggactccaacggctcgaccacttcattcgggctcaaggcgatcaacttgatctctggcaacggctgaagctcgtgcgcgcgattgccgaagcactggatgcggcgcaccgctatcggctctaccaccgtggcctgtcaccccacacgatcatggtcaggaccgtcggtaccaattccttcgatgtcaccctcttcgattggcagatcgctacccgtcagttgcaagaggccgagagcgaaacgacgggcacgctccatgtggaaatgctctcagaccgtgtggcgcaagagatctatctcgctcccgaagcacgcaacgcgccccggccagatgccattaagctggatgtgttctcgcttggtgccatctcgtatttcgtcctcgccggcgagccgccggccgttagcggcgatgagttggtcatcaagtgcgaacagggccccgggctcaccttgtcggcgatggtcaatgggtgcttggccgaaatcgaggatctaatccagtttgctacctggccgtcgcccgatgatcgattcagctctaccaacgaattcctgagtgcgctcgacaaggctgaagaggcgcttgaagacgctctgaccgcaccggcatcacctttggcgtcaccccttgatgcgaacacgggcaatgagctcaacggctttgaagtcttgcgtcgactgggcaagggcggtaccagcctggccctcgaggtacggcggaaaagcgcgggacaaccacgccagggagtctttaaaattgcgttggagccggagtacaacaatcgactcaagcaggaagccgagacgctggtcagacttcagccccatcagaatatcgtccagtgctttgagcgcttcgaaattgctggtctggcgaccttgttcctgtcctcggcaggagaggaaacgctgggtgaacgcttgcgtcaagaaggacgcttgggtttggacctgctgcagaggtttggcgaagagctgatttccgttgtggagtacctggagcgcgagggcgtcccgcaccgcgacatcaagccagacaacatcggtattcgcccgggagccggaaaacgacttaccctgacgctgtttgacttctcgctggcgggtgtgcccgctaccgacctgaacgcgggcacacgggtctacatggacccgttcctgcgcaaacgcggaatgtgggatggctatgccgagcgctactcctgtgcgctcactttgcacgagatggctaccggcacactacccgaatggggcgatggcagcgccgatccggttacgctgaagtcggaaatcgttctggactcggagcgctttgacgcgtcgattcgaaagcaggcactcgacttcttcagccgggcgctggcgcgcgatcaccgcaagcgttttgacaacgccgagcagatgttgcgtcaatggcgcagggttttcgagaacgtctcgcgtcctgtcacgacgcacacgacgcaacttccgcaaagtcaactacccctcggcgaagaatcacctgcagggggaatcacgcccggcacgcctcttgagtcgttggagctggactcgcgtcacctcgaactgctcgaccggatcggtcgcgatgagctggctactgccggggatctggccgatttaccgcgtaatcggctctacaggcaccggggcattgcgctggctgtagcacgtgaactgcatcaaattgccgaccggctgcgtcaccagttcagcggtggcgccgctaaggatgacgagcccgcagatactactgtagccaaactatcggtggatgccgcagccgcattgctcatacccaagaaaggcgatgaaagccaactcgaggtattggagaaatggctcgggctgagcgcgcagccgggcacgtcacttctgcaggaagacgtgttgcaatcgatggttgagcggatgtcgcggcagccagagatcacccacctgcgcgacgacgtggccctagtgctggccggtctgggcggcattgcgaccgttggtgaaattgccgccgcattgctggcccgacgtgggagcgtgcaaacaggtgcggcccgacgcagcgaggccgaagccgtgacacgggccgtcattaccgtcgagcgcaccaagcaagcagcccgctggcaacttgtgaagcgcgccgccaacgttcgccctctagtggaaccaccgcaagttgacgatctggtggtcgcgaccttggccagcagcggtgcggccgggctattcccttctgctcccgaggttcgagccagctacgccgtggctttgggcgaagcagcggaccggctggcccaacaagaccctctgccgtcgtcgcaacaggtggcggacaccttggcccgcataccgccgccggctggcgacttggggttgagctcggagcgactgattcgtctggctgccgcttgtgcccaacaggcggctttgtcctcgcgtttggagttttacccagtccagctgtctgctgcgcgtgccgtcaaattggccacgaactcattgctcggtttgcgtcagttcgacctgcagacaatcgggcgccggatcttcgctcggtatcctgaggccgcgccgctgcccggccccacagaactggagcaactgctcgaggacgctggattggaggtgaagtgggacggtgccaagtgcgccttcgtcacgcactattctgcgggcatcatttcgagcaccacgcagatcggccgctttggcaccaataaccgcccgcgcacggcgaccgcaccggatgtgcaggcggctcagcagatcgacgagcgcatcaagcacgccttgagcagcggcaaattgcttaccttgtccgtcgatcccaagggcctcgcgatcgcgcagcatgagctggcgcagcgttttggactgaaagtcatcgatttcgacgacctcgtgctcacacagtttgaggcgcaagccaaggaatgggacatagactggaataccctgctagctgccgatgccgctcccgcaggttcggtcgattctcataactttgccaccgttcttggcgaagtttggcccaaggttgaagcacagttactccaagacgaccaaccaggcttgttggtgaacctcggtttagcggcgcgctggcagaagatgcccttgttcgccaagcttgccgatgcctgcatgttcggcaagcgccctccgctgattgccttgcttgcgagcccgctaacgcccgataacagaccggtgctggacggcgaagcagttccagtcaccatcaacactacggattacggtcgcatcccccgagcttggcttgaaaacgcccatcgcaaacacgacatcacggcctctacgaccagcacgaagtcaaaactaatatga

SEQ ID NO: 209 - DNA, 4242 bp, Candidatus Accumulibacter
atgaaagatccgcgctggacagcgatctcggaatcaaactttgcctgggaaaaggcggcgctcgattggctgcgtgatcgactctcggatcgcgatccctggcacgtctggtcgaactttgaattcatcgacgacgaaggcaaggtcaatgaggtggatgccttggtgctctcgcccgtgggcatcttcctggtcgaggtcaagagtcgccccggcgttctcaccggtgatgcgcatacctggacgtggcgtactgacgggcgtgactacgcctacgacaaccccttgattcttgcgaaccgcaaggccaagcgactggcgacgctgttgcgtcggcaatcgtcggtgatcaaggcgaggtcccgggtgccgttcatcgagccactgatctttctctcggcgatcaacgctgacgctttcaggctgtcaggtaacgggcgctccggcgcctttctcaagggtcgtcccgacaccagcaacgacgacgggatcatcgcccgcctggagggcaccgggaattacccacccactggaccgctgctcggtcacgaactggggcgtgtggtttgccgcgccgttgtcgaagccggcgtgcgcccatccaacaaacaccggcgcatcgctgactatcagttgggcgccctcattcaggagggcgagaattatcaggactgggcgggagagcacgtttcggccggtgtccgccgtcgcgtcaggatttatggctacgccctggcgtcgaccgttgacgcccggcaatcgctggtgcggcaggcgacgcgcgagttccagattctcgagggcgtggatcatcccggcatcctcaaggtgcgcgatttcaaggaaagcgaactcggcccggccctgcttttcgactacaacccgcagggccgacgactcgatttcctgctgcgcgagcaaggcaatcagctcaacgccgaccagcggctgtccatccttcggcaactggcggaaaccctcaagtatgcccaccagaagaagctgattcaccgggcactatcaccacaaagcatcctcgtccagaaccaggatggcgccccactcaagctcgccatcatgaactggcagctcgccgcgcgcggtgggcaagggacggagcagtcgaatctgacggctcttggcgcatcggctggaacattggcgcgtaccgtcggaacccggcacgttgaaaattacctggaagatccggcgagagtatttctcgcaccggaagccctctgggatggcgcgccaactggaccccacctcgacgtcttctcgctcggcgccatcgcctggcaggtgttcaccggcgcgccgccggcaaccagcgcctccgagctgcaacagaaactccgggccggcaacggattgcgcatctccgatgtgctggatggcgccggccgggcgctgcaggacctgatccagttctcgacctgcccggacgtttctgcccgcctcggctcggtgacggattttcttgaatacctcgaacttgtcgaggatgaactgactgcgccggccgagttggccacagtcgatccagcttccgccaagtcaggcgaccccatcgatggcggtttcaccgtcgtccgtcgtctcggcaagggctcgtcatccgatgtgctgctggtcactcgccgcggcaacgccgaagagctggtcctcaaggttgccctcgacgccagccacaacaggcgcctgcttgccgaaggggaagcgctgcgcaagctgcgccacgccaatattgtcgagtggcgcgaaacgctgaccgttgccggccgcacggcgctgctgatgagcagtgccggcaaggacacgctggctcatctcctgcgcaacaaccgcccctcgctggatctcgtccggcgtttcggcgaggaactgctgcagacagtcgtctatctggaaaacgaaggcatctatcaccgcgacatcaagcccgacaacatcggactttgcccgtcgtcgcatagcggtcgcctgcaactggtactgttcgacttctccctgtcgaaagcttccgtcgacaacatccaggccggcacgcgcccctacctcgatcccttcctcagcctgcgcaagccgccacgctgggacatttacgccgagcgctttgccgcagccatgacgctctacgagatgctcaccggcacactgccgggctggggcgacggcgtctccgacccggccgtgatcgagcccgaagtcacgctcgatgtcaccctcttcgaccccaacctgcgggaagcctcggccgccttctttggcaaagctctgcgtcgtgatttccgcgagcgtttcgacaacgcagaagacatgctgcgtgactggcgaaagattttcgaccaggccgacacgcaaaccgcagccgatcccttcgaggtcatcgctcttcgtgcgacgcgggaaacggccattggtgagctcgactacagcgttgaagcgcagaacgttctcgaccgcatggggatccacagcgttcgcgaactgctcgccgtcgaccgcgtccgtttccgctacctcaagagcgttggcgacaaggtgcgcaaggaaattcggggcaccgccaagcgcctcgcccagattcgtcccgatctcgttgccggcacgcccactgttctcgataccgatgccggcaagagcggcattcgcagcctcgacgaactcgccaaccacctcttcccgaagcgcgccgcagccgacgagcgcccggatgacgatgcgctggcgatctacctgggcctggagacagccgaaacgggcaccgagaatgaacgaaacgccacactctggcccactcttggggacgcagcgcaggcagcgggaattgcccggccggccttgacccatgcgatcgtcgcctcgcgcgcgcgctggatcaggtcaatcgccatcagcgaagtgcgcgaggaactggccatcacgctcagcgccagtggcggcgtcatggccgtcaccgaagcagccagctcgctgctggcgagccatggctcgatagagcaggacgacgccaatcgcctgcggctcgctgctgccgtgctgcgcgccgtcagcgaaaccgaagccgacctcgcgcaaccgcgctaccaggtattccccggcgctgcaaagggcgccgtaccgctggtcgcggccagtgtcgaccatgccgactacgcactccgactcggcgccgccgccgacagcgtcatcgccgccgatgaagaaacatcggctggcgaaagcctgccgacaccgcaacaggtgattgaaaggctcgaagcggtggatcgtccccacaccgttgccgccgtgtccacgcagcggctggtgaagcttgcggcaggttgcagccagcgcgcggcagtttccagtcgtctggaactctatcccctggcgatggctgcccagcgcgccatccggatcgccatgggctccctgatcggcccgcgtgtcctcaccgagagccaggtacgcgaacgcatcatggggcgctaccccgatgcggagcccctgcccggccggccgtcgctggacagcctgctcggcgcagcaggttccgatctcgtctggcgccatgacggcgaagacggtcccggctactactccgcgcacagaggctttggcccttcggcgggaacgaccaccttcctgcaccgtcccgacacggtggccgacgacgaccaaagcgaagaagtcctcgccgcacgccagttcgacgacaggctcaagcacgccatcaaatcggggggatttctggtgttgaccgccgcaccgcggctggcgcgccacgccgaggcggcactgcggcgcaccattgccggcgccgacttcctgccgatcagcctcgaccgcatcgtgctcgaatcactcaaggaagaagcactgcagcgcaaggtcggctggagcaaggtcctcgaagccgacatcggcggaccgggctcgcgcgactggagcaacctcatccgccttgcctctttcgccagggcgcgtatcagaggaaagctcaccgctcagggcaaatcgctgctgcttctcgatcctggcctgctggcaaggctggatttgctggacctgatcagcgacctgcaaagcatggccggcagggccgacgggattttgtcggtctggatgctggcgccaatggctggccagggcatgccaacgctggatggcgtaccgattcccgtgattacgcaggcccagtgggcaagggttccagaccgatggccaggccattcttctcgcaccgctgcctga

SEQ ID NO: 210 - DNA, 4089 bp, Corallococcus coralloides
atggcggccaagttcatccagatcggtgagcccgcgcacgatgccgagcggcaggcgctccgcttcctcgtcgaggggttgccagagagcttcaccgtctacggcaatgcatggctcgtggagcgcagcggcgtcgtctatgagctcgacaccgtcgtcgtcgcaccgcacgcaatcttcgtcgttgagatcaagtcgtaccgaggccgcattgagggtaccgacaacgactggtggctgccggagaagatcagaagcccgctcaagctgaatcgcatcacgtcccaggtgctcaagtcgcacctgaagaacgcgagctaccaggctggccaggtgtggaccgaaggccttgtcttcctctcggccacgactgacgtcggcgtgcgcggcccggcgagcaacgaccgcgtccacacgcgcaagaccatcctggctgcgctccaggatcccgagctcatcaagcgcatgagcggcgggcgcgcgctcatgccgtcgtcgaacgccgagcgcgaattgctcgaactgttcacgggcgcgcagagcgggccgcgcccggtgcgccgtgttcgcgagtatgaggtcgtcgagaccttcgagcaccacgacaccttcacggagttgctcgggaagaacacgctgtcgggagccgagcgcgtgctgcgcatctacagcgtcccgcccctcgctacgcagacgcagcgtgaccgcatctccgagcgcgcgcggtgggaagcgcaagtcctcggtcgcctcggtcgcagtgagggtgtgctcaccgccgatccgcccttctccgacgaggccggcatcgtgctgccgctcgagcacttcaagggcatcacgctcaccacctgggtcgagcgctacgggccggacgcgcgtggcaaagagaaggctgagctccgcgtccgctcggacctctggatccgcatcgcccagacaatcgacgaggtgcaccgtcagggcgtggtccatcgcctgcttcggcccgacgtcgtccttgtcgaggacaagcaagagccgacagaggtgcgcgtcacgggcttcgacctcgcgaagcagatgacgagcgacgccaccatctcgctcaccaccatccacgacgaccggctcgtgtacgcggcgcccgaggtcgtgaccgcgttctccagcgcagagcccgcgtccgaccagttcagccttggcgcgatgctggcactcgtcctcaccggcaagccgctcttcgagaacacccgccagctcatggcgcagcgccggctcatgcgccgcgtgcgcgacatctcgcagcgcctgcccctcagcctcgacgaggccgtcgccaagatggtcgagctgcgcgccaccgaccgctacgccacgctcgccgaggccatcgaggccgtgcgcatcgggcgcgatccgtcgccccgcgttcaggcgctcatccagaacgtcggccgcgcgcagctcgatgccgacaacctccaggcgggccagcggatcggctccgactacgagatcgtcacgcgcctcggtcagggcggcatggctgtcgtctacgccgcgcgccacctggtcagcgggcgcacccgcgccctgaagatcgcgcgctcggaggacgccgcggaggaggccttgcgcggcgagtacacggtgctcaccggactcgatcacccgaacatcgtgcgggtcatcgatctgaccaagatggtcgaggggcgcctgacgctcgtcatggagcgggtgagcggcatgaacctgcgccagtggttcgcacagcacccagcccccgagcctaccacgcagcgccgccttgctgaggacctcatcgcgggccttgactaccttgagcagaaatcggtcacgcacaaagacctcaagcccgacaacctgctcgtctccgacgggcggctcacgatcatcgacttcagcctcgcgtccatgcctgaggacgcgccctacggcggcaccgccctctatcgcgactcggcgagcgcgcgctggacgcatgccaccgaccggttcgccgccgcgctgtgtctcttcgaactctacgccggccgccacgccttcgagggccgcgtgcccgagccgggccaggcgccgatcgtcgctgacgacgacatccagcccacgggcctcgccgcgttcttccgcaaggcactcgaaccgacgcccgagaagcgcttcccgtcggcgcgcgcaatgcgcgaggcgctgcttgtcgcgctcggcgaggacacgaccacagcgtcctccgtcccgccgcccaagcagatcgacgcgaccacgccgctgcgcacctccgggctctcgacgcgcgccatcaacgcgctcgcccgctgccaggtccatacggtgggccagctcctcgcactgcctgacgcacaggtacgtgccattcacgccattggcaccaagaccgcgaacgacatcatcgcattccaggagacgctgcgcggtcgcgggctcgaaggcaccgagtcggcgggcacgctcgagcctccgctcttgcccgacctctgctcgtcccctgagcccgtgcagaagcttccgcttggcgagacgctccgctctgcgctggccgcgggagggcttcccacggtcggcgccgtggcctcggtcacgcgcagcgcgctgctcgcgctcccgggcattggccgcaagaggctcgccgaagtcgtcgaggcgctgtaccagttccgtgcgtacaccgaaggcaaggcgacgggtggcgacgacggtgcgcacacgctcgatcgcgtctgggaactcgcgacgaggccgctcacgcccgagcagcgcatcgccgtcgagcgcgtcatcggcattaccggcgagcccgagacacaggagcagatcgccgacgacctcgggaccaaccagccgaaggtcagtcacgacgtctcgaaggggctcgagcgcatggacctttcggcgctcgccgacctcacgagcgccttcgacgcggtggtcgatggcttcggtggtctcgtgcggcttgacgagatcggccagcgcttcgagagcgaatggcccgcaggcgtcgtgaccggcgaaggcatcgtgcgcgtgatcgtgcgcgtcacgcccggtcgcgcgcacatcttcgaggtcgacggcgctgagcagccgattgtcgcgcgccccattttcgatcgcgacacggtcaaggccttcgccgccgaggtggtgcgcctcgccggtcaatggccgcccgtcgagcccgacactgcgcggcgcacgctcgcggggctcctgccgcacttcgacggcgatccgctcgccctcggtgtgcgcatctgtgaggacgtcgagatcgccgagaccgggcacctcttcatcggcccggttgacccgaagcactcgatcggtttcgtgctcgaccaggcccgcgagccccttcagctcgaagatctcgccgtgcgcgtgcggcgcatcttcggcccgcacacgccgtaccccgatcccgatcacctgctcgcgatcctgcgcgaccttgactgccgcgttcagggcgcgctggttctgccgggccgagcgggctccatcgtggccgcgcagccgctcgctgcagacgagctgccgaacagctttggcgccgagcgcagccctgagctggtggtgcgcgacatgttgaaggaggccgccgggtcgcgcggcttccgcatgctggtgacgcctcccgagggccacgccgagatcgggcgctccgtctccgccgcgctcgggggcaagtggctttcgttcgacgacgctttcttcggtgagcattctgcggacatcaagtcgctcgagcgagccgagcgcttcgtcgcccagcgcgaggcgctgaccgaggcggcggagcagacgctgttcaacctgctcgaagaatacggacgaccgggcaacgtgatcgtccttggcgacaccgcgctcttcggcctgtgcgaggcgctcgaccttccgcgccgcctctacgacgagacactctccggcagccggggcttctggatcctcgtagtcccgggcgtcattcacaaccgccagccacgcttcaacgagggctccgccatgtggcacctcgaaggcgcgacgctgcctcttctgcacccgcttccgggctga

SEQ ID NO: 211 - DNA, 4008 bp, Corynebacterium variabile
gtggacgccctggttgtctcccccgcccagatcaacctcatcgagctgaaatcctggagcgggcatttcacgggcaacgagcattcctggcactcggactggaacggcggcagctcccgccgcaatccgctgggtgcagcgaactacaaggcgaaactgctgaagtcccgcctggagacggtcttccgccgcatcctcaccgagcaccggggcgacccggactacccggagtctttcgcggaggtgccgtggatccaggagtgcgtcttcctccacagtgagcggatcaccacggatttctcctcccagggtgcgcagaacgtcttcggcatcgacggccaccgggcgcagacgaacctcccgggcatcggcaaccgcatcacggagaaggtccgccgctaccaggccccgatcgacgaacgctttgccacaaacatgctcatcccggcactcacggagatcaccggttaccgccggcgcaacgcccgggcagacgagtggctgctcaccgaacatctcgacgacgaggaggaccgtcaggtctgggccgcggaaaatgcccgcgaccggaaggaccgcgcggtggtccgggtcatcgacatcccccgcaccgccgaccggatcgagaacaaccgtctctacgcccacgcgcaccgcgagtacgaactgctcaaagggctaacccacccgaacatcgaggcgccgttcgccctgaagatcgcggacatcggtgccggcgaggccccggccctggtctaccggccctccgacggtttcgagccgctggacctgctgtacccgggtctggtcctcaccgccgcccagcaggtcgagctgatcacccaggtggcggacgcggtgacctacgcccacgcgaacaacgtggtgcaccgccgcctgaccccggccgcggtcctgctgaacacggcggcgctggacaaggacaaccccgccgggtcccggatcgaggtgaaggtctcccgctggacggcggtgaccgagagcgtgcagtccacccggctgcgatccgccctcaccgcgcagaccggcaccaccgccgggacgaagaacgccacctccttcgacgagaccgtcggtttcctccccccggagggtttcgacggcaccgcggaccgtaccgtcggcgacctgttcagcatcggcgccctggcctacttcatcttctccggcggacgccagcccgccaccacccgcgcggacctcgaccgggtcctcacccgctccgggggcctggacctggacgccaccgacgcacaggtcgaggaacgcatccgcgacttggtcctcggggtcacctcccccagtcccaccacccggctgtccacggtggagccgaagtccggacgccgcggcaagggtaccgatccggtgaagctgttcctggacaagctccaggacaccagccgcgaccgcctgccggacgagggcgacgccctgcacccgaaggtcggcgaactgctggacgaccgcttcaccatggtcaagcagctcggcaccggctccaccgccctcggcctgctggtccaggacaatcaggcggacaactccgaacgggtcctcaaggtcgcccgctccgaggatgtcgtcgccgacctggagcacgaggccgagagcctcaccgagctgagccgtaagctcgccggcaatccgcagaagaagcacttcgtcgagctgctggagcccaccctgcggctgccgttcaaccgcaccgccctgctgctgtccttcggcggcgagttcaccctcgccgaccagctgcagatgggcccgctgggcgccgaccagttctggacccacggcgagcagctcctcaccctcctcgtcgccctggagaacacgggcctggcccaccgggacatcaagccggcgaacctgggtctgctgggcaagccgtccgccaagaccctcgtcctcttcgacttctccctgacccacaaggatctcacggccacggacctgggcacccgcccgtacctggacccgttcctgtcgaaggacgccacccccgcccgcccgcacttcgacagttacgccgagcggtactccgccctggtggtgctgctgcagatggcgacggcggactacccccgctacggtgccgacgacggcaccgccgccgcactgaccgacgggcacctggcgctgaccgccgaggacttccccgccgagtggccggccgcccagcgtgaagccctgaccgacctgttcgccgacaacctggaccgggacctgcgccggcgcgccgggtcggcccaggatctgctggaggcgttccgcagtatccgtcgccgtcgcggtaccaccggtgctgcgggagcttccggtgccaccgacaccgccgacgccacacagatccaggaggccgccccggtcccggagctgaccgtcacccggacaccctcgggtgtcacactgctgagcctgaacgacctgtcccaggaactcgccgcctactcgggggcgaagggctcccacgagcgccgcctggtgcagaacatcctcggtgtcgccaaggacgccacccacatcgacccgttcatccctgccagtggtttcgccgagatcctggagacctccccgggcaagatgccggcactcatggccgcggtcgccccggtgtgggaccagacccccgccctgcgcaacgccctggacgcactgagcgcgaagctggcgacggtcctgcgctccctcggcgggatcggcacaccggaggatctgcgcccggtggtcgaggaactgttcccctccaccgcctcggcggtccccaccccggggtccacaccggggcagaacgcccgccgccagctcggtgtgctacgcctgctggagatgacactgtcgcgccgggccgacggtgacggccgggtccatctcatccgtcgtgccggttccggggatgctgcggcggtcgccctgaccgatgacgctgccctgaccggactgcctgccgcgctggcggaggcggcacagaccctgctggagaccgccccgcacgagatcgtggatgccactgccctggtgaccgccctgtcgaatgcggcggtggagtacctgggtgtggcgccgacggatctgcaggtgcccccgtcgatgctgccgcgcctggcagtcgccgcggacggcgccctggccctgaccgcctcgggtgacctgtacccggtgggtatctcgacggagtccctggtgcgcgcggtcttcccgacagcggcggaccgggtggaccggcacaccctgacgaacaaggtgcagcgccggttcccggaggcggtgcatgcgaagctgccggcgcatccgaagttgacggagatcgtcacggccctggtcccggacctggtctatgacgccgcgaagaaggcgtggctgcgcccgacggcggaacagccggtcagtgtgctggagacccggctgacccgccacaccacggtgggtctgtcggaccggcctcgggcggatctgccggagcgctcccgggtactgctagacgggctggaggccacgctgcgggaccggtacttccgggttgtcccggtggccaccggtgaggcggcgcagaccctggatctcatcaagaccagcttcggtgcccgccatgtcgatatcgccgaggtcgtcctggacgagttgtggcacatgttcgaggagaccagacagacggcggaggcgttcaccgcgctactggacatggacgcggcggacaaccctgcccgcccgcagcttgcccaactgatccgggtcttcgcggacaaggctctgaagaatgcgctggccaccacggacccggccccggtggtgctgacggatgcctcgatcctggcggacttcgggtgtctggatgtgctggccccgtggatgcagatcggggcggacaacccggtgccggtctggctgatcaccgtggacgattcgccgtcgctgacgaacgcccatgcggtcgagggtgtgcagctgccgctgagcagtccggggcaggtagtgggagcatag

SEQ ID NO: 212 - DNA, 4221 bp, Frankia sp.
ttggacgatgagcgctggacgcagtgcacaccgtccgagtacgcctgggagcgtgcggccctgtcctatctcaaggcgcagctaccaaccggggatccctaccgggcttgggcgaacgccgagtttctcgggtccgacggttccgtcaacgaggtcgacctgcttctcgtcctgccggcgggcatcgtcgtgctggagatcaagtcctggtccggtgtcctcgtgggagacgcgggcacctggcgtcagagccaccgcgccccggtcgacaaccccgtcatcggagcaaaccgcaaggcccgcaaactgaagtcgctgctggtttcccggccggcgatgcggggccgacgggtgccatgggtggagggcgcggtattcctgagcgacgcgcggctggagatccgccttgtcccagaaggccgggcgcacgtcttcggacggcatgaccagacccagctgccgagtttcctggacttcgcgcggcagcccggccgggtggacggcgagctcagtaatgccctggcccgggccgtcgaccaggccggaatccgcccgtcccagcgggcgcggaccgtcggcagccttcgcctggagctgcccgccttccaggagggcgtcggctggcaggacttcctcgcccgcaaccagcggtttcccgacgaccggccgcggcgggtgcggatctatctggccagtggtgtggagtcggtgcaccagcgtgaccagctcgtgcgggccgccgagcgggagtacctcgcactacgcggcatcgactatccggggatcgcggcgccgatcgacttcgtcgagcacgatctgggccccgcgctcgtctttccccacgatcccgagctgatccggctggaccatttcctccaagaacacgaacgcgagctgtccttcgacgatcggttggcactgctgcgcgtccttgccgagaccatggcctacgcccaccggcgggtgctgacgcaccggggcctgagcccgcgatgcgtctgggttcggcgccggtccgaccgcttcgccctccagatcacggactggcagacggcctcccgcggctccgaatcgacgtcagggataccgagcaccaccggcccggccacgtcgacggggggctacgtcgaactggccgacgacgccgccgcggcctacttcgcacccgagtggagctggggcacggcgaagggggtcaccctcgacgtcttcggggtcggcgccatcgcctaccggatcttcaccgggaaaccccccgcggcctcatccggggagctcagccgacgtctgtccgaacacaaccgactgttactcgccgaacaggttgatgccgtctccgaggagctcaacaagctcgtcgcccgggcgaccgaggccgacccggagcaacgcacccgggacatggccgcgttcctgctcgatctcgacctggttcgggaacggctggccgccatcgcggaggaggcaccggttgtcgttgatcccctggaggccgaggccggcgccgaactggagggcggattttcggtcctcggccggctgggccgcggctcgacggcgctcgctctgctcgtcgagcgggacggcgggcgcgcggttctcaaggtgtcgttggaccgagacagggatccgcggttggtcgccgaggccgagacgctgcgcaccctcagcgagcatcccggtgtcgtgcagctgctgagcgacggcgtgatcgacgtcggcccacgccgggccctgttgatcacttcagccggggaacgcaccctcgcccaggagctacgcgagcgaggccgactacaaccggaatggctccaggggtggggcgacgacctgctggagatcgtccagcatctacagcgggccgggctggcgcatcgcgacatcaagccggacaacctcggcgtcgccgaacgtggcggcaggggcaagaagcggcagctcgtcctgttcgacttctccctggcgaaggagccgttggaggccatcgaagccggcacccgcccgtacctcgacccgttcctcggccgcggcgagcgccgccgatgggatcaggctgccgagcgatacgccgcggcggtgacgctctacgagatggcgaccgcacgccggcccgagtacggaacccatggcgggcatccgagtttcgtcgacgccgacgtggcgatcgaacccgagctgttcgaccggtcgtacgcgaccggtctcaccgagttcttccgccgagcgctgcaccgggacgtcagacagcgcttcgacaccgcggaggacatgcgccgcgcctggaacgcgatcctggccgaaccggccagcgtggtcccgcagccgccctccgcgcgcatcagccgggacacgcccatcggcgccgccggtctgtcccgcccggtgctgtcggtgttcgaacggctgtcgatcgatacggtgggcggcgcgctcgacctgtcgcccgcccaggtcgtctggctgcccggcatcggtacgaagacccgccagcagttgcgtgcggacctggaccggctggccggccaggtcacctcctccccggccgagcggcccaccgagccgacgctcctcgaccgcgtcgccgccgggctcatcccccgcgcgaccgaccgggccgtcgccgaagccctgctcggcctcggcgagcagggcggcaacgcatggacgagcgtgcgcgacgcggccaaggcccttgaccgcgagcaacgtaccgtccggcaggcggtagccaggttcgagcggcattggctggccctcgacgggatgcgagagctgcgggacaccatcgtcaaggtcgtcgagtcggtcggtggggtcgcctccgcccggcactgcgcggcggccctgctcgactttcagggcagcacggtggaggaaccgctgcgctcccggctcgccgaggccgtcgtacgcgcggcgatcgatgccgagctggccgacgactccccccgcgacgacaccactcacgacaccacccacgacgcctccggcggttccgagatgggtggcgatccacggctggtgtacagccgagagcccaacggcatcctcgtcgccgccggccccgcgcgcgccggggacgggccctccaccgccgatcggttggactgggcctcccggctcggcggcgcggccgacgacctcgccggcgcggacccgctgccggctccggctcgggtcatcgagacgttgcgcgccgtccgcgcccccggcgacaccgacccctccctgatcttccccgaacggctcctcgacgtcgccatgatcgcctccgagaacgccgcggtgacgccgcgcctggaggtctacccgcgaggcctcgacgcgggacgggcgctgcggctggccgccggggcgctgtacggccgcacggagctgacccccgagcaggtggccgagcggatcatcgtgcggttcccgcacgcgggcgcgctgcccggccgtcccgagctggacgccctgctcgacgcggccggggtgccgctgtgctgggacgacgagaaaaagcggtacgtgacccgccgcatcgaggtgaccgggctcacctccctggtcacctcccgtggaaccaggccgcgctggagcaccggcgcgggcgccgcctggacgacaatgggatggcgccgggtctccgacgaggtgctggccgcggatgaccggctcacccgttcgctggtggacggcggctggctggtgctgtcggtgccgccgcggcgactcgcccgggccgaacgctgcctggccgcgcaggatgtcaccgttgtcgacgcggaacaagccctgctcgcggggatgcgggagttctgcgcccagcaccgggtgcagtggtcgatcgtcctggcggccgacgccgccgaccgatcgtcgcgcgactgggccaacctctcaagggtcgcgcaggccgggctcgccggtgtgcgggcctcgatcgaggccgcggggccggcggtgctgatcacgaatgcgggggtggtcgcccggtacgatccggcgctggtggtactggatgagctgcgcgcatcggtgcggatgacgaccgagacatcaccggtgcgtacggtgtggctgctcgtaccctgggccgacgtggacaaacaaccgttgttggatggtggcgctcccgtgccccagttcggcaaccagggcctggcgctgtccgaggagtggattgtccggcacgagtctcggctcgccgacggcgctgagggaggagcagcgtga

SEQ ID NO: 213 - DNA, 4752 bp, Frankia sp.
gtgcgcgaaggcgagggccggtgggagacggtcacgccgtcgcagtttccgcatgagcgggaggcgttggagcaggttcggaagctgctgccggacgccgagccgtaccgggcctggtcgaacttcaccttcacagcgacgacaggccacatccgcgaggtcgacctgctggtcgtggcccgcggcggggtctacctcatcgagatcaagagcctggccggccggctgaccgcgtccgggtcgaactggacccagcaccgctcctccggcgagccgcggatcttcgacaacccgctgcacctggcgaaccagaagtccaaggagctgcgttccctgctggagaacgccgcccgcacgccgggccagagccgggtacggatcccgttcatccagccggcggtcttcctgtcgaacccgacgctgcgggtcgagttccccgaccaccagctgcactggatcttcggccccgagcaggccgcggcccaagccggccagtcctccggcgcggccgcggcaccaaaggctcgccccggcggtggcgtgacacttccgtcgatctggtccggcctgctggacgcgccgctgcgcgacgagcgataccgggtcacccctgaggtgtcgaaggcgctggcgaagctacttcccgccgccgggatcgcacggagccgccgccatcagcgggtcggctcctggcagctggagttcccggcgttcgactcgggcccgacctggcaggactaccacgccgcccacacccaggtggcctccgagcgccgccgggtgcggatctacctcgtcgagcgggccgcgggcgaggccgagcgggcgagccgggaggcggtggcccggcgcgagttcctggtgctgcacgggatcaaccatccggggatcgtccaggtcgacggtttggagagccacgaggccggcccggcgctgatcttccggcaccggccggacgagctgcgcctcgaccagtacctcgaccgctacggcgaccgcctggacgccggaacccgacttgacatgatccgccagctggcggaggcagtcgcctacgcgcacggccgccacctttaccaccgggcgttggcggcccgcagcgtgctggtcgtgccctcgggccggcggagcgccggcgagcagggctggcttgctcccaggctcgtgatcagtgactggcaggccgcggcccgcgacgccggctcgagcacgggcgttctgaccggcgcgatgacgaagacgtcgatggcgctggccgtcgagccggcggcccggttcctgccgcatctggaggtggccaccgccggctacctggcgcccgagatcggcgctcccttcccggacccggtcggtatcgacgtcttcggcctgggcgcgctggcctacctgatcctcactggccagccgcccgcggacagccccaacgcgctgaaggcccgcttagaacagtccggcggtctgaatccggccgaggttgtcgactcgctctccgagatggcgaacgagctggtcgcggaggccacccgtccgctgcccgatgacaggcccgcgaccgttggcgagttcctcgacttgttggggctcgtcgaggaggagttcaccaggcccgaacctgccgtggcggccggtgacagcacgccggcggaacagcccgtcgcgggacaggacgagccggagcccgacccgctggaggcccagcacggcgacctggtcggcggcgagtggcggatcagggaacggctcggcaccggctcgacgagccgggcgttcctcgcgcacaacgagaagaccaaccgctacgaggtcctcaaggtcgcgctctccgacgagcgggcggcgcggctggaacacgaggcgtcggtgctgggccgcctcggcgactcccgggtgatccggctggcccgtcccgacacgctcgtcatcggtgggcgcgcggtgctcgtcctcgaccacgccggtgagcagaccgtcgcccgcaagctgcgcgagggccggctctcggtcgacgagctggagacctacagcgactacctgttcggcgcggtcgactacctggacggcgagggcgtcgcccaccgggacctgaagccggacaacatcgtcatccgccgccggccgaaccgtacctaccagctggtcctcatcgacttctcgctggccaaccactcggtgcgcgacatcgccgccggcacgccccgctatctggacccgttcctcggcgctggcactcgcaccgcgtacgacgaccatgccgagcgctacgcgctggcggtcaccctgcatgagatggcctccggcgagctgccgctgtggggcgatggatcggccgaagcgcggttcacgcagggcccgccgacggtggcgacggaagcgttcgacccggcaatccgcgccggtctcacatccttcttcctgcgcacgctcgaccgggacgccaccaggcgcttcgcgtcgctgaaggacatgcgcgacgcctggcaggccgtcttccgcgccgccgactcgaccccgccggcggtcaccgcgcatccagcggcaagcgacggcgcgagactgacggagagcgagtcggtcgtcgtcacccccgggtcgtcggcaggtgtggccatggccgacgaggagaccgcacgcagggcccgcgacgcggctgcggcggcggcgacgagcgacaccccgctggatgcggcagggctgtcgccgcgggccgtctcggcggcgcaccggctgaacgcgacgaccgtcggcgacctgctcacgctgggctccaaggagatcatcagcctgcccggtaccggcgcgaagacccgccaggagctgcagtccaggatccgccagtggcgccgctccctcgccgcggccccggctgggaccccgtccgccgcgacggccgcccagccagacccggcccagcaggagacgccggctgcgcagacgcctgcggcaaagccggactacgcccgtatgcccgtcgaggacgtcgccggccggctgctccctcgcgccctggccggcggccgcaacgccaccgagcgggaggcgacccgcctgctgctcggcctgcccgacgacgccggacggctgccagacgtgccactgtgggcgccacagcagcagatcgccgagcgggtcggggtgacatcaggccggatcgcccaggtgctgaccgcgcgccgcaagacttggcatgccgacgaggcggtccgctcggtccgcgacgagctggtcgagatcctcggcgacgccggccgggtgatgggctttgacgagctgacgaccgccgtccttgcccgccatggcagtcgtcgcccgccggccgaacgccgggcgctggcgggcgccgcggttcgcgccgcgttggagaccgtcgacctggacagcgagcccaccctcgcccgccggaagttctacgagcggacactggtcgcgctggaagctgcggaggatgacggcccgctcacccccgccgcgccggcactgttcgactacgcgatcgccctcggtaaggccgccgaccggctagcgaaggccgaggagctcccagctccggcgaccgtgctgcgggagctcgccgccgtcggcgccgcgccggcagcgggcgacaccgacgacgccggcctggccgacaccgacccggcagcggccgaggggcgggccggactgccggcgctcgacgagcagcgcctcgtccggctcgccgccgccgcgtcccgcaacgccgctgccaacgctcgcctggagatctacccgcgggacctgggcctggtccgggcgctgcgcctggcgcaggccggcgtgccgccgccccgacaggctgtgatgccggcgccgcccgccggactggatgagcgccccgaccggccactgctggaggtggctgtcatccacgaacgggtgacggcccgtttccccgggctgacgaccgagctgccggcgcacccggcgctcgaccgcccgctggcggatgccgggttcgtccttgagtggaacgcggcccgcgacggctacgtcccgcccaacagcctgttgacctcgaccgggctcggaggctcccgggcaacgccggtccgcgagcccaccgacctgggcagccgcccggcgcggcgggtgttcgacagccccgacctggcggacgcggcgcgtaccgagcagcgactcgtcgccgccgctgaatccggcggtttccgggcgctcaccgtccggcgcaaccactatctgctcgcccgcgcggagctggcccagcctcaccggttcgccgccgaaccgatcgacgtcgccgccgtgttcctcgacgcgctgcacgccgaggtcgacccgcggcccaagccgacctgggcgacggtcctgcgcgccgacgtcgccgagccgggcagccgcgcagccggcaacctcaccgagttggtgcgaacggcctgggatcgggccgcgccgctgctcgccgagctggtcgatgccgccgccggccggaccgggccgcacgggccggcaccgctgctgctgcacgacgccggcgtcttcggccgctacgacggccgtgggatggacctgctgttcacgctcgccgagcgggcccgcgcgggcggccgggccgtctgggtgctgtgcccgacgactgagccgacccagcctccgcgcctcgacggcaccctcgtccagctcgtgaccggaagcgagtgggtagcactgccggacgcgtgggtgatcaaccggcaccggtccgacgacgagccggacctcgctgggaaagcatcctga

SEQ ID NO: 214 - DNA, 4242 bp, Haliangium ochraceum
gtgagcgcccgccacatcgagatcggcgcgcccgtgcacgccggcgaggccagcggcatccgcttcctggtcgagaacctgcccgacgactacctcgtggtcagcaacgtcgagctgcccaccgggcgtcccggacgcacgtacgaacacgacgccgtggtcgttgccccgcacgcggtgttcgcggtcgagctcaagtcctggggcggcctgatccagggcaaccgcgaccgctggcgcctgagcggcagcggctacgtggcctcgcccatctcgctcatcctcagcaaggcgcgcgtgctcaagggcgtgctcaagacccgccacgccgacctgcgcagcatctgggtgcagggcctggtgttcgtgaccgcgcccgacgccacgctgtcgatctcgcgcgacttcgacgagtacgcccacacccgcgacaccatcatcgccgcgctcacccagcccgcgcagtggggcctcgcggcaggcgcgctcagcgccgggcagaagcgccacgtcgagaccttcctggccgacggcgtcccgcccagcgcgcgcacccactacggcggctacgagctggtggagcggctgccggtcgaggacaagccctacgacgcctaccgcgccaaggacagcctgggctttcaccgcctgatccacgtctaccccgtcctcggcgacaacgaggtcacccagcagcgcgcgcgcagccgcgccctgcgcgaggccaccttcgccgacaagctctcgggcggccccgacatcctgcgctggtgcggccaccacgatctgccgcacgacaacgtcatcgtcctggccttcgaggacaccggcgcgttgctcaccctgcgcgactgggtcgaccagcgtcgccccggctttcaagaccgcttgtccgtggccctgagcgtggcccgcgcgctggtctggatccaccagaagaaggtcatccaccgccgcatctcgccccagaccatcctggtatccgaccaggataagcccatcgatctgcgcctggccgccttcgacctggcccgcgatctcagcggccaggcgccgaccatcaccgccaagcggctgcgcgactcggaatatcgctacaccgcgcccgagctgctcaagcgcggcgaggccggcatcggctccgacctcttcgccctcggcgccaccctggtcgagttgttcatcgagcggccgctgtttcaaaaggccgaggaggcgctgcatcccttcgaggtgccgccactgcacgtcgccggccagccggttcccgccgaggtccagcgcctggtcgagcagcttctggcgctgaatccgaccgatcgtcccgaatccgcgaccgcggttgccgagcggctcgagcgctgcctgcgccgccccgtggacgcgagcgagcgccagcgcccgctgcaagccgacgacgaggtccagggctatcgcctgctcgagctggtcgccgagggcgcgggcggccagacctggaaagtcctgcatctgctcgagaatcaggtctgggcggccaagatcgccgaccccgagcgcagcgccgagctcgagatcgagcagggcatcctgcgcgatgtaaagcaccccaacctggtgccctacaaagacatctgcaacctgccgggccgcggcatgatgctggtcctgggctggatcgacggcgtcaccgggaaggagtgggccgagctcggcgacccgctgtcgcccgagcaactcctcgcctgtggccgaggtcttttcggcgcgattgacgccctgcaccgcgccggctacgtgcaccgcgacctcaagcccgccaacctcatgctgcgcgagcccggcgccgagcctgtgctcatcgacctcgggctcggcaccctggccggcgacaccgaccacctcacggtcggcaccgtcgactacaaagacccgcagctctacgagcagggcgcctgggagccgtccttcgacctcttcgccgcctggctggtgctgtaccaggtcgccaccggcgtgcaccccttcggcggccgccccgagcccggccgccagccggccatcgacacctcgctgttcgccgaaggctacgcaggcgaccagctcgaccgcctgggcaagctcttcgaagaggcgctctcgccgaagctggaccatcgtccgaaatcggccgacgcggcccgccgggcgctcgtcgatcttctcgcccccgcgccgcaagtcaccttcgacgacctgcgcgccaacctgggcgcgcccccggccccgccgccgcagccggccgcgcagccccaggcgcccgagctctccgccgcgcccggccccggcgagctgctggccggcgcctcggtggacaccccgctcgccgagatcgcgctctcggcccgcgccgctcgcgccctggcgcggctgggcgtgaccctggtgggccaggtcggcgcgatcgcgcccgcccagctcgccggccagcgcaacgtcggcaccaagacccggcgcgagctcgagaacctcatcgccgaggcgcgcgcgcgcttccccggcctgcccagcgcgccgctcgcgtccgagatcccgctgaccgcggccgtggacgcgctctaccccgagctcgagggcgacgagcggcccatcgacgagctcggcgccgcgctcaagcccaaggcgcgccagggcctcgcgcgcatgggcgtgggctctgtcggcgagctggccatgctcgaccgcacgaccctgcgcagcgtgcccggcctcggccccaagcagagcgacgagatcgtgcgcgcgctcgagcgcctggccggcgcgacccgggcgcccgccgacctggccgcgctggccgtcgagatcgaggccgagatcggcgccgccagcttcggcatcatcgcccagctcgtgggcctcagcgacggcctcgtgcgcagccgccgcgaggtcgccgagcacttcgacatcagccgccagcgcgtcgagcaggtcgccgacgtctcgcagctccgcaagcaggcgtccgcggccgcgcccctgctcgcggccgtgcgccggctgctgcccaaggccggcttcgcgcgcctcgacgccatcgccgacaccctgcccacgcagatccggccgagcgcgggcgccagcgccctgggctacgcgcgcctggccgcggtgctgctcgagcccggccgccgcctgctcgacctcgacgacatcgagctggtgtgcctgccgccgtggacggccgaggccgtgggctacgtggtcgagaccgtggccagcgccgcgtcctggccgccgctgccgcgcgccgaagccgccgccctggcctggcgcgccacccccgaggtcattcagggcaccctgcgccgctggggcgtcgagcccgaggccgtgctcggcgcctcccggccgctgctcggcgacgtgctcgccacccacgacgaggccctgttcacgccgcccgtgccctttgccgaggccgtgcgccacgcgcgcgccgagctcgagccgccgctgtcgctcggccagctccgcgagaccctgcagcgacgctaccgcggcgtgcccgaccccgatgacctcgaggccgagctggaggccgccgacctgcgcctgcacgacggccaggtcatcgacgccgccgcgcccgcgcccgcgcccgccagcgtgcccaagctcgaccagggcgtggcccaccgcgtgcgcaccgacgacggcgagctcgacctcggcgtgctcgtggccgcggccgagcgcggcggcttccgcgtggccgtgctgccgccgggccgccatcaccgcctggtcgaggacatccgcgcggccctcgagcgccagctcggcgacgagcgcgtgcgcctcatcgacgtcgatcgcgtgctgctcgaggccctcgagcacgccggcctgtggtccgacgccgagtttttcgaccgccagggcgacacctcctggggctgggcgcgcgaggccctggtggccgcgctcgagcacgccatcgacgagaccgcgcgccccggccgcgtcaccatcctcggccgtccctcgctgctcggcccgctcggcctgctcgactggctggccggcgtctacgaccaggtgcgcggcggcgtgcgcggcctgctgctgctggccctgcccggcggcatccacgacggccgcgtgcgcctcaacgagcgctaccccttcccgtacacccccgacatggccgccgtgagcctgatcgacgcggccgccttcacccgcgagcccgagcccggggccggcgagctgcgctga

SEQ ID NO: 215 - DNA, 4254 bp, Microlunatus phosphovorus
atgacaccagcggctgaccctcggtgggtcgaggtgtcgccgtcgcagttcacccacgagaccgagggcgtgcgctacgtcaaggacctgctgccgagtcagccgcccttccgagcctggtcgaacttcgagttccgcgactctcacggtcgctggcatgaggtcgatctgctggtgctcggacgacggcgactgcacctggtcgaactcaagtactactcgggtcggctgcgcggagacgaccaccgctggttgcgcgacggtcatcgcgccgaagactctccgctcaagctggcgcgccgcaaggcgcagtatttggcgagcaagctccaagacgagtttcggagttgggtccgcgagaagagggtgcaaaacgcacccccggtacgcgaggtcgttccgttcatccaggaggccgtgttcctgcaccacccaggtctacggtgcgaactgtcggaagcgagcgcgctcggtctctacgggctcgacgggcaggcgcgaaccacccgcctgccggggatctccgacctgctgctggagccggctcgacccggcgtcgccattcacgagcgcatcgtggccgagttgatggcacgcatcgggctggtgccccggcgcgagcgcgaagccggatcctgggtgatcgaaggcgagccggtcggtgaaggcgacggctggcaggactgggatgccttccaccgcttcactcagcgggagcgcgcccggatccgcttccagatcgccgccccgggagccagtgacgacgagcgccgccggatccggcgcatcgccgagcacgagttcaccgtgatgcgacggctgaaccacgagggcctgctggccccgcaggacctggtcgaagccgacttgggtgtcggcctggtctacccactcgacgagtcctggcagcgactcgacctttggctggccgaccgaccggacggcatccctttgactacccagctcgccatcatccgccaggtgggcgagaccctccagtacgcccacggcaaccgggttgtgcaccgcggcatccgccccggcgcggtctgggtgcgtgagcagggcagcgctgtcaccgtccaggttcgcgactggcagagcgccggccaggtgccgtttaccgaccagacggcatcgtccgccggcggcgttacagccctcttcgatccgagcaaactcatcggcgacgacgctggtggtctgggacctttcgccgcaccggagggcgccttggccgccggcgtggaccgcgtccgggtcgatgttttcggcctgggcgccctcgccttctatctgctggccggccagccggctgcgacgtccgcgtcgacgcttcgggatcggctccgcgagcagtcgggcctcgatctcgctcccgagctgccgcaggtgtcgtctaccttgcgccgggccatcctgcatgcgacccggccggcggtcagcgagcggaccgcggacgtgaccgccttcctggccgagctgagtgaggccgagcgggtcgagaccgagcacgaaccggtggtcgatccactggaggcgccacccgacgccatcatggacgggcggttccggctgatccgccggctcggcaccggctccaccgcagtaggcctgctggtccgcgacctggcgcatgccgacagcgagcgggtgctgaaagtggccgtcgacgacgcggcacggcagcggctgcacgacgaggccgaggtgctgactggtctccgcagccctcgcctggtctcactggtcgagggaccactgatcgtgggcggccggactgccctgctgctggagagcgcgggtgagcagacgctggcccacgcgctgagcgcccgcggccggatgtcgctcgacctcttggagcgttggggcaccgacattctggaggccctgattgctctcgaccgggccggcgtcgaccaccgtgacatcaagcccagcaatctcggggtccgcgagatccgggccactcgagaagaccgcgccgcgcatctggtgctgttcgacttctccctgtcgcgcgctgccgcctcggcgctgcgggcgggaacgccgccgtacctggatccgttcctgggagccgacggtcgggaccggtacgactcggcggccgagcggtacgcagccgctgccgtactgctggagatggctaccgggcagccaccgcagtacggcgacggtctgtcggatccggcggtcatcgacgccgaggtgacgctccggctggatcgcttcgacccggctgtggcgcacgagatgctgtcgttcttccagcgggctctggctcgccgggtcgctgaccggcagcacacggcggccgagctgctcgccggctggcagcaggtgttcggtcagtcccacaccaccgcccccgacaacgccgacgagctggtcggcgctgcgaccctggagacatccttgaccgggtccgggctgtccgctcgggcattgtcggcactggagccattgggtgtgaccacggttggcgagctggtcgctgtggatccggtacggctgaatcggctgccaggggtggcgcgcgccacgcgtgaccagatcaaggaggcggtgtcgcgctggcgggcccggctcgggccggtgcgcggtcgtcgcgatggggggtcgtggcagcagagcacgctgccggttccgtacgacctggccgagatgctgctcgcgccgacccacgcacgcagggcccggatccgaaccgccctggcgtcgatgatgctgggggtgaccggccaggccgatgcgttcgcgacccaggctcagctgggggctctgctgcctgaaccggtcaccgccgctcgtgttacgcaggtggtggccgagctccacgatctgtgggcggcggatgagaccaccttgaccttgctgacccggctgggtgcggaggtggatgctcgactggacgtgctgggcggcgtcgccacagcggatgagctgaccaggcacctgctcgccttgatggtgaccgacccggcgaacgagccctccgactccgaacgcatcgcggcaggcgtgctccgcatcgccgtcgatcgacgtcgggctctgtctcgggccgatgagcggacagtagagtatgtggttcggcgccgtgacccgtcacctctcttggttgcccgcgaggccagcctccttgaccttgcaggccaactcggggaggaagcggaccggctgcttcgagacgccagcccggccgacccgaccatcgccgtcctggccgctattcgcgtgaacgaggagctgagcagggccgctggtggagttgaccagctgccagtcgcgctgcgggggtcgacccgtctggcagggcttgctgctgccacttcgaccgctgccgcgctctccggcactggtgagctccaccaccgagggctgccgttgccccgagccatcgcccacgctctcggctccttggcggccggtcaggcattgccgccgaccgagatccgggatcgagtccgcgtgcggttcccggcgctgcgaccgctgccggagcggcctcggctggatcaactgatcgctgactcaggactggggttgcgctacgacgaccgggagcgggtctatcgggcgccgcgcgccgaccacggcacaactggcctgccctcgcgtcaagtcaccgacatcgcaccggagccaaccccggtctccgccctgggtgcgatcggccaacggctggccgacagtctcgcccgccgctcgttcctcgcactcggcgtcccagcccgggccctgctcaagctgcccaccgtgctcgagaccacctactcggctcgcttgatcaacatctcggcggagctgatcgcgatcatgcaccagcaggccgaccaggtcggactgccctgggcccgggtccgggccgctgacgcccagccatcgggcagccgagacgcacagggcatcaaggcgttggtcgagcgcagcctgccgctgctggaagagcgcatccaggcaacgctggaagatgccggaccgggtccggtggtgctcgctgacgcagagccgttggcccgctacggcgcggtcaaccggctgagccggtggacggacctcgggacccgccgctcacgagccgtctggctggtcgttccacagctgcacgccaaccagggcgccctgctggatcacaaaccggtgccgttggccgccccgggacagttcgtgcccgtcgactccagctgggtcgatgcccagtacgccgccattgctgagcctgtccaggaaggagcatccgcgtga

SEQ ID NO: 216 - DNA, 4110 bp, Micromonospora aurantiaca
atgcgtgaggactcaccacgctggcaacaaatcaaccccactgcttacctgcatgaacaggacggcctgcgggagctggcgtcgtacctgccggacgccgagccttatcatgtctgggccaacgtggagttcgtgggcaccgacggctccatcaacgagatcgacgccctggtactcacccgcagcggcctttacgtgctcgaactcaagcactggcaaggtcgaatctctggcgacgggcagcggtggcagcatggtcgatcgcacgtagacagcccgctgatcctgaccaaccgcaaggccaaacggctgcgcagcgtcattcgccagtacgccccgcccgctgcccggatccccttcgtgcacgcggcagtgttcctgcacgcccggaacatgcactgcgaactggacgacatcgggcgtcagcacgtctacggcttggacgacaacaacagccagttgccgagcctcaagcagatgctgctggcgccgccagcggattcccgccatctcgtcgacgcggtacgtgcccgccagatcgtcgagctggtgcgcggcgccaagattcggccgtcggtggccgagcggcgggtcaaccaactcatgctgcaccagcggcccttcgcggagggaatcggctggcaggacttcctcgccgaccataccgtggacacctcgctgctgcggcgggtgcggttctatctgaccagccgagctgcggaggaggacgtgccggccatccggcgggccgccgaacgtgagttccggctgttacagggcatccatcatccgggtatcgcccgcgcgctggacctggtcgaccacccctggggcccggcggtggtcttcgaccaccggcccgagtggcagcgactcgaccagtggctggccgagcgagacggccggctccaactggcccagcgactgcaactggtgcaggatctcgccgagatcgtggggcacgcccactcgcgtcggctgtcacaccgctcgctgaacccccgggcggtctacgtctgcgacccggacagcgcccgccccacgctggtggtcaccgactggcagaccggtgggcggctgcccggcacccggatgacctccctcggctcgcccacggacccggcctcgctggagctcttcttcgacgactcggtccggcgctaccaggcacccgaggcggcaaccctggacgacctgccgggccatcagctcgacatgttctcgctcggggcgctggcgtaccgcatctttacggccgtggagccggcagcttcggcggaggaacttgtcgcggcagtggccggcggtggcctgcggctggacgcggtcgccgacggcatgccgaaggcgctcgttgaaatcgtctacgacgccacccggggcgatccggggccgcggatgcggcgggtcaccgacttcctcgccggcctggagctggtctgggaggaactgaccgcgccggagccggagccggtggtggatccgttacgcgcccaccgcggcgacgtcctcgacggcgggctgaccgtgctcggccggctgggcagcggctccacggcggtcgccctgctggtaaccgaagaggccggatcggaccggcgaccggtggtgctgaaggtcgcccgggacgagcagtacgcggaccgcttcgccgccgaggcccgcgccgtggacaagctgcgggacgcgcgagttgccgcgctggtgcgtggtccggtcaaggtgggcggccggaccgcgctactgctggagaacgcgggcgaacgtactctggccgaggacctgcgtggcgggcggctggcgctggacctgctggaacggtacggccgggacctgctggagatcgtcgccttcctggacgggcagggcgtgtggcaccgggacatcaaaccggcgaacctggcttcccgccctcgtccgaaggacaagcaaccacacctgtgcatcttcgacttctcgctggcagcggtccccgccgaccagctcaccgccggcaccaccgcctacctggacccgttcctcggtccgcctcgccgactgcgctacgacgccgcggccgaacggttcgccgccgccgtgacgctctacgagatggccaccgggacactgccccggtggggcaacggcgccaacccggccgctgtcagcgacgaagtaaccctcgacccggcggccttcgatccctcggtcgcggaccgcctggtcgcctacttcgccaaggcgttggcccgggacacggcggaccggttcgacacgctcgacgagatgaccgacgcgtggcgggcggtgttccgggagattcccgaaccggcggccctcgccggcgacaccggtggtctcgcgccgttgagccgagcctcgtcgctggaggcggccgagttgaccgcccgcgcgcggtcggcgctggaacgcctcggcatcggcaccgtcggcgagttgctggacgccgagccctccgcgttgacccgggctcggggggtgccggacgccacccgcaaggagatcctcgcccggagccgggagctacgtgagctcctcgccaccgtcgagccgccggtacccggccggccggacgcacagcacgtcgaggcgctctgcgccaccctgctgcctgcggagaccgcccgcacctcctggcaccgcaccgccattcaggtgttgctcggtcaagccgccgacgaggacggtcactacctgcactggccgtcccaggcggatgtggcacgggtggtcggcaaacagcagccgcagatctccaacctgttgcgccgggtccaaacccgcgactggctgtccaactcggcgctcggcctggtccgcgacgaggtcgtggcgctgctggacgcgcggggtggggtggcgtccagcgaagagatcgctgaggcgctgaacgtcacccgcggctcctacacggccgagcccaagcgcaccgcgcaggccatcggcctggtccgcgccgcggtggagacggaactggcccggggcggtgacgcacggctggcgatgcagcggttgcgcggtggggacaccgtgctcatcggtcgcgaaccggacgatccctccaccgagcgcacggccgacgatctgctcggatacgtcacccgcctgggtcgccgggcggcggtgctggccggcgcggacccgctgccgagccggagtcgtgccgtggaggaactgcgggcgctggagcgtcccccggccggaatgccaccgttgagcgaggcccggctgcttcagctcgctgccgccggcagcggcggcgaggccgcggtcaacgcgcagggccagctctacccggccgagcggatggccgccgagcgcgcgctgcgcctggccgccggcgcgctcgtgggccagaagctcgaccccgagacggtacgcgccagagtgcgtgcccggttcccgcgtgctcaggaactaccgccacgaccgaagctcgacgaactggtgcgggagatcccgctgttctgggatgcgagcaccggccgttacgtcccgccggaccgcacctcgtcgctgaccggtacccgctcggtcagtacagtcgggccgatcctggcgccgggagccgccgcccgggcccgccggcggctcgccgaggtgatcgaccggcgcggcttcctggtggcgctgacgtcgatccggcggccgggctgcgcccgccaggccctgctggaccgctacgacctcaccgaggtcgacgtgaccgcggtcatgctggagcggctccgcgcgctcggcttcccctgggagacgatcgtcgccgctgacaccggctcgccgaccgacgctgatttccgctcccttgtggagctcttccagcacgaggtgatgccggcgatccggaccgcgctggccgagaccgaccggccggtgctgatcaccgaggcggcgccgttggcccgctaccagcagttgggggtggtccaggaactggccgacccgacccgtccccgtccggccgcccggttgctgctggtgccggtgcgccgcaccgagccgctgctgctcgacgggcagcagcttccgctcacctcgctggccaaccagtcgctgtggctgccggacgagtgggacagccccatcctggagaggaccgccccccgatga

SEQ ID NO: 217 - DNA, 4218 bp, Mycobacterium gilvum
gtgaaggacggccgctgggtcacgatcgccgagtcgcagttcgaccacgaaaaggccgggctcaacgcgatcaagcagctactgccggatgccgagccgttccgcgcctgggccaacttcgagttccgcgacaaccgcggtcgctggcacgaggtcgacctgttggtgctggcccgcgacaccctctacctgatcgaactcaagcactaccgcggcatcctgaccggcaatgaccaccggtggcggcgcaacaaccgcaccgaagactcgccgctgctgctggcccgccgcaaggcccagtacttctcctcgctgctcaaggacgccatccgagagcgcggcggtgacgaggcggtcagcagaatcacgtatgtccaggagctggtgttcctgcaccacgagcagttcgtctgcgacctgccaccgaactcgaagatcaacctctacggcctcgacgggcgtgagggcatcaccaagctgcccggcatctccaaggtgctgctggcccccgccagacacgaccccatctccgagcgcgacagccagctgatcgccggcctgatgaaggccatcggcctggcgccgcgccgccagcgtgaggtcggctcgtggatcatcgacgaccaacccctggccgacggtgacggctggcaggactggccggcgtttcaccacgtcaacaccgaggaccacgtccgcatccggttctatacggccacaccgggcgccaccaaggccgacgagcacgcgcggcgccaggccgtcacccacgaatacaacctgctgtcccggctgacctacgacgggctgcaggcgcccaaggatctggtcgacgaacccgaactgggcatcggcctggtcttcccgcagcccaagtccgacaccccgctggacctgtggctggccgaccacaccctgtcgttggacgcccagctcgacctgatcgcccgactggccgacatcgtgcactacgcgcaccgccaccgggtggtgcaccgcagcctcaacccgcgctcggtggccgtccgggagcgcggcgaggcactgctcccccaggtcgttgactgggacagcgcaggcatcctgccggccaaccccgacaccgccgtcacccggctctcgggtggctcgctgacgctgatggccggcgcccccagcgacactgcgcgcctgttcgccgccccggaaggctcgcggcccacggacccggcccgcatcgacgtcttcggactcggcgcgctggcgttcttcatcctcaccggcggcacggccccggccaccgaacgcggcgagttgatcgaccggctgcgccgtgaccggggcctggacctggccgccgagatgccccaggtccgcaccccgctgcggcagctggtactcgacgccaccaacccgagcccggccgaccgcatcgccgacatcggcgagttcgtcgcccgcctcgatgccgtccgcaacgaggtgctgctcaagaccacgggcaccgacccgttggaagccgggccgggcgccgagctcgccggcggccggttcgtctaccagcgcagactgggcgccggctccaccgcggtgggaatcctggtcaaggacaatcaggttggcggtgccttgcgggtgctcaaggtcgccaaggatcccgacgccgccgaacggctgcgcgccgaggcccaggtgctgggccgcttcgagaacgacgaccggattgtcaccctgcacggcgtggaagacgtcggcgggcgcaccgcactgatcctgcgctacgccgggcgcaccacccttgccgaggaactcaacaaccgcggacggctctctatcgacgtgctgcagcgctggggcaccgacctgctgaccgcgctggtcgccctggaacgcaacggcgtcacccaccgtgacatcaaaccgtccaatctcggtgtctatcagagcagttcacgcgccgacacgcatctggtgatgttcgacttctcgatggccggggtgtcccccgacaatgtcgaggccggcaccccgccgtacctggatccgttcctgggcaccggcacccgccgccggtacgacaccgcggccgaacgctacggcgccgcggtggtgctcttcgagatggccaccggcgccaccccgcactatggccccgaccccggcgcccacccggccaccgtcgatgacgacgtcaccgttgtaccggccatgttcgaagccgcactggccccggcgatggtcgcgttcttcaccgccgcgctgtcccgtgaccctgcccgccgacccgacaccgccgaggacatgctgcgggcctggcggcagaccttcaccgccgccgacacccccgtcaccccacaggcaaacgatgccgacgccgaaaacgccgacgccgcaacaattttgagttccgctgggctcagcgcccgggccgtgtccgcgctggcctcggcggcggtgaccaccgtcggcgagttgctggcggtggactccaccaccctgaaccggctggtggcccgcgaagccaaggacacccgcaaggagatcgtcgagcgctaccgggcctggaccaaacgcctgggcaagcagcaaccacagcggtcgggcaccgaactgcgcagcctgaacgacaccggcgcgctgctgctgtcggcggtctccgcgcagcggtcgtcgaccacccgccgcgacgccgccgccctgctgctcggcaccacccccggcctggacggcttcgccagcagcaccgaactggccgagaagctcggcaaagccccgcagcgcggcacccagctgatcaaggagttgcaggaggactgggccaacaccccggccacccgtgagctgctcgacgcgctgaccgacatcgcccgcggggtgatcgaggacttcggcggggtggccgcggtgtccacgctgaccgccgagatccgctcccagctcccccagaccggcgcgggtgccatcgaccccagcgccgaacgcgccgcggccgggctgctgcgggtcgccctggaccggctgcatgagcacgaaactgcctcggatgagaagactctggtgcgacgtcggcacggccgccgcctggcgctgctggccaccgacgagatgctgctcagcgccgccgaggcggccgcgaaacgcgccgacgagctggtgtcggcagacccgaacgccgtcatccccgccgtgcgcgccgccgcggcgctgcgcaccgcgttccaggctgggtacaccgccgtcgccgacagcgacgccaccgccccgatgcccagcgacggccggctggtccggctggccgccgcgatcgccaaacacgccgcggtgtcgggccgcggtgaactgcacaacaccgacatgtcgccggcggccgcggtggccgaggcactgcgcgggctggcgcagaacgagtcgctatcggcctcgcagatccgcagccgggtgaccgctcgcttccccgaactggacaaggttccgcagcgcccgcacctggacaccatcctcgcgcagaccgcgcttaacctgacctgggacgccgcccgcgaggtctactgcttccccgacgccgaaccgcccagcgccaccagcatgcacacccggcagcccaccgccctgcccgcgaccggcgagacggtggccgacatcgatcaggcagtcaacgcggttgccctgttgcgccgttcgctcgacgaagccgggttcgtggccgtcggggtccagatcccacgggaccgccccggtgagcacgagcgggtggcgcaacacctggccaagacctacggcggcgagttggtggacgtgaccacggagttgatcgcgggaatgcagaagctcgccgacgagcgcggcatcccgtgggatctgatccgcggggccgattccgccgaggccactccccgcgacgcccagggcctgcgggcggtgatcgaccgggtggccccggcgctgcgggagacgttgcgggcggcggtgttcgacgggcagcgcagcgcgtcgccgctgattctgaccgaggtgtccccgctggcccgctacgggcatctggacctgctggccacgctcagcgatctggccgccccgcgtcgacgaccggtgtgggtggtgctgccgcagctgcgggggcaggtcggggcgctggtggaccgcaagcccatccagttggggtcaccgggtggtcagttcgtgttgtggcgggacgcactggatgcggtacccaccgccggtgacgggaagacgacgtaa

SEQ ID NO: 218 - DNA, 4485 bp, Nocardia cyriacigeorgica
atggacgagggtcggtggacaacggtcaccgagtcgagtttcgagcatgagcgccgggggctggaggcgatccggacgcagctgccgaatgtcgatccgtggtacgcctggtcgaacttcaccttcaccgccaagaccgggcacatccgtgaggtcgatctgttggtgatcgccgcgaacggcgtctacatgatcgaactcaaggactggagcggccggctcaccagcgagggtggggattgggtccagaccaccacgcgcggcgatcgccggttccaccggaacccgctgcacctggtgaaccagaagagcaaagagctggccggcctgctcggcgacaacggcgcccgcgttttcctgagctcggcggtctgcctcaccaattcggggctgcgcttcgatctgccgacaggtgaccgcgcgagcacgtacacggtccgggagttgatcgatcggctgcacgctccggtccgcgacatcaagcacacgatcaacgcccagcgtgcgcgggcgatcaagaaggcactggagcagatcggcatccggcgcagcgacgcggacttcaccgtcggcccgtatctgctggagcgcaagccgctcgacgcgggcccgacctggcaggattatctggccgttcacaccgagctgcgggagcccgtccgagttcgcctctacctgcgtgaacgcggcgccgatgaggaggcccgcaagtcggtggacgccgccgctcgacgagaagccgcagtgctacgcaggttccggcatccaggggccgtgcaattggagctgttcgacccgtcggcccatactgcgggaccggcgctgatcttccggtaccacccggacacactgcacctggacgattaccttgcccgccacggcgcgtcactggatatcggtgaccgcatcgaactagtgcgacagctcgcggaaaccttgcggtcggcgcattcggcccggctgtatcaccgggcactggccgctcgttcgatccatgtcgttccgcggccgggagccggcgaggcgcagcggtggcgctcaccgcggctgcagatctcggactggcaggttgctacccaacgttcagccggcacggcgctgacgatgacccggcatgccccgactctgctgtcggcacaccacctgtccgccggttcagacgcctatctcgcgcccgaagtgtccgcgccatcgcccgaccccatcgccatggatgtctacggtctgggcttgctcacctatctcctggtgacgggtcgcgctcccgcggcaacacaggcggaactgctggcccgcttcgaggccggtgaggacctgcgtccgagcgcactggtcgacaacctgccctccgatgtcgatctcctggtggcagcggcgacggactatcgaccgtcgaagcggctcacctccatggatgagttcctcgagttggtcgaggatgtcgaggagtcgctgaccgcacccgcggaagaggaggtcgtgaccgaggagaaggacccactggacgctgtcccaggcgatgtgcttgccggccgctggctggtgcgccgccgcctgggcaccggatcgaccagccgcgccttgctcgttcgcgatctgcaggccgagaccgacaagcggggcgccaaaacctatgtggtgctgaagatcgcgctctccgacgaccgagccgacctactcgagcgcgaggccggcgtgctgcgtggcctgcggcgacattccggtgtgatcaatttggtcgatccgggtgtgctggtactcggggggcgcaagacgctggtcctcgagtacgtcggcgacgagcagggcctggaccaggactcggaccaccgcaccgaggcgaccgtcgcccgcgagctgcgcgacaacggtcgccttcaggtcgggcgcctggagacctacagcgactacctcttcgctgccagcgatttcctcgagggcgaaggcgtctggcatcgcgacctgaaaccggacaacatcgcgatccgcgtgcgtcccaaccgaacccgcgaactcgtcctcatcgacttctcactggcggggtacccggtacagaacaccgatgcgggcacagacggttacctcgacccgttcatcggtaccctaactcgcagcgtctacgacgcccaggcggaacgctacgcgctggccgtgacactgcacgagatggcgtcgggcgagttgcctcgatggggtgacggcagcgtattgccgcgccagctggaccccgcggagttcccatatccgaagatcgcagccgacgctttcgacgcttctgtgcgtgacggtttggtcgcctttttccggaaggcgctacatcgcgatgcaggacaacgcttttcggatctgaagccgatgcgcgatgcgtggcgcaaaatcttcctcgacatgagtcgctcggtgccgtcccgaccgctcagctcacatccgtcagagcccgtcgatgtcgatgaggtctcgccggaagatcagcgccgcctcatcgccgagcaggcgaccgtcgaaacccacctgtcgcaggcgggcctgaccgctgccaccgagcagttcctctatgggttgggcgtgaacacggtcggtgagctgctggattacggccgaggcaaactgatcaacgcacccggcctcggcgctcgcgcccgccgcgagatccaggaccggctgaaggaatggggccgtcgcttcggcaaagaggagcccgcaccgctcacaccgcaagcacggaaggaagcgaagcaggaactcgacgccgctgaggccgatctgggcgccggcctgctccgcacgctgagcctggataccctggccgctcgatttgtgccggagcgcaataacaatggctccaatgccagcaaggtcgatgcggtggcacgactgttgcgcattcccggtgcgggcgatctccccgaactggatgcgtggccgacccaatcgtcggtcgccgaatccctgaatctgacctcgggccgggtcgcgcaactgctgaaagctcaacggcagcagtggaagaaagaccccgcagtccaggctctccgcgaccaggtgctggagctgctcgaggaattcggacgggtcgcggcggccaccgaactcgccgatgcgttggccgcccggcgtggcacccggctggacgaccgagctcagcgccgcgcactgggtctggctgccgtgcgcgtcgtggtcgaggtcgagcagctgacgccggatgaggcggccctctacaccgcgcagaaacgcgattccggcgccaatccggtggtcgtgctggcactcgaggcgggcgaggaagccggcccaggtgccccggctgcaccggcgctggcgaattacgcccttcgcctgggcagaaccgctgatgcattggctgcccaggagacactgccgacggccgcgaccgtgttggatcggctgggcgcgatcgaacctcccgcgggcactttcgccttggacgagcggcgcctcgtgcaggtagcggtcagcgcgtcgcgcaacgccgccgtgacacccaggctcgagatctatccgcgcgacctcccgttggtgcgcgccgtccggctgacccaggccggactgctgaccctcacccccggagttccgctgaagcagcagaccgggctgcgggccgagcgcgtcttcgagcggatcctggcacgattcccggagctggtcatcgcgggaagcgaccgcgatgtaccgaccccggagctgacgaaagcgctgcgcgaggccggattcgacctggtggtggcaacccaccccgagtcccgcatccagcgctatatccccgagcacgccgacctgcagtccagctataccgcgcacgcaccgcgctggtcgaccgccgtcaacagccacgcggccggtagctactcggacgatccggacatggccaaggccgcccgcgccgaggagctgctgaccggtgccgcaccacgggacggattccgggtactcacctcccccacttcaccgacctcagccacccccgctgccattcgcgaactgcgcgagcgtttctcggtgcgcccgatgtcggcgacggcattgttcctggcgaacatgcacgatctggttcctccgggcacaaaacccacctgggacaccatcctgcgcgccgatatcgccgagccggggtcgcgcgctgccttgaagttcagtgagtacgcgcgcaccgcgtggggccgcatcgaaaccgagatcgccgacaatatcgcgggagacggcccactgctgctcaccgacacactcgtgttcgcccgctacgacgccatgggcgtcctcggccgcctggctgaacaggcacgacgcggtaagggcggcctgtggctgctgtgcccgcagtccgatcccctccgccaacctcacctcggcaccgaagcggtgccgtaccaatcctccctcaacgaatggatccagttgcccgaagcgtggatccgcaatatccatcgcaccagcgcctcgaccgacacaggagtaaccgcatga

SEQ ID NO: 219 - DNA, 4284 bp, Polaromonas naphthalenivorans
atgagcatgagcgccaaccgctggaaggtcattgccgaatccagctttccctgggagcgcgatgcgctcgaatggctgcgcgcccaattgcccgaccgtgagccctggagtgtctggacgaatttcgaattcatcgatgaccaaggaaaagtcaacgaggtcgatgtcttggtgctgtcgcccgccgggctgtttctgatcgagatcaaaagccggcctggtacggtcgatggcgacgcgcacacctggacctggaacaccgatggccgggagtacagctacgacaaccctttgctgctggcggaccgcaaatccaaacgcctggccagcctgctgcgccgccaggcggccatcgtcaaggccaagatccgcctgccgttcatccagccagcgatctttctctcgtccaccagccttaaaagcaagctgcaaggcatcgccaaaaccgccacctttcagcgcggccagcccggctcgctcaccgacgacggcatcgttcacgccctggtcaacggcatccacagcaacgcggctcaagctgtcgatggccagaaagccagggccatcgcccgcgggctggcagaagccggcatccggccctccaacaaacaccggcaggtcggggactaccaactcatcaaactgatcgccgagggcgaaggcttccaggactggcaaagccagcacgtgagcatggcgagcattcagagacgggttcgcatctacaccgtggcccatgcgtccagtcccgaagcgcgcgccacccgggttcgccaggccaggcgtgagtttgaagtgctcgaaggcatcagccaccccaacatcctgaaggtcaacgactacaaagagaccgaaatgggcccggcgctggtgtttgaccacgaccccaaggcccagcggttagatcacttgttgcgcgatcgcggtacgcaactcaccgtcacccagcgcctgcaattggtgcgcgacattgccgaaaccttgaaatttgcccactccaggcgcctgtaccaccgcgccctggggccgcaaagcatcatggttcacacggcggacggcggcgcgctgacgccccggctgatgaactggcaaaccgcctcgcgcgaggcgggcaatcccgacacggtccaccgcaccaccggcacgcgccatgtggaggactacgtcgaagaccccggcctggtgtacctggcgcctgaaaccacgcgcgccgatgccacccatggccccagcctggacgtgttttcgctcggcgccattgcctaccatgtgttctccggccaggccccggccgggtcggtccttgaactggcagaaaagctgcgtctgggccagggcctgcgcctgtccgatgtctctgacggctgcggcatgcggctgcaagagttgattcagtacgccacctgcccggacgtgatggcgcgttacgacgtggtgcagggtttcctggacgacctggtcaaagtggaagacgagctcaccgcgcccgacccggaagcaaccgtcgaccccagcatcgccgggcacggcgaccggctcgaaggcggcttcacggtggtcaagcggatggggcgtggctcctccagcgatgtgctgctggtgcgcgaagacgattcgccagaagagttgatcctcaaggtcgcgtgtgatctggcgcataacgatcgcctggtggccgaaggcgatgtactggccggcctgcaccaccaaaatattgtcgagtaccgccgcaccctgtcggttgccggccgcaccgccttgctgatgcgcagcgccggccccaagacgctggcgcaaaagatcaaggaagacggccgcctgtcgctggacctgctccagcgctttggcgaggaactcatcgaggtcgtcaaccacctcgaagaccacggcgtggcccaccgcgacctcaagcctgaaaacatcggcattgccaccaccagctccggcaagctgcaactggtcctctttgatttctcgctgtgccgcaccccgaccgagaacatatccgccggaacccattcctacctggacccgtttctgagcctgcgcaagccgccacgctgggatttgtatgccgagcggtttgcgctggccgttaccttgtacgaaatggccattggcaagctgcctgtctggggcgatggccagacctccccggccatgctggatgtggaagctacggttgccagcgatgtgttcgaccctgtcacgcgcgaaggcttcaccgcgtttttctccaaagccatgcgccgggacttcaaggagcgctttgataacgccgaagacatgctgcgcgcctggcgggccatcttcgccgcccggcagaccgtacacccaccccaggctgaaggtttttcggccatcgcgctcacggccttgtccaccaccaccatggccgagttgggctacacgctggaggcgcaggacgttctggagcgcatgggtgtccacaacgctcgcgaactgctcgccgtcgatcgcattcgttttcgctacctcaagggcgtgggcgacaggattcgcaaggaaatcaggctcacggccaaagagctggcgcacctgcggcctgacctcgcgcaaggtcgcgccacactgcacgattccgatgacgatggcacccatgacggcgctgtcagcgtcaacgaactggccgccctgctcatgccccgcaggcccgccggcgatgaccgtcccgaagaagcagcgctggcgcattaccttgggctcgaccttggcctcgacgacgcggcccagccggaaagcgcatccagccaggctgcatggcctaccctgggcgaatcggcccaggccaccggcgtggagcgcagcacgctcaccgccaccctggtcaaggcccgcgagcgatggctaaaaaacccggcgttcaccgaagtgcgcctgcagctcgacaaactggtgctcacccagggccaggtgatgaccgcccatgaagcggccctggccttgctcgccctgcgcggctgcgccatgcaggaggatgcgcagcgcctgcaactcgccagcgccgtcctgcgcgccgtcctggaggccgaagcccatctggagaacccccgcattcagctctatgaccatccgccttcgcccctgatcgcgaccagttcagcctgggccgattacgcccgccagctcggcagcgtggccgacacctgcgcgctggtcgatcccttgctgcccccttcgcgcgtgatcgaagcgctcgttgccgtccagccggtgggcgtcctcatgggcagcggcccggcgcaagaggccggcgaagcccccatgcccggcacccggctgcttcgcctggccacatcggcctcgcgcaccgccgccctgtcgagccggcaggaaatctatcgccggggcatgcccgccttgcaggcgctgcgccagtccctgggcgcacttgtgggtgtgcccacattgcgcatccgcgaactgcaggaccgcgtgcgcggccgttacccggaagccaccctgctccctggtcggcctgcgctggaccgcttgctcgaagaagccggcgccccgctgcaatggagccctgctgcggccgatggcgcaggcgcctacctgtgccccgcgctgaacaaccaccccacggtgggcacgacgaccgtgttttcccgtcaatcgacctttccgggcgcccatgcagctggaacgccagccggtgaagccagcgaggcagccctggccgacgcccaggcggccgagattcggctgcagcgcgccctcaagtccggaggccttttggtgctgacggtcgaaccgcgtcaggcgcgccatgctgaagccgaactgctgcgccgcttcgggccagactcgcaaacacaaccggcactgcaacgcatgagctttgacgcgctgctgctcaaggccctgcgcaccgaagcagaccgtgcccgtgtggactggtccatggtgctgcgcgccgacaccgccgagcccggcagccgcgactgggccaacctgcagcgcctggtgcagcgcaccctggccagcctcaaacccctgctgctcgacagtccggcgcctgccctgctaaccaacgtgggcctgctggcgcgctacgacctcatggcactcgtcaccgagatggaagccagcgccggccgccccggccacaccccggcggtgtggctgctgctgccttcgcacaagcagggcctgcccgtcattgatggcgtgcccgtgccgctggtcaacagcacgcaggcttttgccctgccgcccgcctggattgaaaacaagcaccgcgcatcggccctagcctga

SEQ ID NO: 220 - DNA, 4227 bp, Saccharomonospora viridis
ttgatgccgcaggcggaaccgtaccgagcctgggccacgttctctttcaccgcggcctccggtcggatcaatgagtgcgatctgctgatcgcggttcccggtgggctctatctggtggagctcaaaggccataccgggcgtgtggtgaacagcggtgagacgtggagtttcttcagggagggggaaaagcggccacggaggtttcgcaatccgctgcatctcaccgacctgaagtgcaaggaactcaagcagcgtttggagtgggctgccaagcagatcgggtacagcgggcggataccgtggatcgagccggcgattttcctttccgcgcccgggttggtgtcggagctcgacgaggtgcagcgcacccgcgtgtacggccgtgacgaacaggtcgaggggctggattggatttggcgtgacctgttgtcgcgtccaccgcagcgggagcagcagcgggtcagcccgaagttctcacagcggttgccggagctgttgaagaagatcggcattcgggcttcgacggcgcacctgcatttcggtgatgactgggtgctctccgacgaggtgctggacgcggggccgacgtgggaggaccgtctcgccaagcacgcggggccggtgcgcgatgagggtcgggtccgcatctacctcaccgagcagcaggccgtcgaggagcggcggcagtcggtggagcgggccgcgcggcgtgagtatcaggtgttgcagggcatcattcaccgtggcatcgcgcaggccatgcagttccgggagcatcaaagcggtcccgcgatcctcttccgacacaattcgtcggatctgcggttggactcctatctggaaatccatggtgaacggctcagcatcgagactcggcttgacttggtgcgacagctcgccgaggccgtgcagtacgcccaccatcgctcgctctaccaccgtgccctgtcggcacgttcggtgtgggttgcggccaaagaggatggctccgatccggtgttgcggatcaccgactggcaggccgctgcccgtgacttcgattcgacgtcgacggcgacggtgggtaagacgtcgttgaccggggaacatttggccagttcggcggaggtgtacctggcaccggagttcgccccacacgccgatccggtggacctcgacgtcttcggcctgggcgcggtgtcgttcctgatcctgaccgggcagccacctgccacacagcgcagcggcctcatcgaacggttggccgaaagccaggggctgcatccgtacgcggtgtcggacggtatttccgatgcgctcgacgcgttggtgttcgacgcgacccgtacggatctgtcacagcggttggagtcggcggatgccttcctcaagcgcttggacgcggcggagtgggagtcgctgcccgagtcctcggtgccggtggtcgatccgctcaccgtgtcggccgggcagatggtggatgagcagtggcgtgttgagcgggtgctcggcaccggtgccacggcgcgggctttgctggtccgcagggtggacaccgacgacgaacagcctgagcgtcgggtcctcaaggtcgcgctcgacgaggacaaggcacagcacctgcacgcggaggcccgagccttggcgttggcgggtggcggtgtggtggtgaagctgctcgacggtcctcgtgagctcggtggtcgcaccgtgctcgacttggagtacgcgggtggtcaggacccccagggctacacgttgggcgagttgttgcgcgctgagggcaagctcagctaccacaacttggagcgttatggccgcgacttgttcaccgcgttggatcagctcgcgggcaagggcgtgcgtcatcgggatctgaagccggacaacttcggcgtctaccgcagggctgatcggtcgacgcagttgatgttgttcgacttctcgctggccgaggcgtcggagcgcgatgtcacggcaggcacacgcggatatctggatcccttcctgggcaccaatcgccgtcccgcctacgacgatcacgccgagcgctatgcggcggcggtgacattgcatgagatggcatccggtcagcgaccggtgtggggtgacggggtcagtgatcctcgcacgaccggtgatgagctgcccgtgctcgcggtcgagctgttcgagccggcgttgcgtgacggattgacggagttcttccagcgtgcgctgcatcgggatgtcaatcgccggttcgacacgttgcggcagatggaggacgcctggcgcgaggtgttcaccgcggcggataccgcccagccactcaccactccggacacggtgggcatcgaaggtaagacgctggaggaagcccgcgacttctacgccgagaaggcgaccttggacacgcagctcgacgtggccgggctgagcccgcgcgcggtgtcgttggcgcagtcgcttggtgctacgacggtgcgggaattgttggagcaggtgcggccgtatgagatcagtcgagcgcgcggtgcgggcaaggtggtgcgcaacgagctgaaccgccggtacaagcagtggacgcgggcgctgtcgctgcaggacgagcctgaccggccggccccggaggccacgcccggtttgtccactgtggatgattttgttgcgtggttggtgccgcagaaggcgcggaggggttcgcgcaaggccgatgtcgtgcggttgacgctcgggttgccggagggggacgacgatgagctactgcggtggccgacgcagaccgaggtcgcccggcggctggagatcacgcagggcacggtgtcgcagcattaccgcgcggcagtgaaggcgtgggcggccgagccgtggctgtcgagggtgcgcgacgagttggtggagctggtcgccgaggcgggccgggtgatgacggcgcacgagctggcggccgcggtgagagccaagtacggagtcgcggagccggaggctcgagaacgtgccttggcgaggtcgttggcggtggtgcgtgcggcggtggacaccgaggcgtgggagcggcaacaggatgaggacgaggacgaggaaggcccacggttctcggcgttgcggcgtggcgatcacgtgttgattgcgttggagtctttgccgggcaccgacgcaccgagcgctccggagttggctgactacgccgtggcgttgggggcgcgggccgatgagctggtggccatggacccgcttcccggccgaggcgtggtggtgcgggagttgcgggcggtgccggctccggaggggctgccctcgcaggcggatacgcgtcttgtggagttggccgcggtgatgtcgcagcgggcggcggcgtcggcgcgcgcggagctgtatccccgggagttggatatggtgcgcgcgctgcgcatgtcgcaggccgcggtgggggtgcgtcgtgaaacggggatcacgcgcgaagccctgttggcgaaggtgcgtgcgcggttcccggccgtggtggtggatgaccagacctcggaagtgcagctggaggaggcgctgcgcgcggcggggaccccgttggaatgggatacggagacgaagcggttccggccgccggaaccgaagttctcccgttcggccgtgtcgtccagtacgagccgaagtggtcacggtccgctgttctccggtggtgtggacccacgggaggtgttgggcgggaaactcgtcagggcgggggagcacggcgggttcttggcgttgacgctgcggggggtgtatctgccgggagtcgccgaggcgttggcgtcgcggtatgcggtgcacccggtgcacgtggacagcgagtttgtggcgacattccgtgagttgatcgccgagcgcggccaggactgggagctggtgcgcaggttggacgccggcttcgggcggacggggctaccgaagccgggtttccgcgagtatgtgcggaaggtgtgggagcggctgcgggaccggttggtggcggtcgggggtgaacgcacggtgctgttgctgcaccatgcgggtttggtgggccgctatgccgacctgggtgggcgcgagttcttgacaagtttgcagcaggcggcccgttcagcgagcgcgaagccgcatggtttgtgggtgttgtgtccgggcgagtcggcgcgggaagcacctcagctcgacggtctgcgtgtcgaagcgttgacggagtcggagcgggtggtgttggacaaggatttcctgcgtgatttgcaggtggttgatcaggcgagctga

SEQ ID NO: 221 - DNA, 3927 bp, Saccharopolyspora erythraea
ttgcagcagcgcggtcaccgcagtatgcgcacgccttggatccagcctgcgatcttcctgtctgcacaggggttgcggtcggagctggacgaggtgcagcgcgctcacgtctacgcccggtccgaggactcggggctgccggagatctggcgtgatctgcttgccaagccgccgcaacgtgagcaccagcgggtgcggccggagttctcacggctgctccgagatctgttcgccacgatcgggatcagcgcggccacgtcgcatctgcggttcggcgacaactggtcgctgtggccggagaagctcgacgcgggccgcacctgggaggatcggctggcggagcggtccgttccggtcaaggaagagggccgggtacggatctatctcaccgcacagcaggccagcgagaagcagcggcaatcggtggagcgggccgcgcggcgcgagtaccaggtgctgcagggcatcaaccaccgcgggatcgcgcaggcggtgcagttcgccgagcacggcggatccccggcgatcctgtttcggcaccgacacgccgacctgcggctggactcgtatctggacctattcggtgatcgactgagtaccgaggcccggctggagctggtgcggcagttggcggaggccgtgcagtacgcgcatcagcggtcgctgtatcaccgggcgctgtcggcgcggtcgatctatgtgtcggcccgtgacgatggatcgcagccgctgttgcggatcatcgactggcagaccgccgcgcgcgacttcgagacgacgatgggcacgtcatcgctgggcaacagctcggtgaccggcgagcatctggccgactcgtcagaggtgtatctcgctccggacttcgacacgccgtatgcggacccggtggatctggacgtgttcgggctgggtgcgctcacgtacttcctgctgaccggcagcccgcccgccacccagcgcagcgcgttgatcgaccggctgcggaagaaccagggactgcggccgtcggcggtggccgacggggtgtccgacgagttggatgcgctggtcttcgaggcaacccgggcagatccgatggatcggctgaccgcggcagacgagttcctcaagcggctcgacgacgcggagaagaagtcggttccggtgggcgtggcctcagacgtggatccgctcgacgtctcggcaggccagaccgtcgggggcgagtgggacgtcgtgcgtgtgctgggcaccggcgccaccgcccgcgcgctgttggtgtcgcggatcgacgaggacgccgacggggagccgagacccgagtaccgcgtgttcaaggtggccctcgacgaggacaaggccgcgcagctgcgggccgaggccgaggcgctgacgaaggtcggcggcggtgtcgtggtgaagctgctgtcgccggctcggcagttcgccgggcgcacggtgctggatctggagttcgcgggcgggttcgacctcgagggcaagacgctcggcgagacgatccgcgccgagggcaagctcagctaccacaacctggagcgctacggccgcgacctgttcaacgccctcgacatcctcgccggccacggtgtctggcaccgggacctcaagcccgacaacttcggggtgttcaagcgcgcagaccgctcgacgcagctgatgctgttcgacttctccctggccggcgtgtcggaacgcgatgtcaaggcaggcactcgtggctacctggacccgttcctgggcacgtcccgccgccctgtctatgacgatcacgcggagcggtacgcggcggcggtgacgctgcacgagatggcgtcggggcagcggccggagtggggcgacgggatgaccgacccgcgcaccactgcggacgagaccccgaacctggcggcggacctgttcgagccggatctgcgtgagccgctgacgtcgttcttccggcgcgcgttccaccgcgaggtcgacaagcgcttcgacacgctcaagcagatggacgacgcgtggcgggaggtattccgcaaggccgaccgcaccccgccgctgactaccccgggcacagccgaggccgacgacgcgtcgctaccggacctgcgcgaggctgcggcgaagagcgcgacgctggagaccccgctggatgcggccggactgtcgccgcgcgccgtgtcggtggcgaactcgttcgaggcgttcaccgtcggcgacctgctgcgggtgccgccatatcagatctcgaaggcgcgcggagccggcgcactggtgcggcgcgaactcaaccgacggcacacccagtggagcaaggtcctcctggccggggcgacaccgcagcgcccgcaggtcgagggccgggcgccgacgatcgacgaccttgtcgagatcctcgccccgaagccgcgccgaggctccccgcggcccgaggcgatccggctgttgttggggttgccgggcgaggacgggaccccgccgccgtggccgacgcagagcgacgtggccaaggccctcggacgcacccaggcgaccgtctcacgtcacctcaactcccaggccaaggaatgggcggcggacgaacacctcaccgccgtccgcgatgatctcgtggcactgctgggcgaggcgggccgggtgatgaccgccgacgaactcgcggccgcgctgcgtgcccggcgcggctcggtcgagcaggactccgcgcgggcgcacgcgttggcgcttgccgtggtgcgggcggcggcagagaccgagatggcggcccagggcaccgacgccgagccgaggttgctggtcctgcgccgagcggagcgcgtgctggtagctctcgagtcgctgtcggactcctcggacccgagtgccccggaactcgcggacttcgccggagcactgggctcgtgtgccgacgaactggtgaaactcgaccctctgccgggccggggcgttgtggtgcgcgaacttcggtccatcgacgcacccgctggcctgccggtccaggcggacacgcggctggtggaactggccgcagcgatgtcgcgcaacgcggccgcctcaccccgactggagctgtatccgagggacttggacctggtgcgggcgctgcggatctcgcaggctccggccggggtgcggcgcggggtcgggatcgccgtcgatgatctgcttgcgaaggtcaaggcccggtttcccctgctggaactcggcgagtcgatcacgtacgtgcaactggagcgtgagctgtcggcggccgggttcccgctggtctacgacgtggagaaggcgcggttcacgcagcccgagcccgaatcgtcgcgcagcgtcggcagctcctacacctcggtcacgtcgacggagcagcggagcgatccgagcgagcaggcgcacgcgaagctgacgtccgcgttgaacaagggcggtttcgctgcgctgacgctgcgcggggtacaccttccgggggcggcggagtcgatctcctcggccttcccggtcgactcggtgcacgtggacgaactgttcctggcgcagttccgggcgctggtcaagcagcacgacgtggactggaacgacatccgcgctctcgacaacgagttcggcgcgactggggtgatcgcggacggcttcgcgtcgttcgtcgaagtgacctgggagaacgtgcaggaggaactggccaggcgggcctcgtcctcagtgctgtttctgcaccacgcaagcctgttggcccgctattacaaccggggcggccgagatctgttgacggaattgcaaaacgcggcccgccgcccagactcgcgtccccacggcatgtggcttctgtgcccaggcgattcggcgtgggagacaccgcggctggagcagcacatcgtcgaggtgctcggcgagtcggaacgggtggtgctggacggcgccttcctggcggggttgaacgcgggcgagggcgccgcgtga

SEQ ID NO: 222 - DNA, 4203 bp, Saccharothrix espanaensis
gtggacgagaattcgaaacggtggcacgagatcacgcagtcggcgttcggccacgagcgcgccgcgctgcggcaggtccgcgacctgcttccggaccgtcacccgttcgaggcgtggtcgaacttcaccttcacctcccagcacggacacgtccgcgaagtcgacttgctggtcgccacgcccagcgggctgcacctggtcgagatcaagagcctccaaggcaggctgaccaaccagaacagcatctgggtccagcaccgtcccaacggtcgggtgcgcacgttcgacaacccgctggcactggcgaaccagaaagccatggagctgaagagcctgctgctccaggccgcacgccgggacggggtgcacgtcccgtacgtcgccgcggcggtgttcctttccgaggccggcctggactgccgcctgagcgagtcgcagcgccacggcgtctacggtcccgagcacggcacctccttggcgaagatcggctcggacctgctcaccggccaggtcagccgctcgccggtgccaccggaattcttcatcgccctgccccggttgctcaagagcatcggcatccacccgacacggcgcagcgtgaccgtcggtgcgtggcagatcgagccgcgcccttacgagagcggccccacctggcaggaccaccacgcgaccagggaggacatgcccggcgagtaccgccgggtgcggatctacctctacgagcgcgaggcggaccgggacaagcgcgagtcgatccgggccgcggcggaacgcgagttccgggcctgccagggcatccggcaccccgggttgttgcgcccggtcgacttcgtcgcgcacgaactggggccggcgctgctgctggagcagcagccggaagcggtccggctggaccactacatcgcacagcaccacgccgcgctcgacctgccgacccgcctggacctcgtgcgccagctcgccgaggcggtgaactacgcccacgagcgcaggctggtgcaccgggcgctgtcccctcgcgcggtgatcgtccagccgaccggtggtgactggctccggccacagctccaggtgggtgagtggcaggcggccgcgcgtgggctgtccggtccgaccaccggtcaccgcctgcgccccagcagcggggccgcagcgcacatcgaggccgcagcgacgccctacctcgccccggacttcaccgacgacccggacggcacggtcgccatcgacgtcttcggcgtcggtgccatcgcgtacctggtgctcaccggacaggctcccgcggcacccgccgaccgggcccaggaccacgacggcctgcacccgcaggccgccgacgacagcatccccgacgacctggacgcggtgatcgcgctggccaccacccccgtggtggccgacaggttccccgacctcgcgctcttcctggaggagttggccgacgccaccaggctcgacgccaccggcgcggagcgggaggacccgtgggacgccggcctcggccagcgcctcgcggactccgactacgtggtgcgcaaggtgctgggcaccggcgcgacggcccgcgcgtacctggtcgaccacgacggcatcgacaccgtggtgaaggtgtcccggtcggccgaggcggaagaccggctggtcgacgaagcgcactcgctggagcacctgcgccacgaccacatcgtcgtgctgcggcggagcctgttccccctgggcagccgacacgcgatcgagatcgactacgccggggagcgctcgctggcccaggtgctgcgggacgagggcgccctgctgccggacaagctccagctgctcggcgaccaactgctcgacgcgctgtcctacctggaacgcaagggtgtcgcgcaccgcgacatcaagccggacaacctcggcctgcgcagtcacccgaagaccgggcaggcgttggtgctgttcgacttctcactggcgggcgcaccaccgaatgacgtgcaggccggtacgcgcggctacctggacccgttcctcggcacggatcggcggcccggctacgacgcgcacggcgagcgctacgccgcagccgtcacgctgcacgagatggccagcctggaactgccgacgtggggtgaggacggcaccaacccgaggttccacggtcacccggccaccatcgcgagcgagctgttcgaagccggcctgcgcgaaccgctgcgcaccttcttcggcaaggcgctgcaccgcgacgccgagcagcggttcgcctccgccgagcagatgcgcgaggcgtggcggcaggtgttcaccgcgctggacgagaccggtcccgccgcgatctcgtcctcgggttcggacgatccggcggagctgcggcaggaggccgccgaacgggccggtctggacaccgcgctggacgcggccggcctcaccttgcgcgcggtggccgtggcgaaccggttgggcgcgaacacggtcggagacctgctggacctccggctcaacgaggtccgccgagcgcgcgggctcagccggaagacgcggacggaactgctcgaccggatcgccgcgtggcgcacccgcttggtgtccgacccgagcgcgatgcgcccgctgccactgcctgaggacgccgactccggccgcctcccgctcgacgcgatcgtcccgctgctcctgccgacggccaagcgccgcaacgacacgcaggccgcgatcagccgccttctgctggggttgccggacgcggggggagcgctgcccgctacccggtggccgaccaaccgggcggtggccgaccgcacgaacgtgacgccggggcgcatcgcccaggtgttgaccgcccgccgcaaggcgtggtcggaactggacgtcctggagagcgtgctcgacgaggtggtcgacgcgctcgcgtcgttgcgccgggtggccgccgcagaagagctcgccgaggtgctgatcgcccggcacggcttcgccgagacgacggaccccgggctgcggactgcctacgcgtacgcggtgctacgcgctgtctacgaagcggactcgatccgggaagagagcaggttggtgctgcgcaggcaccacgaccgcctgctactggcgttgcaggtcggccaggacgagccggtcgagacgccgtcggacgaggcgttgctcgacctggccaccgcgttggcggacgcggcgaccgcgctcgccgcacaggatcccctgcccacgccgaccgccgtggtccgcgaactggccgcgtgcgtggagcggttcggcgaggccttcgacgagaagcggctggtccgcttggccgcggcgggatccggagcggtcctgtcgaacgtgcgcatggagctgtacccgcgtgacctgcctgcggtccgggcccttcgcctggcgcaggccggtgccgggctgccgacggacggcctgagcgccgaagcggtgcagcggcgggtcgacaaccggttccccgggctcgaccggctgccgaccgggcgtgcgctgaaggagttgctggtcgaagccggcttcgcggtgcgatgggacggcgagcggttcggtccgcccgcaccgcagctcaccgccgtcacgccggacctcacctcgtccacgggctcgacgagccggccaatgatcgaggggacggccgcaggggacgtggacgcgcggttggccgacgtcgcccggcgcggcggcatccgggtcgtcaccgtccggctcaagcggtgggctcgggcgcgggtggcggtggaactggccctgggactgcccgtcgtggacgtgacgaccgcgttcgtggcagccctgcgcgaagtcgcgaaggagttgcgcatcccggacttcgaccgggtgttgcgcgcggacgcggcggagcccggcagcaacgatcagctcaacctgcaccgggtggtggagcaggcgtgccggcggctggaagcggactggacgcgccgccacgtgctggctttggacggcctcactccgctcgggcgctacccggccgcacaagcgctgctggagaagctgtgcgaccgcgcccgctacggccggacggcgggcggcccgcccggtccggacacggtggtgctgctgtgcccggcggaggacgagacgaaggcccctcacatcaatggttacgtcatcagggtgaattcgccggaagagtggatcatcgcgagatctccttggccgccggccggaatactgcacccacaagcgggctga

SEQ ID NO: 223 - DNA, 4242 bp, Singulisphaera acidiphila
atgatgaagacgcgatggaacacgatcaccccgtcgcagtattcgtgggagcgggccgcgctggactttgtccgcgagggtttgcccgaccacgatccgtatcgggcctggtcaaatttcgagttccaggcggatggcggggcgatctatgaagtcgatttgctcgtcctgaccaaacaaggcttctggctcgtcgagtgcaaaggttggaatgggaggattaccggggactcgggttcctggactcgatccgacggcggtcggcccaaatcggaggacaatccggtcctgctggccaaccgcaaggcgaaggccctctcgtccctcctcaaggcgcagtcgtccgtcgccaaagtgaaggtcccctggctcgacgccctggtcttcctgtcggcggacgaggttcagtgcgagctcaccggccccgcgagaaatcgggtctgcctcaaggatcgaccggctcacgaaggccgtcccgaacgcaagagcgtgcttgccgccttgctggagcgcgactgtccgggcgtcgatcctgacctgcgctcgaccatcgatacgaaggtcgccaaggccttatcccgcgcgatggagcaagcgggaatccgcccgtcgcaacgggctcgccgggtgggtgactacgtgctcggcggtctgatcgccgatggcatcggctatcaagactggctggccaagcatgcctccttcgaggatgtccactgccgggtgcggcagtatacggtcgcccaggcgttgtcggaggaagaacgccagcgactgcggcgggcggcggctcgggaattccagatcatccagacgcttgatcacccggggatcctgcccgtcctcgactacaaggagcacgagaacggccccgccctgctcttccgctacctcgacccgaacgccatccgattcgaccagtacctggcgacgaacgcccacaagctcacgaccgaccagcggctcgacctcctgcgccaggtcgccgatgccgttcgctacgcccaccgcaagcgggtgattcaccgggcactcagcccgcagagcatcctggtcacggacgcggcctcttcgacgccccggctgcaaatctacaactggcaggtgggtgtccgggagacggcctccacgtcggctcgagcaaccgaggtggaagatctggtcgaatcacaagccttcgtctacatgtcgcccgaggcgatcgcggatgggcggaaggtcaccgaggcgtcggatgtcttctcgctgggggcaatcgcgtttcacctgttcgcctcgcgcccccctgccagcagtccggccgacctggcgagaatcttgcgggaacagaaagggctcagcatctcctcagtcctcgacggtgcgggggccaagctcgaagagttgatccagtggagcacccaccccgacgtcctgacccgcatcggttcggtcgaagactacttgacgctgctcgatgatgtcgaggacgagctgaccgcgcccgccgaagccgtcgttctcgatcccttgcaggctaaacggggtgaccggatcgaacaaggattcgtcgtccagcgcgtgctcggccagggtgcgacggccgtcgccttgctcgtcaccaagggtgacgaggagttcgtcctcaaggtggcgatctccgaggaacagaacgcccgcttgcacgaagaagccgaggccctccggtcgatccacagcgaattcatcgtcgccatcgtggatgaactcatcatcaatggcaaggccgtgctcgtcttgcaaaaggcgggcgacaagaccctcgccgccatgctccggtccgagggtgtgcccggtctggagatgctcgctcgctatggcgatgacctgctctcggcggtttcctcgctggaacgccatggggtcgcccatcgcgacatcaagccggacaacatcgggatccgttcgctgacgaagcagcgcaaccagctcatcctctttgacttctccctggcccaggcccccctcgacaacatccgggtgggcacgtccggctataccgatccattccttatcaaccggaaacccaaacgctgggatctcgacgccgagcgctactcggcggcgacgaccttgtacgagatgaccctcgggacgggcgtgctcccccagtggggagacgggaagtccgacccggcgatgaccgacgccgaactgcggatcgacgccgagaaattcgatcccagcgtccgcgaaggcctggtcaagttcttcttcaaggcgctggaccgtgaccccaccgggcggttccacaacgccgacgagatgcgctgggcctggcagcaagtcttccagggggcggaagagcggaagatcaagacgccgagcggcgaagaggtcgacctccgggtcaccctggaacaggccgacctcacgacgccggtcgccgccctgggcctgagctcccgtgcccaaaacgccctggagcgggccaacatcctgacggtccgcaacctgctggaacacccgatcggtgacatccacctgatgcgcggggtcggcaaccagacccggcgtgagatcatcgacttcctcaccaagctgcggggccgcttccctagcgtcgaggcgacgtccaccaaggaccagggatcaccggacgagtcctcggggccacccggcctcgaactgatggagcatcggatcgtcgggatcaagatccccaagaaagatgccgaatggcagatccgcacggccctgctcggtgtcacggtggcggactcgcagccgcccgacaagtggcccagtcagtccgacgtggccgacgcgctcggcctctcccgcgcccgtgtcggccagatcgtgatcttcgaccggaaccgctggagcaaagacccggcggtcacatccttccgccacgaactctgcgagcagatccagcgcctcggcgggatcgtcaccatccccgagatcatcgacctcacgatcctgctccgccctcccgcgagcctacttgaacccggccggcaacaacggatggcatcggccgtggcgcgggcggcggtcgaaaccgagacgtcgatgacagtcccccggttccagatccgccggatcggcaggaaggtcgccgtctcctgctcccaggaactggccgtgtttgccgaggagcttggccagaaggcggacgggctcgccgcgaccgaccccctgcccccgccattgcgggtcttccaggagctctacgaggtcgctcagccgcagcagccgcacggctgccagcccttcggtaacgaacgcctcctgaagctggcggcggccatgagccggaacgccgccgtctcctcgcgccaggaactctatccccgcgacatggcggcggaacgtgccttgcggctggggatcggggcactctcaggcctggggcttggcgaaggcgacgacggcttcactatcgagcagatccgcgatcgcctgaagagtcgctaccccgaggccgatcccctgcccggccgcccggagctcgacgacctcctccggagagtggggctcgacgtccgctggcacccgcacacctcgacgtaccaccggcgtgaaacgtcgaccctcgccacctcgggctcatccatccccctccgtcgaaccacggcgacctccaaccgcaaggtcgagatcacccctgatctggccgaggctcggcagttcgaggagcgactgagccacgcctacgacgacggcgggttcctggttctcaccgtccgccccagccggatgcgccggtgtgaaaacgagttgatgcgacggttccccctggaacgggtctccttcgacgccctcctgttcgacgcccttcgcgatgaggccgacgaactagagatcgactggtcgatcgttgaggaagcggatggtgcagaccgttccagtcaggactggaacaacctcatcagtctcgtcgctcgagtggcccctaagctcactgctggactgtgcgaccgccgccaacacctactcatggtccatccggggctggcagctcgctacgatcaaatgacggtcctggagacgttgcgggacaaggtgggccacgacgtcgcctgtcccggtctatggttacttgtggcgacggactggcagcacgacctccccatgctcgacaacgctgagatccccctgattacgccaggacaacggtcgagggtctccgaatcctggatcgacaacctacaccggggccatgcgaacggagcagccactcgtcccgttgcttctaggaagggaggcgtctaa

SEQ ID NO: 224 - DNA, 4434 bp, Sorangium cellulosum
gtggcgctctcgcgtgggagggtcctcgcccagggcacgacgccgcatcgccacgagcaggaggcgctcgagttcgtcaaatcggtcctgcctgacaccgacccgtaccgcgtctgggcgctcgtcgacctcgtcgactcgagcgggcgccggtacgagctcgacctcgtcgtgctcggctaccacgccctctatctgatcgagatcaagagtcatccgggcgccgtctccggggatgtcgtcgactggcgctttcgttctcccgaagggcacgtctccatcaaggaaaaccctctccggctgaccgcgctcaaggcccgcgtcctcgggagcctcctcgaaaagcagatggggagaaagcggccgtacgtcgagccgctcgtcttcctctccgacccgaacatccatgtcacgctcgagggcaatgcgaaggcccgcgtcgtcacccggcgcggcttcctcgccgccatgcagcacggcgactacccgggctccgaggcgcgcccgctcggctccccgatcgaccggccgatggggcaagcgatcgatgtggcgctcaaggcgctcgggcttcgcgagagcaagggcgcgatgaaggtcggcgatctcgcgctcggcgagctcatcgaggaggggccgggctaccaggatcgcgaagcccagcacgagcgcatggcgacgttgaagcgtcgcgtccgcagctacctcgtcccccagagccccggtcaggagcggcgggaccagctccggcgcgccgccgaccgcgaggccgaggtgctctcggtcctgagcgatcaccccgcgatcctgcgcttcaccgactacatcgccgaaggcccgatgggcgggccctgcatcgtcttcgaggacttcgcgggcgggctccccctcgacgcctacctccgccggcacccggatctgtcgttcgatcaccggatccacatggtccagcagctcgccgatgcgctcgactactgccaccggaagaaggtcctgcaccgcgggctgcaccccggcgccgtgctcgtccgcgagcggcaggacaacaaacctcccgaggttcgcctctacaacttccagcttgccagtcgggaagacggcagctctggcaccgtccacctctcggcgctcgcgcccgatcgcgccgtcgtctaccgcgcgcccgaggtcatcgaggagccctccgcagccaagccggagagcgacgtcttctcgctcggcgccatcgcctaccagatcttcacaaggaccgcgcccggggcgaccctcctcgagcgggagatgctcttgcaggcgggcggaggccacctgtcgatcgcggcggtgcgcgacgacctcgccggcggggccacgccgctgggcgagaccgagcgcaagtccctcgacgaagtcgtcgggttcgccaccgaggccaaccccgtccagcgcgctgacaacgcgctcgattggctcgatctgctgctccaggcggtcaccgcgcccgcgaccgggccagtcccgggcctcgacccgctcgaggcgcgccccggcgatctcctcggcggaaagctctcggtggcgcgcctcctcggcacgggggccaccgcgcgcgtgctcgccgtcgagcgcgaggggtcgctgctcgccctcaaggtgccgctcgcccccgagttcgaggatcgcctgcgcgccgaggccgaggtgctgggcgcgctccggagcgagcgcatcgtccggctcgagggcacgccgacgctggggggccgcttctgcctgctcacctcgtacggcggcgagacgctcgccgatctcctcacgcgggaaggcccgccgagcctcgattacgcgcgccgctggggcgaggacctgctccgggccctcgagttcctcgaggacgagggcgtacagcaccgcgacatcaagcccgcgaacgtcggcgtcctcccgagccagtcgaagaagcaacggcacctctacctgttcgacttctccctctcgatgctcgacagcgcccagaccctcgtcggcacccccgcctaccgcgatccgttcgtcccgctgcgcggccgctgggacgaggccgccgatcgcttctccgctgcggtcacgctctacgagctgctcaccggcacccggccccgctggggtcgaggcgacgtgcccgccaccgccggccaggaggagatgtcgctcgacgccgagcgcttcgatacggccgtgcgcgggcgcctcgtgccgttcttccgtcgcgcgttcgcccgggaggcgggccagcgccacgagaccgccgagcagatgcgaaccgagtggatcgcctgcttcgccgccgcgcccagcgaggccggcgccgacgaggcggacggcgcgcctcccgtcgcggcggatctctcgatctttaccgaggccacgcccgtcgaggccctcccgctcggcgcgcgcgagaagaacgccctcgaccgctccggcatcgtcaccgtgcgcgagctcctcgcgctcccgcagaaccagctctccgcgatccgcggcgtcggccgggagacggcgcgcgccatccaggacttcgtcgagcgctggcgcgcggcgcgcgccacagcaggcgtggcctcgtcggtccccgaaggcggcgcgccaggccgaccgcgatcggcccccccgctccccgccccgttctacccgggctttcagggcgaggacgccgccgtcgcctatctccccggggtgccgcgcgagctcaccacggccctcgccgacgccggcctcgcccgcgcctcccacgtggccgcggcctcgccgcgacgcatcctccacgtcctcggcgatcggcctgacgccgccgaggcggtgcgcgctgccctcgccaagctcgcggagggcgccaccgacgacgcgcccgcgaccctcgccgcatggctcgatctgctgctgcccggcaaggcggcgggctccggcagggcgcgcgtcaacgcgggccggggcccggggtccgccgtcccgttcaagcacgtccgcgagctgttcggcctcgatcccgtggagggcgagcggatcaccgaggcctcgctcctcgcgaagaagcaccgtatctcgcctcaggccgtctacctccagctctccaaggcccgggagcactggcgcggcttcccccggctccaggtgctccacgacctcgtgcacggcgcgctcgcgggcctcggcggcgtcgcctcggtggccagcgtcggcgccgccctcgcctccgccgtccccgcggggcccgcggcggcggacgcctcgtccgacgcggccgcgcgcctcgcggaggccctggtccgcgtcgtcgtcgagaccagcgagcacctcgtcgtcgggcccgtccgcggcctgtggatcgccccttcgtacgagcacctccgcgtcgcgcgcgcgctcggcgacgaggccgacgccctcgcggcgcgcgagccgctcccggcctcggaggaggcgcgcgcggcgctggcggcgcgcgtgaaggacaccgagctcgcggcgctgccccccgagcggctcgtctccctcgccgccgaggccagccgcaccgccgcgaagagcgccaggctcgagctctatccgcgcgcgatgtcgcccgcgcgtgccctcaagctctccgccggggcgatggcgcacctcgagctccagcccgaggagatcctcaaggccgtcgccgcgcgctaccccgaggccgagcgcccgccgccccgcccggcgctcgatgcgctggtccggccgctcggcctcgagtggagcgacgaaaaaaacgcgtacatccgccccggcgcgctcccgacgagcacggtgcacacccaggtcccgccccccccgctgccgacccaccatgggtcccgccggcccacgcgcgacccgctcgtccaggaagcgcgcgagttcgacgagcgcctgcgcctcgccgcgagccgcaagctcttccgcgtcatcgaggtcaactgcgccttcgccgacgaggccgcgaaccggctctcgcgggacctcgggatcgagcctgtctccctcgatcgcgccatcttgcgcgccgccgacgcggtggccctggagtgggagatccccgaccgcggcgtcctcgacgacgccgatcgcgcgggcccgaccggcccggactgggccaacctccgcgacctgatgcgcgagagcgccgagcgcgtcgtgcgcgacctcgtggcgaggaacgcgtcggtgctcctgacccagccggggctccttgcccgctatcgcctcgacggcgtcctggccacgctgatcgaggcgacgcagaaggacgacgggcccgccgtcttcctcctggtcccggcctacgacgacctcggcccggcgccgatcgacgccgttccggcgccgatgccgatcccgcagagctcgccggcgcagcggctgcgcgtgcccgagtcgtggatcgagaaccgacaccgggcgatgccctga

SEQ ID NO: 225 - DNA, 5421 bp, Sorangium cellulosum
gtgaggctgcccagggagatgggcgctccctccccgtacacgatcaccgggaccctccacgagggcggaagaacccgcctgcttcgcgcggtccggagcgccgatggccgcccggtgatcttgaaggtcatcgacccgaggagcggttgctcgcaggacatcgagcgactccggcgcgagtacatgatgggcaaggctctccgccacgaggccttcgtcgaaccgctcgccctcgagacgttcgaggggctgccggcgctcgtgatggaggatttcggcggcgagtcgctcgatcacctcatcctcctcgacgcgcccatgagcgccgggcggttcctcgatctcgcggtgcgtctcgtcacctgcgtggcggagctccaccagcgggacgtcctccacaaggatctcaagccccagaacatcctcgtcaacgcgacgacgggcgaggtgaagctcgccgacttcggccttgcctcccgcctcccccgcgagcagcccccggtggggactccccggctcatcgaaggctccttgccgtacctgtctccggagcagacggggcgaatgaatagggcgatcgacggccgcgcagacctctatgcggtcggcgtcaccttctaccagatgctcacggggcgcctgccgttcgaggcgcgggatccgctcgagtgggtgcactgccacgtcgccctcgccccgccgccgccctccgcggtcgtccccggggtgcccgaggtcctctcggcgatcgtcgtgaagctcctcgccaagatggcggaggatcgctaccagaccgcccgcggcctcaggcacgacctcgatcggtgcctctcgcagcaccgggcgtgtggcaggatcgagccgttctccctgggcgagcgcgacatctccggccgggtccagctcccgcagaagctctatggccgcgagcgcgaggtgagcgccttgcggcgcacgttcgagcgcgtcgtggacacgggagtccccgagctcgtcctggtctccggctattccggcagcggaaagtcggccctcgttcacgagctctacagatcgatcgtccgggaacgggccctgtttctctcggggaagttcgaacgatccaggcgcggcgtccctcacttcacgctcgtccaggccttccgggacgtcgtatgcgagatcctcgccgagcccgaggatcggatcgcggcgctccggcagcggctgctcgacgcgctcgggcccaacggacagctcatcgtggacgtcatcccgcaggtcgagctcgtcatcggccggcaaccgcaggtccctgagctcccgctggccgaggcgcagcaccggttccgcgtcgtgttccggaggttcatcggggcgttcgcccggaaggagcacccgctcgtgctcttcctcgacgatctccagtggaccaaccccgcgagcctcgggctccttcatgatctgatgacccaccccgaggcgcgccacctcctcttcgtcggcgcgtaccgcgacaacgaggtgacgccctcgcacccgctcatgatggcgctcgacaaggtgcgaaaggacggcgcgcgcgtctcggacatcgtgctcggcccgctctcccgggagcacctcggcgcgctcgtcggcgacgcgctccgctgccgcagcgaggacgccgcgcagctctcggccctcgtccacgagaagacggccggcaaccccttcttcgcgatccagttcctcaccgcgctgcacgaggagcggctcatcgagctcgacgagcgcgccgagcgcttccggtgggacgtcgcgaagatccgcgacaagggcttcacggacaacgtgatcgacctgatggtcggcaagctcgtgcggctccctccgggcgcccaggaggcgctgaagcacctcgcctgtctcgggagcgccgccggcgtcgacctcctcgcgatggtccgcggcagctcggtggaggagacacacgcggacctctgggatgccgtccgcgcggggctggtcctgcgcaggggcgcctcgtacaggttcgtccatgaccgggtccaggaggccgcctattcgctcatccccgaaggcgagcggccggcggtgcacctcgggatcggccggctgctcgcgtcgcgcgcggcgccggaggcgctcgaggagaagatcttcgagatcgtcaatcagctcgaccgaggcgctccgctgatcacatcacgggcggagcgcgagcgggtggctgagctcaacctcatcgcgggcaagcgcgccagggggtcgaacgcctgcgtcctggcgctgaggtatctggccgtcggcagggcgctgctcccggaggatggctgggagcgacggtacgagctcaccttcgagctcgagctccatcgggccgagtgcgagtacctcaccggcgatctctcggcggccgaggagcggctctcggcgctctcgcgccgcgccgcgagcctcgtcgatctggccgccgtcacgtgcgtgcgcctcggcctctacacgaccatggaccgcagcgatcgcggcgtcgacgtgggcctcgactacctccgccgcgtcggcgtcacgtggtcgccgcaccccacggacgaggaggtacggaaggaatacgagcgcgtctgggagctgctcgggagccgttcggtcgaggacctcatcgactcaccccagatgacggacccggagtgccgcgcgaccctcgatgtcctgacccacgcgcagtcgccggcgctgttcaccgacgcgaacctgaattgcctcgtcgtgacgcgaatgacgaccctctgcctcgagcgcggcaactgcgatgcatcgtgcatcgcctacacctggttcgtcgtgcagcgggcgcggttcggcctcgaggtcgacatcgtcaccgcgcagctcaggctcatccgggccctccggggcctcttgcccgatctctcctcgttcagcgacgccgacttcgacgagcgccggttcgagcggcgcctggagggcgatccgcgcctcgcgatcgcgacctgctggtactggatacgcaagctgcaagcgcgcttcctcgcgggcgatctcgacggctcgctcgaggccgcggagaaggcgcggccgctcctctggacgtcgggctcgttcttcgaggtggccgagtaccatttctatggagcgctcgcgcgggcggcgcgctgccgcgcggcggacgccgccgagcggcgccggcacctcgaggcgctcgccgcccaccagaggcagatcgacacctgggcggagagctgccccgagaacttccgcgaccgggcggcgttgatcggcgccgagatcgcgcgtctccgcggcgcatgggacgacgctgcccagctctacgagcaggcgatccgcgccgggcgcgcgagcggcttcgtccaccacgaggcgctggcctacgagatcgcgtcggggttctatcgggagcgagggttcgagctgatcgccgacacctacctccgcgaggcccgcgcctgctatgtccgctggggggcggacggcaaggtccggcacatcgatcagcggaatccgcgtctctgggacgcgaggccgctcgccccgaccgcctccttcgcggcgcggttcgagcagctcgaccagctctcggtgatcaaggcgtcgcagacgctctcgagcgagatcgtcctcgacaagctcctgcggacgctgctcacggtcgtcctcgagcagggcggcgcgcagcgagcttgtctcgtcctgcaccaggacgagcgcctctccgtcggagccgaggccatcctggaggagagcggggaggtgaagaccctcctcccgcgctctggggagggcgcttcacagcgcgtccccatgtcgctcgtccgctacgtgcaaaggacgaaggagcgcgtcatcctgagccctaccgaggctctcgacggcaagttctccggcgacgcgtacttcgcgcggcgcaagcccaggtcggtcctctgcatgcccatcctgaggcaggcggaggtggcgggcctgctctatctcgagaacgacctcctcgccggcgcgttcccgccggagcggctcaccgccctgtccctgctcgccgcgcaggccgcgatctccctggagaacgcgcggctcctctccaaggagcaggccgcgaggacgggggccgaggcggcggagcggcgcgcggccttcctggccgaggccggggagatcctctccggatcgctcgattacgaggagacgctggggcgcgtcgcgcggctcgcggtgcaatcgctctgcgactggtgcatcaccgatgtcgtcgaaggcgagcagatccggcgaagcctctgggcgcacagggattccgccaaggagtcgctgatcgagcagctgcggcgtcggtattcttctgccctggactctccccatccggcggccagggcgctgcggcgtggtgagccgttgctggtctccgggtgctccgaggaagagctccggcaatactgcgaggacgacgagcatgcgaggctcatccacgagctcggggtgcagagcctcatcgtggtgccgctcatggcgcgggggcggccgatcggggcgctgagcgtcgtctcgtccgcgccggggcgctgctacggggaggccgacctggagatcgtccagcacgtggcgcacagggccgcgctcgcgatcgacaatgcgcggctgtaccgcgccacccaggaggccatccgcatgcgggacgagttcctcaccgtggcgacgcacgagctcaatacgccgatgacgtcgctcacgctctcgctcgaggccatggacaggagccttcgctcgggtcggccctgcgatccgccggcgatgggcaggcaggtcgagcgcgcgctgcggcaggtgatgcgcctggcccgcctgaaccgcgagctcctcgaggtctcgaggatcgacacggatcgggcctcgctcgacctcgcggaggtcgacctcggcgtggtcgtgcgcgacgtgatcgcgcggttcgagctggatctggcgcgcgccggctgctcggtctcactgaggatcagcggccggaacgtgggctcctgggatcgctcccgcgtcgaccagatcgtcacgaacctcgtggccaacgcgatcaagttcggcccgggcaagcccatcgagatcgtcctcggcgaggaggccgggacgacgcggctctcggtgaaggatcacgggatcggcgtcgacccggcgcgccaggagcggatcttcgatcgcttcgagcgcgccgtgtccgaacggcactacggcgggctggggctcggcctgtacatcagccgccagatcgcgcaggcgcacggcggctcgatccgtgtcgagagcgcgcccggcgccggcgccacgttcaccgtcgagctccccggcgccggaccgccggtgtcgccgcgcgcgccggtcttctcgaacgattcgataggatcgattcgatag

SEQ ID NO: 226 - DNA, 5517 bp, Sorangium cellulosum
atgcggagcacgtcggaggcatggaatcgacctgctgtccaggaggctcgctccgtcgagcctgggcgcgcgccctcggtgcgaccaggcacagcccagctcaaggggtatcacgtcaccgcgaagatcggcgagggcccgggctccaccacgtatcgagcccgtcgggacgccgacggcatcgacgtggcgatcaggatgctgcacaccgatgacgcccgagccggcgatgtcatgcgcctcaggcacgcctaccgcgcgatacggcagctcgactcggagagggtcgtcaaggtgtacgccgtcgaggagcacgaggacggcctggcgctcgtcaccgaggctttcccgggcgccccgctgtccgcgaaggcggcctgcaagctgggcgtccgcgcgtcgctggacgtcttgatccccgtggccgaggccctggccgacatccatcgtcatggcctcatccatggcgacgtgaggcctacgaacatcctgctcggagaggacggtcaggtgaagctcacgggcttcggcgtggagtccatcgtgacgcgcgagaaggaggagatctattgccgccgcgtcctctcgaaggtgctcccctatacatcgccggagcagaccggccgcatgaaccggagcgtggactaccgcaccgacatgtactcgttcggcgtcgtcctctacgagatgctcgcggggcggaggccgttcgaggcgctcgaccccctcgagctgatgcacgcccacatcgccgtgacgcccgtcgccccctcggagatcgacccggaggtgcccgacgcgctctccgccgtcacgatgaagctgctcagcaagaacgccgaggaccgctaccagtgcgccgaggggctgagggccgatctggaggagatccgagcgcgatggcagcgcggcggccagataggagcgttcagccctggccgccacgacaggagagacctcttccggctcccccagaagctctacggccgcgaaggagacatccggaagctcgtcggcgcgttcgacgacgtgctgcggggcaagcggacgatcgtcctcgtctcgggctattcgggcatcggcaagtcgtccctcgtccaggagatcttgaagccgctggtgcgcgagaagggctattacatcagcgggaagtacgatcaggtcaaccgcgacacgccctacagcgccatcgtccacgcgttcgacacgctcgtcaggcagctcctctccgagagcgaggagcggatcacacggtggcgggacgccatcctgggcgcgctcgggaccaacggacaggtgatctgcgacgtcctcccgtcgctcgagcacctcctcggcgagcagccgcccgtccccgcgctcggcccggtcgaggcccagaaccgcttcatcctctacttccacaacttcgtgtccgtcttcgcccggcacgcccacccgctggccctcttcctcgacgatctccagtgggtggactcggccagcctgagcctgctcacgagcgtcctcgcgagagaggacctggagtcgctcttcttctgcggcgcttaccgcgacaacgaggtgagcccgacccaccccttcctcgtcgcgctggagcagctcacgaagggcggcctcgaggcgcgcgacatcgtcctcgcgcccctcggcctggcgcacctgacagagctcatcaacgacagcctgcagacaggcggcggagaggcgctcgcgggcgcgatcatgaagaagaccgggggcaacccgttcttcgtgaagcagttcatgcggcacctctacgacacgaaggcgctggtcttcgatccgccggcgggctggcgctgggacctgcgccagatcgagcggctggagtgcaccgataacgtcctgagcctcatggcggagaccatccggcgcctgccgcaggcgacgcagcgggtgctccggctggcctcggcgatcggcaacacgttcgagatggatgtcctgaacaccgtcagcgagcggccccccgacgagacgtacgcgagcctcgaccacgccgtcgccgaaggcctgatcgtgagcgcggacgagcaggttcgattcgcgcacgacaagatccaggaggccgcatattcgctgatcccggagggagacaggccggcgtttcactaccggatcgggaagctcctgctcggcaagccgcgctccgacgaggggcgcgatctgttcgacgtcgtcaatcacctgaacagcgccggcgatctgatccgcgcgccggaagagcgcatggaatcggccaggctcaacctccaggcggccgggcgcgcccaggagtcgtcggccttcaccgcggccctcaggtacctggaacatggcatctccatgctgcccggagacgcgtggacctccagctacgagctgaccttcacctaccacacgaagaaggggctcctggagtcgctctgcggacgccacgacgacgcgctctccaccctctcggggaccttcgaaagagcggtggggcgcctccacaagacggaggtgcgccgcctgaagatgaacgtggagatcctgaagaacgatctgcccgccgccatggaagaggggctcgccgcgctcggggcgtacgacatccacctgccgccttatccggacgacggcgcgctcatggccgagatggagcggaccatcgcgatgatcggcgaccgcccgatcgcgtcgctcgtcgatctgcccgcgctcgacgatcccgagatcgccgccctgcaggacgtgctccaggagatgttctcgccgacctaccagctcggcacgaacaacttcggcatcacggtgatgaaggcgctccagaactcgctggcccatggcatctcgcggaactcgatctacgcctacgtgaacttcgggacgctcctgtgcgccaggctcgacatcgagaaggggtacgagttcgggcgggcggcggtccgcctgaacgagcgccgcccggacgcgaagtccgagtccatgctgtgcaacatgtggggagcgtgggtccagcactggatggatccctacgagagctcgaaggcgtccctgcgcaagggcgtccacgccggcatggagacggggcagtacatctgggccttctacaacgcgtgcaacgcgagcatgaacggcctcctccggggggagcacctccacgacgtcatcgaggaggcgaggcagtatctgccgctctgcaagctcgacaagttcaacgcgatcacgtggatcgtcggggccgtcgggcagctctgcgagtacctgagcacgccggacgagggcgactggaagcgcggggcgtgggtcgacatcgacgcggtcaccgaggccgcccgcagcatcgacaaccgggcgtcgctctacttcgtgaacgtcttcaaggtccacgccggcgtgttccagggcgcgtacgaggaggtggccgagatctggggctcgaccgatccggcccgcctcggcatgctcgccgcgtggcacgcgagcccttgttatcacttctacggcgggctggccttctcgcgggccgcgggcgccgccgcccccgcgctcagggcggcgtacctcgcgaggctcgcggagtgcgcgcgcaaggtggagtcgtgggcggcgctcggcccggagagccaccgccaccgcagcttgatcctgaaggccgaggtcgcccggagcgagcgccgagagggcgcgggcgccctctacgatcaggggatcgcggccgcgcgggagggccatttcctgcacgacgaggcgctggccaacgagctctgcgctcgacactacctcgacctgggcagggcgttcgtcgcgcgcgcctacatgaccgaggcgcacaggctctatgcgcgctggggcgccgtgcggccgatgctgcgcctcgagagggactttccgcacgcgctcgggccggaggcgctgcgcaggcggaccgacctcgcgcgggacgggggcgccgacgtccgcggcgccgccgtgggtcacggcgctcgcccggggctcgacttcatgaccatgctcagggcctcgcaggcggtctctggcgagctgaacctcgaccgggtgatcgaggccctgctgacgatcgcggtcgagcacgcgggcgccgagcgggggctgctgatccgcgcgtcctgtggctcgcacgccgcgcacgacgtcgaggccgaggtcgtcacccggcgcggccgggtcgaggtcacccttcgccagacgcccgtcacctcgagcgatctccccaccgccatcctccagtacgtcatccgcacgcgagagagcgtgatcctggacgacgccgccgtgcccaacctgtactcggaagacgcctacgtgcgcgggcggcgcccccgctccgtgctctgcctccccctggtgaagcagggcgcgctcgtcggcgtgctctatctggagaacaacctgaccccgcgcgccttcaccgcggatcggatcgaggtgctggagctcctggcctcccagtccgccatctcgctggagaacgcgcgcctctacacccagctccagcaggagaacggcgagcgcaggcgggcggagctggcgctgcgggagagagaggcgcgcatccggcgcctcgtggactccaacatcatcgggatcgccgtctgggacctcgacggcagggtcatcgacgcgaacgacgcgctcctgtgcatgctcggctacagccgtgaagatctgacctcggggaacatccgctgggcagatctcacgccgccggagttcaaggaggcgacccggcggacgctcgagcaggtccgcgtgacgggtgagttcgggccgctggagaaggagtatttccgaaaggacggcggccgcgtcccggtggtgatcggcggcgcgcggttcgaggggtcggagagccagggggtggcgttcttcctcgacgtgaccgagcgcaagcaggcggaggagcgccagaagctcctgatgaacgagctgaaccaccgggtgaagaacacgctggcgatcgtccaggcgatcgccgtgcagacgctccgcatggcggactcgcccaaggccttcacgagcgccttcctcgcccggttgctcgccctgtcccagacccacaacctcctgaaccagacggcgtggcagggcgccgacctccacgacgtcgtccgcgccgagctggcgccgcacgccagcggcgacgccgagcgcgtccgcctggtgggccaggacgtccgcctcctcccggaggcggcggtgacgctcggcatggtctttcacgagctggcgagcaacgcgaccaagtacggagcgctatcgcagccgtccggccgcgtcgcggtcacatgggacgtgatcacccaggcgcacgggcgcctgctccacctggaatggcaggagacgggcgggccgcctgtccggccgccgcgccgcaagggcttcggctcacgcctgatcgagcgcgatctcggccgccagctcgccacggaggtgcgcctcgactacctgcctggcggcgtacattgcgtgatggatctgcccttcgagcgcgtgggcgtaggatga

SEQ ID NO: 227 - DNA, 4674 bp, Streptomyces coelicolor
atgcgggaaggccggtgggtcacggtcaccgagtccgagttcgagcacgaacgacggggcctggaggcgatccgccagaagctgccggacggcgacccgtggcgggcctggtcgaacttcaccttcaccgcgaacaccggccacgtccgcgaggtcgacctgctggtcgtcgcccccggcggcctctgcatggtcgagctaaaggactggcacggctcggtcacctccgagaacggcacctgggtccagaccacccccggcggccgccgccgcacccacggcaacccgttgcacctggtcaaccgcaaggccaaggagctggccggcctgctcgcccagcccggcgccaagcgggtctgggtcgccgaggccgtctgcttcaccgacaacggcctgcgtgtccggctgcccgcccacgaccagaacggcgtgtacaccgtcgacgaactggtcgacatgctcaagcaggccccgtccgacgagcgtcgccgcgtcaccgcgatcggctcgcgcgaggtcgctgccgccctgaagaacatcggcatccgcaagagcgacgcccagtacaaggtcggcccctacgagctggagcggaagtccttcgactccgggcccacctgggcggactacctcgcccgccacagcgacctgcccgaggccgcccgcgtgcggatctacctcagtgagcgcggctccgacgcctcactgcgccagtccgtcgagaacgccgcccgccgcgaggccgcagtcctcggccgcttcaagcaccccggagccgtccagctcaagcagtacttcccctccggtcacgccgccggacccgcgctgatcttcgactaccacccgcacacgcagaagctggacgagtacctggtccagtacggcgagaagctcgacatcctcggccggatggccctggtacgccagctcgccgagaccgtccgctccgcgcacgccagccgcatccaccaccgggcgctcgccgcccgctccgtgctcgtcgtcccccgttcacgtggcgggaagggccgggccgtcggggaggaggccgcctggctcaccccgcagctccagatctccgactggcagatcgccacccagcgcagcggcgactcctcgcagggtcagggcatgacccggttcgcgccgaccgccctgtccgccatgcacctggccgacgacgccgacgcctacctcgcccccgagctgaccgccctcaaccccgacccggtctacctcgacgtctacgggctaggcgtcctcacctacctgctggtcaccggaaaggccccggccgccagccaggccgagttgctggcccgcctggaggcgggggagggcctgcgccccagctccctggtggacggcctctccgaggacgtggacgagctggtgcaggcggccaccgcctaccggcccggccagcgcctctcaagcgtcgacgagtttctggagctgctggaggtcgtcgaggactccctgaccgcccccgccgcagcccttgacgggcccgccgaggacgagaccggggcgagcgccgacaaggacccgctggaggtagtcgccggtgacttgctcgccggccggtgggaggtccgccgccgcctcggcaccggctccaccagccgagccttcctcgtccgcgacctggaggcggagacccgcaggacgcgcccgctggccgtgctgaaggtcgccctgtccgacagccgaggcgagatcctcgtccgcgaggccgaggccatgcgccgcctgcgcccccactccggcatcatccgtctcgccgagcccgagccgctgcacatcggcggccgtactgtcttggcactggagtacgtcggcgacgaacgcgacgacgacggcccgggcgccgagggcgcgacccgcccgcgccgccgcgaggagaccgtcgcccgccagctccgcgagcacggccgcctcccggtcgaccagttggaggcgtacggcgactacctcttcggcgccgtcgacttcctggagggcgagggcatctggcaccgggacatcaagcccgacaacatcgccgtccgcatccgccccaaccgcacccgcgagctggtcctcatcgacttctcgctggccggctacccggcgaagaacaccgacgcgggcaccgacggctacctcgaccccttcgttgacgtcatcacccgcggctcctacgactcgcacgccgagcggtacgccgtcgccgtcaccctgcaccagatggcctccggggaactgcccaagtggggcgacggcagcgtcctgccgcgcatgaccgacccgaaggagtggccgtacccgaccatcgcggccgaggccttcgacccggccgtgcgggacgggctcgtcgccttcttccagaaggccctgcaccgcgacgcgggcaagcggttccccgagctgaagccgatgcgggacgcctggcgcaaggttttcctcgacgcctcgcagaccgtcccctccagccaccgcacccgccccgcggcccccgccgacggggccgcgcccgccgagggcgccgccgcggggatcgcggacgccgagccggagaccgccgagcagcagcgcgaccgcctcgccgccgaggtcacccgcgacaccccgctgaccgtctccggcctgacgcccgccgcccagtccttcctctacggcctgggcattacgacggtcggcgaactcctcgactacagccgtcgcaagctcgtcaacgcccccggtctcggtgccaagacccgcaacgaggtccagcagcggcagcgggaatggggcgagcggctgcgcgaggcccccgtctcgccgctcacgccgaagggccgtgcggaggcgaaggaggagctggagcagctcaccgccgccgagtccgccctcgtcggacagctcgcgacgggcgagtcggcgggcgccctgtccgcccgcacgctgcgctcggtcagcctcgacaccctcgccaccgttcttgtcccggcggtcaacaacaacggctccaaccgcaacaaggcggagatggtgcggctgttgctgcgcctgcccgacgagcacggcgtcctgcccggcatcggcgtctggccgaagcagaaggacgtcgccgacgcgctcggcctcagccacggccgcatcccgcagatgctcaaggacgagcgcaaacgctggaaggcggagcccgccgtccaggcactgcgggacgagatcatcgagctgctggcgagcatggggcgcgtcgcctccgccgtggagatcgccgacgccctcgccgtccggcgcggcacacacctcgcagggcgggagcagcggcgcgcgatggccctggcggcggtacgggccgtcgtcgaggtcgagcaactggtgccgcaggaggtcgagttccagcaccagccgaaccgcaaggcgaccgacgagtccctgggcgccggccttctcgccctcgacgtccgcgaggacgacgccccggacaccccgaccgcgcccggcctgctcgactacgcgacgcgcctcggcaagaccgccgaccggctcgcccggttggacaccctgccgacggccgcgaccgtcctggccgaactgggcgcactgaccgttccgcccggcgcggtcgactgggacgaacggcgcatggtggagctggctgctgccgcgtcggtgaacgccgctgccactccgcgcctggagatctacccgcgcgacctgtcgctcgtccgggcgctgaggctcacgcaggccgggctcgttcgctggattccgggtgttccggaggggcggcagcccggtctgaccggtgaggacgtgcacgagcgggttcgcgcccgctttcccgagctggtcgtcccggacggacgtggcggcacggcccacgaactgccgactgccggtccgctcaccaaggccctacgcgacgcgggcttcgagctgtcgctgagcatgcgcgaggacacgggcacgctgcgctacctgccgacgcgggtggacgaggcgtccagctacctcacgacgggagcgtggcggcagtcgacgcgcacgggcacggtgacccggtacgcggacgacccgcagctcgcgggcgcggtgcgcgcggaggaacggctgctcgcctcggcccaccgggacgggtaccgggtgctgaccgtacggcagcagctcgtacgggacgcggtacgggaactgggcgccgagcgcttgggcgggcaagcggtgtcagtgaccgagctgttcctggaggccctgcacgggcaggtcactccgggcaccaagccgacctgggagaccctgctcaaagcggacgccgccgagccggggtcgaagggcgcggtgcggttcgcggagtacgcgcggacggcgtggggctcggtcgagccccggatcgccgagctgctgggcgacggtggcggcggtgcgggtccggtcctgctgacggaggctggggtgttcgcccggtacgacgcgatgggcgtcctggaccggctggcgtcggcggcccggcggggcgggcgggggctgtggctcctggtcccgcagagcgacccgtcgcgtgagccgaggctcgggcaggtggccgtgccgtaccaggccggcctgggggagtggatccagcttccggacacgtgggtgggcaaccgccatcgcgggtccggcgaggttgtggcaagtggtgtcgagggagacgcgaagtga

SEQ ID NO: 228 - DNA, 4677 bp, Streptomyces griseus
atgcgagaaggccggtggaccacggtcaccgagtcggagttcgaccatgagcggcgtgggctgaaggccatccgcgagcagttgccggacgccgacccgtggcgggcctggtcgaatttcaccttcaccgcgaacagtggccacgtccgtgaagtggatctgctcgtcgtcgctcccggcggcgtctgcatgatcgaactcaagaactggcacggctccctcaccagcgagaacggcacgtgggtgcagaccgcgccgaacggccgccgcatcccgcacggcaatccgctgcatctggtcgacaagaaggcgaaggaactggcgggcctgctcggccagcacggcaggcgggtgtgggtgggcgaggccgtctgcttcaccgagggttcgctgcgcatccggctcccggccaacgaccagaacggcgttcacaccgtcgacgagctggtcgccatgctcaagcagccaccccgtgacgagcgccggcggatcaccgctcccggctcccgcgacatcaagaaggcgctggaccgcgtcggcatccgcaagagcgatgccgagttcaaggtcggtccctacgagctcaagcggaagtccttcgacaccggaccgacctgggcggactacctggccgagcacagtgagctgccggagatcgcccgcgtccgcgtgtacctgcgggagcgcggctcggacgccaccattcgccggtcggtggagaccgcagccctccgtgaggccgcggtgctgcagaggttccagcatgtcggcgtggtgcagctcaagcagtacaacccgtccgggcactcggcgggcccggcgctgatcttcgactaccacccgcagaccctgcgcctggacgagtacctgctccagtacggcgagaagctcgacatcctcggacggatggcgctggtacgccaactcgcggagacaatgcgctccgcccattcgagccggatcttccaccgggcgctggccgcccgctcggtgcacgtcataccgcgtgaccgggggcggcgggaccacgccctgggagaggaagccgcgtggctgaccccggggctgcagatctcggactggcagatcgccacccaacagggcgccacgacacccggttcgacccggctggccccgacagcgctgtccacgacgcacctggccgagggatcggacgcctatctcgccccagaactgcgggcccctagcgcggacccggtgtatctggacgtgtacgggctcggtgtcctgacctacctcctggtcaccggcagagcgcccgccgccagccaggccgagctgctggccaggctggaggccggggaggggctgcggcccagctcgctggtggacggtctctcggaggacatcgacgaactggtgcaggcggcgaccgcctaccgcccggaccaccggctgtccacggtcgacgagttcctggagatgttggagctggtcgaggacgctctcaccgccccgtccagctcacccgtgaccgaggctccggagaaggacccgctggaagccgtggccggggatgtcctgggcgggcgctgggaggtccgccgacgcctcggcacaggttcgacgagccgcgccttcctggtccgggacctggaggcggaggcgcgcggcacccggccgctggccgtcctgaaggtggcgctgtccgacagccggggcgatgtgctggcccgggaggcggaggtcatggggcggctgcgcccggactcgcgcgtcatccgcctcgtcgagccgcagcccctgcggatcgcggagcggacgctgctcgcgctggagtacgtgggcgacgagcgggacgacgacgcggagagcacggagacgggcggcaagcgcagccggcgccggcaggagacggtggcccgccagctccgcgacagcgggcgtctccaggtcgaccagttggaggcgtacggagagtatctgttcggcgcggtcgacttcctggaaggggagagcgtctggcaccgggacatcaagcccgacaacatcgcgatccgcgtccgcccgaaccgcacgcgcgagctggtcctgatcgacttctcgctggccggttatccggcccgggagtacgaggcgggcacggacggctacctggacccgttcatcggcacgctgacgcgtacggcgtacgactcgcacgcggagcggtacgcggtcgcggtcacccttcaccagatggcctccggcgagctgccgaagtggggggacggctcggtcctgccgcgccagaccgaccacaaggagttcccgtacccgacggtggcggcggacgcgttcgagcccgcggtacgggacgggctggtcgcgttcttccagaaggcgctccaccgggacgtctcccgccgctatcccgagctgaagccgatgcgggacgcgtggcggaagatctttctggacgcctcgcagaccgttccgtccagcttctcccgcccggccagcaccccggtcccggtctccgaggacggccgtcccgccatcgcggacgcggagccgctcagtgcggaacagcagcgcgaccggctcgccaaggacgtcacccgcgagacgcacctgtcgacggccggactcaccgaggccgcccagtccttcctctacaacctgggcatcaccacggtcggcgggcttctggactacagccgccgcaagctcgtcaacgcaccggggctcggcgccaagacccggggagaggtgcagcgccgccagcgggagtggggcgagctgctgcgcgaggcgccggtctccccgttgacggcccggggccgcgcggaggccaaggaggagctggcgcagctcacctccggcgaggcggcggtggtcgacgccctggccacggacggcaaggcggcggggctgtccggtgcggcactccgctcggtcagcctcgacaccctcgccaccatcctggttccggagctgaacaacaacggcgcgaacagcagcaaggtggaaatggtccgtctgctgctgcgcctgccgaacgagcgcggtgttctgccggccatcggcgtctggccccggccgaaggacgtcgcggaactggtgggcgtgaccccgcagcgcgtctaccagatgctcaaggaggagcggaagcgctggaagaaggacccggccgtctccgcgctgcgcgccgagatcatggatctcctgaaggggctgggccggatcgcgtccgcctcggagatcgcggacgccctcgcggtgcgtcgcggtacgcagctgtccgagcgggagcagcgccgggcgctggcgctggcggcggtacgggccgtggtggagctggagcagttcgacccggagagcgcccagttccagcaccaggcgaaccgcggggccaccgacgagtctctcggcgcgggtctgctggccttggacgtccgggacccggacgaggaggcggggacgcctggcgacccgccggacaccccgacggccccgggtctcctggactacgcggcccggctgggcaggaaggccgacgggctcgccgctctggacaccctgccgaccgcgacgacggtgctgggcgagctggcggcgctggccccgccgccggggacggtggagtgggacgagcgccgcctggtggagctggccgccgcggcatcggagaacgccgcggccactccccgtctggagatctacccccgcgacctcgacctggtccgcgcgctgcgactgacccaggccggtctggtgcgcctgatcccgggatcgccggagggccggcagccggggatcaccggcgacgacgtgcacgagcgggtacgggcacgtttcccggagctggtcgtgccggacggccggggcggcacgaccgtcgacctgccgacggcgggcccgctgaccaaggcgctgcgggaggcgggcttcgagctgaccctcgccacccgcgaggacaccgggacgctgcgctacctcccgacgcggatggacgcggcgtccagctacctgaccacggacagctggggccgctcgacgaacctgggcgcggtcacccggtacgcggacgatccactggtggcagccgccgtacgcaccgacgagcgcctcgtcgcctcggcccgcaaggacggctaccgggttctgacagtgcgccaggacctgtcgccgaaggcggtacggtccctggcgcgcgagagcggggacggtgcgctgggcgcgcacgcggtgtcggcgacgcagttgttcctggacgccctgcacgcactggtcccgccggggacgaagccgacgtgggagacgctgctgaaggcggacgcggcggagccggggcaccggggcgcggtgaagttcgccgagtacgcgcgtacggcgtggggctcggtggaaccgcgtgtacgggagctgctggcggagggcggccccggtacgccgccagtgctgctgacggacgcgaacgtcttcgcccggtacgacgcgatgggcgtcctgcaccggctggcgcaggcggcccgccacggcgggcgggggctgtggctgctggtcccgcagggcgacccggcccgcgaaccgaagctcggccaggtcgcggtcgcctatcaggcgggcctgggtgagtggatcgaacttccggacgcctgggtggacgacgtccaccggtccgtacccgccgccaggagcggcgtccagcaacaccagggagaaaccaagtga

SEQ ID NO: 229 - DNA, 4266 bp, Thermobifida fusca
atgaccgaccggtggtggggggaacgctccgaacatccatgggagcaggaagctctcgaacacatcaaagcgctcatgccgcagcgcgacccctaccgggcctggcagtgcttctcgttcaccgccgcgtccgggcagatccgcgaatgcgacctgttcatcgtcaccccagccggggcgttcctcgtcgaaatcaaaagccagccgggacgggccatcaaccgcggcagcacgtggacgttctacggggaccgggtccgcaccatcgacaacccgctctacctcaccgacaagaaagccaaagagctcaaaagccaactggagtgggccgctaaaaagctcggcatccgcgactaccggttgccgtacttcacccccgccgtcttcctctccgcccccgacctgcgctgcgacttcgacgaaatccagcggcagcacgtctacggccgcgaaggactggacaagcagaccgggctgcccgggatttggagcggcctgctgaaccggcggacccaccgcagccccgaccccgtgttcttccgctccatcacccggctcatggaaacgatcggggcgaaagcgatccgccgcgacctgacggccggctcctacactctccagcgccgggcgttcgacagcggacccacgtggaccgactacctgggcaagcacacggttatcaccaacaagcactcccgggtgcggatctaccactaccgtccggacgccgacgagcagacgaagaaatcagtgctgcgagccgcggaacgcgaataccgctccctggtcggggtcgcccacgaaggcatagtcaaagccgaagacttcgtcgaagtcgagggctaccgtcccgcggtcgtgttcgaacaccgcgaaagctggcagcgtctcgaccacttcatgcaggagaaaggcgccgacctcgacgtctacacccgcgtggagatggtccgccagctcgccgaagcagtcaaccacgcccaccgcaaccggctgttccaccgggcgctcgcggcccgcagcgtctgggtggaactcgacggccactatccgcggctgcggatcgccgactggcagaccgcggcccggcaggggatcggcagcctcggacacacccagcacgtcgggcagaccacggtgcacgccctcgtcgaacacattgaggccgccgcccaggcctacctcgcccccgaagtcaacgctcccaacagcgacccgcgtgccttggacatgttcggcctgggggcgctcaccttcctcatcctgacagggcagccgccgggcaacgaccgccgagagttcaacgaacacatccgggagcacggcgaactctcccctgccgcggtgagcgacgacatccacccgctgatggacaccctggtgcgggaagcgacccggctcatccccaccgaacgcacctcatccccccgcgagttcctgcgccgtctcgaagaaatcgaggagctgctcacccggcccgaggtcgtcaccagcccgttggaggccaccaaaggccaggagatcatcgacggctggaaggtggagagcgtcctcggcaagggcgccacgtcccgcgccctgctcgtgtcccgcaacggcgaacagcgggttttcaaagtggcggtgaacgacagtgccgccgccaagctccgccgggaagcggaacagctccgcaggctccgcgaccgccgtattgtcgcggtgatcggcgacgacccggtcatgacgatcggcgagcacaccgtgctgcaactggaactggccggggaggtcacgctcgccgactacctgcgccaggaaggcaacctcggtatcgaggagctgcgccgattcggcatcgacctgttcgagatcgccgactatttggaagaccagaaggttttccaccgcgacatcaaacccgccaacctgggcgtgcgggaacgcaccaagaagagccgcgaactggtgctgttcgacttctctctcgcgggcaccagcacccgggaaacccaggccggcacccccggatacctggacccgttcctcgcagaaggcaaccgcagctacgacagcgccgcggaacgctacgccatcgccgtgaccttgcacgagatggcgtccggcgacctgccggtgtggaacgaggagggggtcgaaccccacctgctgccggacagtgtcgaatacccgcgactcagcgaagaggacttccccgaccaggtgcgcgcctcactcaccgagttcttccggcgtgccctgcaccgcagacccgagcagcggttcgccacgctcgccgacatgcgcgaagcgtgggagcaggcgttccagaacatcgaagcctccccggtcaccaccccggacagcctggagctggctgaggtggacgacgaggccacgcggcggcgcaacgcagagaacgccaccgcggacacgccgctggtcgtggccgggctgagcccggacgcgctggacgccgcaacccgcctgctgcgctgtgaaaccgtcggcgacctgttgaagaaaccggttgcggagatccgccgcctgcgcggcgtgccgctgcgggcccgcaacgaactggcccgccaagccaaccggtggcgcaggaagctggcgcacgccgaaccgctgccgaaggtcagcgcaaaactgtccgtggacggtgccagcgaggaagagaaggagctcgctctcgagaacgcgagcctcgacaagatcattcgccagttcctgccgaagaccacggaacggaaccgcgactgggtgcgcactgtccgggagctgcttggcctccccgaggacgctctcgccgaaccggtgtggcgcacccagaaagaggtggccaggcggctcggcttgcagcaggccaccgtgtcccggcatttggcggaggcccgccagtactgggtgaagaacactccttcccagctgcgtaccgcggtccgcgacgacatcgtggagatcctggaacgccacggccgggtccgcgaggtgcggcagatcgcagacgagctgctgagtaaacgggggacgagcgcagaaatcccggagacccggaaagcgtatgcgctggccgcgatccgcgtggtgaccgaatgcgaagagcgaaagcaaaaagagtcgcccgtgtttgtgctgcgccgcctctacacgcacagcgacaccccgaaggtgctggtcgcccaggtcatcgagaacgacccgaccgttcccgtcgaggccgacctgctcgactatgcggcggccttgggtcgggaagccgaccggattgtccggttcgacgatgacgcgccgctgccttcccccgccgaggtgcggcagcggctgcgcggggtgcccaccaaaccgggcatggccccgctgtccgacgtggacttggtgacgctggccgcggcagcctcggagaacgcgcaggccaccgcgcgcctggagttgtatccgcggtcgttgagcctgaaacgggtgctggacatcgtccaggtcgccagctatctcggcgagcccggcatcaccccgcagcagatcgtcgaccgggtgcgggcccgtttcccgcacatggacccgcctggcgtgcacgtgatccgtcggcagctgcgcgaagacttccccaacctggagtcccggacggcctcggacggcaccgagtactggtatctgccacgcaccgcgatcaccaggtccatcacctattcggcgatcagtgcgggcggcggatacgagccgccgagcgagcatgagagtgcccgccgccgcctcgaccaggcggtggcccgcggcggctaccttgccgtgaagacgtggatgtcagaggccgaacgggtggcagagctgttggctgcccggccggatgtggcggcgttcgacgcgtctgcggagttcgtgcgggtcgtcaccgagatgatcaaccagtacggcggcccgccatgggatgtggtggtcgccgctgacgtgcccggcggcccgcccgagttcgggaacatggttgccgaggcgtgcatgattctcggcgaccggatccgcgccgcgggacaggaccggcctgtgttcgtgtacggggcgaccccgctggcccgctacccggcaggccgagacttgctgcgcacgctagcccagcaggcccgggagagcggcaccgccccgtacggcctgtggctgctgtgcccgatgggcaacccgtaccgtccggcccggctcgacgacgaaccggcgggcgcgatcacggatgcggaacagttgcggctgccccgcggtttcggcgcagaagaaccggttttggtggggtga

SEQ ID NO: 230 - DNA, 4164 bp, Thermobispora bispora
gtggaacccggtagcaagcgctggatcgaggtcaccccttcacagcacgcccacgagcggggcggcctcgccgccatccgggcactcctgccggacgccgagccgtaccgcgcctggagcaacttcaccttcaccaccaagggcaaccggcagtacgaggtcgacctgctcgtcatcggcaaggccggcatcttcctgctggagctgaagcactggtccggcaccatcacgggcgaccaccagacctggttccacaacgggttcgccgaggacaacccgcgcatcctggcggagagcaaggccaagcacttcaaacagctcctcatcgagaccggcgagcgggccgtaccgttcgtctacgcgggcgtggtgctgcacaaccccgaagcccaggtacggctcaccgagcgcggccgggccggggtctaccggatcgacggtcaaggcccggccggcctgcctgagctgatcaaagacctcatcaccgccgaaccgcgcaacccccaccacctgatcgacgccaagcgctcccaggacctcgccaagttgatcaagaaggcgggggtacggcagagcatgcagttccgcaaggtcggcaacctgctgctcgccgaagacccgatcgcggaagggccgggctggcaggactacctggccaagcatccgatgctcgaccggccgcgccgcgtccgcttctacctggtgaacaaggccgcctcaccgaacgaacgggccgcgatcatgcgggccgcccagcgcgagttcatcgtgctggagaacctcaaccaccccggcatcgcgcgggccatcgagttctacgagcacgaacgcggcccggcggtggtgttcgatcacgacccgaccgagacgcgcctcgaccacttcatgcggcagaagggcgcggcactcaccgtcgaacagcgcgtcgacctggtccgcacgctcgcccagacactccgctacgcgcactcccggcggctcgtgcaccgccggctcagcccgctatcggtgttcgtccgcaacctcgcccagggcaagtacggcgtgcgggtgagggactggcacaccgccggccggctgatgcccggcacgcccggccatcgtgcacaggtcgcgggcacccgcaccctcgacgccctgaccgacaagggcgcacatggctacatcgcccccgagacgctgcacagcccggacgcggacccgatcctcgccgacatcttcgggctcggtgccgtctcctacctgatcttcactggtgccgcccccgccgagtcgagcgagcagctccaccagcggctcgcccgcgaacgcggcctggacgtccgggtcgccctggacggcgccccgcaggccatggtcgacctggtccacgacgccaccgccgccgacgccgacctgcgcatcgcgtccgtggacgagttcgtcgagcgcctggagcggctcgcccaggaggtcaccgccgagcaggccgccgccgagcaggtcgatccgctcgaggcggtggcggggtcgcggatcggccccgccgacgatccgacccggttcgaggtgatccagcggctcggccagggctccaccgcgctcgccctgctggtcaaggacccggtgcacggccaggcggtgctcaaggtcgccatcgacgaggaggacgcgcggcagcggctgctcgatgaagccgaggtgctccccctggcccgggacccacgcgtggtgcgctgcctcgaagggccgatgacggtgggcggacgcaccgccctgctgctggaggacgccgggcgggaaaccctggccgccctcatccgccgggaaggccggctctccctggacttcctcgcccggtggggcaccgacctgctcgacatcctcgccgcgctcgacctggccggcatcaaccaccgcgacatcaagccggacaacctcgccttccgggagctgggcaagaaccgcgaggtccacctcaccctcttcgacttctccttgtcgcgggccccgctggagcagaccgccgtcggcaccccgccgtacctcgacccgttcttcgacccggtgcaccggccccgctacgacgcggcggccgagcgctacgccgccgcggtcacgctctacgagatggccaccggccagaccccgatctacggttcggggaccagccacccggccgtgatcgacagcgatgtcacgatcgatccggaggacttcgagcccgggccggctcgcgacccgctcatcgcgttcctccgcaaggcgctcgctcgcgatgtcaagcagcgccatgactcgatcgagagcatgcgcctcgagtggcgggcggtgttcgaggcggtgccgcccgcggccgccacgccggcgagcgtcaacccggtcaccggcaaggagctcgacgaggcggccgcccgtgccacgctggacacgccgatcgccgcggccggcctcaccccgcgcgcggtcgacgcgctgcaccggatcgacgtccgcacggtgcgggacctgctcgcgcgctcgcccttcgagctctcccgcctctccggcgtcgccgacccgacgaagcgggagatcaggcgccgggccaagcagtggcgggcccggctccagccggccacgccggagcccatcggcacgggtgaaccggcggacgatctcgggcgcggggtcgacgcggtgctccgctcgctactccccaagggggtgaagccggacaccgcggaggcccaggtgctgcgctgctacctcgggctggaggaaaccgagtccgcctggccgaccaacgcggagctcggcgaggccgccggggtgaccgcgggccgggtgagccagatcctgcccaaagctcgcaagcgctggcggcagagcaaggccctcgccgaggtgcgtgacgagatcgtccacctggtgaccgaggcgggcggggtgctctccgccgaggcgatcgccgagaccctgctcacgctgcgcgggtcggcggccgcgggcgaccagcggatgcggcgggcgctgggactggtgcgcaccgcggtcgaggtagaggccgaacggggcggggaggcacgcctgctgcaccggcgcacccgcaactccgcgatcgtcgccctggaggaacccaccgacccggacgcggtggcgggcaccgacctgctcgactacgcggtacggctcggccgggtcgccgaccgcctggccgccgaggaccccttgccgacggccgagcagaccgaggcccagctccgcaaggtccggctgccgcagggcatggcggagctgccggccgagcggctcgccgccctcgccgcggcggcctcggagcgcgccgcggcaaacggacgcggtgagatctaccccgacggcctcgacccgcggcgggctttggagcggctctcctcctccttcggcgtgatccggtacggcctgaccccggaccagctcaaggcccggatccgcgtccgctacccgcgcgtcggcccgctcccggacgacctgcaggacctcgacgccctgctccggctcgccagggtgccgctcgtcttccaggacggggtgttctggccgcggcgggacgtgcagagcagcgtgctggtgccgtcgacgcacgggtcgttcacccgcctcgccggtccggtggccgatcgggactccgccgacttcgagcggcgcctgacggcgtcgctggaggagcggggtttcgtcacgatcagcgcgagcttccgggcgtacccggaggcgatccgcgcgctggccggccggttcggggtcgaggtggtggacgtgaccgccgagctgctggtcgcgatgcggaccaccgctgaggcgaacaacgtggactggtcgctcgtgctgcgggccgaccggccggacgccgccccgcaggacgcggccaacctccgcctgctggtcggcctcgccgcaaccggcctggaggagcgcctgcgcaccgacccgcggccgttgctcatcatcgaggccgccccgctcgcccggtacgaccggctcgccgtgctggagcagctcgccgacaaggcgacggaccggccggccgcccgttggctgctggtcccggtggagcaggacggccggccgtacctcgacaaccggcccgccccgggcgcgctcggcgcggtacggcttccgtcggcttggctggtgcagcagcggcggcaagcggcctcctga

SEQ ID NO: 231 - DNA, 4158 bp, Hahella chejuensis
atggataaattctggaaacaaataaccacctccgatcatacttgggagcaagaggcgctggacttcgtgaaagcagcgcttccggatcacgagccctatcgagcttgggcgaactttgagttcattactaaggaaggcttcgtcaacgaggtggatctactcgtccacaccccaaaagggctgtttctggtcgagatcaaatcgcacccgggtgtcatgaaaggcgacgcaggaatctggatttgggaagcgcctgagggtaagcgcaaagcttttgacaacccactactgctcacggatcgcaaagccaaaaagcttgcatctttgctacaagctcaggatgccgcacgtaagtcatccaaagaaagaatccctttcattacgcccgtcatttttctttctgcgcccaatattgttaacaagttggaaggcaacggccgtaagcaggtgtatacccgtaagaatttcatagaagaaatcactcgtattgatgacagctggaagcataaaaagctggacaaagtgtcggcgaaaacggtttctcaagccatgttacaggcgggtatcaaagagtctctgcgcacccggcgtgtcggtcagtttgacctcgctgagttactggatgaaacggatttgtaccaagagtggcttgggcgacatgtggatactcaggtaagaaggcgagtaagaatctacctcacccaaggcaaagcagcagacgaagccgcacggctggacaaagccgcccatttggaggcgcagctcttggaaggggttgattacccaggcattctcaaaaccttggagtttcaacggcacgaccacggcccagcgttgatctatgaaaacttcgatggctcccagcgtctggaccactggttgctcaagcaagacgaaggtaaacgcctggatcaatctgtggcggtaagcttacttcgctccatagcggaaacggttaaatacgcgcacagccaaaagctttatcacagggcgctcagcccacaatccatttttattaaagaagagaacggcgagttcaagatcaaaattgccaattgggccacagcgcagcggatctttgagaccgaatccaaacacatcagtgcatttagcaagcttacacgcatggttcaggaagaatccggttcctatatggcgctggaatctcatactttggaagaagctgacggcactcaacttgatgtcttctcattgggcgccatcgcttaccacttgtttactggtaaaaagcccgcagcaaatgaacttgagctgcaagacaaactaggaaaagatggccttcaggtaacagatgtaatcaatggtgcgtcatcctgggtttcctatttggttcagtacgctacacacccagacccaggcgccagattggattccgtgcaggactttttggactacctgaccgaagtcgaaaatgacattacccgaccagagggggaagtcacgcaaaagcccacagaagctaagaaaggcgataccttcgaaggcggttacaccgtcatcaagcgtctaggtcgcggcgcctgttctgtcgcatttttagttgaataccaaggccagcaacgcgtgttaaaaatggccctggacccagaacacaatcggcggctgcatcaggagggtgaaaccctcggccaacttcgccatcaagccattatcgcgcaccacaaaacgctggatatccttggccatacctgcctgcttattgattacgccacaggcggcactttggcgcaacgcatccgacgcaccggagccattcagttggagttattggagcgctttggtgacgacctcctcagcgccatggtccatctggaagacaaagccctaatgcaccgtgacatcaaaccagacaacattggcgttactgagctcggtagccagttgcatctggttttgttcgacttttccttgtctaacgctggtaccgacaatatcaaagtcggcaccatggcctatatggacccttacatccgcgacgctggccgcaggcgttgggatgactatgccgaacgatttgccgccgcgctcactctttacgaaatggccgcaggcactttgcccggttgggcggccaatcaaggtttacccatagatttggaacatgagcttcaattggacgcttcagtattcgatccatccattcgcagcagtatggccaagttctttcaaagagcattagctcgggatctcggcagccgtttcgccacagcggccgatatgctgcgcgcctggcgccaggtctttctgcaggcctctaaagaatcccggcatcccactgttcacggcgaggtaccgacgtgcccggtggaagaggctcagcaagacacccaaatcgggcttctggaacttagcccgcaagccctggatgcgcttagtcgacgtaatctcaatacagtggcggatctactcaaacaaaaccgtagtaaggtgcgcgcctggccgggtgtcggtatcaaaacccgtaacgaagtgtcagagctgattcgcaaactccaggaaaagtggccaaacgaagttgctcagccagtatcccagcatgatggtgcgcaacaagccagcgttgaccgcctattcggccttatctaccctaaaacacctgatatctcccgacgcagctttttaaatgaattcttaggcaggttggattccgaagcgccgaaaggccatcacaatgtccactggcccagcatcaccatgctgtgcagcgaaatcaatatggaggcagccgaggcccggcaaatcctcagcaaactcaccacccagtggggcaagttgtcggaagtcaacttgctgcgcaatgaaatcgttgagattctcaccgaaaacggtggtgtgatgaccgcaattgaactggccgatgctgtgctgctgcgcaggggctcggtggaagacaaccccatacgctcccgtcacgctcaggccgtggtgcgggcagcggtggagaccgaaatcagcaaacagcaacctcgctggatattgcgccgttttggtaaccgctatgtcattgcggacaaccaacaagagcaaggtgaagacctcgccacctacgctcaggaccttggtcaattggccagcgaatgtgcattaaagcaacctttactctcaccccaggccacattggataaagtccgtgcagtgcctgctccggaaaccttcacaggcctgagcacccatcggctactgcgcctggcggccgcagcatcggaacaggctgcactatccagccgggcggagttctacccacgggatatggaggccgcgcaggctttagagctggcgcaaggcgccctcttaggaagcaaggcgctcactgtggcggaggttcaagtccgggtaaaggggcgttaccctgctgccaaacctttaccaggcaggccccacttggacgacttagtacttaagctggatatgggctttttgtgggacccaaattacgaaaccttcgataaagacggcaaaaaacaactgggcgcctactgcttgcccatcaccagctttactgagtatcaggccactcaaaccaagacctcattaacgcaacaaactgattgggatggtgaagcctggcaggatgaaaaaagcattcgccaatccatcagcaacagtttgcgcgacggccgtttcctggcgcttggtgtgcgcccgcgggatatggaaaaggccaaaatcaagctttgttctacctacgggcttgttagcttcagtttcgatgagttacttcttaggcgcctacaccaacactgcgcagcaatgaagaacccacccaattggcaggtggtgcttaaagccgatgccgccgaccaaaccagtcgtgattgggtgaacctgcaaaggctggttcatcaggttttgccctcgattgccgacgaaataaaacaatccgataaacccgtgctattaacagagcccggccttatcgcccgttacgatcttattcacacctggcttaacgagctgcgccagcatttggcgaatacgggtcatgttcatgccttggtgttattaattgtcggggacgcacagcaacatgcgcctgttattgatggcaaagtaattccattggaggcgggaaacagcatctatgcacgactttccggcagctgggttaaaccagatcaaccacagttttcaaattaa

SEQ ID NO: 232 - DNA, 3510 bp, Actinomyces sp.
atggacatgaagggtctgtacgcgaaggatattttccggtcgatcgacggtgtcatcaaggctgatgacgtctcgaaggtcgcctccgaggtcgacgaatacgttatgaccagcgagatccgcagcggtctgtcgcggattgtcgatgcgtggaaccaggtcgatgctccgtcgaacggcgtgtggatcgcgggtttctttgggtcgggtaagtcgcacctgctgaagatgctgtcctacctgctgggtgagcaggcgggaagccagccgatgacccgcgaagatgtcgaacgagccttcgaacagaaggtcgcaggcgatgagacacttattgcggacctcaagaggagcctgcatacgcccatgcgcgcggtgctcttcaatatcgacgccaaggatgataagtcgacgcgtgagcgcggatcggcaatgatcgaggtcttctacaaggtctactttgaggcgcgcggcctgtactcgaaggatctgggagttggtgcactcgagtgtgacctggaagatcggggagaactggcgcgttttcgcgaggcctaccaggaggaagctgggcatacctgggaggtcggtcgcgtcaacaccgtcttttcggaggcgcttgtctcgagggcgctggcccgccttgggcaccaggtggatcagcccttccgcagctatcgggagcagatgaacctgtcggccgaggccttcgcgcaggacgtggcctcgtggcttgaccgtcaggggcctcaccagcgcatcgccttcttcgtcgacgaggtcggccagttcatcggcgacgactctcagctgatgctgaacctgcagaccatcaccgagcagctggcgacgcattgccccggtcgcgcctgggtctttgtgacctcgcaggaggaactgagtggtattacggcgcagatgaacgagcgccgtagcacggacttctccaagattcaggggcgcttcgcgatcaaggtgagcctgtcgacggaggaggtcacggacgtgatcgctcgccgactgctgacaaagagtgagcagggggcggaagacctggacacgctgtggcagcgtctcggcgcggggttcccgtcgatgttccgtttcccagtgaagacgaagaagtacgataactacctgacgagggatagcttcgttgctaaatacccgttcgtggactaccaatttgagatgttcacgcaggcgatgcgaggcctgtccgataacgacctcttcacgggccgtcactcgtcggtgggtgcgcgttcgctgctgggcgtgtgtcagcagatcgcgcaggagctgacggatgacgagctgggtacggttgcgtctttcgatcgcttctacgacggcatcgcggcgatgctcaagtccgacgtgaaggacaatattgggcgagccgcacaggattcgcgcacgtgtgactccttcacgatgagcgtgctgaaggtgctccttctcgttcgctacgtggattccttccatgcatatccgcgcaatattgcggttctgctgcgccgttccctggatcaggatgcgactgatctggaaacacgtgttgagcgtgcgcttcgcatcctgtcggatcaggtgtacgtgcagcgtcaggcggatggaacctacgcgtacatgacaaatgaagaaaaggaagtccgtcgagagattcgtcagatcaccgtggagtccagggaaatagcggatctgctgcgcacggacatccgtaagcacgtcggtacctccgcgacgagcttcgtgtatcccggaacgaaccgacgcatgggcgtgtccctgttcgtcgatggacgccgcgaacaggccgagccgctggtaatctcggtgtccacgccgcagtcctccctggacgaggcgggtattcgtaacgagagtgcctatcgccatgacagcctttcgttggggctggatatcagctccgagatcctcgaggatgtgcgagtcttctgccagactgaggagtatgtgaagcgtcaggcaggcgctgcctcaggccttcgcaagcgcatcatcctggcgcataaggaagacaatgagcagcgtcgtcgagtgatcggcgaggccgtgaaggatgcgcttatgcgggcgtcgttgtttgttgcgggggaggaagtgaagacgggtacggcgaagacgccggcagacgtgattgagctgggactgactcgtcttgctcagaaagtctacccccgtatcgaggatgcgaagccgctggcgggcctcaaggatggacagatcgtgtccttcctgcgcgatcaggaggacgcgacgctggacgttgacccgggcgtggatatcgcgcagagtctcgcgggcgagtgcgcccagtgggtggagcaggcgcgcgtgctgaacggacaaaacgtgttcgtgaagaacgcgatcgagtattacggtcgggcccccttcggctgggacaagaacgcggtgctggccatcgtggcgacggcccttcgcctggagctgctcgaggccctcgagaacgacagacccctcactcgcacggagctggagggtgccctgcgcgacgtgacccgccaggggcgggtgctgctgcagaaaaagaagcacctggatcgcgccgcactcgcggatttccagcgttttgttggtcattttgtcccgagggagtccccgcaggatggcccttcgcgcgttcgcgcggttgaggtcaaggcggccgagtgggtgaagctgctcaagggatacaggtccgactggtacagctttgatgacgaagtcgcggaggccctcgacctgctgacgccgctcacaaccacgcagcacaccgaagaggagatgcttgccccgcagatccgcggcggattcgacgatctgatcgagattgtcgacgacttcctcatgccctaccgggagttcgtggaggagcatgaacaggagcttcgcgacgcgttggccgaggcggacagcctgtcgttcttcgaactcacggaggacggtgagcaggcaattgatgagcttcgaaagctcgcaggtgactcgaggctgtacgtgcgcacgcaggagatcgcgccgctggttcggcgtatcgacgcggcgcgtcgtgcgttggtgcaggcgcagcgtgacaaggtactgcgacgcatcgacgaggccgtggcgggtattcgcggatccgctgagttcaaggctgcgtcggaggaagctcggctgagggttgatgcggtgatggagcggctctgtgctgcggtgaattcggtatcgaagccgggtcatgcggaggaaatcggccgtcagctcgatcagcgtgtggacgacctctacgccgcattgatcgcgtcggcgacgcccgcggagtacccggacccagacgaggcgacggagccgaccaagaggccgacgattgtgcgcctggcggatctgctgccgaagacgaacggcctcctgtcgacgccggatcaggtcaacgagtacatcgagcgcgttcgtgagcagatgctcgcggctgtgaacgacggcaagcagctgcgcccctga

SEQ ID NO: 233 - DNA, 3678 bp, Vibrio cholerae
atgaaaattgaacagattttttccaagaagttgacgcgtgatattaacggcgttgttaaagcggaacagaaagacaatgacagtgtgtatgtcgaacttgatgagtatgttgttacccgagagctagatcgacattttcgcgctttctttgaggcttacgttccatctgtgacgcaaagcggcgcatcaatgtcaggtaaaattggtgtgtggatctctggcttctttggttcgggtaagtctcacttcctgaaaattttgtcttacctcctcgaaaataaatctgtcgaaaaggatgggcaaggacgccaagcatttgagttttttaaagaaaaaatcaacgatgccatgctgttggccgatatccaaaacgctgttaccaaagatacagacgttattctttttaacatcgattcacgagccaatacggatgaccgagaaaatgctattcttaaggtcttcctcaaagtctttaatgagcgtgtaggatactgcgctgattttcctcatattgcgcacttagaacgcgagcttgataagcgtaatcaatacatgtctttcaaggacaaatttgctgagttgactcaatcaacttgggaaaaggagcgtgatgcctatgacttctatcgagacgaactttcagaagcactcgctcatgccagtgagcaatcattagagtctgccaaagcgtgggttgagcaggttgaaaacaatttcccgctagatatccgaaacttctgtaagtgggttaatgaatacttagatcgaactggggatcgtaaccttcttttcttagtcgatgaagtcggtcagtttatcggtaagaacacacaaatgatgttgaagcttcagaccattactgaagatcttggcacatattgtggtggcagagcttgggtcgttgttacctctcaggcagacattgatgctgccattggtggtatggataagcgcgatggcgaggacttttctaaaattcaggggcgttttagtacccgcttacagctgtcgagctcgaacacctcggaagttattcaaaagcgtttgttgtccaaaacggaagaagctcgtacacatctcatcgatgtctttgctgaaaagggcgatattcttcgtaaccagctgacatttgataaaacgacaaccgcgtcactaaagggctacaccgacgctccgtctttcgtggacaactatccgttcgtgccttaccactacacgctagttcaaaaagtgtttgagtcaattcgaacaaaaggcgcgacgggtaagcacttagccatgggtgagcgttcattacttgatgctttccaatcagctgcaaaacagatgaaggactctggccttgaggtgttaatccctttttacagtttctatgcaccgattgaaagctttttggagccagcggttaagcgaacgattgaccaagcctgtgagttggattccttaacggattttgatggcaagatcctaaaaactcttttcttgatccgttatgtagatgttgtcaaaagcacactggacaaccttgtgacgctgtcaattgatcgaatcgatgcagataaaattgcgctgcgtaaacaaattgaagagagcttgaatcgtcttgaacgtcaattgctgattgcccgtaatggtgatgaatttatcttcctgaccaacgaagaaaaagagattgaaaacgagatccgccacactgacgttgaaatgtcagaggtctctaacaagctttcagcaatcgtatttgacggtattttgaaaggtaatcgtgcctatcgttacccgattaataagcaagactttgcggtgagccgtttttgcaatggtcatccgaaagatggcaccacgctggaagacctagtcattaaagtcatttcacctttggattcgcactttgaaaattactcccacgatcaagcgtgcatcaatcatacgcttgaggctgatgggtgcgtgctcgtcaagctgggcgaacataagcgtctttgggatgacctgacaacctttattaaaactgaccgattcttaaaacaaaattcaggacagcgaccagagcaagaacaccttctccgcgaaaagcagatggaaaatattgagcgtgaaaaacgcttaagaacggattttgaagctttgtttgcagaggctgacgtttacgctatcggcacaaaactaccgaagaaatctgcaacgccaagtgccatcgtcgaagaagcatacaaatacgttatcgaaaacaccttcgctaaattaaacatgctcaaggcaacgcctggtgaagttttgcgtgagctacaggccgttcttgttgctgatgatattgctcagattggactggatcttcaagcggatgaatgtaacccagaagctacgcgtgaggttgagcagtacgtaacgctaaaagtcgagcgtaatgagcctgtgtacttacgtgacatcgttgcccgtttcggcaagcgcccgtatggctggccagacaatgaaatcttattgctcactgcaaggctgggcttggctggaaaggtatcttttagtacccagggcacagatctggcgttgaaaaaagcttacgagccgtttaccagtgtgcgtaaacgcggtgagatccgtgtacataagatcaggcaacatgacgagcgccaaattaaaaaggctgctggtcttgttaaagaaatcttttctaaaacctttaccggctctggtgagaaggagctctacgaattagtgcgcgatgaattactggcttggaatgaagagcttaaatcattcagaaccaagtcacagacaggccatttcccaggtaaatctcaaattgacgatggtcttgcattggtcgcgggtattcttgagcaaacttcaagcttcgcccttatcgctagattcttagaagacgctgatgcccttgaagagtttgctgaggactttgaggatcttgatgacttctacaatagccaatttcaaacttggcaagcccttgcgggcgcattaaacgagaagtttaaggccaacagacccgcgttagaaaaagacagtgaagcattaaaagcgctcactgagttagaacgcatttacaatatgtcctcaccgtatgagcagctgcgccacattaatccgcttatcgagcaggtggcaaaagttaactcaacattggttgaagaaaaacgcactcatgccttagagcgtgttgatctgcgcatcggacgtgtaaaagaagcgctagctgacgctcatgcaccgtctgaactacagaaccaagcactgcgcccgttacaaatgtgcagacagcgcattgaagcaacctcttcaataccacaaattatcagtgagcaaactgaagcggaaggttacgaggacgaagcctatgagttgctgaatggctttatcgaagatcaacgcaaaaaagctgaagccgagcaaagacgtcgtgaactcgaacagaagaaacgcgaagaagaagcagcgaaagccggtaaggcagctccagcacctgagccagctcccgaaccagtgcagccacagccggttgcaaaacgtaccgtaacgattaacccaaccgatgccatggcaaagtcagtaacaaccggattcattgaaagtgaagccgaagttgatgcctatcttgccgctttaagagagcagctgattgctgctgtcaaagctggtgaccgcgtacgaattaagtaa

SEQ ID NO: 234 - DNA, 3678 bp, Vibrio harveyi
atgaatattaaacaactttttacgaaagatatcgctcgccctatcaatggcgttgttaaagcagatcaaaccgaaaatgaaaccgtctttgtcgaacttgatgaatacgtcatcacgaatgaactaaaagagcatatagagaacttttttaaattttatatgccctctgtgtacgacccagaacaagctgcgatcactggcaaatcagggatttgggtttctggctttttcggtagcggtaaatcgcacttcatcaagatcctgtcataccttttgaaaaatgtgtcagctactgatggaataacgactcgcacagcgtttgattttttctctgaaaaattgaaggacgatgcattcctagttggtgacattgaaaaagcgatccagaaagacaacaaagttatcttattcaatattgatagccgagccgacactgatgacaaagaagatgcgattcttaaggtcttcctaaaagtattcaatgaagaaatgggctactcaggcgatcatgcgcatattgcccacttggagcgagaactggattctcgtgggcagtttgaaggctttcaaactgcctttgagtcaatcacaggtgaaagctggctagaacaacgggattcctatgatttctaccgtgatgacatggcagaagcactggcacaggttacgggtcaatcattagattccactaagctgtgggtcgagaaaattgaagaaaacttccctctggatattgccaatttctgtaagtgggtaaaagaataccttgatgggaatcgcgatcgccgcttgctcttcttcgtcgatgaaatcggtcagtttattggtaaaaacacccagatgatgctcaaactacaaactatcaccgagaatctcggaacaatttgtggtggtcgcgcttgggtgatagtgacttctcaagccgatatcgactccattgttggcggtatgcaaggctcaaaaagccaggatttttccaaaatccaaggtcgatttgaacgtatttccctttctagttccaacacaaatgaagtcatcgaaaagcgtctactcagtaaaacagaggaagctaaaagtcacctgtctgaactttatgatgccaaaggcgatatcattcgtagccagttgagttttgaacaaagcaatgcggctgaaatggcgaactatcaaagtagcgatgatttcatcaatacctatccattcgtgccgtaccaatacaacttggtacaaaagatcttcacaggcatcagccgtgctggtgcttcagggcaacacatgagtcgtggtgaacgttcgttgattgacgccttccaaatcgcctcaaaagagtttgccgataaaaacgtgggtcgcttgatccctattcacagtttttatcactccattaagaagtttcttgatgatgctgtcgtgcgtgacattaatcatgccgcagacaaaacttccattgatgaatttgcagttcaagttctgcaaaccttatttatgatccgttacgtcgatgaagtgaaatccaatattgataacttggtaaccctttgcatcagcgaaattgatcaggataaacgcgcgttgcgactggctattgaggctcgtctcgaggtactggaacgtaacaacttaattgctcgacaaaacgatgaatacattttcctgactaatgaggaaaaagagatcgaagaagcgattaagaagaccgatatcgaaccttcagatgagacaaccgaactgagtaacatcatctttaacgagatattgcgtcgcaacaacaacttccgttacccagagaacaagcaagattttccagtggctcgtttttgtaacggtgttccttttgatcgcaatttagacagtgatattttgctgaaagtcgtttcacctatcgacaacagttacgacgaatacaacgacgctacctgtgcaaacttttcatcagattgcattcttgtcaaactgaatgataaccctcgcctattcgatgatcttcgtacttatattaagacagaaaaattcattcgcaaaagcagtagcgcctcaggctcaagtcaagaacagatccgacgcgataaagccaacgagaacatgaatcgtcgcaagcgattagtcggagatctcgaagaactaatcaaagagtctgatttttacacgcttggctctggctttgatgcaaaaggtagctcacttgctgtcatgctagagggagcctaccgctacatcattgaaaatactttcggtaagctcaaactgatcaagccattccctggaaatatcctaagcgaaattcagcaaactttagccgctggcgatacggcacagattggcctcgacttagcaggtgaagaagccaatccactcgcagttcttgaaatagaacagcacgtttcattaagtgacgaccatggttacgcggtaacagcggccgatatcatcaagaagttctcaaagcgcccttatggttggaacaccgatgagatcatcctaatattggcacgtcttggtcttgccaataaacttgtgtttcaagctaaccaacaggaagtcccgttgaaaggcttatatgaacatctaagtaagtctcaaaaaagagcgaacctgcgtattcgccgtatcaagcaacaatctgaagctaatctgaaaaaagcagcgaagctgtataaagatcttagctttggcaccgctcctagcgccgaaaaagagttatttaactcagcagttgaaaagttaaatcaatggctgactaaattgagacgattcaaatctatgtcatcgactggtcattaccctggtggtaacgagatcgatgatggcattatgttgttatcaggcttaacggaaatcaaaaccagcttccagttcgttgatgaattcatcgctaaaaccaacgacctactcgattttgaagaagagtatgagttactggaaaacttctacgaaactcagtttacaagttggcaagggctagagcgtgctttaaatatcaccttctccgcaaaccgtgcgttccttgaaaaaaatgcggaggcaatggctgcacttgataaacttactgctatttatcacaacgcatcaccgtatcgagatattcgtaatattcaacctttggttgagacgctgacctcaatcaataaccaactgattgaaaaacagcaaagttacactattaaaaagctcgaacagcgtattgatgaagttaaagaactgattgaaaacgctggagcaagtgcagagatcagcaacaaagtattattgccattccagaatgcaattaaacgcgtacaacgtgaaaacagcgtttcgcagattaagcacgagcttattgaagcggatgattggtttaatgatgcggaaaaggcagtgaacgcctacattcttcagcagcaagcactagcgaaaaaaacgaaagaagcacaatcttcaaattcagaagccaccgactcaccatcatcaacgagtcagtctactgcgaattatggttcatcgacgacagaagcaatgcctgtccgcgaaaaagcgcccaaggcaaagcctactcaagcaattgatgcgatggaagtctacagagaagtctctgaggcgacttatatggaaaccgtcgaagatgttgaaaattacctgaaggcgctgcgcgataaactggtcactctcgttgagagtaaccataaagtacgcattaaatag

SEQ ID NO: 235 - DNA, 3549 bp, Lachnospiraceae bacterium
atgatgattcgagatatgtttgcggatgacatcaaccgcaaaatcaatggtgtaattaaagtagatcaggctgctgatgatgtaatcgagcaggagttaaatgaatatgtcattaccagagaattgaagaaacacttcattactttcttcaactattatggagatgcctttgaccagcctacggctgatatgggtgtttggatttccggtttctttggaagtggtaaatctcactttctgaaaatgctttcctaccttttggaaaataaagaggtaaaaggcattcgtagtgtagagcgtttccgcaaaaagtttgaggacgatccggcaacctttatgctgattgaccgtgctacaaagggaacaacggagacaattctgtttaatattgatattgagggattcagcaataaagacaagacagctgtacttcgtgtttttgcgaagatgttctataaccatctgggattttacggagaaaatctgaaagttgccatgatggagcgttatatcgaccaacagggaaaaactgaggagttccgcagagtttttgaagaaaagaaaggcaagccctggctggaaatgcgtcgtgcctttgctttcaatggaaagtttattattccgacactgatggaagttctggatatgagtgaggacgatgccaaagcatggttcaatgataaaaccgcaacagaaatttctatcgcacagcttgtggaagatatgaaagcctatgtggataccaagcctgccaacttccgtttgttgtttatgattgatgaggttggacagtatgttggtacagataccgatatgcttttgaaccttcagtctttgacagagaaaattggaagtgaatgcgaaggaaagatttgggtgatctgcaccggacaggaagccattgatgaaatcatcaaagttcgtgccgatgagttctcccgtattcaggctcgttttaaaacaagactgagtttatcatcttcctctgtggatgaagtcatccagaaacgtattctgaaaaagaaaccagaagcagctaaaaatctggaagatgtttatgagcagaatgattctgttcttcgtaacctgttcagctttagcggctctattctggatattaaaggctattccggtccgagggaatttaccgagaacttcccgtttgtgccgtatcagtttattatcatgcagaaggtatttgctgaaattcgcaagcacggaaattctggcaagcacctgtctggtggtgagcgttccatgctctcaggcttccaggaagctgcacagaaaattcaggagaaggacgaatatgcacttgttccgtttttccgtttttatgatactgtacatacttttctggatggttcgatccgtcgtgtaattgagcgttgccagaaagctgtcgacaacggggacggcattgaacagcaggatgtagatgtactgaaacttttgtacttaattcgatatattgatgatattccttccaatttggacaatatcgtaatccttatggcagacgatattcgtgtggataagattatcatgcgcgaagctgttcgtggatgtcttgatcgtctgatgagccagaactatatcggcagaaccggagacacttataacttcctgactgacgaagaacaggatattcagcgtgaaatcagagatacaaatgtggataccgcttctatcgtagagcgtattgctcagatgatttacggtgatattttcacaactaagaagttccgttatggaaaatatgactttgcgtttgatcagatggtggatggaattaccgttggtgcggcaacaggaggtatgcgtctacgcttcctaactgttgctactgatgccattgaaaaaacagattaccgtctgatggcagaatccaaaggtaacgaagcaatcgtggttctggctgatacgccttattatgaatctctggaatctgttatgaagattcgtaagtacgtaaagcagagaaatgtaagccagcttccaaaaactgtgcagaaaatcatcagcgatcagcaggacgaagccggaaaatatgagctgagtgccatgactgaattacagaacgctatcgaaggagcgcagttctatgtagatggggagcatctggaaatcaaagccggaaatgctaagagtaagattgatcagtctctggaatatctggttgctcatgtatatagtaagctcgacctgattacagatcatgcaggcagtgacgcagatattattgcgattctgacaggtgcagtaacggcacttccgggcatggagccaaaccgtgatgctgcttctgctatggaagaatatctggaaatgcaggatgctaaaaaactgccgacatctatggcagacgtgcaaagcaaatatagtgcgattccgtatggatggaaagaaatcgacattgctgcggttgcggcacagctgatttattcccagaaagtaaccatcaagtatgcaggcaataccattcagccggatgacccgaaattgccggatatgctccgcaaaaagagtgagatcggcaagacttccatcagcaagcgtaaaaccatttcagctacgatgatgcgtgatgtaaaagcaatgctccgagagtattttgatgttatggatgtgccagacgatgaagatggtctgattcgctttgtgactgaaaaattcggtgaacagcgtgattactatgcttctctggatgcccgttatgacggacataaatacccggatcgtgcattggtgcaggaagccattcatctgatggaggatgtactttcccagaagaaagacaatattgccctgattgagcgtgtgctgaaaaaagaggatgctctctttgataacaaagaagccgtgagcaacggtatcgaaaactttttcaagacccaggtagcagtattcgatcaggcagtgcagtttgaaaaatctctgcatgatgaccttgaccgcattgcagaaaatgaggaagcacacaaggcattgaataccattcgtctgattaccatggttcagaccggaagcaagttcaactataaccggattcgtgaactgaatccgttgatggatacggttcgtactgctcatgataagatgctggaagaaaaacgtgcagaggttctggaaaccgttcgtcagtgtatggaagcaacccacactgccgcaaacggcgattccaaggcatcccatctgattgaaaaatcagatcggtatttcagccagtgcaaggagaaaatcgcagagttaaagagccttgcccttctggatgccatgttcctgccgatgtgccagtataaggatgatacggtcagcaatattgagtctgttctggctccgcctgcaccgaagccgccagcacaggcgacacagccgggaaaagggcaagcgatcgcaaagaagaaagtgattcgtacctataaccgtcaggttgtattccaggcaaagaccttacagaccgaagcagatattgatgattatgtagagaagattcgttctcagctgaaacagttgttgaagaattgcgacgagatcaagctgaattaa

SEQ ID NO: 236 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctagataaacgcggtcagtatgagacctttaaagccgcgtttgccgatatcaatggctcacgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattaccgaaaaccttggggtaatctgcggtggccgcgcatgggttatcgtgacttcgcaggctgatatcgacgcggcaatcggtggtatgagcagtcgcgacggacaggacttctccaagatccaggggcgcttttcaacacgcctgcaactttccagctctaacacatcagaagttatccagaaacgtttgttggtaaaaactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagactgcggcgcagcaaatctcagcgcaagggctggattctctggtgcctttctggcgcttctatgccgccattgagagcttcctggagcctgccgttagccgcaccatcactcaggcttgccagaatggcattcttgatgagttcgatggcaacctgctgaaaacgctgttcctgatccgttatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggcgcagtgcttaacgatctggtggtgaagatcctgacccctaaagatccgacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaatattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaagtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaatgagattgaatccggtctgcgcctgcttaatgccattcttaatgaaaaagaagattttgccctgatcgaaaaagtctcatcgctgaaagatgaacttctggatttcagtgaagaccgtgaagatttggtcgacttctaccgtaagcaattcgccacctggcaaaaactgggggctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgcgtaaaaagcaagaggcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaggttctggaaacgaccgaacaggtggaaaaggcgctcgacacgttacgcacaacgctgctggccgccattaaagcaggcgatcgtattcgccttcagtaa

SEQ ID NO: 237 - DNA, 3549 bp, Coprobacillus sp.
atgataattcgagatatgtttgcggatgacatcaaccgcaaaatcaatggtgttattaaagtagatcaggctgctgacgatgtgatcgagcaggaattaaatgagtatgttatcaccaaggaattgaagaagcacttcattacctttttcaattactatggcgatgcctttgagcagccgaccgccgatatgggcgtttggatttctggtttctttggaagtggtaaatctcactttctgaaaatgctctcttatcttctggagaacaaagaagttaagggcattcgcagtgtagagcgtttccggaaaaagtttgaagatgatccagcaacctttatgctgattgaccgtgctacgaagggtcagacagaaaccattcttttcaacattgatattgaaggctttagcaacaaagacaagactgctgttcttcgtgttttcgccaagatgttctataaccatcttggattttacggcgaaaacttaaaggttgccatgatggagcgctatattgaccagcaaggcaagaccgatgagttccgcagagtttttgaagaaaagaagggcaaatcttggctggaaatgcgccgtgcatttgcattcaacggcaagttcattatccctactctgatggaagttctggatatgagtgaggacgatgctaaagcatggtttaatgataaaacctccacggaaatttcgattgcacagcttgtggaagatatgaaagcctatgtggataccaagcccgcaaacttccgtctgctgtttatgatcgacgaagttggtcagtatgtcggcactgataccgatatgctgttgaacctccagtcgttgaccgagaaaatcggcagcgagtgcgaaggcaagatctgggtgatctgcaccggacaggaagccattgatgaaatcatcaaggttcgtgccgatgagttctcccgaattcaggctcgtttcaaaacgagactgagcttatcttcttcctctgtggacgaagtgattcagaagcgtattctgaaaaagaaaccggacgcagccaaagaactggaggcagtttatgaacagaatgattctgttctgcgtaacctgttcagtttcagtggttcgattctggatattaagggctactccacttcgatggagttttcggacaatttcccgtttgtgccgtatcagttcatcatcatgcagaaggtgtttgctgaaatccgtaagcacggaaattccggtaagcacctgtccggtggtgagcgttccatgctgtccggattccaggaagctgcacagaaaattcaggagagggacgagtatgccctcgttccgttcttccgtttttatgataccgtacatactttcctggacggttctatccgtcgagtgattgagcgctgccagaaagcagctgacaacggtgatggcattgagcagcaggatgtggatgtattgaagctcctgtatctgattcgatacattgatgatattccttccaatctggacaatatcgtaatcctgatggcagacgatattcgtgtagataaaatcatcatgcgtgaatctgttcgtggttgccttgaccgcttgatgagtcagaactatatcggcagaaccggtgatacctataacttcctgactgatgaagaacaggacattcagcgtgaaatccgagataccaatgtggataccgcttctattgtggagcgtattgcccagatgatctacggcgatattttcacaactaagaagttccgctatgagaaatatgacttcgccttcgaccagatggtggacggaatcaccgttggtgtaacgaccggtggtatgcgcctgcgctttttgacagttgcaacggatgccacggaaaagacagagttccgtttgatggcagagtctaaaggcaacgaagcaatcgttgttctggcagacaccccttactacgaatctctggaatctgccatgaagattcgcaaatatgtaaaacagagaaatgtaagccagttgcctaagagtgtgcagaaaattatcagcgaccagcaggatgaagccggaaaatatgagctgagcgccatgaccgaattgcagaaggctatcgagggagcgcagttctatgtggatggtgaacatctggagatcaaatccggaaatgccaagagcagaattgaccagtccctggaatacttggttgcccatgtatatagcaagctggatttgattaccaagaatgccgacagcgatgccgatattatcgccattctgaacggaaccgaaacgatgattcccggaacggagccgaaccgtgaagcggcttctgccatggaagaatatctggaaatgcaggatgcgaagaagctgcctacctctatggcagatattcagagcaagtacagtgcaattccctacggctggaaggaaatcgacattgctgcggttgcggcacagctgatctatgcccagaaagtaaccatcaagtatgcgggcaacaccattcaacccggtgacccgaaactgccggatatgctccgtaaaaagagcgagattggtaaaacctctatcagcaagcgtaaaaccatctccgctacaatgatgcgtgatgtcaaagaaatgctccgagagtatttcgatattatggatgtgccggacgatgaagatggtctgatccgctttgtaaccgagaaattcacagaacagcgtgaatattatgcttccctggatactcgttatgaagggcacaaatatccggatcacggattggtgcaggaagccattcatctgatggacgatgttctttcccagaagaaggacaacattgccctgattgagcgagtgctgaaaaaagaagatgacctgttcgacaacaaggaaacgatgagcaacggcatcgaaaacttcttcaaaacgcaggttacggtgttcgaccaggcagtgcagtttgaaaaatcgctgcacgacgaccttgaccgcattgcggaaaatgaggaagcacacaaggcgctgaacaccattcgtctgattatcacgattcagatgggtacaaagtttagatatgaccggattcgtgagctgaacccgttgatggatacggttcgtgctgcccatgacaagatgctggaagaaaaacgtgccgaggttctggaaacggttcgtcagtgcatggaagcgacccatactgccgcaaacggcgatatgaaagcgtccaacctgattgaacgctcggataagtatttcagccagtgcaaggagaagattgccgaattaaagagccttgcccttctggatgctatgttcctgccgatgtgccagtacaaggatgatacggtcagcaacattgaagccgttctcgccccgcctgcaccgaagccgcagcctcagccgaatcaggcaggtaaagaagcagccccggcaaagaaaaaggtcgttcgtgcctataaccgtcaggttgtgttccaggcaaagaccttgcagacggatgcggatattgatgagtatgtagagaagattcgttctcagctgaagcagctcttgaagaattgcgatgagatcaagctgaattaa

SEQ ID NO: 238 - DNA, 3672 bp, Enterococcus faecium
atgctaattaaagatatttttgcaaaaccaattgaccgaaatattcaaggagttattaaggtcggtcaagcaaaggatgaaaatgttcaacaagaattagaagaatacgtggttacgaaagaactacaaaaacactttaaaacaatttttgatgcctaccaacggagtatcaatacaccaacagataaaatgggtgtttggattcaggggttctttggttcaggtaaatctcatttcttaaaaattatttcttacttgctcgcaaatcgagaaataaatgacaagaaagccattgattacttcaaagaagatgggaaaatcaaagatccactgactttggcaacgatggaacggtgctcacaaataaatacagatgttattctgtttaatattgattcaaaaagtgatgcaggtggtaaaaaagacaaaaacggaatcgtgaatgtttttttaaaggtatttaacgaaatgcaaggattaagcacgattccacatctagcagattttgaacgtcggttaattaaagaagaaaagtttgatgcattcaaagctgcttttgaagagattaatggggcaaaatggcaagaagagcgccatgagtttgattggatccaagatgatatcaaagaagcggcacttaaaatcgattttatgagtgaagccgctattgataattttttagaaaaagcatcaggaaattatttaataagcattgatgactttgcaaatctagttaaaagctatcttgattccaaagaagcagaccatcatattgcctttctagtcgatgaggtcggacaatatatcggcggtaatcgtgagttgactttgcagttacaaaccgttgtggaagatttgggtcgaatttgtgaaggtaaggcttgggtattagtgacaagtcaggaagcgattgatcacgtaacaaactttgataacaattctgataatgatttttctaagatcaaggatcgttttgccacaactgtgagtttatcttcagcaaatgccgatgaagtaattaaagaacgtattttgaagaaaaaagagtttgccaatgattctttagccttacaatttgaaactgttcaaacagaattgaaaaataaattactctttgttgatagtcctgaattaaagctcttccaagatgctgaaaattacgcagaagtttatccatttattccctatcaattcaatttattggggcaaattctaaccgagattcgtaatcacagctatcaaggatcaaacttatcgtctggtgaacgttcattactagcaatgtttaaagaagccgctgaacgaaataaggaaaatgatacaaccagtttggtttctttagatcagttttattactcgttagaacgttggattgatacagcaattagccgagtgattacacaagctacaaataattctcatattcaaagaccaactgatatagataactttaacgtaaatgtcttacgaattttattcatgattaaatatgttgatcaagccatcaaaccaaatgttgaaaatattacgagcttgatgataagaaatatcaacgaagaccgcctggaaactaaaaaacgagtagaagaagcattggaccttttaattaaggaaaactttgtgcggaagaacttagatagttatattttccaaactgatgaagaacaggaaattactcgtgagattaaaaatcaaaatattacagatagtgatttgatcgtagaactatctaaacgaatttttgacggcgttctagaccgaaatagttttgcctatgaaaaattaggcatgtcaggtggaaataaatttaaaaaccggtatacgtttacttatgcacaagtgttagatcaacgtccatacaagcaagctggaaatgctgaaatgacagttaattttatttcaccatactctgatttagcaggtcaagaggcagaacttgcgcttaagagttcccgtaacttattattcgtagaattgccatcagataaagaatttaaagatgatatagcaatgtatgctagaatgaatctttatttaacaacgacttattcgagtgtagtaaagaactttgacgcgattcgttcggaaaaatctggtgaattacaggaactaagtgcaagtatcaacgatcaattaaatgaactgttgaaatctgcaaaatttttctataacggtgcagaaattcaactgacaggctccgactttaaagcaaaattccaatcagcacttcagaaaatggctgaagaagtataccataaattaaaccaaattgatgcgcctaaagaaaaagaagatatcttatatttagtgaaagaaagcaaaaatgaaattattgaagatccatcaaatgagcaagcagttcaggaaattttcaattttatcaatgatcaaaagagaaatcacctaacgattacgatgaaaacaattcgtgatcgttttgaaacaaaacaaccgtatggattcacagaacttgatgtggaatggtgcatcgctaaacttttcatgtctggtaaaattgatttactttataacaatgtacaaatttcacggatggatgatccaaatagtattgtaatgattattcaaaaacgacgagaaagtgaaaagataaaaattgaaccaagcgcggtgatttcgccaaaagcaaaaaaattggttgacgaaatcggtagagaactgtttcaaagtcgtaatattgttgatgaaaataacaatgaacatacaatggaaaatttcaagaaatatttaaaaggtcaattagacaatttacgctcttattttgatttacaaaacacttatacctaccctagtgcttatgaatatgagcaaataaaaaaatatcttgaagtaattgttcaaacgtcagatgttgaagactttttttatacaatcaaaaaatatcgcgatgaattattcgactgggctgaaacatatgataaaattaaaaatttccacaagcaaaatagtactcagaaaaaaatctgggagaatgcacaagataaaattagattaatcgaaaaaagtcggcgtcaaacttctagccaagaaattgatcaattgattcatgagatgaaaaccattttgaaaaaggctgatccttattcagatatgatgaaactaaatgagttgattcaagaatttattgaacaatataatcaactgttagagttggaaagtcaggaaatattaaataaattaacggaagaaaaacaagcaacatttaaattattagaaggaaaagattttaaggatcaatttgtaccaatagttgaccaagaatttcaagaactgaaagcaaaaattgaacaagcgaatactatagatgatcttgttttcttatcattaaacgtagcagaacagtatttgatctttaatcaacgtttcgataatgaagaaaaccgcagacgtcaagaagaacaagcacgtaaacaaattgaagcagcaaacttgattcgtgaaactgaaaaagatgaaatagactctgcagcaaaagctgaagaaatagcgatagtaaaacctactattcaacagaaaacagtaccaatgagaacacttaacgttcatgttaaaactattaagtcagcagcagatattgatgagttaacagctgaaattaatcaaaaactgaaggaacaacttcaagaaaatacagaaatcacgattcaattctag

SEQ ID NO: 239 - DNA, 3456 bp, Vibrio cholerae
atgctgggttatataatagataaccagattataaatggtactcctgcacgtgagcgttttataccacgcttaaaaggtgtaagtgatgcaggtcttattgaaaacgccctacgtaatcttgacgcaattaacagccgcgtagtgttccttgatgttgctaagcaaaatactgaacgtggattggctttcaccttgtttgctaatctgcttaaaaatcttggttttcgtgatgatatttacggttatatggagtttgatctgctcctagatggtaaatacgacgagtttaaatccattgtccaaaaactagagtcgaaggattgggatgagctaaagaaaagtaatcggcatgtcgctagagttatgcgaaaggtcttttcagaaatgggctacagcgagtcagattatgaagatactaaaagcgtctacagtgcttcaatagaggatttttctgccagtaaatttaagacggaactggaaaaataccttaagtttaattcagaagaaacactggtctttgttttcgacgaggcgagtgaggctattagccaaaagaaatttacccttttagatttagaagggattagtgaatcactatcgagtataagtaataaagtttggaccatagcgattgcacaagaaaagctcgacgacgtgattaacaatgctaacgttagtcgcagtagtttgaccaaggttactgatcgttttaaaaccaagattcaccttgagtctacagaagtagacgttatcattcgtagtcgattacttcaaaaaacagaacaggcaaaacaagatttagttgcttattaccaaaagaatgaaggcctaatcagcgacgccaccaacctgaagtcatcgttccctacgaaaacggaaacagctgaagattttgcggtctattatcctttccacaaatatcaattcgatattttgcaaaagttcttgtttagctcaaacgctttagttgctacccaaattgcagctcgaggcatgattatcacaacatttgacgtactacgtaagcaaatgcgtgacaaagagctgtatagctttacgccagggttcgcgatatgtgatgaagcccaaaccgcaccgccagttggattggtcaacaaatacgatactagccgcaaaatattaaaagaaaatggcagcagcattgacggcgagaaactgctcaaaaccatgcatctattagccgactctgaagtagtagctccaacggttgaaaatataaccaaaagctacattacggacatcacgtcgtactatgaagtaaaaccagcaattgaagacgcgcttaagctactgcttgaagcaaaagtactactactatcaaacaacaactacaaaattacctcagatcttgaaggcaaactgctcgaagaaatgaaagattttgatgtcgaacttttcagcaagaagcgtgagttaattaagtatttgaaggactacaaaacctttaacgcagttgcatcctacaatgatggcagtgatgcattcaaatttagcgtgctgtcagaccaagacgatgagttagcacctgtaggaagcaaacacttaaagatcacagcctatagcttgttcaatatcagtgatgatcgtcaggattttattgaacaactgaagcttgatactcagtatcagaaagagcttattaccttggtgccagatacttcagagttctcccagattgataaattgataggcgaagttatgcgctacgcctacatggaggaaaaatactcgaatgaaaaagatgccgataagcgtcaaattattcgtgaatttgaagttatacgagaagagaagcaacgaactttaagagggctaattcaagacgcatatcacaatgcatccctgatctacatgttcgacgagcatctgttgaacgttgatacatttaagggaaccattgccgacaaccagcgaaaaatggtgaaaaacatctacaccaagcgtttatcaagtcaactttctgatagcctggtctcgaagattttcagcacacataaagaaagcctgaataagttatttaccgctaatgattttgcattcttcgacggtcacggcaattttactggcgatcaccttaaaattgttgaagaaatcaatgctaagataaagtcgcgctatatggatggtaaatctctagaagctgacttgtcaggtgctccatggggctatagctacggaacattagtaacgactcttgcagtactattccgtgccggtcgactatcggttaagtttaacggcgacacctatttttctcatgagcaaaaagcggttcacgatgcctttacgaataccaccaagtttaaatctgcgtcgttcaaatcgattactgcaacgctaaccgctgtgcagaagaaccaggcagtacaactactgatggaactcgaaacacaggaccatatcggcaaaaaggtagattggaatacaaacgattttgacttggctgacagtattcgtttgatggctgaacattttatcagtgccattaccaacctgagtgatactgttcaagattttgaagaactattccccaaagtggtaggtttaaaacaagacttgcaaggttttgcgggtaaagttaccgagagtaactatatcgaaaaggttgagtatctacttaataacagcgatacgttcagcgatgcggttcaagccatattaaaagctcagaaattcattaaaaagaactttccaaaagttaaagaatttaagcgctttattgacgatgttcgaagcgagctgattaaagctgatcgcagtgacaataacattgatgaagcctatgaagaattcgagcgcttattcaaacaggatctggtgaaaaactttgccaatctccagcaacaagtacaagttgtaaaagatgcttattacaagttagttaagacagcatctataggtatgagtcacgagtacaaggtcctgagcggtaaaattgaggctgcttttcgtgaacttaagaactaccccgcggcgccgaaccgattaaatcagcaaaagcttgatgccttaaaagcctacgcagaaaaacgagtagttggtgaaccagtacttgcgttcagcattagttgctcaaatagtggtttttctctctccgatattttgaattacacagctcaagcaccgctaaaagatagcgagctgcttatcgtgcaaagtagttttatcacagaagagccacagcccgagcctgtacccacaccgcagcctacacctaatcgtggtcccgatggtggcgagcctgcaccagccccgactccagttcaatcaccagcaccgaaacaaccccgcaaagttgcttttaaagtttctagtaaggtgatgacagtgcaagagtataaaaccttgctgactacgcagctaacggcgcttgctgcggccaagcccgatgaagaaatcgaactaactgtagatattaatagcgaaggactgtaa

SEQ ID NO: 240 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgacatggcacaagcattaagccaggccacgcagcagagtcttgaatcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcactggcaaaagtgtggcaagagaaagccgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcgaacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgaattcgatggcaacctgcttaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagtcgcttcctgaacggacacccattagacggcgcagtgcttaacgatctggtagtgaagatcctgacccctaaagatccgacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcttccacaccatcgaacattgtcgatgaagcctgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcaacatgaatatcgaatacaataaacctgtgtatttacgcgatattctgaaccatttcgcgcgtcgcccttatggctggcccgaagacgaagtgaaactgctggtagcccgtctggcctgcaaaggtaagttcagctttagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagtgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaatctgtggatcgatgagctgtgtaaaaagcaagaagcacaactccgggcagcaaatgaagctaaacgcgctgccgactcagaacagacttatgttgtggtggaaaaaaccgttatccaaccggtaccgaaaaaaacgcatctggtgaatgtcgccagtgagatgcgtaacgccgccggtggtgaggttctggaaaccaccgaacaggtggaaaaggcgctcgacacgttacgcacaacgctgctggccgccattaaagcaggcgatcgaattcgccttcagtaa

SEQ ID NO: 241 - DNA, 3654 bp, Lachnospiraceae oral
atgcagattaaagatatgtttgccaaaaagattgaccgtgagattcagggggtcatcatcgtagggcagggcgaagagacaaatgtgtcacaggaacttgaggaatatgtggttacaaaagaattgcaaaagcattttgcggattttttcgctgcatataaaaagagtattgatggaggcacacctaagatgggagtgtggatctcgggtttttttggaagcggtaaatcacatttcctaaagatattatcatatctgcttgataacaaaattgtcggagataagcatgcacttgattactttatagatgataataagatagcagataagaaggtactctctgatatgcaacttgcagcaaatataccggcggatgttgtactttttaatattgattcaaagagtgaatcaagcggtaagcataataaagatgctattgtaaatgtgtttttgaaagtctttaacgaaatgcaagggttttgcggatctatgcctcatatagcagaccttgagagaagacttgttgaagtgggaaggtttgacgagtttaaagctgtatttgaagatgaatatggagagtcatgggaggagtccagaaaagactttgactttatacaagacagtgtggtggatgctcttgtaaatatggactatatgagtgaggcagctgcaagaaactggtgtgagaaagctgcagaaagctacactataagtatagaagattttgcaaagcgtgtaaaatcatatatagagagaaagggaaacaaccatcatgtggttttccttgtagatgaaattggacagtatataggtgatgattcaaaacttatgctgaatcttcagactgttacggaagaacttggaaaagaatgtatgggcagagcctgggtgatcgttacatcacagcaggatatagactctattaccaaggtaaagggaaatgatttttcaaagattcagggaagatttgatacaagactgtcactatcaagcgccaatgtggatgccgtaatcaaaaaaagaattcttgataaaaccgatactgcggcacagacacttagacttttgtatgagcaaaaatcaactattataaaaaatctgatcgtatttaatgacggtgtggagaaaaagctttatgcaaatgaaaatgattttactgaaagctatccatttgtgccatatcagtttaacctgctggcaagtgtgctgacatccattcgtacacatggtgcatcaggaaaacatttgtcggagggagagcgttccatgctggctttatttaaggagtcggcgtcaacattaaaggaaagagagatgggagtcattgtgcccttccatcgtttttatgatgccttggaaaactttcttgatcacagccataagggagttatcagtaaagcttataataacaattatatcaatccggagcaaaaagatgccgatgtctttaccgtcaatgttttaaagacattgtttatgatcaagtatgtgcttgaaatagaatcaaatattgacaatattacaagccttatgattgaaaatatcgatgatgatcgcattgcactgaaggaaaaggtggaagatgcgataaagatattgatgcgtcagatgctggttcaaaaaaacggaaatatctatgtatttttgactgatgaagagcaggaaatcaacaatgagatagaaaaagaaaatgttgaaatgtcggaggtcatcacaaagattgccgaaatgatatttgaagatattttcgcagataagaagtatcgctaccctgagtttaacggcagatactcattctcatttaatcagatggtagatgatcgcccatataagtcgagtcaaaatgccgatataggacttcgtatacttacaccttggtatgacggaggtatggatgatgcaaagcttcgcatgatgtcaggacagggaagggaagtccttgtggtgcttccaaatgatgatgagtttttgacagagatgagggtatatctaaagattgagagattccttaggaaaaatacttccatgcagcttgccaaatatgaaagtataaaagatacaaagcgtgtggagatgagagaacgaaatgccaatgcaagactttatctgactgaggggctaaaagatgcgaccatatatgtaaatggggatattgcaaatatatcagcaaaggaagtaaataacaagatttctgaagccataggcagacttgtacagaccgttttccacaagctttcatatattgatactgttatgggagaggcagatatcagaaaacttttccaaactacaaatcagatgcagatgttgccggaaggaggcagatttgcaaatgcttatgcacttgatgatgtacagggatatatatccatgaactcacataatcacttaaagacatccatgaagtctgtaaaggatcgctttatgaaagcaccttacggatttgtagaggatgatataaattggcttgttgcatgcctgtttaagcgtggagatatttcgtttactgtaaatggagcatccgtaagcttaaataataaatctgaagatgaaataataaactacatcacgaaaaaagcctttgtagaaaagcttttgatggaagaacgtgtgcgtgttgcccaaaaggataaaaagtctgtacgtgatgtgatgaaagaggtatttaataccaccctttccacagaggatgaggacagtattatgaaagactttaaaagattgtcctcaaatatgataaatgagatggacaaacttgaggtatattacagacagtataattatccgggaaagaatgtacttgatagcggtaaacgcctgttacagtctgtaatgcagcttaacggtgcattggaatttttctcacatatttcaaaataccaagataccttctttgatatggcagaagactatgaacctgtaaaagcattctttaatggagagcagcagaatatatttatgcgtgcactggatatgcttgcaatatatgaagacagtaaaacttatattgtggacagtgaattggaaaaagttgtaggggagatgcgtgctatagtaaagcaggataagccttataagaatatacctaagctgccggaacttatagctcagtttagggatgcctataatcaggttatagatgtggaagaagcaccggttcttaactctatagatcaatcaaggcagcgtgttttagaagtgctcagtacaaaagaatatgaaaagcaaaagaaagaacattatttatccttatttgaagagataaaagatggagcgcaaagctgtaataatatatcatcacttagaagttttgcagataaagccggagctttaaaaattcgccttatggatgagatggacaatatggatcgtcagattgcggaaagaaagcaggctgaagagataagaagaattgaagaagaagccaaaaagcgaggtagtgacgtcagcgatgttgaagtggcaagaagtatagctgagcaaaaaaaacagtataaagtacgtaaaacaaagaatgtacctattaagaaaataacaggtacatcttcttggagacttgagaataaagctgatattgataaatacgttgaagagctgagaatgagactgctctctcaaatggatgaggacactattgtcaatatagagttttaa

SEQ ID NO: 242 - DNA, 3642 bp, Salmonella enterica
atgaatattgaacagatctttgaaaaacgtctggaccgaaatattaatggcgttgtaaaagccgaacagacggacgatgccagtgcctggattgaacttgatgaatacgtcatcacccgggaactggaaggacatcttcgccacttctttgaatcttatgttccggcaaccggtccggagcgcatacgcatggaaaacaaaatcggcgtatgggtgtcagggttctttggctcaggtaaatcacactttatcaagattctgtcgtatctgttgtctaaccgcaaagtcagccataacggtacagaacgtcatgcttactccttctttgaagacaaaatcaaagatgctctgttcctcgctgatatcaacaaagcggtccatcatccgacggaagtgattctgttcaatattgattctcgtgctaacgtcgacgataaagaagacgccatccttaaagtcttcctgaaggtatttaacgaacgggttggctactgcgctgattttccgcacatcgcccatctggagcgtgaactggctaaacgcggccaatacgacgcgtttaagaccgcattcgccactatcactggctcaagttgggaaaaagagcgcgattcttactatttcatcagcgatgaaatggcagaagccctaagccaggccaccggtcaaagcgttgacgcctcgcgtcaatgggtggaacagctggataagaatttcccattagatatcaataatttttgccagtgggtcaaagagtggctggatgaaaacggcaaaaatatcctcttcatggtggatgaagtcggccagttcatcggcaaaaatacgcagatgatgttgaagctgcagactatcactgaaaacctgggtgttatctgtggtggacgcgcatgggttattgttacttcccaggcggatattaatgcggccattggtggaatgagcagccgtgacggacaagatttctctaaaattcagggccgtttctctacccgtttgcagctttcaagctccaacacctccgaagttatccaaaaacgtttgctggtgaaaaccgatgccgcaaaacccgcgctggcgaaagtctggcaggaaaaaggcgatattctacgtaaccagcttgcctttgatccaacaaccaccgcttctttgcgcccctacactagcgaagaagaatttattgataactacccgtttgtcccgtggcactaccagattctgcagaaggtttttgagtctatccggaccaaaggtgccgccggtaaacagttagccatgggtgaacgctcacagttagaagccttccagactgcggcacagcagatcgccccgcaaggtctggattctctggtgccgttctggcgtttttatgccgcgattgaaagcttcctggagccggccgtcagccgcaccatcactcaggcctgccagaatggtattcttgatgagttcgatggcaacttactgaaaacgctgttcctgatccgctacgtcgatgtgctgaaaagtacattagataacctggttactctttcgatagacaaaatcgataccgataaagtcgaactacgccgtcgcgttgaaaaaagcctgaataagctggaacgggaaatgttgattgcacgtgttgaagacaaatacgtgttcctgaccaacgaagaaaaagagatcgagaacgagatccgtaacgtcgaagttgatttctccgcgatcaacaagaaactggcatcgatcatctttgatgacattctgaaaaaccggaagtatcgctatccggcgaataagcaggactttgatatcagccgcttcctgaacgggcacccgttagacggcgcgatgcttaacgatctggtagtgaagatccttacgccaaaagatccgacctatgaattctatagcaacgatgctgcctgtcgcccctatacctcagaaggggacgggtgcattttaattcgtctacctgctgatgcacgcacctggactgacattgatttggtcgttcagactgaaaaattcctcagggacaacgccgggcagcgcccggaacaggccagcttgctttcagaaaaagctaaagagaacagcgttcgcgagaaaatgcttcgcgtacagctggagtcgcttattgccgaagctgacgtctgggcgattggcgagcgcttaccgaagaaatcttcgacgccatccagcatcgtggatgaagcctgccgttacgtgattgaaaacacgtttgccaagctgaaaatgctgcgcccgttcaacggtgatatcgcacgtgaaatccatgcactactcacggtagagaacgatgcggagctggatctgggcgaactggaggaatccaaccccgacgcgatgcgcgaggtggaagcctggataagcatgaatattgagttcaataagccggtctatttacgcgatattctgaaccactttgcccgccgtccttatggatggccagaagaagaagtgaagctgctggttgctcgcctggcacgcaaaggcaaattcagctttagccagcaaaataacaatatcgagcgtaagctggtgtgggagctgtttaataacagccgccgccacagcgagctgcgtctgcacaaaattcgccgtcacgacgaatcgcaaattcgcaaggccgcacaaactatggcggaaattgcccaacagccgtttagcgaacgtgaagaaccggccctggttgaacatatccgccaggtcttcaatgactggaagcaagagctgaatgtcttcaaagcgaaagcggaaggtggaaacaatccaggtaaagatgagattgagtcaggccttcgcctgctgaattccattctgagtgaaaaagaagattttgccctgattgagaaggtcaccagccaggccaatgagcttctggatttcagtgaagatcgtgaagatttggtcgatttctaccgcaagcagtttgcaacctggcaaaaactgggcgcggcgctgaacggcagctttaaatccaaccgcagcgcgctggaaaaagacgccgtggcggtaaaagcgctgggcgagctggaaaacatctggcagatgtcggagccttataaacatctcaaccgtatcacgccgctgattgaacaggtccagagcgtcaatcatcagttagtggaacagcaccgccagcacgccctggagcgtattgacgcccgcattgaggaaagccgtcaacgcttgcaggaagcgcatgccacgtcggagctgcaaaacagcgttctgctgccgatgcaaaaagccagaaaacgtgccgaggtcagccagtcaattccggaaattctggcggaacagcaagaaacaatggcactgcaaacggatgccgagaagaagattaaccagtggatcgacgagctgcgtaaaaagcaggaagcccagctacgagcagcaaatgaagctaaacgcgcggccgagtcacaacagacttatgttgtggtagagaaacccgttatccaaccggtaccgaaaaaaacgcatctggtgaatgtcgccagcgagatgcgcaaagccaccggtggtgaagtgctggaaaccgccgaacaggtggaaaaagcgctggatacgcttcgtacttcgctgctggcagctattgaggcaggtgaccggattcgtcttcagtaa

SEQ ID NO: 243 - DNA, 3615 bp, Pectobacterium wasabiae
atgaatattgaacaaatttttgagaaaccgctaaaacgtaatattaacggcgtggttaaagccgagcagaccgacgacgaaagcgcctggatagaactggatgagtatgtcatcactcgggagctcgctggtcacttgcgtcagttctttgaagtatatgccccagctactggaccaggcagattacagcttgccgacaaaatgggcgtctgggtttcaggcttctttgggtccggtaaatcacacttcattaagatcctttcctatctgctggcgaaccgcgaagttagccacaatggcgtcacgcgtaatgcgctctccttctttgaagagaaaattaatgatgcactgttattggccgatattcggaaatcggttcagcatccgactgatgtcgtactattcaatattgactcacgtgcgaatgttgaagatggcgttgatgccatcctaaaagtatttctgaaagtctttaacgaactggctggttattgtggcgacttcccacatattgcacacctggaacgtgagcttgataagcgtggacagtttgatacttttaaggccgccttcgcggacattagcgggtctcgctgggaagacgaacgtgatgtttatctgatgataaacgatcagatggctcaggcgctgagtgtagctacaggccagagtgaagagtcttctcgccagtggatcgagcaacttgataagaacttcccactggatatcaaaaatttctgtacgtgggtgaaagagtggctggatagtcagggcaatcgcaacatcctgtttatggtcgatgaagttggtcagttcattggcaaagatgcccagatgatgctgaagctgcaaaccatcaccgaaaacctgggcgttatttgcggtggccgcgcatgggtgattgtgacctcccaggccgacattaatgctgccattggcggaatgagtagtcgcgacggtcaggacttctcgaagattcaggggcgtttctcaactcgcttacagctctccagttcgaatacctcagaagttatccagaaacgtttgctggtgaaaactgatgctgcaataccagcgctggaagctgtctggcaggaaaaaggcgacattctgcgtaaccagctggcgttcgacacgacaacaactgctaccctgcgtgcctacaccaacagccgcgaattcgtggataactatccgtttgtgccgtggcattaccagatcctgcaaaaggtctttgaatcaatccgtaccaaaggggcagcaggtaagcagttggcaatgggggagcgttctttgctggatgccttccagtctgccgcagtccagatttctgccgatggcctagatagcctcgtaccgttctggcgcttctactctgcaattgaaagcttcctggaacctgcagttagccgcactatcattcaggcctgccagtctccgtcactgaccgaatttgacggtaaacttttgaaaacgctgtttctgatccgctacgtcgatgtgctgaaaagtacgctcgataatctcgtcacgctctctattgagcgcattgatactgacaaagtggaactccgtcgacagattgaagccagcctcaatcgcctgcaggcagagatgctgatctcgcgtattgatgacaaattcgttttcctcactaacgaagaaaaagagattgaaaacgaaatccgcaatattgatgttgaattcaccaccatcaataagcagctctcgaccattattttcgaagagatcctgaagaataaaagatatcgctatccggccaataagcaggattttgatatcagtcgcttctgtaacgggcatccgctggatggtgcgaatcttaacgatctggtggttaaagtgctcacgccactggactcgaactacgagagctataagggtgtgcattccaatagtctgctgatgacggacagtaaaggctgcatcttaatttgcctgcctgatgaggctcgtacctggcaagacctgaccatgtacgtgcagaccaaagccttcctcagcaagcaaagcggccagcgcccggaacaggcaacgctgttggcggaaaaaggccgtgaaaatggcatgcgcgaaaaaacgctgaaggcgcagatcgaaggcttgctggctcaggctgatgtctgggcgctgggtgaacggctggataagaaatcctcttcgccgttagctatcgtggatgcagcctgcggttacgttatcgagaacagtttctccaaactaaaattgttgcgtctaagtaccggagacgtaaatcgtgaaactcacgcgctgttgacagtagaaaatgatacccagctcgacctcggagaaatggaagagtccaacccagaggcaatgcgtgaagtggataactggataagtatgagtattgagactcataagccagtttacctgcgggatatccttaccacttttggccgtcgcccatttggctggccggaagatgaagtcaaattgctggtggctaggctggcacgcagcggtaaatacagcttcacactgcaaggcagcgaaatcgcactgaagcaggcatgggacgcgtttaataattcacgtcgttacagcgatttgcgtctgcacaaagttcgtcgccatgatgaagcacagttgactaaagctgcgctgctgatggctgagattgctggagaaccgtttaacgagcgtgaagaacagttgttggtctctcatattcgcgaactcttaggccgccggaagagcgaactgaccgtttttaaaactcgtgcagagagtggacaaaaccctggccgtaaagagatagaagaaggcctggtattgctgaacgggatcctcaacgagaaagaagaatacgcggtgattgaaaaaatcaccgcagcggttgacgctcttaaagatttctcggaagactgggacgatttggtcagcttctacaaaaaccaatacgccacctggcagcgcttgagtgtggcattgaatggcagttttaaagctaaccgtaacacgctggataaagacgaaacggcccaaaaggcgttacaggagttggaagggatctacagtaaggcacgaccttacggagagctgcaccggattatcccgctgattgaaaccgttgaaaccatcaaccagcgtctggtggaagaataccgaagccatgcgctgctgcagatcgatggtcatatcaatgaactgaagcaaagcatgctggagatgcatgtccctgctgacttacagcactcgcttttacacccgatgcagcaatcgcgtaagaaagtggagcaaaacggtctgatcccacagattatggaagagcaagccgaggttcgggcgctacaattcaaagcaaacgaacaactgaacggctgggttgaagaacagcgtaagaaagtgcctgaaccaaaacccgcccctcagccaggggttatcgacccagtagttaagcctgaacccaagctgaaaaagaccatctacgtgaacacgcgtaaaacgatggaacgagctgcgggtgtgacaacgctggataacgccgaacaggtagacaaggcgctggaacaactccgtaaaacgctaatggatgctattaacgcaggcgaacgcgtacagcttcagtaa

SEQ ID NO: 244 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctagataaacgcggtcagtatgagacctttaaagccgcgtttgccgatatcaatggctcacgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattactgaaaaccttggggtaacctgcggtggtcgcgcatgggttatcgtgacttcgcaggccgatatcaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctgacaaaagtgtggcgagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccaacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgagcgcttaccgaaaaaatcctccacgccatcgaacattgtcgatgaagcttgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcacaggtgcgtaaagccgcgcaaaccatggctgacatcgctcagcaaccatttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgaaaaagaagattttgccctgatcgaaaaagtgtcatcgctgaaagatgaacttctggatttcagcgaagaccgtgaagatttggtcgatttctaccgtaagcaattcgccacctggcaaaaactgggcgctgcgttgaatggcagctttaaatccaaccgcagcgcgctggaaaaagacgccgcggcggttaaagcgctgggcgagctggaaagcatctggcaaatgccggaaccttataagcatctcaatcgtatcacgccgttgattgaacaggtccagaacgtcaaccatcagttagtcgaacagcaccgccagcacgccctcgaacgcattgatgcccgcattgaggaaagccgtcaacgcttgctggaagcgcatgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgtgtaaaaagcaagaagcacaactccgggcagcaaatgaagctaaacgcgctgccgactcagaacagacttatgttgtggtggaaaaacccgttatccaaccggtaccgaaaaaaacgcatctggtgaatgtcgccagtgagatgcgtaacgccaccggtggtgaggttctggaaacgaccgaacaggtggaaaaggcgctagacacgttacgcacaacgctgctggccgccattaaagcaggcgatcgcattcgccttcagtaa

SEQ ID NO: 245 - DNA, 3531 bp, Ruminococcaceae bacterium
atgttccagaaggacattgaaagagacatcaacggcgttatcaaggttatgcaggatgatgaccggagtttggaacaggaactcagcgaatacataattaccaaggagcttcgccgtcacttccgcacattctttgacaactacacaaaggctatcgaccagccgactgataaaatcggcgtgtggatttccggcttctttggaagtggtaaatctcatttcctgaaaatcctctcttacctgctttccaatcaggaagtctgcggtaaaagagcgattgactactttgcagacaaattcgatgacccgattatgtatgctcaggcggttaaaagtgtgtccgtgcctacgcagtctatccttttcaacattgacatcgaaggtcctctcacgaaggataagaccgcagtgctgcgcgtctttgcaaagatgttctacaatcactgcgggttttacggcgatgatctgaaaattgccaagctggaacgcttcattgaaaagcaaggcaagacgcagcagttccgcgaagcctttgagaaggtcaatggtgcgccttggacggagactcgcgattcctttgcgttctttgaggatgacattgtttcggttctgcaatctacgctcggcatgagcgaacaggcggcgcggaactggttcaatggtgaggaaacgaatgagctgagcatcgcccagctcgtagctgacattcaggaatatgtagacggcaagggcaaggatttccgactgctgtttatggtggatgaagtcggtcagtacattggtgacgatggtgacttgatgatcaatctgcaatctcttgtagaagagattggcattcgctgccacggcaaggtttgggtcatggtgacaagtcaggaggcgattgactccgttgtccatatcaccggcaatgacttttccaaaattcagggacgcttcaatacgcgcctcagcctttcctcgtcctccgttgatgaagttatcaaaaagcgtgttctggcgaaaacagatgcggcagatcagcttcttcgcatggtctatgacaaggaacacgccgtactcaaaaacctctatactttcaacaatcccgttcttgacatcaagggctttacggatggtgcggagttttctgcaactttcccctttgtgccgtatcagttcatcgtgatccagaaggtgcttgccgagattcgcaagcacggcaattccggcaagcatctgtccggcggcgagcgttccatgctctccggcttccaagaagcagcacaggatgtgaaggataaggatgaaaatgctctggttccattccatcttttttacaatacagttcacacattcctcgaaagccccatccgacgggttatcgaccgctgccagactgcggcagacaatcacgatgggcttgagcagcaggatgtcagcgtcctgaagctcctttaccttgtacgttatattgaggacatcaaggcgaatatcgacaatatctccatcctcatgatcgatgacatccgcacagataagattgcgctgcgggcgtcggtttccgcctcgctggaaaggcttctctcgcagaactacatttctcgcaatggcgatacctatgccttcctgacggacgaggaacaggacattgccatcgacatcaagaacacaccggttgacagcgcacaggtcatcaccagcattgcacagaccgtttacggagaaatctatccctccaagaaattcaaacatgacaagtatgacttcgcctacgaccaatacattgacgagaccctgaacggctctgcttgcggaggaatgcggcttcgcattgttaccgtggcaagcgactactacggtgcgccgaacgaacggcttattatggattctcaggtcaacaacgaagcaattgttgtgctctccaatgagacgccgtattttgatgagctggaacaggcgatgaagatccgcaagtatgtcaagcagcggaacgtatctcagcttcccgaaagcattcaggacattatccgcaagcggcagcaacaggcgcgcattctggaagaaagagcgcgtagctatattgaaaaagctatcgtcggtgcaaaggtcattgtccacggcgaggtcatggacatcaagactggcaacgcgaaagacaagctggacgctgcgatgaacggtctggttgagagcgtctattccaagctcaacatggtcaaccggttcgtagagagcgacgcagacattctttccatcctgaatggaacggatgacgggcagattgccttcaccggtcagggcgcaaacaacgaggatgcgctgaacgagatcagccagtggcttgagcttcaaaatcagaagatgctcagcacctcaatgggcgatgtgcagcgccggtatcaggcgattccctacggctggcgtgaaattgatattgctgcgctgattgctcgtttgatctctcagcagaaaatctccatcaaatacggcggtgctttggttggcaaggacgagcgtagactggttgattatctgcgcaaaaaatccgagatcgacaaggcagtcgttacccgcagaattgccccgtccgaggaccttatgcgcaagagcatcgccttcctccgggactatcttggcgcgatggatattccttctgatgaggatgggctgatccgcttcgtgctggacacctttacccaaaagcaggagcattatcaggagcttcttgataaagcctattctgagttccgttacccggaaaaggaagttgtcacaaaagcccacgaccttatgaatgatgttctgagtcagcgtagggacaatgttgcgcttctcacacgcatggtgcagcgtcaggaagaccttctggattgctctgaggacatggagggtgtggagttcttcttcaagtcgcagcggagtgtgtatgatgaggcacggcgtcagatggagcgcgtgaacaaggaacgtgactactttgcttctgatgcggatacattggaggtcttccatactattgcgaccatccttgcacagccgaagccctatgaccgcattggtgagctgccggagctgattcaaaaggtcaaaacggcatactccggtctgctggatttgaagaaggatgaggttgtcgagaatatccgtcagtgtatgcaggacgttcatcagcttgcaaccgaggcacgggatgctggagttctgctacgtcaggcagacgattactttgtcggcaagcgtgaggcggcgaagaacgcatcttctctcaccgagttggacgctatgatcacccagcttctcacctacaaggacaatatctgccgtcgcatggaggttatgtctgcatctcatcaggaacgcactaccccggtcggtacaggtacggcacagcccgctccgaagatgccgaagattacgacacttcgccggtatgacctctgctctgtcaagcgtctgcaatccaaggaggatattgaccggtacgtcgatggaatccgcgagaagctgctgaaaacgttggaaagctgcgacggcgttcagatcaactaa

SEQ ID NO: 246 - DNA, 3618 bp, Holophaga foetida
atgcagattcaagatcttttcgaacgtcgcattgcccgcgccatcaatggcgtggtcaaggctgaccaaatggatgacgcctcggtctggcaggaattggatgagttcgtggtcacccgcgaactcaatggccacatggccaagttcctggatgccttcgcctccaccttggggaaggccgccgatgccgaggccgcctcgaagaatggcgtgtggatctcaggctttttcggatccggcaagtcccacttcatcaaggtgctgtcctacctcttgaagaacgacacccaccgatatgagggccaggagcgcaaggctgcggagttcttccagagcaaggtcgaagacgccatgatcctgggcgatatccgccgcgtggccacggcccacacggatgtcatcctcttcaacatcgatagcaaggccgacaccaaccatggccgggatgccatcctccgggtcttcctgaaggtcttcaacgagatgcagggcttctgcgccgatcatcccgagatcgcctacatggagcgccacctcactaagaagggccagtaccaggccttcgtggacgccttcctccgggactacggttccgagtgggaaaaggagcgggatgccaaggacctcctgcgggaccacgtcatcgccgccttgagtgaagcccttgccatcagcacggaatccgccgagaagttcttcgatagcggcagcgattcggtctccatcacccccgaaaacttcagccgctgggtgaaggaatacctggacgagaaggggccccagcaccggatcgtcttcctggtggatgaggtgggccagttcatcggctccgattcccacctcatgctcagcctccagaccatcaccgagaacctgggcaccatctgtgaaggccgcgcctgggtggtggtcacctcccaggaggatatcgatgccgtcctcgggcagttgaagaaggacaaggcccaggacttttccaagatccaggggcgcttcaagacccgactttcgctctctagcaccaatgtggacgaggtcatcctcaaacgactcctagaaaagaagccccaggtgacgggcgagttgcaggccatcttcagggccaagggcgacatcctcaagcaccaaacatcttttcaaaacgcgggcatgaccttccgccactacaaagaggccgacgactttgcggcgcactaccccttcgcgccctaccagttccagctcatccagaagatcttcgaggccatccgcaagcacggggccaccggggcccacctttcccggggcgagcgctccatcctggatgccttccagtccgccgccaagcaggtggccgagcaggaactgggggtgctggtgcccctctaccgcttctacccctccatcgaaagcttcctggatacggcggtgaagcgcaccatcgaccaggccaaggataacgaggccctccagcccttcgatgtcctcctgctccaggtcctcttcctcatccgctacgtggaggagatgaaggccgatgtggataacctggcctccctctgcgccgaggagatcgatcaggaccgcatccccctcaagcgccgcattgaggagagccttgcccggctggaaaaggagaccctgatcagccgcaacggcgagatctacttcttcctcaccaacgaagagcgggatatcaaccgcgaaatcaagaatgtggatgtcagctcctccgaggaggccaccaccctgggcaagctgatcttcgaggatgtctacaaggacaacaagaagttcacccatctccggaccaagcgccctttcgtcttcaaccgcgagtgtgaccagcacgccatcgggcacaaggccgaggccggtttgccggtcctggtgatcacgcccctggcggatgactacgacacctgggacaagggccgctgtctggccgagagtgccgcccgggatggcggggccgtggtgatcaagctgggggataccttcggcaagcttcagcaggagctgcgcatgtgcctccaggtggagcgctacaattcgcagaagaatgatggcaccctgcctcccgccaccctccgcatcctgcaagacctggccgccgagaaccgtaagcgccgggagcgcctggtggtcgaagtgggcaggctcctcgaagaagccgatacctatgtggcgggccagcccttggccctcaagaagagcggcccccaggactgcctcttcgaggccctgggctacctcgtggacaacaccttcaccaaaatgggctatctccacaagcgtggggaaggggacaccagccagaccgtcctgcgggagatccaggcggtgttgcgggccaatgatgtggcccaggctcgactcggcatcgaagaggaggagagcaatccccaggccatcaaggagctgcgggactacctctaccttatgaacgtgaggagcacccaggtggtgctgcacgatctggtggagacccgcttctcccgccgtccctatggctggcccgaggaggagaccctcctcctcgtggcccgcctcctggtgctgggggagatccaccttgtcatggacggggcctccctggccctggacaaggtctttgaggccatcaccaatgcccagaagcgccggaagatcaccctggtgcagcgcaaggccctggatcccaaggccatccagacggcgcgccagttgggcaaagatgtcttcgctcagatggggcccgatggcgaggatcccatcgtggccttcctgcgcagcaagctggagggctggcaggatgaactgaagcgcttccagggcctggaagggagcggctaccccggcaaggccgaggtggagcaccttctgaagctggtgaagcctctgttggccgaaaaggagggcgcggccttcctggaggccttcagcgccgccaagaacgatctgttggatggaggagaggacttccacaccctcagtcacttcttcggctcccagcgcccaacctgggaccggatgcgcaaggcctatggcaagttcgagctgaaccgtctccagatcgaagaggaggaagccgggaaggtcgctttgcggcgcctgaaggagatcctccagatggcccacccctacaccagcatcatggaggggccggatctcatcgccaaattggagggcatccagaacctcctggtggcccagcatcgccagcagaccaagggtaagattgctgggttgctgaccagcctgggccaggatgcggagcgcctccatgtttctggcagcgtgtttgaaggctgtgtggcggcgctaaaggggctgctggatcgcatggatcgccaggagagcatcccccacctcaagcaggctgtggaggaggcggaccaactctacggcgaggccctgcaccggctggaggcggcctatgagccgccagcccccattgtcacccccgttggcgagcccaaaatcgacatcccgccccaacccaagcccgtgatcaagaagccccgcgtggtgaagcctgcggaactggcacccaatggtgtgctggaaaaccaggaagaggtggatgcgtttctggtgaccctgaggacgcagcttgaggcggcgttggcgaaccatgagcggatacagatccggtaa

SEQ ID NO: 247 - DNA, 3642 bp, Escherichia coli; identical to SEQ ID NO: 236

SEQ ID NO: 248 - DNA, 3645 bp, Oribacterium sp.
atgcagattaaagagatgttcaaaaagtctattacaagagatatccaaggtgttgtaattgccggacaaggggaaaaaaacaatattgcgacagagttggaagagtatgttgtgacacctgagttgcagcgtcatttcgcagatttcttttctgcatatgctaaaggagttaatggcgagaccacaaagatgggagtctggatctccggcttttttggaagtggtaaatctcactttctaaaaatcttatcgtatattctggataatgaaatcatcgggagcaagcatgctatcgattattttttttacgataaaaagatttctgatccaatggtgcttgcggatatgcaattagcagcaaacacgcctgcagatatcatcatcttcaacattgacgcgaagagcgaggctgatggaaagtccaataaagatgcgatagtaaatgtattcctaaaggtatttaataattctctgggcttttgtggagcaattccctatttagcagacttggagcgtaagcttagcgaggatggaaaatacgaagaatttaaagagacgtaccaaaaagtgactggccatgactggtattcggaacgccatgaattcctttctcggcaggatggcgttgttgataccttaatcgagatgggctacatgagcgagaaagcagcttggaactggtgtgatgctgctattggggattatcagatcagtattgaggattttgcaaagcgtgtgaaatcctatatcgaccgaaaaggcaataatcaccatgtagtatttctcgttgatgaaattggtcaatacattggagatgattccaagcttatgttaaatcttcagaccgtgacggaggaattagggaaagagtgtaagggtaaggcttgggtcattgtgaccagccagcaggatattgattccatcaccaaagtgaaagggaatgacttttctaagattcagggacgctttgatactcgtttgtctctgtcctctgcgaatgtcgataccgtcatcaagaaaagaatcctggacaagaccgatactgctgcacagacacttcgcctcttgtatgagcagaaagctacgatcatcaaaaatttgatcgtctttaatgatggagtagagaagaagctgtatggaagcgatagagactttgcagaagtttatccctttattccgtatcaattcaacctgctggcaagtgtacttacctccattcgtacgcacggggcatccggaaagcacttgtctgaaggagagcgttccatgctggcgctatttaaagaatctgcgatggcacttaaggatgaagaggcaggagcaattgtgccttttcatcggttttatgatgcattggaaaattttctggatcacagccataagggcgttatcatcaaagcctacgacaacagctatatcaatccggaccataaggaaaaagatgtttttgctattaatgtgctgaagactttgttcatgattaagtatgttctggaaattgagtctaacattgataacattaccagtttaatggtcgataacattgatgatgatcgcattgctgtgaagagcagagtagaagaagcgctgaaggttcttatgcgacagatgctggtgcagaagaatggctccaattatgttttcctgaccgatgaagagcaggaaattaatcgtgagattgacagccagaatgtagagatagcggaagtcattaacaaagtatctgagatgatctttgaagatattttcacagataaaaaatatcgctatccagccttcaatgggcgatattcctttagtttcaatcaggctgtagatgacagaccatacaaggcaagccagaactatgatatcggtgttcgtatcctgacaccctggtacgaggggggaaatgatgatcttacccttcgtatgatgtccggacagaagaacgaagtcttgctgtcactaccaaacgatgctgcattcttggaggaaattcggcagtacctaaagattgagaaattcctacggcttaatacctctacacagcttgcaaagtacgaaaccatcaaagaagcaaagcgtgtagaaatgcgtgagaggaatgccaatgcaaaactctatctgacagagtgcatgaaagaagcgaccatttatgtgaatggcgatgttccccgtatttctggaaaggaagtatccaccagaatttcggaagcgatggggaagctggtgcagacggtttataataagctgtcgtatattacggctgctatgggagaaatggaaattcgaaagatgttccattcttctaaccagatgaatttgggcttagatgacgcagaagcaaacatccatgcactggatgatgtattacaatttatcgcatcgaatacccgtatacatataaaaacctctatgaagacggtgaaggaccgtttcatgaaggctccttatggatttgtggaagacgatgtgcattggcttgtggcaaggctatttaaacgaggggatcttgcctttactatgaacggagtaagcgttaaccagaataataaaactgaagaagaattgatcgatttcatcacgaaaaaagcatttgttgagaagctccttatggaagagcgaattcgtgtaaatgaaaaagataagaaagctgtccgcgatatcatgaaggaactctttggtgtttccagcagtgcagaagatgaagacagtatcatgaagaattttcagaaatatgcgcagaatatgattaatgagattctccgtctagaaccagagtacaagaaatatgccacctatcccggcgagaaagttttgcactccggaaagatcttacttgaagaggtaatgcagatacaatctcccttagagtttttccagcaagtatctaaaaagcaggattacttctatgattttgcggaagattttgagccggtgaagattttcttttcaggagagcaacagaaaatctttgccagagcactggatatgctggcaatttacgatgatagcaagacatatatcgtggatgaggccttggagaaaattgttgctgacatgcggcacatcgtaagacaagacaaaccctatcaaaatattccgaagcttccggagcttcgtagccagtttaatgaggcttatggaaagatactgtcgcaggaagaagaacctgtgttggatgctattcatcatgcaagagaacgtgtgctggaggttctgaatacaaaggaatatgctgcgtcaaagaagaaaaaatatctagacctctttaaagaaattcaggatggagcagaaaaatgtaataatgtatcttctctaagaagttttgcagataaagcggatgctcttaagattcgcctcatgaacgaaatggatgcgcttgaccgtcaaattgcggaagaaaaatcgttgatagccaagaaagaagcggaggaggctgctcaaaaagcaaaagaggaaggaagagctgttccaatccatgtagcagaagaaaaagctacttacctgaagaatacgaagaatgtgacaattaaaaacatgacgaggacctcttcctggaggttagagaatgagcaggatgtagaccagtatcttgctaaacttagacaggttctactggaagaattggaagagagtgatattgttaatgttgagttttaa

SEQ ID NO: 249 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagtctttaacgaacgtattggatactgcgctgattttccgcatattgcccatcttgagcgcgagctggataaacgcggtcagtatgaaacctttaaagccgcgtttgccgatatcaatggctcgcgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattactgaaaaccttggggtaatctgcggtggccgcgcatgggttatcgtgacttcgcaggccgatattaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtaccgtggcactatcagattctgcaaaaagtgtttgaatctattcggacgaaaggtgcagcgggtaaacaattggccatgggtgagcgttctcagctggaggcattccagactgcggcgcagcaaatctcagcgcaagggctggattctctggtgcctttctggcgcttctatgccgccattgagagcttcctggagcctgccgttagccgcaccatcactcaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggtgcagtgcttaacgatctggtggtgaagatcctgacccctaaagatccgacctattcgttctataacagcgatgcgacctgtcgcccttatacgtcagaaggcgacggctgtattttgattcgtctgccggaagagggccgtacctggagcgatattgatttagtcgttcagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaatattgtcgatgaagcctgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcacgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgctatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaaagagattgaatccggtctgcgcctgcttaatgccattcttaatgagaaagaagattttgccctgatcgaaaaagtgtcatcgctgaaagatgaacttctggatttcagcgaagatcgtgaagatttggtcgacttctaccgtaagcaattcgccacctggcaaaaactgggtgctgcgctgaatggcagctttcaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagagctgcaaaacagcgttctgctgccgatgcaaaaagccagaaaacgcgctgaagtcagccagtcaattccggaaattttggcggaacagcaagagacaaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgccattaaagcaggcgatcgcattcgccttcagtaa

SEQ ID NO: 250 - DNA, 3681 bp, Acinetobacter johnsonii
atgaatattaaagaacttttttacaagccattagatcgtgcaattaacggggtggtgaaggcagatcaggatgataatgccacggtttaccaggagctggatgagtacgtggtcaccaatgagctggaaaagcattttcgggactttttccagtcctatggtacagacctcagcgacccttcgattgccaatcgtgtcggcgtgtggatttctggcttctttggttcaggtaaatcgcattttctgaaaaccttgtcctatattctggccaataaagtggcaagcgatgctgaaggtaaggaacgtagcgcagccgagttctttgatgaatctaaaatccgtgatgcgtttatccgtgccgatattggcaaggccgtcagccatcatgccgatgtcatcctgtttaacatcgacagtaaagccagttccaatgacgatggcaatccgattctgaatgtgtttttacgcgtgtttaacgagtatcagggttttagtgctgaccatccacatattgcccatatggaacgtcacctgagccagaaaggggtgtatgagcgctttaaacaagcctttgaagaatccagcggcatgtcatggttggaagaacgtgatggctatcagttctatcaggatgatgtcgaaaccgcgatttcccaagccctcaacttatctgctgaagctgcgcataaatggtttgaggattctgagcagacttttagtgtttcggttgaaaacttctgtcagtgggtgaaagaatacctggacagcaaaggaccccagcaacgcatgttgttcttggtcgatgaagtggggcagtttattggcagcgatacccgcttgatgctgacattgcaaaccattactgaaaacctgggtacgatctgtaaaggccgtgcttggattatcgtgacctcacaggcagacatcgatgctgttttaggtgagatgtcttcttccaaagccaatgacttctccaagattgctgggcgttttaaaacccgtttatcactgtccagttccaataccgatgaagtcatccagaaacgtttattacgtaaaaccccagaagcagaagcattgctcagatcggtgtttgagcaaaagggcgatatcttaaaaaatcagattacctttgaccgttcaggcccaaccctcaagaactatgaggggccagatagctttattcataactatccttttgcgccgtaccatttccagctggtacaaaaagtatttgaagaaatccgtaaagtcggtgcgactggtgcacatctggcctatggtgaacgatctatgctagatgcattccagatggccgcgaatgcgattgccacagatgaagtcggtgccctggttcctttccaccgcttctatacttcagtcgaaggcttcctggatacagcagtgaagcgtaccatcgaccaggcagggcagaataagaccctggatggttttgatgtgcagatgctgcgtaccctgttcatgatccgctatgtcgatatcatcaaaggtacgctagataacctggtgactttgtcgattgagaaaattgatgaagataagctggcattgcgtaagcggattgaagagagcctgcagcgtctggaaaaagagagcctgattacgaggaatggcgatgagttcctgttcctgaccaatgaagagcgggatatcacccgcaaaattaaagccactgacttagcagcttcagaagaaaataaagagttagccaatctgatctttaaagatttactgcgcgatcagaacaaataccgccatcaagccaacaagatggactatcagattggtcgtttcctagatagccatagcctggatggcaagtatgagagcgatttgaaagttgaaatcatttctccgctggatacggaatacaacctctacactgaagcttactgtattggtaaaagtactcaggccgaaggacaagtgctgtttaaactggcagacgataaacagttctttaatgaactgcgcacctggctgaaaaccaataaattcatccgcttaaatgatgatggcactcagtccgatatttcccgtattctggcagaccgtggccgtgagaatcaggagcgtaaaaaacgcctgcgtgcccgggtcgaagaaatgttgctggacgcggaaagttatgccttgggtcaacatctacaactttcatcttcaagtccaaccaccaagctggatgaggcttgtcgttatttgctggaaaacacctataccaaactgagctatttgcaggtctatcagcaggatgcctggcgtgaactgaacgccgtcttgactgtggatgatatggcgcagctcggattgtctctggatggcggacagagcaatccgaaagccctacaggaagtggagcagtacattgcactacgggccaccggtacagagcgtattctagtctcagatgtgatagatcgttttgccaaacgtccttatggctggccggatgccgagattttactgctggtggggcagttggcggcaatggggcgggtttcactgcagctaaatggcggcagcttgcagctgaaagaggcctttgagcctttacaaaacagtcgccgtcgccgtgatgtttccattattaaaaagcgccagactgatgatcaggtgttgaaacaggcacgccaactcacccaagacctattctcggccatgggaccagcgactgaaaaagagctatttgaattctatacccaacattttaaaaactggttagccaactttaaatcgtataagagtaaaactgatgttgggcagttcccgggcaagaaagtgattgaaaagtcgattctgactttggagcgcttgctggccaatagcgacagcttcgatttctttaaagccgtggttgagaacaaggacgactatctggatctggaagaagactatcgtgacattcacgagttcttcagtaaccaaatgccaagctggcagcaactgcaacatgccttacgtcattttgagaagaacaaacaggcactgggtagtgatgaggtagctaaaaaagccctctctgaattacatcgtattttcactcttgaatcgccctatggcctgttaaataaagtggctgatttggttcgcacagtggaaagcgtcaatgagcaattgctgactgagaagcgtaatcaggcgatagaacaccttgatgacaagatcaagcagttagaagccgagatcaaaaacagtggcatcgctagcgctgagctgagtaacaagctattacgcccactacaactgctgaaaacggatattgaagtggaaactagcctgtccaccatctatatgctgcaaacccaaaccagcgtcgagcgttttgatgaagccttatatgagttggaaagcgaagttcaggcggaaatccagcgtcaggccaaagcggcacaactggctcagagcaaagccgagagtataaccaacactgcaaccacctccagcccagctacatcaacacctgctgcgagtccagtacagcctgcgacagccgtagtgccaccgaaacctgttgtcgaagttgatgtcgccagcatttacagcaaaacctccagtagtgtctacctggaaacagaagaatcagtggatcagtttgtagacgcactcaaagctgaattgaaaaaaattgtgggtgacaaaaagcgtgtgcgtatccgctaa

SEQ ID NO: 251 - DNA, 3552 bp, Selenomonas sputigena
atgtgccttatgatgataaaaaacatgttcgccgaggacattgaccgcaaaatcaacggcgtagtcaaagttgagcaggatgaaagcgccattctcgtgcaggaactggatgaatatgtcatcacgaaggaactgaaaaagcactttatcgcttttttcaataactacggcgagtcctttgaagaaaatatctccgatattggcgtgtggatttccggcttctttggcagcggtaaatcccactttttgaaaatgctctcctatctcctggagaacaaagaagtgcagggcgtaaagaccgtggagcgtttccgtaagaaatttgaggacgacgccgccgcgttcatgccgattgacaaggtcacccgtggagaaacgcacaccattctcttcaatattgacgtgcaaagttccggacaaaaggacgaaacggctgttcttcgtgtatttgccaagatgttttatcactatctgggcttttacggtgaagatttgaaggtcgcaaaattggagcagtttatcgaaaaacaaggcaagaccgccgagttccgtcgggtattcgaggaaaagaacggcgcatcgtggctgtcctcccgtgattcctttgcgttctttgaggacgatgtggtcagcactctgacgcaagtcctcggcatgagtgagagtgccgctgaaaactggtttaacggcacacagaccgtggacatctccattgccaagctggtatccgagatcaaggaatattcggatgccaagcctcaggattttcggctgctctttatgattgatgaagtggggcagtatgttggcgatgacagaagtttgcttctcaatcttcagtcgctggtggaaacgatcggagctgagtgcaaaggaaaagtttgggtggtctgcaccgggcaggaagccatcgacgaggtcatcaaggcgcgggaaaatgagttctcccgcattcaggcgcgattcaagacgcgtctctccctctcctcagcctcggcggatgaggtgattcagaagcgtatcttgaagaaaacgccggacgcccaagaggagctggaatctctctatacgcaaaacgactccgtgctgaaaaacctcttcagcttcacggagtcggtgaaagatattcgcggctacaacggcgccgccgaatttgcccggaatttccccttcgtcccctatcagttcatcctcatgcagaaggtctttgccgaaatccgcaagcacggcaattccggcaaacatctctcgggcggcgaacgttccatgctctcgggctttcaggaggcggcgcagaaaatcgaagacaagaacgagtatgcccttgcgcctttctatcttttctatgacacagtgcataccttccttgacagttccattcgccaggtcatcgagcgggcagaacgggcagccgaggcaggacatggcctggaaatgcaggatgtggctgtgctgaaactcctctacctcgtgcgctatgtggacgatgtgaaagcgaccctcgacaatcttgttatccttatggcggataagatcagcctcgataaaatcgccgtgcgggagcgagtgggcgcgtcccttgagcggctcctcacgcagaactacatcggtcgcgcaggggaaatctatagcttcctcaccgacgaggaacaggatattcagcgcgacatttaccgcaataccgtcgtggataccgccgccgtcgtgtcccaaatcggcagcatgatttttggcgatatttatacagccaggaaatatcgctatggcggcaaatatgattttccccttgacgggatggtggataacactgtcgtaggcacagcgacgggcggcatgaaactcaaaatcctcaccgtagctgcagatgccgtcgaaaaaacagacctgcgtcttactgccgaatccgttgggcaggctttggtcgttctcgccgacacaccttactatcaatcccttgaaaacgccatgaaggtgcataagtacgtcaagcagaaaaatatgacgcagcttcctccgtcggtgcaggccatcatccgaagccatcaggaagaggcgcgaaagtacgagttggaagcaaaaaaagaactcgtcaaagccatagaaacggcggagttttatgtagacggagaacatctgctgctgaaaggcggcgatgccaaggggatgatcgaccaggcgctggagtatctcgtcgaccatgtctacagcgatctttctctgattcgtaaaaatgcggacagcgaggcggatatttcctccatcctgcgcggtacggagcagaccctcttcggcacgggagcgaacagcgaagccgctgtcaaggtggaggaatatctggagatacagcacgccaaaaaactgcgcacctcgatgcaggacatccagagtcgctataaggggattccctacggttggaaggaattggacatcgcctgtgtggtggcgcagctcatccacgagcagaaggtcaccgtgaaatatggcggcagtaccatccagccgaatgatccgaaactccctcagatgcttcataagaagagtgagatcggcagcactatcgtttcgaagcgccagacggtatctcttgccaaaatccgcgaagtccgagagttcctgcgcgattacttcgatgagatggacgtgcccgaggacgaggatgggctgatccgccacatcacagtccgattcgagggggaaaaggcgcggtatgaaaacctcctcgccctctatgcggggcgcaaataccccgataaactcctggtttcttcggcggtagatgccatgaaggagcttctctcgcacgccaaggacaatatggcgctcattgactacgtaatcaaaaagcaggatgcgatctgtgatctgaaagaacaggtacagaatgtcgaatccttcttcagcaatcagaaagcgctttttgacgaggcggtgaagtacgaggaagcgctccaacacgaccttgaatacatcgctaaggataaagaggcagagaaggcgctcaacacgattcgtctcattaccttgattccggacggcggcggtttcaactataggcggctgccggagctgaacgacctgctggcgaaggtacatgccaagcatgatgccatgttggaggaaaaacggcaggaacttctgaagattgtcgatgattgcctggaagaaatccgcgccaaagccaagaccgagagcaaggcgagggacatccttcaacaagaagagggctatttcgctcgcaagaaagagtatatcgctggcatccgggtgctgaccctcatggacgggcaaatgcccaatatttggctgcgcaaggacgaggctatatctcgcatcgagaacctctgcaaagaggatgacaagcgggaagaagaacagaaaccatcggttacggcaggcaaaaagccgaagaaaatcatcaaatcggtctatcgtcagtcgatgttccccaagcgcacgatcgaaacggatgcggacattgacgaatatgtggaacatatccggcggcgcatgaaaaccatgctgaaggactgcgacggcatccgactcgattag

SEQ ID NO: 252 - DNA, 3681 bp, Acinetobacter junii
atgaacattaaagaacttttttacaagccattagatcgtgcgataaacggggtggtcaaggcagaccagaatgacaataccacggtttaccaggaactcgatgaatacgtggtcaccaatgagctggaaaagcattttcgtgactttttccagtcttatggtacagacctaagcgatccttcgattgccaaccgagtcggtgtgtggatttcaggcttctttggttcaggtaaatcacatttcctgaaaaccttgtcgtatattctggccaataaagtggcacgtgacgcggaaggtaacgaacgcagtgctgcagaattctttgatgaaagcaaaatccgtgatgcgtttatccgggcagatattggcaaggccgttagccatcatgccgatgtcatcctatttaacatcgacagtaaagccagttcaaatgatgacggcaatccgattctgaatgtgtttttacgcgtgtttaacgagtatcagggttttagtgctgaccatccacatattgcgcatatggaacgtcacctgagccagaaaggggtgtatgagcgctttaaacaggcttttgaagaatctagcggcatgtcttggctagaagaacgtgacggctatcagttctatcaggatgatgtcgaaaccgcgatttcccaagccctcaacttatcagcagaagctgcgcataaatggtttgaggattctgagcagacctttagtgtttcggttgaaaacttctgtcagtgggtgaaagaatacctggacagcaaaggaccccagcaacgcatgttgttcttggtcgatgaagtggggcagtttattggcagcgatacccgcttgatgctgacattgcaaaccattactgaaaacctgggtacgatctgtaaaggccgcgcttggattatcgtcacctcacaggcagacatcgatgctgttttaggtgagatgtcttcttccaaagccaatgacttctccaagattgctggacgttttaaaacccgtttatcactgtccagttccaataccgatgaagtcatccagaaacgtttattacgcaaaaccccagaagcagaagcattgctcagatcggtgtttgagcaaaagggcgatatcttaaaaaatcagattacctttgaccgttcaggtccaaccctcaagaactatgaggggccagaaagttttattcataactatccttttgcgccgtaccatttccagctggtgcaaaaagtatttgaagaaatccgtaaagtcggtgcgaccggtgcacatctggcctatggtgaacggtccatgctggatgcgttccagatggccgcgaatgcgattgccacagatgaagtcggggcactggttcctttccaccgcttctatacttcagttgaaggcttcctagatacagcagtgaagcgtaccatcgaccaggcagggcagaacaagaccctggatggttttgatgtgcagatgctgcgtaccctgttcatgatccgctatgtcgatatcatcaaaggtacgttggataacctggtgactttgtcgattgagaaaattgatgaagacaagctggcattgcgcaagcggattgaagaaagcctgcagcgtctggaaaaagagagcctgatcactaggaatggtgatgagttcctgttcctgaccaatgaagaacgcgatatcacccgtaaaattaaagccacagacttagcggcttcagaagaaaataaagaattagccaatctaatctttaaagatttactgcgcgatcagaacaaataccgccatcaagccaacaagatggactatcagattggacgttttctggatggtcatagcctggatggcaagtatgagagcgatttgaaagttgaaatcatttctccactggatacggaatacaacctctacactgaagctttctgtattggtaaaagtactcaggctgaaggacaagtgctgtttaaactggcagacgataaacagttctttaatgaactgcgcacctggctgaaaaccaataaattcatccgcttaaatgatgatggcactcagtccgatatcacccgtattctggcagaccgtggccgtgagaatcaggagcgtaaaaaacgtctgcgtgtccggatcgaagaaatgttgctggacgcggaaagttatgccttgggtcaacatttacaactttcatcttcaagtccaaccaccaagctggatgaggcttgtcgttatttgctagaaaacacttataccaaactgagctatctgcaagtctatcagcaggatgcctggcgtgaactgaacgctgttttgactgtggatgatatggcccagttaggcctgtcactgaatggtgggcagagtaatccgaaagccctacaagaagtggaacagtacattgcgctgcgggcaacaggtacagaacgtattttggtctcggatgtggtggatcgttttgccaaacgtccttatggctggccagataccgagattttactgttggtgggtcagctggctgcgatggggtggatttctctgcagttaaatggcggcagcttacagttaaaagatgcctttgagcctttacaaaacagccgccgtcgccgtgatgtgtcgatcattaaaaaacgccagactgatgatcaggtgttgaaacaggcacgccaactcacccaagacctattctcggctatgggaccagcgacagaaaaagagctgtttgaattctatacccaacattttaaaaactggttagccaactttaagtcgtataagagtaaaactgatgttgggcagttcccgggcaagaaagtgattgaaaagtcgattctgactttggaacgtctgctggcaaatagcgacagctttgatttctttaaggccgtggtcgagaacaaggacgactatctggatctggaagaagattatcgtgatattcatgagttcttcaccaaccagatgccgagctggcagcaactgcaacaggccttacgtcattttgagaaaaacaaacaggcgctgggcagtgatgatgtggcaaaaaaagccctctctgaattacatcgtattgccaccctcgaatcgccttatggcctgttaaataaaatcgctgatttggttcgcactgtggaaagcgtcaatgagcgactgttgagtgagaagcgcaatcaggcgatagaacacattgatgacaagatcaaacagttagaagccgagattaaaaacagtggcatcgctaccgctgagctgagtaacaagctattacgcccactacaactgctgaaaacggatattgaagtggaaactagcctgtccaccatctatatgttgcaaactcaaaccgccgtggagcgttttgatgaagccttgtatgagttggaaagcgaagttcagacggaaatccagcgtcaggccaaagcggcacaactggctcagagcaaagcagagagtgtaaccaacactgcaaccacctccagcccagttacatcaacacctgctgtgagtccggtacagcctgcgacagccgtagtgccaccgaaaccagtggtagaagttgatgtcgctagcatttacagcaaaacctccagcagtgtctatctggaaacagaagaatcagtggatcagtttgtagacgcactcaaagctgaattgaaaaaaattgtgagtgataaaaagcgtgtgcgtatccgctaa

SEQ ID NO: 253 - DNA, 3690 bp, Shewanella baltica
atgaagattgaacagattttttccaagaagttaatgcgtaacattaacggtgttgtaaaagccgagcaaaaagacaatgagagcgtatgtgtagagcttgatgagtatgtggtgacgagagaattagaccgtcattttcgagcgttctttgaagcatatgtaccttcagttactcatccagactctgacatgtcaggtaaaattggtgtgtggatttctggcttctttggatcaggtaaatcacactttctgaaaattttatcttaccttcttgagaataaatctgtcgaaaaggatggccaagttcgtcaagcgttcgagtttttcaaagacaagatcaatgactccatgcttttagccgatatccgaaatgctgttactaaggatacggatgttatcctctttaacatcgattcgcgagcgaatacggatgacagagaaaatgctattctcaaggtcttccttaaagtgttcaacgagcgtgttggttactgtgctgacttcccgcatattgcgcatttagagcgagagcttgataagcgtaatcaatacgtagcatttaaagacaagtttgctgagctaactcaatcaacttgggaaaaagagcgtgacgcctatgacttctatagagacgaactttcagaagcactcgctcatgctagtgagcaatcattagagtctgccaaggcttgggttgagcaggttgaaaacaatttcccgctagatattcgaaacttctgtaagtgggttaatgaatacttagaacttactggggatcgaaatcttctctttttagtcgatgaagttggtcagtttatcggtaagaacacccaaatgatgttgaagcttcagacaattaccgaagatctcggcacttattgtggtggtcgagcatgggtcgttgttacctctcaggccgatattgatgccgccattggtggcatggacaagcgtgatggagaggacttttctaaaattcagggccgttttagcacccgcttacagctgtcgagctcgaatacctcggaagttattcagaagcgtctgttgtccaaaacggaagaggctcgtacatacctaattgatgtctttgctgaaaagggagatattcttcgtaaccagctgacatttgataaaacaacgacagtgtcacttaaaggttatatcgacgctccatcttttgtggataactatccgttcgttccttaccactacacgctggtacaaaaagtatttgagtcgattcgaactaaaggggctacaggtaagcacttagcaatgggcgagcgttctttactagatgccttccaatcagctgcaaagcagatgaaagactctggattagatgtactagtcccattttatagcttctatgcaccgattgagagcttcttggagccagcggttaagcgaacgattgaccaagcctgtgaattggattctttgaccgaatttgacggaaaaattttaaaaacactcttcttgatccgttatgtagatgttgtcaaaagtacactagacaaccttgttacgctgtcgattgatcgtattgacgcggataaaatttcactgcgtaaacaaattgaagaaagtttgaaccgcttagagcgtcaattactaatttcccgcaatagtgatgtatatgtattcttaactaatgaagaaaaagagattgagaacgagatccgacacactgacgtcgaaatgtcagaggtctctaacaagctttcggctatcgtctttgacggtattttgaaaggtaatcgtgcttatcgttacccgattaataagcaagactttgcggtgagccgtttttgtaatggtcatccgaaagacggcaccacgctagaagacctagtcatcaaagtcatttcacctttggattcgcactttgaaaattactcccatgaccaagcgtgcatcaatcatacgcttgaggcagacggatgcgtgctggtcaaattgggcgaacataagcgtctttgggatgacctgacaacctttattaaaactgaccgattcttaaaacaaaattcaggacaacgtccagaacaggaacatctgctgcgcgagaagcagatggaaaatattgagcgtgaaaaacgcctgagaaccgattttgaagccttgtttgcagaggcagacgtttacgcgattggaacgaaactaccgaagaaatcagcgacgccaagtgccatagtcgaagaggcatacaaatacgttatcgagaacaccttcgctaaattgaacatgctcaaggcgacgactggagaagtattgcgagagctacaagctgtactcgttgctgatgatattgctcaaattggactggaccttcaggcggatgaatgcaacccagaagctacgcgtgaggttgagcagtacgttacgctaaaagtcgagcgtaatgagcccgtgtacttacgtgacatcgttgcacgctttggcaaacgcccgtatggctggccagacaatgaaatcttattgctcacagcaaggcttggcttggctggaaaggtatcctttagtactcagggtacagatctggcgttgaaaaaagcttacgagccgtttaccagtgtgcgtaaacgcggcgagatccgtgtacataagatcaggcaacatgacgagcgccaaattaaaaaggctgctggtcttgttaaagagatcttttctaaaacctttaccggctctggtgaaaaagagctctacgaattagtgcgcgatgaattactggcttggaatgaagagcttaaatcattccgaaccgtgattaatacaggggggcagacgggccatttcccaggcaaatctcaaattgatgatggccttgcgttggtcgctggcattctggagcaaacatcaagcttcgcccttatcgctcgattcctagaagacgcagatgcccttgtagagtttgctgaggactttgagaatcttgatgacttctacaatagccaatttcaaacttggcaagcccttgctggcgcattaaacgagaagtttaaggccaatagacccgcgttagaaaaagacagtgaagcattaaaagggctcattgaattagaacgcatctacaatatgccctcaccgtatgagcagctgcgtcacattaacccgcttattgagcaggtggcaaaagtaaactcaacattggttgaagaaaagcgcacacatgccttagggcgtgttgatcagcgtatcggtcgtgtaaaagaagcgctaactgaagcttatgctccgtctgagctacagaaccaggcgctacgcccgttgcaaatgtgcagacagcgcattgtggcaacatcttcaataccacaaattataagtgagcaaactgaagctgaaggttacgaggacgaagcctatgagttgctgaatggctttatcgaagagcaacgcaaaaaagctgaagctgagcaacgacgtcgtgaactcgaacagaagaaacgcgaagaggaagcaacgaaagccggtaaggaagctccagcacctgagcctgcacctgaaccagtgccaccaaagccagttgcaaaacgtaccgtaaccattaacccaacagatgctgtggcaaagtcagtaacaaccggattcattgaaagtgaagccgaagttgatgcctatcttgccgttttgagagagcagctgattgctgctgtcaaagctggtgaccgagtaagaattaagtaa

SEQ ID NO: 254 - DNA, 3456 bp, Vibrio cholerae; identical to SEQ ID NO: 239

SEQ ID NO: 255 - DNA, 3642 bp, Escherichia coli; identical to SEQ ID NO: 56

SEQ ID NO: 256 - DNA, 3693 bp, Halomonas sp.
atgcgcattcaagagcttttcctcaagccgctcaaccggtcaatcaatggcgttgtaaaggctgatcagcgtgaccaggaaactatctaccaagagctagatgagtacgtggtcaccaatgagttagaaaagcactttcgcgccttttttgaatcctacaccaccccgctagacgacccctccatcgccaaccgcgtgggcgtctgggttagcggtttctttgggtcgggtaaatcccactttttgaaaacgctctcttatctgctggaaaataccgaagcttttgatgccaacggccatgccaagcgggcggcggatttctttgacgagcagaagctggtggacagctccatacgggctgatatcaccaacgcggtacgcgaacccgcccatgtggtgctattcaacatcgacagtaaggccagctctaacgacgatggcaaccccatcctcaacgtctttctgcgcgtatttaacgagtaccaaggctttagctcggattacccgcacattgcccacatggagcgccacttagaaaagcggggcgtgtatgagcccttcaagcaggcgtttaatgacgccagcggcatggcgtgggaagaggagcgggacggctatcagttctaccaagatgacatcgagcaagcgattagcgttgcgttagagctttccccggaagctgcccataaatggtttgaagagtcagaagccaattttagtgtttcagtggaaaacttctgccactgggtgaaagagtttttggaatcccaatcatccacccggcgcatggtgtttatggtggacgaagtcggccagtttattggcagcgacacccgccttatgctcaccctgcaaacgctcaccgaaaacctgggcacgatttgcggtggtcgcgcttggattgtggtgacgtctcaggcggatatggacgcagtgctaggcgaaatgaccgcctcaaaagccaacgatttctctaagatcgccggacgcttcaaaacccgcttatcgctctcaagctccaactctgacgaagtcatccgcaagcgcctgctggtgaaaaccgacccggcacgcgctgagctggaaggtgtgtttgaagccaaaggctctatcctgcgtaaccagctgacctttgatcgttccggccccacgctgaaaaacattgaaggcgtggatagctttatcgccaattatcccttcgtgccgtaccacttccaactggtacaaaaagtcttcgaagagatccgcaaggtaggtgccaccggcgcgcatctcgcttatggtgagcgctcaatgctcgatgctttccacatggccgccaaagccgtgcaagaaaaatcgattggcgcgctggtgccgatgcactgcttttatacggcgatagaaggcttccttgatacggccgtaaaacgcaccatcgaccaggccagcgaaaaccccgtgttagaggcgtttgatgtcgaaacgctgcgcacgctgtttatgatccgctatgtggatcttgtcaaaggcacggtcgacaacctcgttacgctatcgctgactcaaattgacgacgaccgaattgctattcgtgagcaattagacgcgaccttagcgcgactagaaaaagagagcctgattacgcgtaatggcgatgaatatcagttcctcaccaatgaagagcgcgacattacccgcaagatcaaagccaccgaagtcaccagtagcgatgagaacaaagagctctccagcctaatttttaaagacctgttgcgtgatcgcgccaaataccgctacccgttgaacaaaaccgactacagcattggccgctacctggatggtcacacactagatggtcgctaccagagtcagctaagggtagaggtggtgtcacccttagacgtggagtacgtgcagcttagcgacgcgggctgtattcacaaaagcggcgacaatggcgggcaggtgctgattaagctacccgacgataagcgctttaccgacgaactgcgtacgctgttaaaaaccgacaagttcatccgcttgaacctatcggccaacgaccacagcgtcgagcgcattctggccgaccgtggccgggaaaaccaagagcgtaaaaaacgcctacgtgttcgtctggaagaaatgctattagatgcagacgcctatgcgcttggccaaaagctggaactcaaccgcagccagttaagcacccgcctggatgaagcttgccgctacctgctggaaaacacctacaacaagctgggccagctgacggtgcttaacccagagcctatgcgtgaactgcaagccgtgttaacagctgatgatatcggtacgcaaaatcttaacttagacggggaggagggcaacgcccaggcagtaaaagaggtggagcagtatatctcgctgcacagcggcgagccggtgccgcttaacccgcttatcgaacgttttagtaaccgacctttcggctggccggaaggcgaaacgttgctgattctaggccgcctacataccgctggccgtttgaccttccacaccgcaggccccgcgctcagcggtaaagaagccttcgagctgcttaataacgcccgccggcgcagtgaagtgcgcattcagaaaaagcgccaaactgaagatgcagtgctgaacaaagcccgcaacctcaccaaagacctgtttggccagctaggccccgcaagcgaaaaagagctattcagctactatgtggatcgcttatcccgctggcgccgcgagctagaagcgtacaaaagcaaaaccgacgtgggcaatttcccagggcgaaaagccattgaaagctcgctgctggaagtagagcggctattgcgcttagacgacagtttcgacttctttaaggcagtggccagccagcaagacacgctgctcgatttagaagaagactaccgcgacctaagcgacttcttcaccaagcagctcaccacctggcagcagctggaacaggcgcgcgtaaggtttggggttaaccacctggagctagaaaaacaccccgaggcccagcaggcactggccgagtgtgagtgcatttatagcgccgatgccccctacgccatgttgaacaaagtagatggcctggtgcgaacgttggatgacattaatacccgcttggtcaccgaaaaacgcgaacacgccattgcacgtatcgacacgcgcatcgccaaggtgagcgctgaaattgccaaaagtggtattggcaacgccgaactcagcaaccgcttgttgcacccgctgcagcagctcaaagcgtcggtcaatcagtcggtcagcatcgcccagatctaccaactgcaaacagaaacggccgttgagcaagaagaagagagcctggatgcgcttcacaacgcccaggctgaggtagccaagcggcagccgcccgcgcctacgcctgctggaggcgactccaccgcgccgacggccaccccaggcagccaaccgcccgcagggcacacggcggcaagagataaaacttacgatccccacaccgcaacagccccagcagcagtcaatgcccccaaacccgtggcaagggttcgcgtcagcgacgtactcagccgcgtgcatagcggtgtgtacctggaaagccaagcggaagtggatgcgtttatggaagagctgagaaaagagctggaagggtcgctttcagcgggcaagcgggtacaggtgcggtag

SEQ ID NO: 257 - DNA, 3657 bp, Bifidobacterium angulatum
atgaacggggaaagcgctatcagcttcaaggagttgttcagcaaagacattgaccgcaatatcaatggtgtgatcaaggccaatgatgagaagaaccttgacgatgaggtcaacgagtatgtgcttacggaggagatttgccgcaatctggccaaattccttgacgcatacaacgacccgtcgaaccacgaacagaacggtgcatggatctccggtttcttcggttctggtaaatcgcacctgttgaagatgctgtcgcatattctgggcgaggtcccggctgaactcgttgacaagggcaataagccgaccatgagtcgcgaacagattgttcatgccttcatgggcaaggccgaagcacaggatgaccagatgcttgcaggccagcttgaaaaggctttgacgataccagccacgtcgattctattcaacatcgatcagaaggcggataaatccaatgcctccgacatgctgctgtacgcttttgtccgcgtattcgatgaggcgcgtggtttctacggcaagaatccatacgttgcgaaattcgaacgcgatttggcgagcaatggttatttcgaggatttcaaacaagagttcgagcaggtggctggcaaaccatggagcgaaggccgtggtgaggccgtgctatgggatgatgagatctgcgaagcctatgccgcggtgacgggcaagccggagcaggatagcatcatccagcgctatgaggatacgtatacgatgacggtcggcgatttcgcagacgacgtgaacgcatggctgtcccatcaggaaccgaaccgccgcatcctgttcctcgtggacgaggttggccagtttatcggtgagaacagggagctcatgctgtccctgcaatctattgccgaggatcttgccgttaagaccaacgggcgtgcgtgggtagtggtcacctctcaggaagacatggataccatcgtcggtgatcggaccaagcagcaaagctatgacttttcgaagatccagggcagattctccatcaagctgaagcttaacagcgccgacgtggtggaggtcattcagaagcgcttgctgaccaagaaaccggaatatgagtcggtgatgaacgagctgtgggatgagcagaacgcgaacctgcgcaccatgttcgaattcactcgtgagacttcgaaattcagtaataacaaggcatacagcaaggacgatttcatcgcatcgtatccgtttgtgaactatgagttcgagctgttccagaacgtgctgcgggaaatgagccggtacaacatgttctccgggcgtcatgcgtccgtgggtgaacggtccatgctttccaccatcagcagcacgctgcggtccagccagaatgagatggtcggggccctgatgccgttcgacaaactatatgacggtattgccgacgccatccaatcaacctcgaacttccgcatcaaccaagccgaaaagagactcggctccgatataaaggagctgggcgtgcgcctgctgaaggtgctgctgctggtcaagcatgtcgacggattccccaccacaccgcataacctgcgcattctgctgaccgaccagttcgacatggacgtgatggaactggaacggaacatcaagtatgttctgggagagttggaaaaagacacgtatgtgcagcgtgtgggagatacctacaattacctgaccaacgaagagcaggatatcgagcaggagatcaaaagcacggacatcgactccagcaaggaaatcgatgagctgaagaagatcctggtcagtgacgtgctcggcaagatgaccgtggcatacggcgaacagcgtgcccagttccgctatggtttgcgcatcgatggggtgcaacagtccgcgcaacagcccatctggttgaacgtggtcacatcgaccaatgcgcaggaccgtgccgatgccattcgcatgggcatgggtatgcgcgacaccatcactttgctgttggatatgtccgacagaacactgttcgatgatctgcgcatgtacgtgaaaacctacacatacctcatgcgcaccgacaagaacagccagtcagaagtgcgccagcagatcatctcccgtaagagcgtcgccaatgaaaggctttacacggagctgcgtacccgcatcgtcaaagccgcagccaatggcgagttcgactataacggcggaaccgtggaagtgaaatccaccgaggtgcaggcccgtatggcggaaggtcttggaacgcttatcggccggtattacacgaacttctccctgctcggcgggcaacgatatgaggaaacggatctcgcccgtatcatcatgaacgcttcgcagcaccagcctggcatgcttgacggcatgaacgcagtgcaggacaagctcgacgttcccgccgatgatgtgttcgccgcggtcagtcgtgacaaaggcaaaggcatattcgccaccgtcaagagccttcttgatgcctacggcagcgttccctatggttggccgtacgccgccacgctcgcatgcatcggccacctgtatggttccgacagaatcacgctgacgctggatggcaagccggtgcagcgcagcgaggccgcccgtttgcttagggaaacgaagaagcaggattccatccgagtggatctgccacgcgtattcgacacgagaaaagtttcacagctgcgtgacttcgccagggatttccttgggctcaccgccgcggacctgccatcgaatgcgattgatctggcggaggccgttaccacgcgacttaagcgggaagcggagagtttgacccagctgcgcgtgcgcaatgcccgattcggctttgtgcagcagctcgacaaggccattgagaaaatcaactatgcctccggaatgggtgaggactggctgcttggcgatttcaccgcacaagaaaccgaaaacggttccgaggaactgctcgagtttaaagaagacgtaatcgacccgattgtcgctttcctcaacggctcccaatccaggattcttgcagacggattggaatggctgaaaaacaacaagccgaacatcgactatgtatctggtactacggcagcaaacctgtaccaatccgcggaacagctggcaaacgacccgaacatcttccgcaaaactaataaattcaagactgccattgacgatctgcgtgaggcaacagacgcaaccatccaaaccgaacgcgccaacgcgcttaacgacgtggaagatattcgcaccagaatccacgattccaccgaatatcagcacgcaacacaagccgcgcaaaccaaggtcgagacagaactggaccaagtggcggaacgcatgcagcgcataccgttcatctacaaaatgcgcgaaagcgtacacgaactgagcgaacgcacctacccacaactcatcaacacgctagcagcctccgcgccgaggccgaagaccgcactcgcagatgaggcgcagactccatctactacgccgatggatgtgaacattcctgaatcgcaacaaaaggaaaccccgcgcgtggccgtgtcgttcgccaccatcagcaggccgcataccaaggacgccttggaaaccaaggatgatgtggatgacttccttgatgcttaccgccgtgagcttatcgccgccattgagaatggaaagaagatcctgctatga

SEQ ID NO: 258 - DNA, 3456 bp, Vibrio cholerae; identical to SEQ ID NO: 239

SEQ ID NO: 259 - DNA, 3579 bp, Alcanivorax pacificus
atgacattgaagaacatttttctaaagcccgttgatcgccctattgaaggcgttatcaaagccgacgatgaagccagtcttcgcctcgaaatcgaagaatacgtactgactaacgaagtcgagaaacgcctcgaagagtttctggacgcctacaacaactatgaaggagcgaacggtgtctgggtatccggtttctttggctcgggcaagtctcacttgctcaaaatgctggcccttctgcttgaaaacagggaaatggacggtgctacaacgctggatctgttccttcccaagtgcagcgagaatgaaattctccggggtgacctgaagcgagccatctctatcccttcaaagagtattcttttcaacatcgatcagaaagccgatgtcatcagcaaaacccagatcgatgcgcttctggccgtgttcgttaaagtctttgacgaaatgtgtggctactacggaaaacaagggcacattgcccagtttgagcgcgatttgcacagccgagggctgtacaagcagttcaaagccgagtacgaggccattgccggtcgctcatggaaaaaaggtcgagagcaagctctcctggaaggcgcgaatattgccaaggcttacgcttctgtgaccgggggcgacccgcagtcggcagcgggcattctcgacaagtaccgcagcgaatatcgagtctcgattgaggacttcgcggataatgtgaatgcctatatcgagaagcaggcaaaagagggtggccacaaagagttccgtctgaatttctttgtggacgaggttggccaatacattgccgacaacaccaaactgatgaccaacctgcaaaccattgccgagagcctcgccaccaaatgtcggggccgggcctggattatcgtcaccgcccaggaagagatgaaagacgttgtgggcgaaatgggcaaacagcagggccacgacttctcgaaaattcaggcgcggttcaataaccgcatgaagctctccagcgcggacgtggcggaggttatccagaagcgcttgctgaccaagaccgaagaaggcgtcaatcaactgtcggacgtctatcacgcgcaggcgaacaacttcaaaaccctctttgactttgccgatggatcggccacctaccggaactttcgggacagggaccacttcatccacagctaccccttcgtcccctaccagttcgcgctgtttcaatcggcgatccagaacctgtcgcagcacaacgccttcgaaggtaagcacagttctgtcggtgaacgctccatgctaggggttttccaacaggttgccatccacatcggcaaccacgaggtgggccagctggccacctttgacctgatgtttgaaggcatccgctctgcactgaaatcacaaatacagcgggcgattattcaggccgagaaccatctggataatgccttcgccatccggctgttgaaggccctcttcctggtcaaatatgtcaaggaattcaagcccacggtgcgcaacctatgcgtgttgatgctcgatgcttttgatcagaacctgccggcacttcgcactaaggtggaggaagccctgagccttctggagcaacagacctacatacagcgcaacggggaccagtacgagtacctgacggacgaagaaaaggacgtcgagcaggagatcaagaacacggaagtcgagtcatcggacatcgctgacgagctggaaaagatcgttttcgactttgtcatcaagcagcgcaagatccgttatgacgccggctcctcccagaaccaggggcaggactactcttattcgcgcaaactggatgatcgtctgcatgggcgtgaatacgagctctccattaatgtcatcagcccgttccacgagcatactgacaatgagcaaatgctccgtacagcctcaacctacaaggcagacgagctgttcgtgctcatgccttcggacgagcgcctggtgcgggacctgcttatgttcaagcgcaccgagaagtacatcaaacagaacatctccgttacccagcagaaaggcgtcaaacggatcctgcatgacaagggcttccaaaaccgtgagcgtgaggccagactccggcagcaagttcagaccctcattggcaagtccaagttgctcattggcggcgccgatgtggaagtggcgaatgaggacccccagacccgcattattcggggcttccatgagctgatttcacgggcttaccccaacctccgcatgttgcgcggcgtttcctatacggaaaacgacatcagcaattgccttaaccgtacagacgatggtcttttcggtaatgacgccacggccctggcggaatccgagcaggaggtgctggcgttcattcagagcaacaaccggggcggtgtccgcaccaccctcaagagcctgctggaaaagttcgaacgcaagccctacggctggtattacgccgctgttctctgcaccctggccaacctgtgtgcccgtggcaaggtggaagttcgtctcgacgggaatatcctggaggacagcgagctggagcgcgccctgcgtaacactcacggccacggcaacgtggtgctggaaccacagattgagttcaccgcctctcaggtccgagccctcaagtcgttctatgaggacttcttcgacagcccgccccgcagcagcgaagccaaagccctgggtaaagaagccggcgaagccttccgggacatgtaccacgacctggatcggcggatagcgcaggtcgaccagtacccgttccttaatgctttgaaacctgctctggagacgctgaaagaagttgccgcaaagccctacacttggcacctgacggaattgggtaagcaggaagatcaactgcttggcctgaaagaggatgtcattgaccccatccgcaagttcatgggcggctcgcaaaaagacatctataaccaggctcgatccttcctgcagagccagaagcccaacttcatctatgtgtccggggatgagatcgagcagattcgcaccatcctgaacgatgccaactgctacaaagggaatcgcattcagcagctcaagggccaactggatagcctgcaggagcgaatcgatgagaaagtgcagcaaatccgctcccaggcagaaacctccctgaagaccatgcaggaacgcatgcaaagcatggacgaatatcagtccctgccggaaccgcgccaggatgagcttaataaaccgttgcgggagctggtcgattacatcggacaggagcgcctgatagccgtgatcaaggaccggatccggtactttgaagaagagggctaccagaagctgctgggcaaaatggtggcaatggccaagcagaaaccagcaccgtcggatgatcccgcgcaacgcacaggtgttgagaatggctggaatggtggacagcctcatgagatcaaggaaccgtctgccgactacattcacactcgcaacctccgtgtcgcgttcgacaaggcctggttggctgacgaggatgatgtggaccgttacctgaatgccttgagagaggccctgttggttgagatccagcaaggtcgcaaggttcagatctaa

SEQ ID NO: 260 - DNA, 3456 bp, Vibrio cholerae; identical to SEQ ID NO: 239

SEQ ID NO: 261 - DNA, 3456 bp, Vibrio cholerae; identical to SEQ ID NO: 239

SEQ ID NO: 262 - DNA, 3537 bp, Gamma proteobacterium
atgctactggaacagctatttaacaaacccgttgaccgcgcgatcgaaggggttatcaaggccgatgacgatgttagcttgtacgttgagctggatgagtacgtcatcaccaatgaagtatctaaacgcctcgatgattttttagatgcttacctgaactacgctggtgctaacggtgtttgggtctcagggttcttcggttctggtaaatcgcacttgctgaaaatgctggcgcttctgctccagaacaagccgatcgaagacacctactatccgctcgatctcttcctgcagaagccgccgtttaacgagggcggcatgcaagctgaggatcttaaacgcgctgtcgccattccttctgagagcattctgttcaacatcgaccagaaagccgatgtcatatccaaagatgagcttgatgcgctgatcgcggtgttcgtcaaggtgttcgatgagcactgtggttactatggcaagcatccctacatcgctcagtttgagcgcgaactggacgtagatggtcagtttgatgcatttaaaacagcatttgaaaaacttgcagagctagattgggaatcaggtcgacgtcgggcaaaacgcatggcgcaacacattgataccgcctacaccgaggtaactggcacatccgtcgtggatattctggataagtaccgggatgactaccgtttgtccatcgaggattttgccgagcaggtcaatgcctatatcgagtcgaaaggcgataccttccgtctgaacttcttcgtcgatgaagtcggtcagtacatcgccgataacgtgaagttgatgaccaacttgcagacggtcgcagaatcccttgcaacaaaatgtaaggggcgctcatgggttgtcgtcaccgcgcagcaggatatatcatctgtgttgggcgagggtgctcaccagtccaacgacttcaccaaaattcaggcacgcttcaacaataagatgccactgaatagccaagatgtggccgaagtcattcagcgacgtctactcgcgaagaaagatgagcatattaatgcgctgtctgatctctatcacgccaatgaaaacaactttaaaacgctgtttgattttgcggacggatcgaccacctaccagaacttcaaagatcgagaacacttcatccagagctaccccttcgttccgtaccagtatttgttgttccaggctgctatccaagggctgtctcgccacagtgccttccaaggtaagcacagctcagtcggtgaacgctcgatgctgggtgttttccagcaggtcgccatcgggatcaaaggccatacgctcggtgatattgcaacctttgatcttatgttcgagggtattcgcaccgcgctgaaaggttcgattcaaacatccattcatagtgcagagaaaacactcactaatgaattcgctctgcgggtgctaaaggcactcttcctcgttaaatacgtcaaagcgtttaaaccgaccgtgcgcaacatctgtgtgttgatgcaaaacaacttcaacacgtcgatcactgcactgaaagccgatgttgaagaggcgctggccctgctcgaaaaccagacccttattcagcgtaatggtgatctctatgagtttttgacggatgaagagcaagacgttgaggctgagatcaagaacaccgaaattgatactcagaccgtggcgggcgaactggagaagctgatctttgatggcgtcatcaagaatcgtaagatccgttgggatgagagcgggcaggactatgcgtacacccgcaaactggatgatgttcaaagcgggcgagagcatgagctggcgattaacgtcatcacttcattccatgattaccgtgatgcgttcgataagcacaagactgataccgtttataacgatgagcttcgtgtcgtactgcctgacagtgatcgtttgattcgcgacctgatgcttctgaagaagactgagaagtacatctctcacgagacacgcaccacacagcaggattcagttaaacggatccttgctgaaaaagcggcccaaaacggcgaacgggcgacacagttaaaagccctgatctcatcgttgatgggtaaagcggtctacttcgttggcggcaaagagattgaactggccggtgaagacggtcaaacaaaggtccagcgcgcatttgtcgagctggcaaagcagacctacccgaacctcaaaatgctgcgtggtaagcagtatcaagagagtgaaatctccggcattttgacgcagggcgagcagggtttgtttggtgatgaaacaagcctgccagaagcgcagcaagagatgttctcgcatatccagagcaatcaccgtggcggtatccgcacgaccgttaaacttctactggagaagtttgagcgcaagccctatggatggtcatacgcagcggtgctttgcacgctggcgcatctgtgcgcccgtggcaaaatcgaagtacgcgaatcgaccaacctgctagacgacagtgaactggcacgggcgctcaccaacacgaatgtgcagggtaatctgattctcgacccacagatcgagttcacgcaggcacagataaaacgcctcaagacgttcttcaatgattacttcgacaaagtggctcacgcaaccgaagctaaagccttggctaaagagactcaggacgcttttgctaaccagaagacagagcttgagcgcctccaccttcaggccgaccgatacccgttccttcgcgcgttaacggtggtgatcgacgatctatccgaattgtcgactaaaccctatcagtggttcgtgacagaactgactcgagatgaagacaaatggctagacgactacaaagatggtctggttgatccgatcgtctcgttcatgaagggttctaacaaagcccagctggatgaagcctcccggcttttaagcgatcacaaggccaatctcagctacgtacaggccgatgagcttgatgccatcaaatctgccgtggttgatcccaatatttacaagggtaaagcgattcaaacgctgattagcaacatacagtcgctcaaatccaagttggattctgtgatcgctgatgagaaggccgcagcggatgccagaatcgatgcgctcgaagccaaactcacccagtacgacggctacctctcgctgagtgatgagaacaaagcgacggttcaggctcggatcgatgcagcaaaacaggcgatttcggaacaaaaccttattgcgatgatccgcgatgccgtgaataactttgaaaaccatcagtacagtgcgttgctgcagcagatcgaagactggaatacgccggttgtccccgaaccgccagtcaagccgggcaatggcgatacgcctattgatcctcctacaccacccgtatcacctgctcctaaggtggaaatcgttggcgcgcgtgatttgtcggtggcttacgccaaacccttgttggaatccgaggcggatattgatgcctatctggaaagctacaagcaagctctggtcaacaccgtcaaacaaggtaaaaaggtgcgcctttag

SEQ ID NO: 263 - DNA, 3642 bp, Escherichia coli; identical to SEQ ID NO: 53

SEQ ID NO: 264 - DNA, 3666 bp, Enterococcus faecalis
atgaaaattaatgatatgttccaaaaagatatccatcgaaatattgaaggagttatcacagcttcacaagctagtgaagagcaagtttatcaagagttggatgagtatgtagttactaaagagttacaaggtcagtttagaacgttttttgatgcctataaacaaggcattaatggtcatactagtaaaatgggtgtttggatacaaggtttttttggttcaggtaaatcacacttcttaaaaattctttcttatattcttgaaaataaagaaataaatgggaaaacagcatttgatttttttacagagggggacgaattaactcgcaagattaaagatccaatgacaattgccgatatggaactagcggttaaaacgccaacaaacgttatacttttcaacgttgaatctaagcatcaaacagggatagagggaaaaaatagtctagtaaatgtattcttgaaagtttttaataatagtctaggttattccactaatccaaaagttgctgatttggaacgtcgtttagataaagatggaaaatataatgaatttaaagaagcttttaaagctgaacatggacttgattggattaatgaacgtcatgaagtggacttcatccaagattctatggtgaatgctctgtcaagtatcggttatatgactgaagatgcagcaaaaacatggtttaataagctagaatctgaatatattattagtatcgaagaatttgcagtgatgattgaggagtacttacaatcaaaagggaacaatgagcatattgtttttttagttgatgaaattgggcagtatataggtggaaacagtgatttaacattgcaattgcaaacaatagttgaagagctgggcaataaatcacgtggtaaggcatgggtgattgtaacaagtcaacaagctattgatgcaattacagatattgctggctcagcagctttagatttttcaaaaattaaaggtcgtttcgaaacaaccttatcattatcttctgctaatgccgatgaagtgatccaaaaacgtattctcgcaaaaaacatttcaggacaacaatacttagaagcagattatcctaatcacgaaagtaacatcaaatcgatgctaatatttgaagatagtcctgaactaaaattatacaactctgctaaaaattatgcagatgtttatccatttgttccatatcaattcaatttgttagcgaatatcctgacacaggtttcaaaacattcaattcaaggagctaatctatctcgtggggaaagatcattacttgcgttctttaaagaaacagcggagcgaaatgcggataatgacagcggtgtgttagtatctttagatcaattttatccttctttagaaaaatggctaaatgaaacagaaaatgctaaagttattaaacaagcagaagaaaatacaaacattgtctcagacggaaaagacttatttaatgtagaagtactaaaagtgttatttatgattaaatacgtagatcaaaatattaaaccaacattgaataacattacaaacttaatggttcgacgtgtaaacgaagataaattagctcttcgcaagagagtagaattagccttgaaaatattgataaaagaaaatttaattcgtcaaaatttacaaaattatgtatttcaaacagatgaagagcaagaggtaacccgtttaatcaatcatattgatttaagtgctacagacgttgaggataggttagctcgagatattttagatgataaagttggtcgtaattcattttcttataaaaatgcaaatgcttcaggacgtgcatttgaaaatcgctataattttatgtataacttttacgttgatgattatgcttatcgcaaaaataataatccgaatttagaagtaaaaattatcacaccatattataatgaattgtggaataatgagccacaattaattttaacaagtacgaagaatcaaatgctgataaatcttccagtagatacagaatttatgaatcatgttcaaacttatcttaaggtagaaaaatatattacaacggcgaatgtttcaagtgcaattaagaatttcgcggcggtaaaagccgaaaaaacagctgaaaatcaagaactagtggaatcaattaattctcaattaaacgatttcttgaaacaagcgactttttattttaataacagtaagttagaggtttctggatccgatttcaaagtgagactgaatgatgcgttgcagcaaatggcaaagctagtctatcataaaaatgatttggtggatgctgctgtttccgaatcagacattaatagtttgttgaaagataatggtacgactcttgtagcatatacagaaaatcaaaatgttgtcgatgatgtaaaacgattcattcaattacaacacaaccaaaatctcacagttacaatgaaaacgttgcgagataattatgttaatcgtgaaccatatggtttcataaatgaagatttagaatgggctattgccagattgtttaaagaaggaagtattagtttatttaaaaatggcattccattagatactaactctgatataaatgagatttcaaaagcaatatttgatcgtaaatctccagaaaaaattcgtgttgaactacgtccgaaatcaaatgatctccagaaaaaaatggtgcgcaatttgggagaagaactgtttaatagtcggaatattgttgatgaaacaaatgatgatacaacacgtatacgctttaatgaaaaagcacaacacatggttcgtgagttacaacgttttaaagatacttcagggcatcattatcctcaatctgacgaaattgtggaagccattaaagtattggatcaggtaataaatgcaagagatacaaaatcattttttgaagtattacaaaatagagaagaggagttattggactgggctgaggattacgaagacatccatagttttcatacaagttctcagaaaagcatctgggataaaacgagagattacatcggtcgcatagaagatagtaaaatcaaagaatctacagaagaaatgaatacaattatttctgagatgaaatctattagaaaacagtcggtaccctataaagatattccaagattaagtgaactgaatggtaaatttgaaatagagtacatgaaatttatggaagctaagtcagataaggcaactagccagataaatgtcattaaagaatcagtattagaagatttgctccgtcgtaattttggagatgactttagaaatgacgtaatcaaagaatttgataaattaaatgatgaattgtcaactgcaaaaacgtttgatgagatcatattaattcaagcgcaagctgaacctttacagcgaaaattcacagctaaatttacaactgaggaaaattatcgtcgtgaagaagaggcaaaaaaaatcagtatagccatcagcaataactgtgatgaggataccaattctatggcagataaaatacctgacgtaatagctgtaacaccggttaagaaagttgaaaatgtttatgtaaaagaattaatcagttctcgtcaacggattaaatcggaagaagacatcgatctcttcgtgaataaactaaaacaagaattattagcaaaattaaatgatgataatgaactagacattttattgtaa

SEQ ID NO: 265 - DNA, 3678 bp, Pseudomonas syringae
atggccgtgagcattaaagaaatcttcttcaaggaactcgaccgcccgattaacggtgtggtcaaggcggatcaggctgatgacgccaccgtgcaccaggagctcgacgaatacgtcgtcaccaatgagctggaaaaacacttccgtagcttcttcgagtcctacagtaccgacctcagtgatccctccatcgccaaccgagtgggcgtatggatcagcggcttctttggctcaggtaagtcgcacttcctgaaaacgctgtcttacctgctggccaacatcgaagcccatgatgcccgaggcaacagcaagcgcgccgttgccttcttcgaccagaacaaagtgcgcgacgccatgatccgcgccgacatcgacaaggcggtagccaacagcgccgatgtcattctgttcaacatcgacagcaaagctagctccaacgacgcaggtaacccgatcctcaacgtcttcctgcgcgtgttcaacgaacaccagggtttcagcggcgaccatccgcacatcgcccatatggaacgccacctcactcagcgcggtgtgtatgagcagttcaagcaagccttcaacacagccacaggcctggagtgggtcgatgagcgtgacggctatcagttctaccaggacgacatcgaaaaggcgcttgccagtgcgctaggtctctctgccgaagccgctcacaagtggttcgaagcctcagagcaaaccttcagcgtgtcggtggagaacttctgcaactgggtgaaggaatacctcgacacccagcccgccaagcaccgcgtactgttcctggtcgacgaagtgggtcagttcatcggcagcgatacccgactgatgcttaccctgcagaccatcaccgaaaatctcggcaccatctgtaaaggccgcgcctggatcatcgtcacctcccaggctgatatggatgctgtgctcggcgagttgtcctccaccaaagccaatgacttctccaagatcgccgggcgtttcaaaacccgcctctcgctttccagctccaacaccgacgaagtcatccagaaacgccttctacgcaagacagaagctgccgaggcggaactgcgcgcgctctgggagcagaagggcgacatcctgcgcaaccagattaccttcgatcgctcgggcccaacgctgaagaattacgacggcccggacagcttcgtcgccaactacccgttcgcgccttaccacttccaactggtgcaaaaagtcttcgaggaaattcgcaaggtcggtgccaccggtgctcacctggcctatggcgaacgctccatgctcgatgccttccaaatggccgccctgtcactcaaggacaaacccttgggcgcattggtgcccatgtacagtttttaccgtgcggtggaaggcttcctcgacaccgccgtcaagcgcaccatcgaccaggccagtgaaagtgaagtgctcgatgacttcgacgtacagatcctgcgcaccctgttcatgattcgctatgtcgacttgatcaaaggcacgctcgataacctggtcactctgtccatcgaagaggtcgacaccgacaagcttgccctgcgtcgccgtcttgaaggcaccctgcagcgcctggaaaaggaaaacctggtcatccgcaatggagacgagttcgtcttcctcaccaacgaagagcgcgacatcacccgtaagatcaaggccactgaaatcgcctcctcggacgagaacaaggcgcttgccgagctcatctacaaggacctactcaaggacaagaacaagttccgctacaacctgaccaaaaccgactacagcatcggtcgtttcctcgatggtcacagccttgaaggccgctacgagcaggatctgcgcgtcgaggttatctccccgctagaccctgactacgccctttatggcgaagccagttgcctcaacaagagcaacgaagcgccagcaggcctcgcactgttcaaactccccgacagcagtgagctgttcggcgagctgcgcatttggctcaaaaccaacaaatttattcgcctcaacaacgatgacaaccagcccgatctcagccgcatcctgtccgaccgtggccgtgaaaaccaagaacgtaaaaaacgcctgcgtctgatgctcgaagcgctgctggagcgtgctgaaatttacgccctcggccagcacctcaaactcagcggcaacaacatccagacccgtttcgacgaagcctgccaatacctgctggagaacacttacaacaagcttggctacctgcgcgtcttgcaacaggagcccgagcgcgagctgcatgccgtactgcacagtgatgatattgcccagcttggcctcaccctggatggggaagacggcaacgcccaggccatcaaggaagtcgagcaattcataaccctgcgcgcctccggtaatgaccgcctgctggttgccgacatcatcgagcgcttcaacaagcgccccttcggctggcccgatggcgaaatcctcctgctgatcggccgcctcgccgccgctgggcgtatctccttccacgttgcaggcccaagcctcgcgctgccggatgctttcgagtacctgaccaacagccgcaagcggcgagaaatctcggtgcagaagaagcgccagaccgatgaggtattgctcaagaaagtccgcaatctcagtcaggatctattcaacgccataggcccggccggtgagaaagagctctatgccttctaccgcagccgcctggaaacctggctctccgaactcaagagctacaagagcaaggttgatgtcggtcgcttcccaggcaaaagcacaatcgagaagtctctactgaccctgcagcgtctgctgggcaacagcgatagcgtcgatttcttcaaggaggtggtcgacaactcgaacgattacctcgacctcgaagaggactaccgtgacctcaacgagttcttcaccaaccagttgcacagctggcagcagctgcaacaggcattgcgccgctttgataaaaaccgcaatgccctggagaaaaacgacagcgcccgcaaggctctggccgaactgcaggccatcgaaagccacgccagtccctacaaccagctacacaaggtctctggcctggtggaaaccgttgaggctgtcaacgtcagcattctcacggaacagcgcgagcaggcgctggtagcgattgaccagaagatcgccctgctgcaggccgaaatcgccaagagcggcatcgaaagccctgagctaagcaatcgcctgctgcgtccgctccagctgcttaaagccgaagccgagactgaaaccagcctggcccacatctaccaactggaaagccaaaccgccgaagaacgcctgcaagacggcatcttcgagctggagcgcgccattcaatccgaggtggatcgccagcaaaagctgcagcagcaagctgacaaagcagcacagcaagctgcccagggcagcaaccagattaaggaagagcgcacaccacctctcgttccggtcaagccggtcgccccacccaagccagtagtcgaaatcgcggctaccagtgttttcaacaagctgggtaatggcgtttacctagaaagtcagagcgatgtggagcgcttcgtcgaggcgctaaaggctgagcttgtagcagccatccagcaggagaaacgtatcaggattcgttaa

SEQ ID NO: 266 - DNA, 3642 bp, Escherichia coli; identical to SEQ ID NO: 56

SEQ ID NO: 267 - DNA, 3537 bp, Pseudanabaena biceps
atgcttttacaaacgatttttgcacaagatattaagcgtcctattgaaggggtgattaaggctgatgatgaggcgcgattgggggtagaaattcgggaatatgtattgactaacgaggtggaaaagcggcttgagtcatttttagaagcatacaatggctatcagggggcaaatggggtttgggtatcaggattttttggatctggtaagtctcatatgctcaagatgttggctttgcttttggaaaatcgcgaggttgatggggagaaaattttagaagcgtttttgtggaagtgtcgagataacgagatcttgcgcggtgaacttagaaaagcggtggcgattccctcgaaaagcattttatttaatattgaccaaaaggctgacgtaattagtaagactcagattgatgcactcttagctgtatttgtgaaagtatttgatgaaatgagtggctattatggcaagcaaggtcatattgctcaatttgagcgcgatcttgatagtcgtgggttttatgccagttttcaagataagtatgaggagattgcgggaagaacttggcaaaaggggcgagagcaggctttgttggaagggcaaaatattgctagggcttatgcggcggtgacggggaatgattctgagtccgcgatcgctattttagataagtatcgcagtcagtatcgggtttcgattgaagattttgcagatcaggtgaaagcttatctggacaaacaaagtcttgattttcgtttaaatttctttgtcgatgaggtggggcagtacatagcggaaaatgtaaagttaatgactaacttgcagacgatcgcggagagtcttaccactaaatgtcagggtagagcttggattattgtgacggctcaggaggatatggactcagtggtgggagaaatgaaccgccaacagagtaatgactttagcaagattcaagcgcggtttcacaatcggatggtgctgaccagtcaagatgttgctgaggtgatccaaaagcgtcttctcactaagaccgaggcggttaagccactattggcaactatttatcaagagcaggctaataactttaagactttgtttgactttacggatggttcgcaaacctatcgcaattttcaagattgtgagcattttactaattgctatccgtttattccctatcaatttacgctctttcaggcggcgatccaaaatttgtcaaagcataatgcttttactggtaagcatagctctgtgggtgagcgctcaatgctggcggtatttcaattagttgctattcagatttgcgatcgcccgattggaaagctggctacctttgatttgatgtttgaaggaattcgcacagcgctgaagtcaagtgcttataagtcgattcgcactgcggaacagaatttagataatcaacttgccattcgtattctgagaacgctgtttttagtcaagtatattaatgagtttaaatcaactttacgaaatttatgtgtgttgatgctggatgagtttaatcaagacttaccacaattgagtaaagacatcgaagaagcgttagatctcttagagcagcaaaactatattcagcgcgatggggaacagtatgtttatttgactgatgaagaacaggatattgagcaggaaattaaaaatacagaggttgagtttcgcgatttggctgacgatctagaaaagctcatttttgattatgtgattaaaaatcggaagatccgtaatgctgaaaataactatgactatgagtattctcgtaagttagatgggcggctgcaagggagggaacatgagttaacaattaatgtgatcacgccgtttcatgaaaatgctgataatgaagctgctttggcgatgcagagtatggggtttgatgagttgttggtgattatgcctgtggaatctcggttgatgagcgatctgatgatgtacaaacgcacggaaaagtatattcgccagaatgtgacgatcgctaagcaggaggggattaagcggatcttggaatacaaggcttctagtaataggactagagaagcacaactgaaggaatcgatcaaggctctgctcggtcagtctaagttgtatgtggcagggacaaagtttgaagttggaggtgaagatgctcagagtcggattattaagggatttcagactttgattgagcgaacttatcccaatttgaaaatgttgcggggaatttcttacagtgaaaatgatttgggaaatgtgctgaataattctcaagagggattatttggaaatgatgtgactacgttggatgagtcggagcaggaggtgcttgcttttatacagggcaataatcggacggggatcaggacaactttaaaattggtgatcgatcgctttcgcaagaaaccctatggctggtatgaggcggcaactctttgtcagatcgccaagttatcggtgcggggcaagctagacactaagattgatagcaatattgtggaaggggatgcgctagaaaaggctttgcgttctgcaagtggctatggcaatgtgattttggagccgcaaatagactttacgacttcacaggtacgcaacttaaaagagttttatcaagagttttttgatgcgtcgccgacaatgagcgaagctaaggctttaggtaaggagacgggagaggcttttcagaagttattgaatctactcatgccgatcgcctcgcaggtgtcgcaatatccatttttgcaagccctcgatcctgcgatcgcaatgatttctgatgtgaagggcaagtcctatgcttggtatttaacggagttatctaaaaaacaggacgatctgctggacttgaaagagcaggtaattgcgccaattcggggctttatgaatggtaatcagagggagatttatgagcaggcgcaaaaatttgtgcaggctcaggagtctaactttgcttatattgctggtactgatgtcgagcagatgcgggcgatcttagccgatcgccaatgctttaagggtaatcggatgcagcaggtcaaggtgttgagcgatcgcgcttcggcagcagttgccgaaaaggtgaaagaggagatcgcgatcgccaaaacatctgtaacggagctacaaactcgactttgtgcgatgtctgagtttactggtttgagtgctgaacaacagactcagattgtgcaaccctttagcaattttttaacggcgatcgctaaccaaagtctaattgcggtaattcgtgatatgcggcggcggtttgaggaagagacttatgctggcttgatggtgcgggtaagtgagtgggcgacggcgactaatcgggttcagcctgactcaacggcaaagagtttagtcggtggtacttacaaagtatcggttaaggacaatcaggcgatcgcttatgtggcgaagcagtcaattcaggttaagtttgatcgggtatggctagaaaatgaggcagatgtggatcgctatttggcagcgatgcgtgaggcttttatggctgagattcaacagaacaagaggatttcgatatga

SEQ ID NO: 268 - DNA, 3456 bp, Vibrio cholerae; identical to SEQ ID NO: 239

SEQ ID NO: 269 - DNA, 3690 bp, Vibrio cholerae; identical to SEQ ID NO: 123

SEQ ID NO: 270 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctagataaacgcggtcagtatgagacctttaaagccgcgtttgccgatatcaatggctcacgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattaccgaaaaccttggggtaatctgcggtggccgcgcatgggttatcgtgacttcgcaggctgatatcgacgcggcaatcggtggtatgagcagtcgcgacggacaggacttctccaagatccaggggcgcttttcaacacgcctgcaactttccagctctaacacatcagaagttatccagaaacgtttgttggtaaaaactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagactgcggcgcagcaaatctcagcgcaagggctggattctctggtgcctttctggcgcttctatgccgccattgagagcttcctggagcctgccgttagccgcaccatcactcaggcttgccagaatggcattcttgatgagttcgatggcaacctgctgaaaacgctgttcctgatccgttatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggcgcagtgcttaacgatctggtggtgaagatcctgacccctaaagatccgacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaatattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaagtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaatgagattgaatccggtctgcgcctgcttaatgccattcttaatgaaaaagaagattttgccctgatcgaaaaagtctcatcgctgaaagatgaacttctggatttcagtgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgcgtaaaaagcaagaggcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaggttctggaaaccaccgaacaggtggaaaaggcgctcgacacgttacgcacaacgctgctggccgccattaaagcaggcgatcgcattcgccttcagtaa

SEQ ID NO: 271 - DNA, 3531 bp, Actinomyces sp.
atggacatgacgggcatttacgccaaggacatcaaccgcacgatcgacggggtgatcaaggcggacgagtccgcccacatccgctccgaggtcgacgagtacgtgatgacctcggagatccgcgcgggcctggaccggatcctggacgagtggaacgccccccggccccagtcgaacggcgtgtggatctcggggttcttcggctcgggcaagtcccatatgctgaaaatgatgtcgtacctgctgggcgatgtccgcggctcgggggagatgacgcgccagcaggtcgcggaggttttcacgcagaaggcccgcggccatgagatgctgatcgccgggatcgggcgcagccagcagatcccggcgctgtcgatgctgttcaacatcgacgcgaaggacgacaaggcgacgtcgcgccccgaggcgatgatcgaggtcttctaccgcgcgttcttcgaggcacggggcctttacacggcggatctgggcgtgggggccctcgagcgggacttggtggaccggggcctgttcaaccagttcaaggagtgcttccgcgcggtcgcgggcggggagtgggaggatcgccgcgcgggaaccgtgttcgccgaggcgccgacggcgagggcgctggccggggtcggcatcgaggtggacaagcccatcgcgtcctaccgggcgtcgttgaaccgttcggcggaggccttcgccgacgaggtcgcccactggctggattcccgggagccgggcgcgcggatcggtttcttcatcgacgaggtcggccagttcatcggtcgcaacacccacctgatgctgaacctgcagaccatcaccgagcagttgttcacgaagtgctcgggacgggcgtgggtgttcgtcacctcgcaggagaagctcgatgacgtcatcggcggcctcggggagcagcaggggaacgatttctcgaagatccaggggcgtttcaccacgcagatcaacttgtcgactcaggaggtcgagcaggtgatcgcgcggcgccttctggccaagagcgatgcggggcgcgccgtgctggaggggcagtggtcgcgctccggcgcgggtttcgcctcgatgttcacgttcccggcgtggcagaaggcgtattcgaactacgcggacgaggaggcgttcatcgcgaagtacccgttcgtggactaccagttcgacatgttctcgcagacgatgatcggcatgtccgagtcggggctgttcacgggtcggcactcgtcggtgggggcgcgctcactgctgggggtgtgccagcagatcgcgcaggacctgcaggagcgcccgatcgggaccatcacgtccttcgaccagttctacgacggcatcgccgcgatgctgaagtcggatgtgaaggagaacctgcaccgcgcgcaggcgaactcgctgacctccgaccccttcaccatttccgttctgaaggccctgctgctggctcgctacgtgaaggacttcccgtgcgcgccgtcgaacctggtggtgctgctgcgccgcgacctggggcaggacgcgaccgccctggaggcccgcgtcaagcggtcgttggacgccctggtcggccagtacttcgtgcagaagctccctgagggcacgtacacgtacatgactgacgaggagaaggaggtcaagcagcagatcggccggatgtccgtgtcggagggcgaggtgacgggccacctgatgcggtcggtgcgcgcggtcctgggcaatgcggccgcctcgtaccggcacccggacacggacctggacctgcggatcacaacgatcatggactgcatgaggcccgcttccacggagtccctcgtcctcaattgcgtgaccccgttgtcgcaagtcgacgcggaggcggcgcgcatccgctcgacgggcgggcaggacacgctgacggtggtgctggcgttgagcgatgagaccgttgaagaggtctacatgtacctgcggaccgagaggtatgtgcgcggggccactggctcctcggcgccgagcgggcgcaagcggttgatccagacctacggcgagcagaacaacgagcgcgacgagcggatcaaggccgcggtgaggatgtctttcaagggcgcgcggttcttcaccgacggctccgaggtggaggtcccggcctcgatgccgcccgccgaagcggtgaacaggggaatgggcgtggtggtggggcgggtctaccaccggatgggggacgccctgcctttggcgaagttgaaggagggcgatgtcgaccggttcttgcgcgacgaggacgagggactgctgcccgaggggggcctgcaggcggcgaaccctttggcggaccagttcgcgcagtgggtgaagcagtcgcgcgacctggaggggcgcagcgttttcgtgcaggacgccgtggaccacttccgcgccgcccccttcgggtgggggcagaacgcggtgctcgcgatcgtggcgacagcgatccgccgcgggcttgtggacgccaaactcaacgagcgcccattgacgcgcacggagttgtcgtcggggttgcgcgtctcccaggagcgctcccgcatcctcctggagccgaagaggcaggtggaccagcgggcgttggcgcgtttccgcgctttcgcgaaggagttcgtcctgtccgacgggcgcttggaagacgacaacgcgcgggccgtcgccgttgacaacgctgtgcaggggtggcgcgcggtcctggaccgggcgcgtcgtacgccgttcgacttcggtggagagatcgacgaggcggaggccacgttggaggcggtcggcgccgggccgctgggcgcggaggcgtacttggcgcccggtgttcaggcggtcttcgacgacgtggtggagatccgctccgatttcctggagccgctccaggagttcctcacgcgccacatgcccgccgtcgaggacgccgtgcgcgcggccgactccttggccgcctacggggacggcgtgggcgaggacgggcggcgcgccattgaggaactgcgggccctggtcagcgacgagcacctgtacaaccgcacggacgaggtggctcctttgcgggagcgggtggaccgggcgcgccgtgttttcgtcgaggagcggcgctcggaggcgctgcgcgcgttcgagggggtgcgcgctgaggtcaccgcgtccgacgagttcgggcaggcggacccgactgcccgcgaggcggcgctgagccggatcgacgccgagtgtgcctcgatcaggggaatgaccgacccgggggcgatcgtgatcgccgcgcagaaggtggatgcgctgtccgcggagttgttcgcccggctgatcgcgtcgcacgagcgggtcgacgaggcacccggccactccgatgaggcgcccggcgggcgcgcggcaccaccccaggtcgtccagctctccgcactcacccgcgacctgtgccgcacgacgatacgcactcccgacgacgtggacgcctacgtcgaggaactgcgctccgctttgcacagggctgtttcgaacggcaacatcatccgacgctga

SEQ ID NO: 272 - DNA, 1938 bp, Fusobacterium necrophorum
gtggatgaaataggacaatatattggagaaaactctcaattgatgttaaatcttcaaactttagtggaaaccttgggagtaaaattcaaaggaagaatttgggtaggagtaacttcacaacaggatttaggaaatattttaggaaaagctcgggaaagaagtaatgatttttcaaaaatacaagatagatttaagacaatgttgcccctatccagtgcaaatattgatgaagttattaaaaaaagactattagaaaagaaacagttacaacaggaagaattagaaagtctatatgacaaaacgagaatttatattgaaaatgcaattacttttgataaaacgggaatgacgttagctctttttgaagacagaaaagattttgctgaaagctatccttttgtaggataccagtttaatctattacaaaaagtttttgaaaaagtcagaaatatgggatattccggacaacatatgtcacgaggagaacgttcccttttaagttctttccaagaagcaggaattcgtgtaaaagatatggaagtgggttcgcttgttccttttcaatatttttatcaatcgattgaacaatttttggaagataatgtaagaagaccctttattcatgctaaaaatgaaagaggcattgatgaatttggcttagaagtgttgaaacttctatttttattaaaagggattaaaggaatcactccaaatatcaataatttagtgagctttatggtggattctgtggattgcgatcgtttggcgttagaagaaaaaataaaaaaagctttgggaaaattagaacaacaagttttaattcagaaagatggagagggatactatttcctaacgaatgaagagcaagacatcaacaaagaaatcaatcaagaactcattaatgaacaggatgtctataaggaattgaacacctatattttcggacaaatttttacaagtccgacagtgactatggaagatacgaaaaataaatataattttagtcaaaaaattgatgaaattccttttggaaaaataggagggcaattggatattctcattttaactcccagatcggacgaatatgataatattgccattcttggatatcgtgatggctatgatttaattcttcgacttcctgaagaaatgacatattggaaagaaattcaacaatctctgagaatagcctcctatgtacaaaaaacattgcgaggaagcattagagaagttgtgcatcaaattttacaaatgaaacaacaagaaaattcgaagagaaaacaaagaatacaaagtgaagtggaaagaatgttgtcggaagcggaaatctacattcaaggtcaaaaagtaaacattacgactacacaagcggataaacgtattgcagaagctttaaaagctgtggcaagacatcgctttaataaagcaaaattgatacaaaaaccttattatgaatcagagattagaaatgtattaagttatgaatacgatgccggaaccaatttattcgatgtcaaaaaagatatgagtacaaatcgtaattatgaagctttgcaagaaattttaacctacattactttacatacaagtcgaggaaatgtgattaccttgaaacatattgtggaatatttttcaaagaaaccttatggatgggaaacattttctattcatggcttggttgcagagttatggatatataagcaaattcaaatagaagaatctaagaatctcattcataatgcagaagaattaaagactcttcttgtgaaatctcaatccaaaacggaagaaagacttgtgattagtcttagagaagaaattgataccgaacttcttcaaaaggtaaataatcttttgaaaaaattatttggaccggaaaaagaagtttccgtggatcagccaaaagaagacatcttggaaattttaaagaaaaaatag

SEQ ID NO: 273 - DNA, 3681 bp, Acinetobacter radioresistens
atgaacattaaagaacttttttacaagccattagatcgtgcgataaacggggtggtcaaggcagaccagaatgacaataccacggtatatcaggaactcgatgaatacgtggtcaccaatgagctggaaaagcattttcgggactttttccagtcttatggtacagacctaagcgatccttcgattgccaatcgtgtcggcgtatggatttcaggcttctttggttcaggtaaatcacacttcctgaaaaccttatcgtatattctggccaataaagtggcacgtgacgcggaaggtaacgaacgcagtgctgcagaattctttgatgaaagcaaaatccgtgatgcgtttatccgtgcggatattggcaaggccgttagccatcatgccgatgtcatcctatttaacatcgacagtaaagccagttccaatgatgacggcaatccgattctgaatgtgtttttacgcgtgtttaacgagtatcagggttttagtgccgatcatccacatattgcacatatggaacgtcacctgagccagaaaggggtgtatgagcgctttaaacaggcttttgaagaatctagcggcatgtcttggctagaagaacgtgacggctatcagttctatcaggatgatgtcgaaaccgcaatttcccaagccctcaacttatcagcagaagcggcacacaagtggtttgaggattctgagcagacttttagtgtttcggtcgaaaacttctgtcagtgggtgaaagaatacctggacagcaaaggaccccagcaacgcatgttgtttctggtggatgaagtggggcagtttattggcagcgatacccgcttgatgctgacactgcaaaccattactgaaaacctgggtacgatctgtaaaggccgcgcttggattatcgtcacctcacaggcagacatcgatgctgttttaggtgagatgtcttcttccaaagccaatgacttctccaagattgctggacgttttaaaacccgtttatcactgtccagttccaataccgatgaagtcatccagaaacgtttattacgtaaaaccccggaagctgaagcattgctcagatcggtgtttgagcaaaagggcgatatcttaaaaaatcagattacctttgaccgttcaggcccaaccctcaagaactatgaggggccagaaagttttattcataactatccttttgcgccgtaccatttccagctggtgcaaaaagtatttgaagaaatccgtaaagtcggtgcgaccggtgcacacttggcctatggtgaacggtccatgctggatgcgttccagatggccgcgaatgcgattgctacagatgaagtcggtgccctggttcctttccaccgcttctatacttcagtcgaaggtttcctggatactgcagtgaagcgtaccatcgaccaggcagggcagaataagaccctggatggttttgatgtgcagatgctgcgtaccctgttcatgatccgctatgtcgatatcatcaaaggtacgctggataacctggtgactttgtcgattgagaaaattgatgaagataagctggcattgcgcaagcggattgaagagagcctgcagcgtctggaaaaagagagcctgattacgaggaatggcgatgagttcctgttcctgaccaatgaagaacgtgatattacccgaaaaatcaaagccactgacttagcagcttcagaagaaaataaagagttagccaatctgatctttaaagatttactgcgcgatcagaacaaataccgccatcaagccaacaagatggactatcagattggtcgtttcctagatagccatagcctggatgggaagtatgagagcgatttgaaagttgaaatcatttctccactagatacggaatataacctctacactgaagcttactgtattggtaaaagtactcaggccgaagggcagatactgtttaaactggcagacgataaacagttctttaatgaactgcgcacctggctgaaaaccaataaattcatccgcttaaatgatgatggcactcagtccgatatttcccgtattctggcagaccgtggtcgtgagaaccaagaacgtaaaaaacgcctgcgtgtccgggtcgaagaaatgttgctggaggcggaaagttatgccttgggtcaacatctacaactttcatcttcaagtccaatcaccaagctggatgaggcctgtcgttatctgctggaaaatacttataccaaactgagctatctgcaggtctatcagcaggatgcctggcgtgaactgaacgccgtcttgactgtcgatgatatggcgcagctcggattgtctctggatggcggtcagagcaatcccaaagccctacaggaagtggagcagtacattgcactacgggccactggtacagagcgtattctggtctcggatgtggtggatcgttttgccaaacgtccttatggctggccggatgccgagattttactgctggtgggtcagttggcggcaatggggcggatttcactgcagttaaatggcggcagcttacagttaaaagatgcctttgagcctttacaaaacagccgccgtcgccgtgatgtgtcgatcattaaaaaacgccagactgatgatcaggtattgaaacaggcacgccaactgacccaagacctattctcggccatggggccagcgactgagaaagagctgtttgaattctatacccaacattttaacaactggttagccaactttaagtcgtacaaaagcaaaactgatgtcgggcagttcccgggcaagaaagtgattgaaaagtcgattctgactttggagcgcttgctggctaatagcgacagcttcgatttctttaaggccgtggttgagaacaaggacgactatctggatctggaagaagattatcgtgatattcatgagttcttcactaaccagatgccgagctggcagcaactgcaacaggccttacgtcattttgagaaaaacaaacaggcgctgggcagtgatgaggtggcaaaaaaagccctctccgaattacatcgtattttcacccttgaatcgccctatggcctgttaaataaagtggctgatttggttcgtacagtggaaagcgttaatgagcaattgctgactgagaagcgtagccatgcggtagagcaaattgatgacaagatcaaacagttagaagctgagattaaaaacagtggtattgctaccgctgagctgagtaacaagctattacgcccactacaactgctcaaagcggatattgaagtggaaactagcctgtccaccatctatatgttgcaaactcaaaccgccgtggagcgttttgatgaagccttgtatgagttggaaagcgaacttcagacggaaatccagcgtcaggccaaagcggcacaactggctcagagcaaagcagagagtgtaaccaacactgcaaccaccgccagcccaattacatcaacacctgctgcgagtccggtacagcctgtgacagccgtagtgccaccgaaacccgtggtggaagtcgatgtcgcgagcatttacagcaaaagctcaagtagtgtctatctggaaacagaagagtcagtagatcaatttgtagacgtactcaaagctgaattgaaaaaaatcgtgagtgacaaaaagcgtgtgcgtatccgctaa

SEQ ID NO: 274 - DNA, 3456 bp, Vibrio cholerae; identical to SEQ ID NO: 239

SEQ ID NO: 275 - DNA, 3654 bp, Bifidobacterium bifidum
atgaacggggaaagcggcatcagcttcaaggagctgttcaataaagacattgaccgcaacatcaatggtgtgatcaaggccaatgatgagaagaacctcgatgatgaagtcaacgagtatgtgctgacggaggagatttgccgcaatctggccaaattcctcgatgcatacaacgacccgtcgaaccatgaacagaacggtgcatggatttccggtttcttcggttccggtaaatcgcacctgttgaagatgctgtcgcatattctgggcgaggtcccggctgaactcgttgacaagggcaataagccgaccatgagtcgcgaacagattgttcatgccttcatgggcaaggccgaagcacaggatgaccagatgcttgcaggccagcttgaaaaggctttgacgataccagccacgtcgattctattcaacatcgatcagaaggcggataaatccaatgcctccgatatgctgctgtacgcttttgttcgcgtattcgatgaagcgcgtggtttctacggcaagaatccatacgttgcgaaattcgaacgcgatttggcgagcaatggttatttcgaggatttcaaacaagagttcgaacaggtggctggcaaaccatggagcgaaggccgtggtgaggccgtgctatgggatgatgagatctgcgaagcctatgccgcggtgacaggcaaaccggagcaagacagcatcatccaacggtacgaggatacgtacacgatgacggtcggcgacttcgcagacgacgtgaacgtgtggctgtcccgtcaggaaccgaaccgccgcatcctgttcctcgtggacgaggttggccagttcatcggtgagaacagagaactcatgctgtcactgcaatccatcgccgaggatcttgccgtcaagaccaacgggcgtgcatgggtggtggtcacttcccaggaagacatggatactatcgtcggtgatcggaccaagcagcaaagctatgacttttcgaagatccagggcaggttctccatcaagctgaagctcaacagcgccgacgtggtggaggtcattcagaagcgcttgctgaccaagaaaccggaatatgagtcggtgatgaacgagctgtggaatgaacagaacgcgaacctgcgcaccatgttcgaattcacgcgcgagacctcgaaattcagtaataacaaggcatacagcaaggacgatttcatcgcatcgtatccgtttgtgaactacgaattcgagctgttccagaacgtgctgcgggaaatgagccgatacaacatgttctccgggcgccacgcgtccgtgggcgaacggtccatgctttccaccatcagcagcacgctgcgatccagccagaatgagacggtcggggccctgatgccattcgacaaactatatgacggtatcgccgacgccatccaatcaacctcgaacttccgcatcaaccaagccgaaaagagactcggctccgatataaaggagctgggtgtgcgcctgctgaaggtgctgctgctggttaagcatgtcgacggattccccaccacaccgcataacctgcgcattctgctgaccgaccagttcgacatggacgtgatggaactggaacggaacatcaagtatgttctgggagagttggaaaaagacacgtatgtgcagcgcgtgggcgacacctacaactacctgaccaacgaagagcaggatatcgagcaggagatcaaaagcacggacatcgactccaccaaggagatcgaagagctgaagaagatcctggtcagtgacgtgctcggcaagatgacagtggcatacggcgaacagcgtgcccagttccgctatggtttgcgcatcgatggggtgcaacagtccgcgcagcagcccatctggttgaacgtggtcacatcgaccaatgcgcaggaccgtgccgatgccattcgcatgggcatgggcatgcgcgacaccatcaccctgttgctggacatgtctgacaaaaccttgctcgacgacctgcgcatgtacgtgaaaacctacacatacctcatgcgcaccgacaagaacagccagtcagaagtgcgccagcagatcatctcccgcaagagcgtcgccaatgaaaggctctatgcggaattacgcacccgcatcgtcaaagccgcagccaatggcgagttcaactataacggcggaaccgtggaagtgaaatccactgaggtgcaggcccgtatggcggaaggtcttggaacgctcatcggccggtattacacaaacttctccttgctcggcggacaacgatatgaggaaacggatctcgcccgtatcatcatgaacgccgcgcagcaccagcccggcatgcttgacggcatgaacgcagtgcaggacaaactcgacgttcccgccgatgatgtgttcgccgcggtcagtcgcgacaaaggcaaaggcatcatcgccaccgtcaaaagccttcttgatgcctacggcagcgttccctatggttggccgtacgccgccacgctcgcatgcatcggccacctgtatggttccgacagaatcacgctgacgctggacggcaagccggtgcagcgcagcgaggccgcccgcgtgcttagagaaacgaagaagcaggattccatccgagtggatctgccacgcgtattcgacacgagaaaagtctcacagctgcgtgacttcgccagggaattcctcggactcaccgccgcggacctgccatcgaacgcgattgatctggcggaggccgttaccacgcgacttaagcgggaagcggagagtctgacccagctgcgcgtgcgcaatgcccgattcggtttcgtgcagcagctcgacaaggccattgagaaaatcaactacgcctccggaatgggtgaggactggctgctcggtgatttcactatacaggaaaccgagaacggttccgaagaattgcttgaactcaaggaagacataatcgacccgatcgtcaccttcctcaacggctcccaatccaggatccttgcggatggattggagtggctgaagaacaacaagccgaacatcgactatgcctccggcactacggcaagcctgtaccaatccgcggaacagctggcaaacgacccgaacatcttccgcaaaaccaacaaattcaagaccgccattgacgatctgcgtgaggcaacagacgcaaccatccaaaccgaacgagccaacgcgcttaaggacgtggaagatattcgcgccagaatccacgattccaccgaataccagcacacaacacaagccgcgcaaaccaaggtcgaaacagaactggaccaagtggcggaacgcatgcagcacataccgttcatctacaaaatgcgcgaaagcgtacacgaactgagcgaatgcacctacccacaactcatcaacgcactagcagcctccgcatcgagaccgaagaccgcgctcgcagatgaggcgcagactccatctactacaccgacggatacgaacattcctgaatcgcggcaagaggagaccctgcgcgtggccgtatcattcgccaccatcagcagacctcacaccaaggatgctttggagaccaaagacgacgtggacgacttccttgacgcctaccgccgtgagcttatcgccgccattgagaatggaaagaagatcctgctatga

SEQ ID NO: 276 - DNA, 3627 bp, Bacteroides ovatus
atgaaactgaaagaattatataataagcctattgaccgtgcagtgaatcctgctgtcagcgctaccaagtttgacccagaaacagaacgtatagaaatacaggaatacgtgtttacggacgagattatgaacggtcttttccgtattttagatgctatcaagaataaccaaccatacgatcacgtgggtatatggattgacggttattatggctcaggaaaatcacattttctgaaatatctggattactgtatcacaccttctactcgtgaagatgctttatcacgtctgctcgaagcaataaaggctatcgacccgcttgatgacaaacattatctgagcttcgactacgagcagatggtttctatcgccaattggttggaacgggccacgatagatacatgtatcttcaatctggaaacaagctatgacaactctaccgacaagaagaaagcttttctgcatgtcttctggaatgagtttaatggcaaacgtggtttcaataagttcaatatcacactggcacagaatcttgaaaaacctttggaagaaaagggagtgtttgaggcattcaaacaacgcatcgcagaggaaggtggtgactggaatgaccctggtatggctgccgatttgattgacaacgaactcgactgggtgcttgacattgccaaagaactggcaccaacactttccgtagatagtattcgtgagcgtatcatcaagcgtgatacgaacatgagtatagaccgttttggtttggaactggcatcatatcttaaagacaagggcgatgattaccgcctgattttccttgccgatgaagtttcacagttcatcaacaaggagcgcgaccgttatcttaaccttcaggaaatcattacgaaactgtctgaagcttgtgataacaaggtctgggtggcttgtacagcacagcaagacctctccgagattatggacgactgtcatatagccgaggagaaagataaagaaggtaaaattaagggacgctttgaagtgaaggtatccctcaaaggaacacagccggaagtaatcacgcagaagcgtattctcgacaagaaagaagaggtgaaagatacattggcctcgctttataacaaatataaagcgggattcgacttgcagttcaagttgcccaactcctacagtagctacgactcgcaggatgatttcatcgactattacccatttgtaccttatcagttcaagcttatcatgcaggtgttcaattcattcctgaacttaggctatgtggcaaaggaagtaaaaggtaatgagcgaagtatcatcaaggttatccactctacagccaaagcgaatgctgatgccgagttgggtaaattcatctctttcgatgaactctataacaatatgtttgaggaaggtttgcaggctcgtggacagaaagctgtggacaatgcccttcgtatggcacgcacctaccagacagataaaccggaaaagactcgtctggcggttcgtgtggccaatgtgctattcatgatatgtaatatctcacagaccgaccagctgcttttcccggccaccgtggataatgtgacttcacttctggtaaacaatatggatactcctcgcctcaccatcaagaatgaggtggagaaaattgtagagttcctttgcgataataatattattcgccgtgaacagggcaaacagggagctcctgacactttcatgttctatagtgaggaagaaatgaaggtggcacaactcattaagaatcaggtggtggacaataatacgcaggctgaacagctgaaagatattttcaataaatatatcacagctctcaagaataaagaacaatataagacacgcagtttctcggttggactgactataaaacagcgtaccttcctgagcaataacccggatgtaatggtagagtttgtcatggaccccgactatgatactgccgagcagcttgcattgcagaacagcaataccaaccgaatggtatattatgtaggtcctcagtatcgtgagaacagacgtttgtacaacgccttttactggtactgtcaggcagaacgttatatgtccactcccgtcccaaacgaggataatgccaatacccgtaaggaatttgccaagcgtgccgaggaactttacgaaggacttattaaaaaagagtttgaaaagattttggatacctgtcctattgtttccggactatacgtgattgacgatgcagagcttggacagaaacgtggtaatgaccgttatcgtgttgccatcgagaaacatttagcaggaatctatcctaaagcaaatttggttgattctccaagcattccacgcactacagagcaattgaagaaagccattctgcgtaatgtgaatcctggagattacgaaggtatgggggcgattcttacagatgctgagcatgaagtggaaatctatctgaataagcagtttgctgaggtaaatgtaaccgatgtacttaccaaattctctaaagctccttatggatgggacaatatctgtaccctatatgtgattaatgaactggtacgtcgtcacaaccgtgactacacttacaccaataatcccaatgtagaaacatctacagtggccaaccgcattgtatcagagagtaataagtttacgctacgacaggcacaggttatttcaccgcaggtaattcagaatttcattgctgcatggaaggaagtatttggaatctcttccgctccgacaactacagacagtacccagctattccgcatgtgtcgtgacatagagagtgagcgtagcctgtccaaattaatcaaaggctataaggacatagaacaacagattatagcttatccttttgtggaaccaatccgtaaggccatagatctcttcgaatcatggcttgatgaacgtgatccgttgaaattcttcaatctcatcatctcatcaaaggatgaagccaggatgcttaccgacaaatgcaaagaggtggtacaatttacccatgatcaactctctacctataaacagctcatccagttcgctgatgagaatacatataacttctcgtttgttccggaagagatgataggagctgttgatgagttcctaaaagtgaaggatgacctttggccaatgggtaacacattccgtggctatataaaattgaggaatcagctttccggcagtttggacgatgtgcgaaatcaacttcgcgataaaattaaagcggcttataacgatatttttgactatttgttgcaagtagctgagaaacagaatgtcccggcaagtgtactttccgaccgtgaagcaaccatacagcttaaaactgcgccaacaaatatacttgtactgagaaacaatatccttaccgatgtattctatcaggagcaggtgaacaagattatgtcgtatattcctcctaagcctactaaaaaggataatgatgaagttgatcctccaacacctcctgtacgagaaaagagaattcgtcaggcatcactgcaaacaaggacaaagttacctattacaaacgaagaagacatagaccgttatcttgaaggtttgcgtcaacagattgaacgtctgcttgtcgaccatgacggagtgatgattattaaataa

SEQ ID NO: 277 - DNA, 3456 bp, Vibrio cholerae; identical to SEQ ID NO: 239

SEQ ID NO: 278 - DNA, 3627 bp, Parabacteroides sp.
atgaaactgaaagaattatataataagcctattgaccgtgcagtgaatcctgctgtcagcgctaccaagtttgacccggaaacagaacgtatagaaatacaggaatacgtgtttacggacgagattatgaacggtcttttccgtattttagatgctatcaagaataaccaaccatacgatcacgtgggtatatggattgacggttattatggctcaggaaaatcacattttctgaaatatctggattactgtatcacaccttctactcgtgaagatgctttatcacgtctgctcgaagcaataaaggctatcgacccgcttgatgacaaacattatctgagcttcgactacgagcagatggtttctatcgccaattggttggaacgggccacgatagatacatgtatcttcaatctggaaacaagctatgacaactctaccgacaagaagaaagcttttctgcatgtcttctggaatgagtttaatggcaagcgtggcttcaataagttcaatatcacacttgcacagaatcttgaaaaaccattggaagaaaaaggagtgtttgaggcattcaaacaacgcatcgcagaggaaggtggtgattggaatgaccctggtatggctgccgatttgattgacaacgaactcgattgggttcttgacattgccaaagaactggcaccaacactttccgtagatagtattcgtgaacgtatcatcaagcgtgatacgaacatgagtatagaccgttttggtttggaactggcatcatatcttaaagacaagggcgatgattaccgcctgattttccttgccgatgaagtttcacagttcatcaacaaggagcgtgaccgttatcttaaccttcaggaaatcattacgaaactgtctgaagcttgtgataacaaggtctgggtggcttgtacagcacagcaagacctctccgagattatggacgactgtcatatagccgaggagaaagataaagaaggtaaaattaagggacgctttgaagtgaaggtatccctcaaaggaacacaaccggaagtgattactcagaaacgtattctcgacaagaaagaagaagtaaaagatacgttggcctcactttataacaaatacaaggccggattcgacttgcagttcaaacttccaaactcatacagcagttacgactcgcaggatgatttcatagactattacccttttgtcccctaccagttcaaactcatcatgcaggtgttcaattcgttcctgaacttaggctatgtggcaaaagaagtaaaaggtaatgagcgaagcatcatcaaggtaatccactctaccgccaaggctaatgccgatgctgaattgggtaaattcatttcattcgatgaactctataacaatatgtttgaggaaggtttgcaggctcgtggacagaaagctgtggacaatgccctccgtatggcacgctcctaccagacagataaaccggaaaagactcgtctggcggttcgtgtagttaatgtgcttttcatgatctgcaacatttcccaaaccgaccagttgctgttccctgcaactgtggataatgtgacctctcttcttgtaaataatatggatactcctcgtatgaccatcaagaatgaggtggagaaaattttagagttcctttgcgataataatattattcgccgtgaacagggtaaacagggagctcctgacacattcactttctatagtgaggaggaaatgaaagtggcgcagctcatccaaagccaggtggtggacaacaatacccaggcagaacagctgaaagatatttttaataaatatattacagctctcaggaataaagagcaatataaaacacgcagtttctccgttgggctgaccataaagcagcgtaccttcctgagtaataaccctgatgtaatggtagagtttatgatggaccccgactatgatactgctgagcagcttgcattgcagaacagcaatactaaccgaatggtatattatgtaggtcctcaatatcgtgagaacagacgtttgtacaacgccttttactggtactgtcaggcagaacgttatatgtccactcccgtcccaaacgaggataatgccaatactcgtaaagaatttgccaagcgagccgaggaactttacgaaggacttattaaaaaagagtttgaaaagattcttgatacctgtcctattgtttccggactatatgtgattgacgaagcagagcttggacagaaacgaggtaatgaccgttatcgtgttgccatcgagaagcatttggcaggaatctaccctaaagcaaatctcgttgattctccaagtattccacgcactacagaacaattgaagaaagctatactgcgtaatgtgaatcccggcgattacgaaggtatgggggcgattcttacagatgctgaacacgaagtggaaatctatcttaataaacagtttgcagaggtaaatgtgactgatgtgcttaccaaattctcaaaagctccatatggatgggacaatatctgtaccctttatgtgattaatgaactggtacgtcgtcacaaccgtgactacgcttacgccaataatcccaatgtagaaacgtctacagtggccaaccgtattgtgacagagagtaataagtttacactccgtcaggcacaggtcatttcaccgcaggtaattcagaaattcatagctgcctggaaggaaatattcggtatttcttccgctccgacaactacagacagcacccaactattccgcatgtgtcgtgacatagagagtgagcgtagcctgtccaaattgataaaaggctataaggacatagaacaacagattatagcttatccttttgtggaaccaatccgtaaggccatagatctcttcgaatcatggcttgatgaacgtgatccgttgaaattcttcaatctcatcatctcatcaaaggatgaagccaggatgcttaccgacaaatgcaaagaggtggtacaatttacccatgatcaactctctacctataaacagctcatacagttcgctgatgagaatacatataacttctcatttgttccggaagagatgataggagctgttgatgagttcctaaaagtgaaggatgacccttggccaatgggtaacacattccgtggctatataaaattgaggaatcagctttccggcagtttggacgatgtgcgaaatcaacttcgcgataaaattaaagcggcttataacgatatttttgactatctgttacaagtggccgagaagcagaatgtcccggcaagtgtactttccgaccgtgaagcaaccatacagcttaaaactgctccaacaaatatcctggtactgagaaacaatatccttaccgatgtattctatcaggagcaggtgaacaagattatgtcgtatattcctcctaagcctactaaaaaggacaatgatgaagttgatcctccaacacctcctgtacgagaaaagagaattcgccaggcatcattgcaaacaaggacaaagttgcctattacgaacgaagaagacatagaccgttatcttgaaggtttgcgtcaacagattgaacgtctgcttgtcgaccatgacggagtgatgattattaaataa

SEQ ID NO: 279 - DNA, 3615 bp, Escherichia coli
atgaatattgaacaaatttttgagaaacagctaaaacgtaatattaacggcgtggttaaagccgagcagaccgacgacgaaagcgcctggatagaactggatgagtatgtcattaccagagagctggatggtcacctgcgtcagttctttgaagtatatgcccctgctactggccctggcagattacagcttgctgacaaaataggcgtctgggtttcaggcttctttggttcgggtaaatcacacttcattaagatcttatcctatctactggcgaaccgcgaagtaagccataatggtgtcactcgtaatgcactttccttctttgaagagaaaattgatgatgcactgctattggctgatattcggaaatcggtacaacatccgaccgatgtcatattattcaatattgactcacgtgcgaatgttgaagatggcgttgatgccatactcaaagtctttctgaaagtctttaacgaactagctggttattgtggcgacttcccacatattgcacatctggaacgtgagctcgataagcgtggacaatttgatacctttagggcagccttcgcggacattacagggtctcgctgggaagacgaacgtgatgtttatctgatgataaacgatcagatggctcaggcactgagtattgctacaggccagagtgaagagtcttctcgtcaatggatcgagcaacttgataagaacttcccattggatatcaaaaatttctgtacgtgggtgaaagagtggctcgacagccatggtaatcgcaatatcctgtttatggtcgatgaagttggtcagttcattggtaaagatgctcagatgatgctcaagctgcaaactatcaccgaaaacttgggcgttatttgtggtgggcgggcatgggtgatagttacctcccaggctgacattaatgctgctattggcggtatgagcagtcgtgatggtcaggacttctccaagattcagggacgtttctcaacgcgcttacaactctccagctcgaatacttcagaagttatccagaaacgtctgctggtaaaaaccgatgcggcaataccggcgctggaagctatctggcaggaaaaaggcgatattctgcgtaaccagttggcgtttgacacgacaacgaccgctactctgcgagcctatacaaacagccgcgagttcgtggataactatccgtttgtaccgtggcattaccagatcctgcaaaaagtctttgaatcaatccgtactaaaggggccgcaggtaagcagctggcaatgggggagcgctctttgctagatgccttccagtcggctgctgtgcaaatctccgcagatggtctggatagtctggtcccgttctggcgcttctattcagcgattgaaagcttcctggaacctgcagttagccgcactattattcaggcctgccagtctccgtcactgactgaatttgacggcaaactactaaagacactgttcctgatccgctacgtcgatgtgctgaaaagtactctcgacaatctcgtcacgctctctattgagcgtattgatactgataaagtggaactccgtcgacagattgaagccagccttaatcgtctgcaggctgagatgctgatctcgcgtattgatgacaaatttgtttttctcactaacgaagaaaaagagattgaaaacgaaatccgcaatattgacgtggaattcaccaccatcaataagcaactctcaaccatcattttcgaagagatcctgaaaaacaaaagatatcgctatccggccaataagcaggattttgatatcagtcgtttttgtaacggacatccgctggatggtgcgaatcttaacgatctggtggttaaagtgctcacgccactggactcgaactacgagagctataagggtgcgcattctaatagtctgctgatgacggacagtaaagactgcatcttaatttgcctgcctgatgaggctcgtacctggcaagacctgaccatgtacgctcagaccaaagctttcctcagcaagcaaagcggccagcgcccggaacaggcaacgctgttggcggaaaaaggccgtgaaaatagtatgcgtgaaaaaacgcttaaggcgcagattgaaggcttgctggctcaagctgatgtctgggcgctgggcgaacggctggataagaaatcctcttcgccgttagctatcgtggatgcagcctgcggttacgttatcgagaacagtttctctaaactaaaattgctgcgtcttagtaccggagacgtaaatcgtgaaactcacgcgctgttgacagtagaaaatgatacccagctcgatctcgggggtatggaagaatccaacccagaggcgatgcgtgaagtggataactggatcagcatgagtattgagactcataagccagtttacctgcgggatattctcaccacttttggccgtcgcccgtttggctggccggaagatgaagtcaaattgctggttgctcggctggcacgcagcggtaaatacagcttcactctgcaaggcagtgaaatcgcactgaagcaggcgtgggacgcgtttaataattcacgtcgttacagcgatttgcgtctgcataaagttcgtcgccatgatgaagcacagttgactaaagctgcgcagctgatggcagagattgctggagagccgtttaacgagcgtgaagaacagtcgttggtctctcatattcgcgaactctttggccgctggaatagcgagttgactgtttttaaaactcgtgcagagagtggacaaaaccctggccgtaaagagatagaagaaggtctggtattgctgaacgggatccttaacgagaaagaggaatacgcggtcattgaaaaaatcaccgcagcggctgacgatcttaaagatttctcggaagactgggacgatttggttagcttctacaaaaaccaatacgctacctggcagcgcttgagtatggcgttgaatggcagttttaaagctaaccgtaacgcgctggataaagacgaaacggcccaaaaggcgttacaggaactggaagggatctacagcaaggcacgaccttatggagaactgcatcggattatcccgctgattgaaaccgttgaaaccatcaaccagcgtctggtcgaagaatatcgaagccatgcgctgctacagatcgatggtcatatcaatgaacttaagcaaagcatgcaggagatgcacgtccctgctgacttgcaacactcgcttttacacccgatgcaacaatcgcgtaagaaagtggagcagaacggcctgatcccacagattatggaagaacaggctgaggttcgagcgctacaatttaaagcgaatgaacggctgaacggctgggttgaggatcagcgtaagaaagtgtctgatccaaaacctgctcctcagcctgggattatcgaccccgtagttaagcctgaacccaagctgaaaaaaaccatctacgtaaacacgcgtaaaacgatggaacgagcggcgggtgtgacaacgctggataacgccgaacaggtagacaaagcgctggaacaactccgtaaaacgctaatggatgccattaacgcaggtgaacgcgtacagcttcagtaa

SEQ ID NO: 280 - DNA, 3534 bp, Lachnospiraceae bacterium
atgtttgcggatgacatcaaccgcaaaatcaatggtgtaattaaagtagatcaggctgctgatgatgtaatcgagcaggagttaaatgaatatgtcattaccagagaattgaagaaacacttcattactttcttcaactattatggagatgcctttgaccagcctacggctgatatgggtgtttggatttccggtttctttggaagtggtaaatctcactttctgaaaatgctttcctaccttttggaaaataaagaggtaaaaggcattcgtagtgtagagcgtttccgcaaaaagtttgaggacgatccggcaacctttatgctgattgaccgtgctacaaagggaacaacggagacaattctgtttaatattgatattgagggattcagcaataaagacaagacagctgtacttcgtgtttttgcgaagatgttctataaccatctgggattttacggagaaaatctgaaagttgccatgatggagcgttatatcgaccaacagggaaaaactgaggagttccgcagagtttttgaagaaaagaaaggcaagccctggctggaaatgcgtcgtgcctttgctttcaatggaaagtttattattccgacactgatggaagttctggatatgagtgaggacgatgccaaagcatggttcaatgataaaaccgcaacagaaatttctatcgcacagcttgtggaagatatgaaagcctatgtggataccaagcctgccaacttccgtttgttgtttatgattgatgaggttggacagtatgttggtacagataccgatatgcttttgaaccttcagtctttgacagagaaaattggaagtgaatgcgaaggaaagatttgggtgatctgcaccggacaggaagccattgatgaaatcatcaaagttcgtgccgatgagttctcccgtattcaggctcgttttaaaacaagactgagtttatcatcttcctctgtggatgaagtcatccagaaacgtattctgaaaaagaaaccagaagcagctaaaaatctggaagatgtttatgagcagaatgattctgttcttcgtaacctgttcagctttagcggctctattctggatattaaaggctattccggtccgagggaatttaccgagaacttcccgtttgtgccgtatcagtttattatcatgcagaaggtatttgctgaaattcgcaagcacggaaattctggcaagcacctgtctggtggtgagcgttccatgctctcaggcttccaggaagctgcacagaaaattcaggagaaggacgaatatgcacttgttccgtttttccgtttttatgatactgtacatacttttctggatggttcgatccgtcgtgtaattgagcgttgccagaaagctgtcgacaacggggacggcattgaacagcaggatgtagatgtactgaaacttttgtacttaattcgatatattgatgatattccttccaatttggacaatatcgtaatccttatggcagacgatattcgtgtggataagattatcatgcgcgaagctgttcgtggatgtcttgatcgtctgatgagccagaactatatcggcagaaccggagacacttataacttcctgactgacgaagaacaggatattcagcgtgaaatcagagatacaaatgtggataccgcttctatcgtagagcgtattgctcagatgatttacggtgatattttcacaactaagaagttccgttatggaaaatatgactttgcgtttgatcagatggtggatggaattaccgttggtgcggcaacaggaggtatgcgtctacgcttcctaactgttgctactgatgccattgaaaaaacagattaccgtctgatggcagaatccaaaggtaacgaagcaatcgtggttctggctgatacgccttattatgaatctctggaatctgttatgaagattcgtaagtacgtaaagcagagaaatgtaagccagcttccaaaaactgtgcagaaaatcatcagcgatcagcaggacgaagccggaaaatatgagctgagtgccatgactgaattacagaacgctatcgaaggagcgcagttctatgtagatggggagcatctggaaatcaaagccggaaatgctaagagtaagattgatcagtctctggaatatctggttgctcatgtatatagtaagctcgacctgattacagatcatgcaggcagtgacgcagatattattgcgattctgacaggtgcagtaacggcacttccgggcatggagccaaaccgtgatgctgcttctgctatggaagaatatctggaaatgcaggatgctaaaaaactgccgacatctatggcagacgtgcaaagcaaatatagtgcgattccgtatggatggaaagaaatcgacattgctgcggttgcggcacagctgatttattcccagaaagtaaccatcaagtatgcaggcaataccattcagccggatgacccgaaattgccggatatgctccgcaaaaagagtgagatcggcaagacttccatcagcaagcgtaaaaccatttcagctacgatgatgcgtgatgtaaaagcaatgctccgagagtattttgatgttatggatgtgccagacgatgaagatggtctgattcgctttgtgactgaaaaattcggtgaacagcgtgattactatgcttctctggatgcccgttatgacggacataaatacccggatcgtgcattggtgcaggaagccattcatctgatggaggatgtactttcccagaagaaagacaatattgccctgattgagcgtgtgctgaaaaaagaggatgctctctttgataacaaagaagccgtgagcaacggtatcgaaaactttttcaagacccaggtagcagtattcgatcaggcagtgcagtttgaaaaatctctgcatgatgaccttgaccgcattgcagaaaatgaggaagcacacaaggcattgaataccattcgtctgattaccatggttcagaccggaagcaagttcaactataaccggattcgtgaactgaatccgttgatggatacggttcgtactgctcatgataagatgctggaagaaaaacgtgcagaggttctggaaaccgttcgtcagtgtatggaagcaacccacactgccgcaaacggcgattccaaggcatcccatctgattgaaaaatcagatcggtatttcagccagtgcaaggagaaaatcgcagagttaaagagccttgcccttctggatgccatgttcctgccgatgtgccagtataaggatgatacggtcagcaatattgagtctgttctggctccgcctgcaccgaagccgccagcacaggcgacacagccgggaaaagggcaagcgatcgcaaagaagaaagtgattcgtacctataaccgtcaggttgtattccaggcaaagaccttacagaccgaagcagatattgatgattatgtagagaagattcgttctcagctgaaacagttgttgaagaattgcgacgagatcaagctgaattaa

SEQ ID NO: 281 - DNA, 3456 bp, Vibrio cholerae; identical to SEQ ID NO: 239

SEQ ID NO: 282 - DNA, 3609 bp, Bacteroides ovatus
atgcaactacaagatctgtatatcaaatccattaatcgtccggtcaatccggcagtttctgctaccaagttcgataaagagaccattgatattgaaatcaaggaatacgtttttaccgatgaaatcctcaatggactttatcgcattctgaatgctatcaagaacaataaaccttacgaccatgttggtatttggattgatggctactacggttcgggtaaatctcacttcttaaagtacctcgactactgcattactcccgaaactcgcgatgtagctttaaaacgtttacttgatgctgtgaaagaaatcgatcctttcgatggtaagcacaaccttcagtttgagttttcacaggttcaagatattgcttcgtggctcaagactgccaccatcgatacctgtatcttcaacctcgaaacctcctacaatgcggctaccgacaaaaagaaggcttttttgcaggtgttttgggatgagtttaacggcaaacgtggactgaacaagtttaacctcaccttagcacagcttttggaaaaaccgctgatggagcgtgggctgttggaacaatttaaggaggtgattgccgagatgggtggcgattggaacaatcccagcgaggctgccgatttggtggatcaagccttggagatggttgtagatgccgcttgtgaactcaatccgcagtttgaccgcaactccctttacaaccatatcgacaagcgcgactatgccatcagtatcgaccgcttcggtatggaactggcagactatatcaaagacaaaggcgaagattatcgcttgatattgcttgccgatgaggtgagccagtttatcaataaggaacgcgaccgttacttgaatctgcaagagattatcactaaactttctgaagcttgcaacaatcaggtgtgggtggcttgtacagctcagcaggatctcagcgagattatggatgactgtaatattggtgaagaaaaggacaaggaaggaaagattaaaggtcgttttgaagtgaaagtatcactcaaaggcacgcagcccgaagtgattacacagaagcgtatcttggaaaagaagccggaggtgaaaaccgacttagctgccatgtacgagcagcagcaaggagccttcagtctccagtttaagttaccaaatgcgtataagagctacgatacggagactgactttatcgacttctacccctttgttccttatcagtttaagctcatcatgcaggtgttcgactctttccttgctttggggtatgtggctaaggaggtgaaaggtaacgaacgaagcatcatcaaggtgattcacgctacggctaaggctcccaacaatgctcaggccgaagtaggtaagttcgtttcgtttgatgaactttacaacaatatgttcgaggagggtttgcaggcccgtggacagaaggctgtggataatgctatccgcattgcccgtacctatgctgacccgaaactggcggtacgtgtagccaatgtcctctttatggtttgcaatatttcgcaaactgatcaactggttttcccggcaacgctcgacaatatcaccacgttgctgattaacgatatgaccacgcctcgcctcaatctgaagaatgaggtagaaaaggtggtagatttcctttgcgacaacaacatcatccgtcgtgaacaaggccgtcagggtgcgcccgacttcttctcgttctatagcgaagaggaaatgaaggtagccgagctgattaaaagtcagactgctgataacaacctacaagccggtgagctgaaagaaattttcaaccgttacttgaaaggattgaagaacaaggagcaatacaaaactcgttcgtttgccgtgggaatgaccatcaatcagcgtaactacctcagtaataaccctgatgtggttgtggagtttatgatggatgacgactatgatacacccgaacaacttgctctacaaaaccagaccaatcggttggtgtactatgtggggccacagtttcgtgccaatgctcgtttgcgcaacaacttctattggtattgcaaggtgcagagctatatgaccgccaatcctgctaccagcgacgagaatgctgccgtgcgcgaagaatttaaaaagcgtgccagtgaagtgatgagtggcattattgagaaagagttccaaaagattctcgacacctgtcctctagtaagtggactttctgtaattgatgatgtagagttgggtaataaaaaagggaatgaccgctacttggctgctatagagaaacacctttccggcatctataccaaagctgggttggtagatttaccgcaaattccccgaaacagtgatagactcaagacggctatccttcgtcccgtgaatccgggtgattacgagggattaaatgactcgcttaccgaagcggaacatgaggtggaaatttacctcaacaagcaatacgaggagttgaatgtgggtgatgtggtagccaagttctctaaagcaccgttcggttgggatggcatctgtaccctatatgtggtgaacgaacttgtgcgtcggcataagcgtgactatagttatagcaacaatcccaatgtggaggtgaatattgtagcaaaccgtttgctgagcgaaaccaacaagtttactattcgtccggctgtaaccatttcgcccgaggtgattaatggtttcattgccgcttggaagaacatctttggtgtgagcgaatctttctccactaccgatagtacccagctattccgtctcagtcgagagaaagagaatgtgcgaagtgtggagaatgtagtagcacgctacaagcagcactacaaggataatgccgcatactctttcagtgcgccgctcgacgagatggtgaccttgctcgaaggttggcttgccgagcgcgatccgttgaagtatttccgtcgtgtgattgacgaacagcagcaggcgcgcaccctcttcgatacttgtaaagaagtcgtgcagtttgtccaagaccaaatgggtaattataaggatgtgctccgctttgtacgcgataatcgggataattttagcttcgtacctattgagcttcacgaggcagttacgcagttgataggaatagagaatgcagcatggcccatcggcatacgtacttatatgaagcttcgcaacactcttgccggggctatcgatgttaaacgaacagaacttcgcaaacaaattgctgaagaatatgccaaaacgtatgctcagttggagcaaggctgtaaggaaaacgaggtatcgacttctgttctctcagatcaagaggtcatagtaaaactcaaaacacaaccggatagcattcctgtgttgcagaccaacctcgataccaatgcattctttgcagagcaaacagcgaagatattggctgcaaaaccgaagcctaaacctacggttggtgatgacaaaaacaagaaggaagaaattcctgctaagaagtatcctacacaggtagctttgagtactcgtaccactttacctattggctcagaggctgatgtggataagtatttggcacaactcaagaagcagctaatggcacatattgacaaaggcgagacggtaatgattatcaaataa

SEQ ID NO: 283 - DNA, 3672 bp, Enterococcus faecium
atgctaattaaagatatttttgcaaaaccaattgaccgaaatattcaaggagttattaaggtcggtcaagcaaaggatgaaaatgttcaacaagaattagaagaatacgtggttacgaaagaactacaaaaacactttaaaacaatttttgatgcctaccaacggagtatcaatacaccaacagataaaatgggtgtttggattcaggggttctttggttcaggtaaatctcatttcttaaaaattatttcttacttgctcgcaaatcgagaaataaatgacaagaaagccattgattacttcaaagaagatgggaaaatcaaagatccactgactttggcaacgatggaacggtgctcacaaataaatacagatgttattctgtttaatattgattcaaaaagtgatgcaggtggtaaaaaagacaaaaacggaatcgtgaatgtttttttaaagatatttaacgaaatgcaaggattaagcacgattccacatctagcagattttgaacgtcggttaattaaagaagaaaagtttgatgcattcaaagctgcttttgaagagattaatggggcaaaatggcaagaagagcgccatgagtttgattggatccaagatgatatcaaagaagcggcacttaaaatcgattttatgagtgaagccgctattgataattttttagaaaaagcatcaggaaattatttaataagcattgatgactttgcaaatctagttaaaagctatcttgattccaaagaagcagaccatcatattgcctttctagtcgatgaggtcggacaatatatcggcggtaatcgtgagttgactttgcagttacaaaccgttgtggaagatttgggtcgaatttgtgaaggtaaggcttgggtattagtgacaagtcaggaagcgattgatcacgtaacaaactttgataacaattctgataatgatttttctaagatcaaggatcgttttgccacaactgtgagtttatcttcagcaaatgccgatgaagtaattaaagaacgtattttgaagaaaaaagagtttgccaatgattctttagccttacaatttgaaactgttcaaacagaattgaaaaataaattactctttgttgatagtcctgaattaaagctcttccaagatgctgaaaattacgcagaagtttatccatttattccctatcaattcaatttattggggcaaattctaaccgagattcgtaatcacagctatcaaggatcaaacttatcgtctggtgaacgttcattactagcaatgtttaaagaagccgctgaacgaaataaggaaaatgatacaaccagtttggtttctttagatcagttttattactcgttagaacgttggattgatacagcaattagccgagtgattacacaagctacaaataattctcatattcaaagaccaactgatatagataactttaacgtaaatgtcttacgaattttattcatgattaaatatgttgatcaagccatcaaaccaaatgttgaaaatattacgagcttgatgataagaaatatcaacgaagaccgcctggaaactaaaaaacgagtagaagaagcattggaccttttaattaaggaaaactttgtgcggaagaacttagatagttatattttccaaactgatgaagaacaggaaattactcgtgagattaaaaatcaaaatattacagatagtgatttgatcgtagaactatctaaacgaatttttgacggcgttctagaccgaaatagttttgcctatgaaaaattaggcatgtcaggtggaaataaatttaaaaaccggtatacgtttacttatgcacaagtgttagatcaacgtccatacaagcaagctggaaatgctgaaatgacagttaattttatttcaccatactctgatttagcaggtcaagaggcagaacttgcgcttaagagttcccgtaacttattattcgtagaattgccatcagataaagaatttaaagatgatatagcaatgtatgctagaatgaatctttatttaacaacgacttattcgagtgtagtaaagaactttgacgcgattcgttcggaaaaatctggtgaattacaggaactaagtgcaagtatcaacgatcaattaaatgaactgttgaaatctgcaaaatttttctataacggtgcagaaattcaactgacaggctccgactttaaagcaaaattccaatcagcacttcagaaaatggctgaagaagtataccataaattaaaccaaattgatgcgcctaaagaaaaagaagatatcttatatttagtgaaagaaagcaaaaatgaaattattgaagatccatcaaatgagcaagcagttcaggaaattttcaattttatcaatgatcaaaagagaaatcacctaacgattacgatgaaaacaattcgtgatcgttttgaaacaaaacaaccgtatggattcacagaacttgatgtggaatggtgcatcgctaaacttttcatgtctggtaaaattgatttactttataacaatgtacaaatttcacggatggatgatccaaatagtattgtaatgattattcaaaaacgacgagaaagtgaaaagataaaaattgaaccaagcgcggtgatttcgccaaaagcaaaaaaattggttgacgaaatcggtagagaactgtttcaaagtcgtaatattgttgatgaaaataacaatgaacatacaatggaaaatttcaagaaatatttaaaaggtcaattagacaatttacgctcttattttgatttacaaaacacttatacctaccctagtgcttatgaatatgagcaaataaaaaaatatcttgaagtaattgttcaaacgtcagatgttgaagactttttttatacaatcaaaaaatatcgcgatgaattattcgactgggctgaaacatatgataaaattaaaaatttccacaagcaaaatagtactcagaaaaaaatctgggagaatgcacaagataaaattagattaatcgaaaaaagtcggcgtcaaacttctagccaagaaattgatcaattgattcatgagatgaaaaccattttgaaaaaggctgatccttattcagatatgatgaaactaaatgagttgattcaagaatttattgaacaatataatcaactgttagagttggaaagtcaggaaatattaaataaattaacggaagaaaaacaagcaacatttaaattattagaaggaaaagattttaaggatcaatttgtaccaatagttgaccaagaatttcaagaactgaaagcaaaaattgaacaagcgaatactatagatgatcttgttttcttatcattaaacgtagcagaacagtatttgatctttaatcaacgtttcgataatgaagaaaaccgcagacgtcaagaagaacaagcacgtaaacaaattgaagcagcaaacttgattcgtgaaactgaaaaagatgaaatagactctgcagcaaaagctgaagaaatagcgatagtaaaacctactattcaacagaaaacagtaccaatgagaacacttaacgttcatgttaaaactattaagtcagcagcagatattgatgagttaacagctgaaattaatcaaaaactgaaggaacaacttcaagaaaatacagaaatcacgattcaattctag

SEQ ID NO: 284 - DNA, 3609 bp, Yersinia ruckeri
atgaatattgaacagattttcgaaaaaccgctaaaacgtaatattaacggcgtggttaaagccgagcagaccgatgacgaaagtgcctgggttgaactggatgagtatgtcattacccgagagctggatggtcacctgcgccagtttttcgaggtgtatgcccccgccacaggccccggtcggttgcaacttgccgataagatgggggtttgggtttccggcttctttgggtccggtaaatcacacttcattaagatcctttcctatctgctggcgaaccgcgaagttagccacaatggcgtcacgcgtaatgcgctctccttctttgaagagaaaattgatgatgcactgctattggccgatattcgcaaagcggttcaacatccgaccgatgtggtgctgttcaatattgattctcgcgcaaacgttgaagacggcgttgatgcgatcctcaaagttttcctgaaagtgtttaacgagcttgctggttattgcggggacttcccacacattgcacacctggagcgcgagctcgataaacgcggtcagtttgatacgtttaaagccgcctttgccgacattacaggctctcactgggaagatgaacgtgatgtctatctgatgatcaacgatcagatggcgaaggcattaagcatcgctaccaagcagagtgaggagtcctctcgccagtggatcgaacaactggataagaacttcccgctggatattaagaacttctgtacgtgggtcaaagagtggctcgacatccagggcaaccgtaacattctgtttatggtcgatgaggttggtcagttcattggcaaagatgcccagatgatgctgaaactgcaaactatcactgaaaacctgggcgttatctgcggtggtcgcgcatgggtgattgtgacgtctcaggctgacatcaatgccgcgattggcggtatgagtagccgcgatggtcaggacttctccaaaattcagggacgcttctccactcgcttgcagctctccagctccaatacttcagaagttatccagaaacgactgttggtgaaaaccgatacggcaaaaccggcgctggaagccgtctggcaggaaaaaggcgacattctacgtaaccagttggcgttcgacacaacaaccacagccactctgcgcgcctactcaaacagcaaagaattcgttgataactatccgtttgtgccatggcactaccagatcctacaaaaggtctttgaatcgatccgtaccaaaggggctgcgggtaagcagctggcaatgggggagcgctctctgctagatgccttccagtcagccgctgtgcaaatctctgccgatggcctggacagcctggtcccgttctggcgtttctattccgcgattgaaagtttcctggaacctgcagttagccgcaccattattcaggcctgccagtcttcatcgctgacggaatttgacggcaagctgttaaagacactgttccttatccgttatgtcgatgtgttgaaaagtaccctggataatctggtcacgctttccattgatcgtattgataccgataaagtggaactgcgtcgacagattgaagccagccttaatcgtctgcaggctgagatgctgatctcgcgtattgatgacaaattcgttttcctcaccaatgaagaaaaagagatcgaaaacgaaatccgcaatatcgacattgagttcaccaccatcaataaacagctctcgactatcatttttgacgagatcctgaagaacaaaaagtaccgttatccggcgaacaagcaggattttgatatcagtcgtttctgtaacggacacccgctggatggtgcgaatctcaacgatctggtggttaaaatccttacgccgctggattcgaactacgaaagctatagaagtgcacattccaacagtctgctgatgacggacagtaaagactgcattctgatttatctgcctgatgaagctcgtacctggcaagacctgaccatgtatgcacagactaaatctttcctcagtaagcaaagtgggcaacgcccagagcaagcaacgctgttggccgaaaaaggccgtgaaaatggcatgcgcgaaaaaacactcaaaacgcagattgaagcccttttggcgcagtctgatgtctgggccttgggcgaacggctggataaaaaatcctcctcgccggtggcgattgtggatgctgcttgcggctacgtgatcgaaaacagtttctccaaattgaaaatgttgcgtctcagtaccggggatgtgaaccgtgaaacccatgcgctgctaacggtagaaaacgatacgcagcttgatttaggagaaatggaagagtctaacccggaggcgatgcgtgaagtggataactggataagcatgagtattgatactcataagccagtttacctgcgggatatcctcaccacgtttggccgccgtccgtttggctggccggaagatgaagtcaaactgctggtggctcgcctggcgcggagcggcaaatacagtttcaacttacagggtagcgaaatcgcgctgaaacaagcgtgggatgcgtttaataattcacgtcgctacagcgatttacggctgcttaaaattcgtcgccatgacgaagcacagttaaccaaagccgcgcagctgatggcagacattgccggggaaccgttcaacgagcgtgaagagcagtcgctagtgtcccacattcgcgaactgtttggccgttggaagagtgaactgactgtctttaaaaccagatccgagagcgggcaaaatcccggtcgtaaagagattgaagaaggtctggtgctgctgaacgggattctcagtgagaaagaagagtatgcggttattgaaaaagttaccgcagcggctgacgacctcaaagattttgcagaagactgggacgatctggtcagcttctacaagaaccagtatgccacctggcaacgtctgagtgccgcgttgaacggcagttttaaagctaaccgtaatgcgctggaaaaagacgataccgcccaaaatacacttcgggaactggaggctatctacggaaagccgcgaccttacggtgaactgcatcgtattatcccgctgattgaaaccgttgaggctgttaaccagcgtctggtggaggaatatcgcaaccatgcgcttatgcagattatcaaccacattgaagatctgaagcagagcatgcaggagatgcatgttccgcctgatttgcagcatacgctcttgcatccaatgcaacagtcgcgcaaaaaagtggagcaaaatggtctaatccctcaaatcatggacgaacagtctgaggtacgcgcgctgttacttaaagcgaacgagcgcctgaacgcctgggttgaagagctgcgtaaaaaagagatcaaaccagagcctgaatcaggaggcgtagtgccgcctactgaacccaaaccgaagcttaaaaaaaccatttacgtcaatacacgtaaaacgatggaacgagcagcgggtgtgacaacgctggataacgccgaacaggtcgacaaagcgctggaacagctgcgtaaaacgctaatggatgccattaacgcaggcgaacgcgtacagcttcagtaa

SEQ ID NO: 285 - DNA, 3609 bp, Pantoea sp.
atgaatattgaacagattttcgaaaaaacgctaaaacgtaatattaacggcgtggttaaagccgagcagacggatgatgaaagtgcctgggttgaactggatgagtatgtcattacccgtgagctggacggccatctacgccagttttttgaggtgtatgctcccgccacaggccccggtcggttgcaacttgccgataagatgggggtttgggtttccggcttctttggctctggtaaatctcacttcattaaaatcctttcttatttgttggcgaaccgcgaggtcagccacaatggggtaacacgcaatgcgctctctttctttgaagagaaaatcgacgacgcattgttattggccgatattcgcaaagcggttcaacatccgaccgatgtggtgctgttcaatattgattcgcgcgcaaacgttgaagatggcgttgatgcgatcctaaaagttttcctgaaagtctttaacgagcttgctggttattgcggggacttcccgcacattgcacacctggagcgtgagctcgataaacgcggtcagtttgatacgtttaaagccgcctttgccgacattaccggttctcattgggaggatgaacgcgatgtttatctgatgatcaacgatcagatggcaaaagcattaagcatcgctaccaaacaaagtgaggagtcctctcgccagtggatcgaacaactggataagaacttcccgctggatattaagaacttctgtacgtgggtgaaagagtggctcgacatccagggcaaccgtaacattctgtttatggtcgatgaggttggtcagttcattggcaaagatgctcagatgatgctgaaactgcaaactatcactgaaaacctgggcgttatctgcggtggtcgcgcatgggtgattgtgacgtctcaggctgacatcaatgccgcgattggcggtatgagtagccgcgatggtcaggacttttccaaaattcagggacgcttctccactcgcttgcagctctccagttccaatacttcagaagttatccagaaacgactattggtgaaaaccgacgtggcaaaaccggctctggaagccgtctggcaggaaaaaggcgacattctacgtaaccagttggcgttcgacacaacaaccacagccacactgcgtgcttactccaacagcaaagaattcgttgataactatccgtttgtgccatggcagtaccagatcctacaaaaggtctttgaatcgatccgtaccaaaggggctgcgggtaagcagctggcaatgggggaacgctctctgctggatgccttccagtctgctgcagtccagatttctgccgatggcctggatagtctcgtaccattttggcgcttctactccgcgattgagagcttcctggagccagcggttagccgcaccatcattcaggcctgccagtctccgtcactgacggaatttgacggcaagctgttaaaaacactgtttctgatccgctacgtcgacgtactgaaaagcacgttggataaccttgtcacgctttccattgatcgtattgatactgataaagtggaactccgtcgtcagattgaagccagccttaatcgtctacaggcagaaatgctgatctcacgtattgatgacaaattcgttttcctcaccaatgaagaaaaagagatcgaaaacgaaatccgcaatatcgacattgagttcaccaccatcaataaacagctctcgactatcatttttgacgagatcctgaagaataaaaagtaccgttatccggcgaacaagcaggattttgatatcagtcgtttctgtaacggacacccgctggatggcgcgaacctcaacgatctggtggttaaagttctcacgccgctggattcgaactacgaaagctatagaagtgcacattccaacagtctgctgatgacggacagtaaagactgcattctgatttgtctgcctgatgaagctcgtacctggcaagacctgaccatgtatgcgcagaccaaagccttcctcagcaagcagagtggccagcgcccggaacaggcaacgttgttggcggaaaaaggccgtgaaaatggcatgcgcgaaaaaacgctgaaaacgcagcttgaagcccttctggcgcaggccgatgtctgggcgttgggggaacggcaggataaaaaatcctcctcgccatcgacaattgttgatgccgcctgcagctatgtgatcgaaaacagtttctccaaactgaaaatgttgcgtctcagtactggggatgtgaaccgtgaaacccatgcgttgctaacggtagaaaatgacacccagcttgatttgggggaaatggaagagtctaacccagaggcgatgcgtgaagtggataactggatcagtatgagtattgagactcataagccagtttacctgcgggatatacttaccacttttggccgtcgcccatttggttggccggaagatgaagtcaaattgctggttgcccgactagcacgcagcggtaaatacagcttcactctgcaaggcagtgaaatcgcactgaagcaggcatgggaggcgttcaataattcacgtcgctacagcgatttacggctgcttaaaattcgtcgccatgacgaagcacagttaaccaaagccgcgcagttgatggccggcattgccggggaacccttcaacgagcgtgaagagcagtcgctggtatcccacattcgcgaattgtttggccgttggaagagtgaactgactgtttttaaaaccagatccgagagcgggcaaaatcccggtcgtaaagagattgaagaaggtctggcgctgctgaacgggattctcagtgagaaagaagagtatgccgttattgaaaaagttatcgcggcgactgaagacctcgaagattttgcagaagactgggacgatctggtcagtttctacaagaaccagtatgcgacctggcaacgtctgagtgccgcattgaacggcagttttaaagctaaccgtaatgcgctggaaaaagacgatactgcccaaaatacacttcgggaactggaagctatctacggaaagccgcgaccttacggtgaactgcatcgtattatcccgctgattgaaaccgttgagtctgttaaccagcgtctggtggaagaataccgcaaccatgcgcttatgcagatgaccaaccacattgaagagctgaagcagagcatgcaggagatgcacgttcctgctgatttgcagcatacgctcttgcatccaatgcaacagtcgcgcaaaaaagtggaacaaaatggtctaatcccgcaaatcatggacgaacagtctgaggtacgtgcgcttttgcttaaagcgaatgagcgcctgaatgcctgggttgaagagcagcgtaaaaaggaaccaaaaccagagcctgcaccgggaggcgcagtactgcctactgaacccaaaccgaagcttaaaaaaaccatctacgtgaatacgcgtaaaacgatggaacgagcagcgggtgtcacaacgctggataacgccgaacaggtcgacaaagcgctggaacagctgcgtaaaacgctgatggatgccattaacgcaggcgaacgcgtacagcttcagtaa

SEQ ID NO: 286 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgatatggcacaagcattaagccaggccacgcagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattaccgaaaaccttggggtaatctgcggtggccgcgcatgggttatcgtgacttcgcaggccgatatcaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggctatgggtgagcgttctcagctggaggcattccagactgcggcgcagcaaatctcagcgcaagggctggattctctggtgcctttctggcgcttctatgccgccattgagagcttcctggaacctgccgttagccgcaccatcactcaggcttgccaaaatggcattcttgatgagttcgatggcaacctgcttaaaacgctgttcctgatccgctatgtggaaacgctgaaaagcaccctggataacctggtcacattatctatcgataggatcgatgccgataaagttgagttgcgccgccgggtcgaaaaaagtctgaacacgcttgaacgcctgatgctcattgcgcgcgttgaagataaatatgtgttcctgaccaacgaagagaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggcgcagtgcttaacgatctggtggtgaagatcctgacccctaaagatccgacctatacgttctataacagtgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgaacgcttaccgaaaaaatcctccacgccatcgaacattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaaccccgacgccatgcgcgaggtagaaacctggatcagcatgaatatcgaatacaataaacctgtgtatttacgcgatattctgaaccattttgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcatcgccagcacgccctcgaacgcattgacgcccgcattgaggaaagccgtcaacgcttgctggaagcgcacgccacgtcggagctgcaaaacagcgttctgctgccgatgcaaaaagccagaaaacgcgctgaagtcagccagtcgattccggaaattttggcggaacagcaagagacaaaagcgctgcaaatggatgcagataaaaagattaacctgtggatcgacgagctgcgtaaaaagcaagaagcacaactccgggcagcaaatgaagctaaacgcgctgccgactcagaacagacttatgttgtggtggaaaaaaccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgtcattaaagcaggcgatcgcattcgccttcagtaa

SEQ ID NO: 287 - DNA, 3690 bp, Vibrio cholerae; identical to SEQ ID NO: 123

SEQ ID NO: 288 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagtctttaacgaacgtattggatactgcgctgattttccgcatattgcccatcttgagcgcgagctggataaacgcggtcagtatgaaacctttaaagccgcgtttgccgatatcaatggctcgcgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattactgaaaaccttggggtaatctgcggtggccgcgcatgggttatcgtgacttcgcaggccgatattaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtaccgtggcactatcagattctgcaaaaagtgtttgaatctattcggacgaaaggtgcagcgggtaaacaattggccatgggtgagcgttctcagctggaggcattccagactgcggcgcagcaaatctcagcgcaagggctggattctctggtgcctttctggcgcttctatgccgccattgagagcttcctggagcctgccgttagccgcaccatcactcaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggtgcagtgcttaacgatctggtggtgaagatcctgacccctaaagatccgacctattcgttctataacagcgatgcgacctgtcgcccttatacgtcagaaggcgacggctgtattttgattcgtctgccggaagagggccgtacctggagcgatattgatttagtcgttcagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaatattgtcgatgaagcctgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcacgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgctatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaaagagattgaatccggtctgcgcctgcttaatgccattcttaatgagaaagaagattttgccctgatcgaaaaagtgtcatcgctgaaagatgaacttctggatttcagcgaagatcgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagagctgcaaaacagcgttctgctgccgatgcaaaaagccagaaaacgcgctgaagtcagccagtcaattccggaaattttggcggaacagcaagagacaaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgccattaaagcaggcgatcgcattcgccttcagtaa

SEQ ID NO: 289 - DNA, 3555 bp, Collinsella intestinalis
atgcgcatccaggacatgttcgaacgcgacatcgaccgcaacatcaacggcgtcatcaagatcgagcagaacgacgaggaggtcatcgagcaggagctcgccgaatacgtcgtgaccaacgagctgcgcgggcacttctcaacgttcttcgacgcctacgagcgcgcgctcgacgcccccaccgacaagatcggtgtatggatctcgggcttctttggttccggtaaatcgcacttcctcaagatgctctcgtacctgctctcggggcagacggcaaacgggcacccggccatcgacatcattgcgccgcgcttcgaagaccccatgatcgaggcgaaggcaaagcgtgccgtggacgtccccaccgagactatcctgttcaacatcgactccaagggcccgtctaacaaggacaagaccgccatcctgcgcatcttcgcccgcgtgttcttcgagcacctcgggttctacggcgaggacctcaagcttgcgcgcctggagcgcgacatcgaccagaagggcaagaccgaggcgttccgcgcagcgtaccgccagatcacgggcaccgaatggctcgacgagcgcgatgcctatgacctcaacagcgacgccgtcatcgacgcgctcgagcaggcgggggccaagagccgcgaggcagcggagcgctggttcgacaacaccgaggagttcgagttcaccatcgattggctcgtgcgccagatcaatcaatacgtgaccgagcgcgccgagcaggagggcggcgagtttcgtctgctgttcatggtcgacgaggtgggccagtacatcggcaccgacacgagcctcatgctcaacctccagaccatcgtggaggacctgggcgcgcagtgcgccggccgcgtgtgggtggtcgtgacgagccaggaggccatcgacgaaatcaccaccgtggcggggcaggacttctccaagatccaggggcggttcaacacccgcctgtcgctttcgagcaccggcgcgggcgaggtcatccgccggcgcatcctctccaagaacgagcacgcgcatgacttgctcaccgtggagtacggcaagaacgccaccgtgctcaagaacctgttcaccttcaagggagcgcgcaacgaccttggcggctatgacggcgcgaagagcttcgcggacgcgttcccattcgtgggctaccagttcaagctcatgcaggacgtcatcaacggcctgcgcaaccagggcagctcgggcaagcacctgagcgccgagcgttcgatgctctcgggcttccaggaagtcgcccaggcgctcgaggaccgcgacgagcacgccctggcccccctgtggatgttctacaacaccgtgcaatcctttctcgagggctaccatcgccgtgtgatcgaccgcgccgcggccgccgcgcgcgacggcgcgggccttgaggaatacgacgtcgccgtgctcaagctgctgttcctcatcaaatgggtgagccaggagatgccgggcaacgtggacaacatcgccaccctcatggccgacgacctgcgcgccaaccgcgccgaggtgcgcgagcaggtgcaggccgcgctcgagcgcctggagcgcgagaactacatcacgcgcaacggcgagtgctacctgttcctcaccgatgacgagcaggagatcgcccgccagatcgcgcgcacccaggtggatgcggccaagctcaccaggaaggcggccgagatcgtgttcggccagatcttcgagacgcccaagatcaccgtgggcaagaacaacttccccgtggcggagtggctggacgagacccgcgtgaacaacgcgggcggcctcaccctgcgcgtgctcgcccgcatggacggcagcgacgcccccagccgcgacgagctcatcttgcgctcgagccgcggtgaggcgatcgtgctgctctccagcgagatcgatttttacagctgccttatggaggcggcgcgcatccagcagttcgcgagcgcgaccatcatcgccaacctgcccgccaaccagcaggacgtgatccgcgccaagcagcaggagcgcaccgcactcgagaccaaggcgcaggcgctcatggaagaggcggtgcgccgcggcgagttctacgccggcgggtcccaggtcaccatcacgggtaccaactccgccaagaagctcatcgagcaatgcacggcaaagctggtggacgccgtctacaccaagctcggctacatcgaccgcaattacgacgacgatgcccaaatcaggcaggtcctgaacggggccgcgcctgcgctcgagggcatcgagcccaacaagcgcgccatcgacgacgtgcgcacgttccttggcgcccaggccatgcgcgcggtgagcgtgtccatggacgacctgcagaagcgctaccaggcggccccttatggatggcgcgagcgcgacatcgccgccgtggtcgccgagctcatcgccgccggcgaggcacgtgtgagctacgccgggcaggtcgtggacgcgcgtgacgccaagatgatcgactaccttcgcaagctgagtatgacgcagcgcgccgtggtggagatgcgcgtgcgcgcctcggcaggagacatgacccgcgcccgccgcgcgatcgagacgctctgccgcgttcacgacctccccaccgaggaggagccgctagccacggcgtgccgcaacgccctgcaagaacgccaggacggactgaacgagctcatcaccggagcgtacagccgcaaccgcaactacccgggctttggcacggtggcagacgccgccgccctcatcaaggacctgctcgccatccgcggcgactccggcgatttgctgcgcgccatcgccaaggcggaaaacgacctgtgcgacgcaggcgaggacctggaggacgtcgacgggttcttccccgacatgcagcgcatctacgacaacgcctccaacctgctcaagcgcctcgatcaagaccgcagttaccttgccgcccacgagggggcgaccaaggcgatcgagaacatcgagcgcattttgggcagcgagaggccctatagccagatcaccgacctcgtccccgccatgcagacgatcgaaaacgctcacgcaaaactgctcgagggcaagcgcgaggaagttaaggcgcagatcgaggacatcttcgccagcgtgaggcagcatggcgaggaactcggtgtcaccttgagcagcgtgggcgagcgagaacgcgcccgcaccggcgcggtgcgcgacgccgccacgctcacccagctcgacgccgtgagcgcacagctcacaggcgatcaggcgcgcctgtttggggacctcgaccgcgaacacgagcgcatccaccgccccgcgccggcaagcaccgggcaggtcgtcaccaccagccacgcccccatcgcgcccgagcgcccgcgcaaagtgcgcgagctccaacgctcaaccgcgtttttgcccaagaccttacacagcgaggccgaaatcgacgcctatctcgccgacgcccgcaagcgcctggtgagcgagctttcccataacgacgccatcaagttgaactag

SEQ ID NO: 290 - DNA, 3642 bp, Salmonella enterica; identical to SEQ ID NO: 8

SEQ ID NO: 291 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgacatggcacaagcattaagccaggccacgcagcagagtcttgaatcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcactggcaaaagtgtggcaagagaaagccgatatcctgcgtaaccagctggcttttgacactacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgcttaaaacgctgttcctgatccgctatgtggaaacgctgaaaagcaccctggataacctggtcacattgtctatcgataggatcgatgccgataaagttgagttgcgccgccgggtcgaaaaaagtctcaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccgacttattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggctaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaacattgtcgatgaagcctgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgaacgaaaacaggcgtgggaattatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtttttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgctgttgattgaacaggtccagaacgtcaaccatcagttagtcgaacagcatcgccagcacgccctcgaacgcattgacgcccgcatcgaggaaagccgtcaacgcttgctcgaagcgcacgccacgtcagaactgcaaaacagcgttctgctgccgatgcaaaaagccagaaaacgcgctgaggtcagccagtctattccggaaattttggcggaacagcaagagacaaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctagaaacgaccgaacaggtggaaaaggcgctcgacacgttacgcacaacgctgctggccgccattaaagcaggcgatcgcattcgccttcagtaa

SEQ ID NO: 292 - DNA, 3540 bp, Nitratireductor indicus
atggctactctactacgtgatatcttcgccaagccggtcgaccgttcgatcgatggtgtcatcaaggccgacgataaggccagcctcctgaccgagctcgatgaatatgtcatcaccaatgagatcggcgcccggctggagcaattcctcgacgcctacaacaactacgacaccgcgaatggcgtgtggatttccggcttcttcgggtcgggtaaatcacacctcctgaagatgctcgcccttctgctggaaaatgctgaggtcgaggggcagcgccccgtcgaaatctttgagcgcaagctcgagggcaatccgatgctggccggcgcgctgcgtaaggctgtgtcgattccctcctggtctgtcttgttcaatattgaccagaaggcggatgtgatctcgaagacggatgtcgatgcgctgctcgccgtcttccagaaggtctttgacgagatgtgcggctattatggcaagctcccgcatatcgcgcagttcgagcgagatctggacagtcgcggcaagctggaggccttcaaggaggcctttgctcaggcctctggtaagccttgggagcgggggcgcgaacaggctctgatggaaggcaagcatattgcttcagccttcgcacaggttaccggtgatgaggtcaaggatgttcttggccagtaccgcaaggacacaaaggtctcgatcgaggatttcgccaatatggtgaaagcctggatcgatgcgcagggtccaaaattccggctgaacttcttcgtcgacgaagtggggcagtatatcgccgacaacgtcaagctcatgacgaacctgcagaccattgccgaaagcctgaacaccaaatgcaaggggcaggcgtggattgttgtcaccgcgcagcaggacatgggttccgtcatcggagatctgacggcgcaacaagagaatgacttctcgaaaattcaggcgcgcttcgccaaccggatgccgctgaactcccaggacgtggccgaggtcatccagcgccgtctgctagccaagaccgaagcgggccagatcacccttggcaatctgtacgatgccgaggagaataacctgcgcacgctgttcgactttggcgacaattccttcaagttcaggaatttctccggaaaagaacagttcgtcgcaagctacccgttcccgaactaccagtacgacctgtttcagcgtgcgatcatgggcctctcccagcataacgcgttcgagggcaagcacagctcggtcggtgaacgctccatgctgggcgtgtttcaggaggtggccaaaaagctggccgatgcgccggtcggaggcctggcgacctttgatctgatgtttgaaggcatccgcaccgccctcaaatcctcggttcagcagtcgatccaactggctgaaagaaaccttggcgacgattttgccgtgcgagtgctgaaggcgctgttccttgtcaaatacgtcaaggaattcaagccgaccgcccgcaacattgcgatcctgctattgtcccggttcgaggcggaccagaccgagcagcgccgcaatatcgaagaggctttatcgctgctggagcgccagacgctgattcagcgcaatggtgaggtctacgaattcctcaccaatgaggaaaaggacgtcgaggccgagatcaaggcaattgcggttgaccccgccgagatcgaacgacagctcgatgaactggcgtttggaacgatcctccgtcacggcaagatcaagcatgccggcacgggcatcgattatgcgtttacccgcaagctcgatgggcacagcctgaaccgggagtatgagctgtcggtaaacatcatctcgcccttcagcgatgattccgacgcgccggatgtggtccgctccaacagcatggcgagcgatgaaatggtggttctgctggggcgggacgtgcgcttcacgcgcgatcttgtcctctggctgcagaccgtaaaatttgcccgtcaggtcaccagtggcgatgcccagcccggccgcgatcgcatcattgcggaaaagcgcgatcagaatacgcgacgtgaaacggaactggtccaacgcctgcgcagcctgatcgcagatgcgcggctgttcgtgcgggggaccgagctggaaatcggcggggaagacccacaagagcggctggtcaagggattccaggtcctggtggacaaggtctacaccagcctgcccgtgctgcgcggcgccacatacaccgaagctgatcttggccgcgcgggccgcgtcgatggcgggcttttcggcggcgaaggcagtggcctgaccgaagccgagcaggatgtgttcaaccatgcacaggcccagatgcgtcttgggacgcgggtgtcggccaaggctctggtcgagaagttcggcgcaaaaccctatggctggcctaccatcgcggtgctttgcctgaccgcaagccttgttgcgcgcggcaagctggaagcccggtccgacagcgctttgctggagggcgatgcattggtgcagcagctgcgcaatagccatgcccttggcaatatcctgctctccccgcagatcgagttcaccgccgcccagatccgcaaatcgcgcgagctgtttcaggaactgttcgatctgcccgcctcgggcaatgacgcccgcagtctgggggcggagtggcaggcgcagctgcgcaagctgaccagcgaactggaaacgctcggtcggcaggcgacgggctatcctttcgtcgcggctctcgatccgctgcggaccttacttgacaacatgcgcgatcaatcggcgacctggttcattaccggcccggtgggccatgaagaccagcttctcgatgcgaaggaagatatcctcgacaaggtccgcagcttcatgtccgggccgcagaagggcatctacgatgaggtgcgcgctttccttgccgcgcaggaccagaaccttgcctatgccggagattctgcggccgacaagctgcgtcaggcgctggccgatccgcactgcttcaagggcaatgccattcaggaactgaaggcggatttctacgccctgaaggaacgcatcgaacaaacggttctggctgagcgcaacgccgtcatcacggcgattgacgaggtggcggataaaatcgcccagacttccgaattccgtgcgctgccgccggaacagcagacgcgtatccgcgacgggcttgccacgcggaaatccggccttgccgcacagagcctgatcccggccttgcgcaatcttgcagccgaggcgcggtccaaccttctggctaacacgctgactcggatcgccgaactgacgcctgcaccggctcccgctgctgcaccacagccgcagcctgccggtggcgtagccgaacctcagccagcgccctatgtgccgccggcgccggcaaagccccaatatgtcaacgcccagtcgatcaccgtctctatcgggaaagcctatctcgaagatgcggacgatgtgacccgctatcttgatgcgatgaaaaagaccctgctggccgagatcggtgcgggcaagaaagtgattgtctga

SEQ ID NO: 293 - DNA, 3642 bp, Escherichia coli; identical to SEQ ID NO: 286

SEQ ID NO: 294 - DNA, 3681 bp, Acinetobacter baumannii
atgaacattaaagaacttttttacaagccattagatcgtgcgattaacggggtggtcaaggcagatcagaatgacaataccacggtatatcaggaactcgatgagtatgtggtcaccaatgaactggaaaagcattttcgggactttttccagtcttatggtacagacctaagcgatccttcgattgccaatcgtgtcggcgtatggatttcaggcttctttggttcaggtaaatcacacttcctgaaaaccttgtcgtatattttggccaataaagtggcatgtgacgcggatggtaacgaacgcagtgctgctgaattctttgatgaaagcaaaatccgtgatgcgtttatccgtgcggatattggcaaggccgtcagccatcatgccgatgtcatcctatttaatattgacagtaaagccagttccaatgatgacggtaatccgatcctaaatgtgtttttacgcgtgtttaacgaatatcagggttttagtgctgaccatccacatattgcacatatggaacgtcacctgagccagaaaggggtgtatgagcgctttaaacaggcgtttgaggaatccagcggcatgtcctggctagaagaacgtgacggctatcagttctatcaggatgatgtcgaaactgcgatttctcaggcactgaatctatcagcagaagcagcgcataaatggtttgaggattctgagcagacctttagtgtttcggttgaaaatttctgtcagtgggtgaaagaatacttagatagcaaaggaccccagcaacgcatgttgttcttggtcgatgaagtggggcagtttattggcagcgatacccgcttgatgctgacactgcaaaccattactgaaaacctgggtacgatttgtaaaggtcgggcctggattattgtcacctcacaggcagacatcgatgctgttttaggtgagatgtcttcatccaaagccaatgacttctccaagattgctggacgttttaaaacccgtttatcactgtccagttcgaataccgatgaagtcatccagaaacgtttattacgtaaaaccccagaagcagaagcactgctcagatcggtgtttgagcaaaagggtgatatcttaaaaaaccagattacctttgaccgttcaggcccaaccctcaagaactatgaggggccagagagctttattcataactatccttttgcgccgtaccatttccagctggtacaaaaagtatttgaagaaatccgtaaagtcggtgcgaccggtgcacacctggcctatggtgaacggtccatgctagatgcgttccagatggccgccaatgcgattgccacagatgaagtcggggcactggttcctttccaccgcttctatacttcagtcgaaggtttcctggatacagcagtgaagcgtaccatcgaccaggcagggcagaataagaccctggatggttttgatgtgcagatgctgcgtaccctgttcatgatccgctatgtcgatatcatcaaaggtacgctggataacctggtgactttgtcgattgagaaaattgatgaagataagctggcattgcgcaagcggattgaagagagcctgcagcgtctggaaaaagagagcctgattacgaggaatggcgatgagttcctgttcctgaccaatgaagagcgggacattacccgcaaaattaaagccactgacttagcagcttcagaagaaaataaagagttagccaatctgatctttaaagatttactgcgagatcagaacaaataccgccatcaagccaacaagatggactatcagattggtcgtttcctagatagccatagcctggatggcaagtatgagagcgatttgaaagttgaaatcatttctccgttggatacggaatacaacctctacactgaagcttactgtattggtaaaagtactcaggccgaagggcaggtgctgtttaaactggcagacgataaacagttctttaatgaactgcgcacctggctaaaaaccaataaatttattcggttaaatgatgatggcacccaatcggatatcagccgtattctggcagaccgtggccgagagaaccaggagcgtaaaaaacgcctgcgtgcccgggtcgaagaaatgttgctggacgcggaaagttatgccttgggtcaacatctacaactttcatcttcaagtccaaccaccaagctggatgaggcttgtcgctatttgctggaaaacacttataccaaactgagctatttgcaggtctatcagcaggatgcctggcgtgaactgaacgccgtcttgactgtggatgatatggcgcagctcggattgtctctggatggcggtcagagcaatcccaaagccctacaggaagtggagcagtacattgcactacgggccaccggtacagagcgtattctagtctcagatgtgatagaccgttttgccaaacgcccttatggctggccagatgccgagattttactgttggtggggcagctggcggcaatgggacggatttcactacagttaaatggtggcagcttacagttaaaagatgcctttgagcctttacaaaacagccgccgtcgccgtgatgtttccattattaaaaaacgccagactgatgatcaggtattgaaacaggcacgccaactgacccaagacctattctcggccatggggccagcgactgagaaagagctgtttgaattctatacccaacattttaacaactggttagccaactttaagtcgtacaaaagcaaaactgatgtcgggcagttcccgggcaagaaagtgattgaaaagtcgattctgactttggagcgcttgctggcgaatagcgacagcttcgatttctttaaggccgtggttgagaacaaggacgactatcttgatctggaagaagattatcgtgatattcatgagttcttcactaaccagatgccgagctggcagcaactgcaacaggccttacgtcattttgagaaaaacaaacaggcgctgggcagtgatgaggtggcaaaaaaagccctgtctgaattacatcgcatttcgacccttgaatcgccctatggcctgttaaataaagtggctgatttggttcgcacagtggaaagcgtcaatgagcaattgctgactgagaagcgcagtcaggcgatagaacacattgatgacaagatcaagcagttagaagccgagattaaaaacagtggcatcgctagcgctgagctgagtaacaagctattacgcccactacaactgctgaaaacagatattgaagtggaaactagcctgtccaccatctatatgctgcaaacccaaaccgccgttgagcgttttgatgaagccttgtatgagttggaaagcgaagttcaggcggaaatccagcgtcaggccaaagcggcacaactggctcagagcaaagcagagagtgtaaccaacactgcaaccacctctagcccagttagatcaacacctgctgcgagtccggtacagcctgtgacagccgtagtgccaccgaaaccggtggtagaagtcgatgtcgccagcatttacagcaaaacctccagcagtgtctatctggaaacggaagaatcagtggatcagtttgtagacgcactcaaagctgaattgaaaaaaattgtgagtgataaaaagcgtgtgcgtatccgctaa

SEQ ID NO: 295 - DNA, 3642 bp, Escherichia coli; identical to SEQ ID NO: 286

SEQ ID NO: 296 - DNA, 3672 bp, Enterococcus faecium
atgctaattaaagatatttttgcaaaaccaattgaccgaaatattcaaggagttattaaggtcggtcaagcaaaggatgaaaatgttcaacaagaattagaagaatacgtggttacgaaagaactacaaaaacactttaaaacaatttttgatgcctaccaacggagtatcaatacaccaacagataaaatgggtgtttggattcaggggttctttggttcaggtaaatctcatttcttaaaaattatttcttacttgctcgcaaatcgagaaataaatgacaagaaagccattgattacttcaaagaagatgggaaaatcaaagatccactgactttggcaacgatggaacggtgctcacaaataaatacagatgttattctgtttaatattgattcaaaaagtgatgcaggtggtaaaaaagacaaaaacggaatcgtgaatgtttttttaaaggtatttaacgaaatgcaaggattaagcacgattccacatctagcagattttgaacgtcggttaattaaagaagaaaagtttgatgcattcaaagctgcttttgaagagattaatggggcaaaatggcaagaagagcgccatgagtttgattggatccaagatgatatcaaagaagcggcacttaaaatcgattttatgagtgaagccgctattgataattttttagaaaaagcatcaggaaattatttaataagcattgatgactttgcaaatctagttaaaagctatcttgattccaaagaagcagaccatcatattgcctttctagtcgatgaggtcggacaatatatcggcggtaatcgtgagttgactttgcagttacaaaccgttgtggaagatttgggtcgaatttgtgaaggtaaggcttgggtattagtgacaagtcaggaagcgattgatcacgtaacaaactttgataacaattctgataatgatttttctaagatcaaggatcgttttgccacaactgtgagtttatcttcagcaaatgccgatgaagtaattaaagaacgtattttgaagaaaaaagagtttgccaatgattctttagccttacaatttgaaactgttcaaacagaattgaaaaataaattactctttgttgatagtcctgaattaaagctcttccaagatgctgaaaattacgcagaagtttatccatttattccctatcaattcaatttattggggcaaattctaaccgagattcgtaatcacagctatcaaggatcaaacttatcgtctggtgaacgttcattactagcaatgtttaaagaagccgctgaacgaaataaggaaaatgatacaaccagtttggtttctttagatcagttttattactcgttagaacgttggattgatacagcaattagccgagtgattacacaagctacaaataattctcatattcaaagaccaactgatatagataactttaacgtaaatgtcttacgaattttattcatgattaaatatgttgatcaagccatcaaaccaaatgttgaaaatattacgagcttgatgataagaaatatcaacgaagaccgcctggaaactaaaaaacgagtagaagaagcattggaccttttaattaaggaaaactttgtgcggaagaacttagatagttatattttccaaactgatgaagaacaggaaattactcgtgagattaaaaatcaaaatattacagatagtgatttgatcgtagaactatctaaacgaatttttgacggcgttctagaccgaaatagttttgcctatgaaaaattaggcatgtcaggtggaaataaatttaaaaaccggtatacgtttacttatgcacaagtgttagatcaacgtccatacaagcaagctggaaatgctgaaatgacagttaattttatttcaccatactctgatttagcaggtcaagaggcagaacttgcgcttaagagttcccgtaacttattattcgtagaattgccatcagataaagaatttaaagatgatatagcaatgtatgctagaatgaatctttatttaacaacgacttattcgagtgtagtaaagaactttgacgcgattcgttcggaaaaatctggtgaattacaggaactaagtgcaagtatcaacgatcaattaaatgaactgttgaaatctgcaaaatttttctataacggtgcagaaattcaactgacaggctccgactttaaagcaaaattccaatcagcacttcagaaaatggctgaagaagtataccataaattaaaccaaattgatgcgcctaaagaaaaagaagatatcttatatttagtgaaagaaagcaaaaatgaaattattgaagatccatcaaatgagcaagcagttcaggaaattttcaattttatcaatgatcaaaagagaaatcacctaacgattacgatgaaaacaattcgtgatcgttttgaaacaaaacaaccgtatggattcacagaacttgatgtggaatggtgcatcgctaaacttttcatgtctggtaaaattgatttactttataacaatgtacaaatttcacggatggatgatccaaatagtattgtaatgattattcaaaaacgacgagaaagtgaaaagataaaaattgaaccaagcgcggtgatttcgccaaaagcaaaaaaattggttgacgaaatcggtagagaactgtttcaaagtcgtaatattgttgatgaaaataacaatgaacatacaatggaaaatttcaagaaatatttaaaaggtcaattagacaatttacgctcttattttgatttacaaaacacttatacctaccctagtgcttatgaatatgagcaaataaaaaaatatcttgaagtaattgttcaaacgtcagatgttgaagactttttttatacaatcaaaaaatatcgcgatgaattattcgactgggctgaaacatatgataaaattaaaaatttccacaagcaaaatagtactcagaaaaaaatctgggagaatgcacaagataaaattagattaatcgaaaaaagtcggcgtcaaacttctagccaagaaattgatcaattgattcatgagatgaaaaccattttgaaaaaggctgatccttattcagatatgatgaaactaaatgagttgattcaagaatttattgaacaatataatcaactgttagagttggaaagtcaggaaatattaaataaattcacggaagaaaaacaagcaacatttaaattattagaaggaaaagattttaaggatcaatttgtaccaatagttgaccaagaatttcaagaactgaaagcaaaaattgaacaagcgaatactatagatgatcttgttttcttatcattaaacgtagcagaacagtatttgatctttaatcaacgtttcgataatgaagaaaaccgcagacgtcaagaagaacaagcacgtaaacaaattgaagcagcaaacttgattcgtgaaactgaaaaagatgaaatagactctgcagcaaaagctgaagaaatagcgatagtaaaacctactattcaacagaaaacagtaccaatgagaacacttaacgttcatgttaaaactattaagtcagcagcagatattgatgagttaacagctgaaattaatcaaaaactgaaggaacaacttcaagaaaatacagaaatcacgattcaattctag

SEQ ID NO: 297 - DNA, 3564 bp, Alcanivorax sp.
atgttcgagcgcagcatccagcgcagcattaacggcgtcatcaaggcggatcaaaaggacgacgccaacgtctggcaggagctcgacgaatacgtcatcaccaaagagctggatggccacctgcgcggtttcttcgagcgctatctctctgccctggataaccccgctgaggccagcggcaatgtgggggtctgggtctccggcttcttcggcagcggtaaatcgcacttcatcaaaatcctctcctacctgctcgccaatcggcaggtcagccaggaagggcaaacccgcaaagcccaggacttcttcgaggacaaaatcaccgatcccatgctggcgggcgacattgcccgcgccattaccggtgacaccgacgtgctgctgttcaatatcgacagcaaagccgatgccgataactcccgcgatgccatcctcaaggtgttcctgaaagtcttcaacgaaatgcgcggcttcagcccggatcacccacatattgcccgcctggagcaggagctggaggaaaaaggcgcgttcgacaccttcaaagccgaattcgaaaaagcggcaggctccccctggttggatgagcgtgacggctacaccttctactctgatgccgtcgccaccgcctatggcgcagccatggggcaagcggtatccgatcccgatgtttggctggagcgcctggagcgcgacttcgacaactggctctcggtcgaaaacgtcggcaagatgatcaaggagtacttggacaaatgcggtaaacagcaccgcatcgtctttctggtggacgagataggacagttcattggtggcaacacccagttgatgctgaacctgcaaaccatcacggaaaacctgggcaccatctgtgatggccgcgcttgggttattgtcacctcccaggaagatatcgacgccgttgtcggtcagctcaaagccagcagcgccaacgacttctccaaaattcaggggcgttttcgcacccgcctgtcgctgtcgtctgccaacgtcgatgaggtcatccaaaagcgcttgctgaaaaagcgcccggaagccgcagacaccctgcgcgagctattccgcaaagaagcggacattctcaaaaaccagctcagcttcaccaacaccgggcgcaccttcaaggcctacgccgatgaagatgaattcgcggaggtgtacccctttgcgccctaccagttcaccctggtgcaaagcatctttgaatccgtgcgcaaggccggcgccactggcttgcacctggcgcggggtgagcgctcgctgctggatgctttccaatctgctgccaaagcggtggtagagcaggagccgggtatactggtgccgctgtactgtttttacccctccattgaaagcttcctcgaaggggtggtgaaatccaccatcgaaaacgccgccaagaacccctcgctgcaggatttcgatgtcaacgtgctgcaaaccctgttcttgatccgctatgtggacgagatcccaggcaatgtcgataacctcattaccttgtttatcgaccagatcgacgccgaccgtcgtggcctgcgcacgcaaatcgaggaaagcctgcagcggctggaaggtcaaaccctggtcagccgcaacggcgataacttcttcttcctcaccaatgaagagcgtgatatcagccgcgagatcaaagcggtcgacctcaccgccgcagaagaagccaagaagctgggggagctgatttttgaagacctgcttggcggtatgcgcaaattccgctttaccgacaacggcaatgactttgcccttaacctcagctgtgaccaacacccttacggcaatcgcaatgagggtgccctgaatctccaggtcatcaccccgctgattgacgaccgcgacgaatggcgcgacgacaaaaccctcatgcgcagtaccgacggcgacggccaggtcattttgcgcctgccagacgatagtcagctggccaccgagctgcggcagtacatccagaccgacaaatacgtgatgaagcgtacggatggcagcctgccatccaccgccaggcgtatcctgcaagaccgcgccgatgaaaatcgtcagcgccgtgatcgcctcaaaatcaccctggaaaagctcctgcaaaacgccgtggcgtttgctgccggccatcaaccagtcctcaaagcctccaccgcccaggccatcgtcaatgaagccctgcatgacctggtgcgcaacagctttggcaaactggcctatatcgaacacctcaccggggatccgcaggccgagatcaaagctctgctggatgatccgtcaacgctggccctggatctgggcgaaggcgagaccgtcaacccccgcgccctgaaagaagtgcagcaatacgtcgaactggccagtgccagccaccgccaaatcatcctgcatgacctagccaatacccactttgcccgccgcccctatggctggtcggaatgggaaaccgttttgctggtgattcgtttggtcagggcgggggagctcagcctcaagctcaatcaaaccgtattgcctatcgagaaggtctacgagcagctcaacccgccgtcgcgctggcgctccattgaggtagagcgtcgcaaagccattggtagtggtgagcttcagcaagccagaaacctcacccgtgacatcttcggcaagctcccccctgaagatgaagaccgcctctatgcggccatcaaaggccatctgcaaaactggcagcaagacttcaagcagtggaacaccctcagcaacaccggctaccccggcaagtccctggcggatgaaggcctggccctgtgcgacaagctgctgtccccacccgacagctttacggccatacagcagttcaccggccacaaagatgacctgctggatgccgccgataatcatcaagagcttggccacttcttcaccaaccagaagccggtctgggacaagctcatccaggcgctgcgcgagtttgaccctaaccgccccgcgctggaaaaagacaacggcgcaaaaaccgcgctgcaacggctggaagccatccgcacggcgccttcgccctttggcctgctgcaagaggtggaagccctagtgagcaaaatcgaccaggtgaacagcgcggagatcgccagggtgcgcacccatgcgctggactatatcgatagccaaattgcacgggtcagcgccgatctggatgccgccaaggccgatgcggatacccgcaaccaatgcctgcacccgcttcaaaccctgcgccaacgggcagaaacacaaaccagcctggcacacctccatcagctatccacccagtccaccgatgcagcggacgatgcggtagacaaactcgccaaaatttccgccaaagccaaaaaggtagcggaagaaaccggcgagtatccggtcgaaaccgtgccagcagtaaagccagtgaaagcgatccacgccagccggcttaccagcacctacatcgaagatgcggaaagtgccgagcaatatctggaagcgctgcgcaaagaaatgatggatgcactggctaaagactgccgcgtgcaaatccgctaa

SEQ ID NO: 298 - DNA, 3456 bp, Vibrio cholerae; identical to SEQ ID NO: 239

SEQ ID NO: 299 - DNA, 3456 bp, Vibrio cholerae; identical to SEQ ID NO: 239

SEQ ID NO: 300 - DNA, 3678 bp, Escherichia coli
atgaaaattgaacagattttttccaagaagttgacgcgtgacattaatggcgttgttaaagcggaacaaaaagacaatgacagtgtgtatgtcgagcttgatgagtatgttgttacccgagagttagatagacactttcgtgcattttttgaggcttacgtcccatctgtgacgcaaagccacggtgatatgtcaggtaaaattggtgtgtggatttctggcttctttggctcgggtaaatcgcacttcctgaaaattttatcttatttgcttgagaataaatctgttgaaaaagatggccaaggccgacaagcgtttgagtttttcaaagacaaaatcaacgacgccatgctgttggcggacatccaaaaagcggttaccaaagacactgatgttattctttttaacatcgattcgcgagccaatacggacgaccgagaaaatgccattcttaaggttttcctcaaagtctttaatgagcgtgtaggatactgcgctgactttcctcatattgcgcacttagaacgcgagcttgataaacgtaatcaatacgcatctttcaaggacaaatttgctgagttgactcaatcaacttgggaaaaggagcgtgacgcctatgacttctatcgagacgaactttcagaagcactcgctcatgccagtgagcaatcattagagtctgccaaagcgtgggttgagcaggttgaaaacaatttcccgctagatatccgaaacttctgtaagtgggttaatgaatacttagatcgcactggggatcgtaaccttcttttcttagtcgatgaagtcggtcagtttatcggtaagaacacacaaatgatgttgaagcttcagaccattactgaagatcttggcacatattgtggtggcagagcttgggtcgttgttacctctcaggcagacattgatgctgccattggtggtatggataagcgcgatggcgaggacttctctaaaattcaagggcgttttagtacccgcttacagctgtcgagctcgaatacctcggaagttattcaaaagcgattgttgtccaaaacggaagaagctcgtacatacctcatcgatgtctttgctgaaaagggcgacattcttcgtaaccagctgacatttgataaaacgacaaccgcgtctctaaagggctacaccgacgctccgtctttcgtggacaactatccgtttgtgccttaccattacacgctggttcaaaaagtgtttgagtcaattcgaacaaaaggcgcgacgggtaagcacttagccatgggggagcgttcattacttgatgctttccaatcagctgcaaaacagatgaaggactctggccttgatgtgttaatcccgttttacagtttctacgcaccgattgaaagctttttggagccagcggttaagcgaacgattgaccaagcctgtgagttggattccttaacggattttgatggcaagatcctaaaaacgcttttcttgatccgttatgtggacgttgtcaaaagcacactagacaaccttgtgacgctgtcaattgatcgaatcgatgcagataaaattgcgctgcgtaaacaaattgaagagagcttgaatcgtcttgaacgccaattgctgattgcgcgtaatggtgatgagtttatcttcctgaccaacgaagaaaaagagatcgaaaacgagatccgtcacactgacgttgaaatgtcagaggtctcgaacaagctttcagccatcgtatttgacggtattttgaaaggtaatcgtgcctatcgatacccgattaataagcaagactttgcggtgagccgtttttgcaatggtcatccaaaagatggcaccacgctggaagacctagtcattaaagtcatttcacctttggattcgcactttgaaaattactcccacgatcaagcgtgcctcaatcatacgcttgaggctgatgggtgcgtgctcgtcaagctgggcgaacataagcgtctttgggatgagctgacaacctttataaaaactgaccgattcttaaaacaaaattcaggacagcgaccagagcaagaacaccttctccgcgaaaagcagatggaaaatatggagcgtgaaaaacgcttaagaacggattttgaagctttgtttgccgaggctgacgtttacgcgatcggcacaaaactgccgaagaaatcagcaacgccaagtgccatcgtcgaagaagcatacaaatacgttatcgaaaataccttcgctaaattgaacatgctcaaggcaacgcctggtgaagttttgcgtgagctacaggccgttcttgttgctgatgatattgctcagattggactggatcttcaagcggatgaatgtaacccagaagctacgcgtgaggttgagcagtacgtaacgctaaaagtcgagcgtaatgagcctgtttacttacgtgacatcgttgcccacttcggcaagcgcccgtatggctggccagacaatgaaatcttattgctcactgcaaggctgggcttggctggaaagttatcttttagtacccagggcacagatctggcgttgaaaaaagcttacgagccgtttaccagcgtgcgtaaacgcggtgagatccgtgtacataaaatcaggcaacatgacgagcgccaaatcaaaaaggctgctggtcttgttaaagagatcttttcaaaaacctttaccggctctggtgaaaaggagctctacgaattagtgcgcgatgaattactggcttggaatgaagagcttaaatcattcagaaccaagtcacagacaggccatttcccaggtaaatctcaaattgacgatggtcttgcattggtcgcgggtattcttgagcaaacttcaagcttcgctcttatcacccgattcttagaaaacgctgatgcccttgaagagtttgctgaggactttgaggatcttgatgacttctacaatagccaatttcaaacttggcaagcccttgctggcgcattgaacgagaagtttaaggccaatagacctgcgttagaaaaagacagtgaagcattaaaagcgctcactgaattagaacgcatttacaatatgccctcgccgtatgagcagctgcgccacattaatccgcttatcgagcaggtggcaaaaattaactcaacattggttgaagaaaaacgcactcatgccttagagcgtgttgatctgcgcatcggacgtgtaaaagaagcgctagctgaagctcatgcaccgtctgaattacagaaccaagcactgcgcccgttacaaatgtgcagacagcgtattgaagcgacctcttcaataccacaaattatcagtgagcaaactgaagcggaaggttacgaggacgaagcctatgagttgctgaatggctttatcgaagatcaacgcaaaaaagctgaagctgagcaaagacgtcgtgaactcgaacagcagacacgcgaagaggaagcagcgaaagccggtaaagcagctccagcacctgagccagcctctgaaccagtgcagccacagccggttgcaaaacgtaccgtaacgattaactcaaccgatgccatggctaagtcagtaacaaccggattcattgaaagtgaagccgaagttgatgcctatcttgccgctttaagagagcagctgattgctgcggtcaaagctggcgaccgagtaagaattaagtaa

SEQ ID NO: 301 - DNA, 3657 bp, Bifidobacterium bifidum
atgaacggggaaagcggcatcagcttcaaggagctgttcaataaagacattgaccgcaacatcaatggtgtgatcaaggccaatgatgagaaaaatcttaacgatgaggtcaacgagtatgtgctgacggaggagatttgccgcaatctggccaaattcctcgatgcatacaacgacccgtcgaaccatgaacagaacggtgcatggatttccggtttcttcggttccggtaaatcgcacctgttgaagatgctgtcgcatattctgggcgaggtcccggctgaactcgttgacaagggcaataagccgaccatgagtcgcgaacagattgttcatgccttcatgggcaaggccgaagcacaggatgaccagatgcttgcaggtcagcttgaaaaggctttgacgataccagccacgtcgattctattcaacatcgatcagaaggcggataaatccaatgcctccgatatgctgctgtacgcttttgttcgcgtattcgatgaggcgcggggtttctacggcaagaatccatacgttgcgaaattcgaacgcgatttggcgagcaatggttatttcgaggatttcaaacaagagttcgaacaggtggctggcaaaccatggagcgaaggccgtggtgaggccgtgctatgggatgatgagatctgcgaagcctatgccgcggtgacaggcaaaccggagcaagacagcatcatccaacggtacgaggatacgtacacgatgacggtcggtgacttcgcagacgacgtgaacgtgtggctgtcccgtcaggaaccgaaccgccgtatcttgttcctcgtggacgaggttggccagttcatcggtgagaacagggagctcatgctgtcactgcaatccatcgccgaggatcttgccgtcaagaccaacgggcgtgcatgggtggtggtcacttcccaggaagacatggatactatcgtcggtgatcggaccaagcagcaaagctatgacttttcgaagatccagggcaggttctccatcaagctgaagctcaacagcgccgacgtggtggaggtcattcagaagcgcttgctgaccaagaaaccggaatatgagtcggtgatgaacgagctgtggaatgaacagaacgcgaacctgcgcaccatgttcgaattcactcgtgagacttcgaaattcagtaataacaaggcatacagcaaggacgatttcatcgcatcgtatccgtttgtgaactatgagttcgagttgttccagaacgtgctgcgggaaatgagccggtacaacatgttctccggacgccacgcgtccgtgggtgaacggtccatgctttccaccatcagcagtacgctgcggtccagccagaatgagatggtcggggccctgatgccattcgacaaactatatgacggtatcgccgacgccatccaatcaacctcgaacttccgcatcaaccaagccgaaaagagactcggctccgatataaaggagctgggtgtgcgcctgctgaaggtgctgctgctggttaagcatgtcgacggattccccaccacaccgcataacctgcgcattctgctgaccgaccagttcgacatggacgtgatggaactggaacggaacatcaagtatgttctgggagagttggaaaaagacacgtatgtgcagcgtgtgggagatacctacaattacctgaccaacgaagagcaggatatcgagcaggagatcaaaagcacggacatcgactccaccaaggagatcgaagagctgaagaagatcctggtcagtgacgtgctcggcaagatgaccgtggcatacggcgaacagcgtgcccagttccgctatggtttgcgcatcgatggggtgcaacagtccgcgcagcagcccatctggttgaacgtggtcacttcgatcaatgcacaggaccgtgccgatgccattcgcatgggcatgggtatgcgcgacaccatcactttgctgttggatatgtccgacagaacactgttcgatgatctgcgcatgtacgtgaagacctatacgtaccttatgcgcaccgacaagaacagccagtcagaagtgcgccagcagatcatctcccgcaagagcgtcgccaatgaaaggctctatgcggaattacgcacccgcatcgtcaaagccgcggccaatggcgagttcaactataacggcggaaccgtggaagtgaaatccaccgaggtgcgggcccgtatggcggaaggtcttggaacgctcatcggccggtactatacgaacttctccctacttggtgggcaaagatacgaggaaacggatctcgcgcgcatcatcatgaacgcttcgcagcaccagcccggcatgcttgacggcatgaacgcagtgcaggacaaactcgacgttcccgccgatgatgtgttcgccgcggtcagtcgtgacaaaggcaaaggcatcatcgccaccgtcaagagccttcttgatgcctacggcagcgttccctatggttggccgtacgccgccacactcgcatgcatcggccacctgtatggttccgacagaatcacgctgacgctggacggcaagccggtgcagcgcagcgaggccgcccgtttgcttagagaaacgaagaagcaggattccatccgagtggatctgccacgcgtattcgacacgagaaaagtttcacagctgcgtgacttcgccagggatttccttgggctcaccgccgcggacctgccatcgaacgcgattgatctggcggagaccgttaccacgcgacttaagcgggaagcggagagtctgacccagctgcgcgtgcgcaatgcccgattcggctttgtgcagcagctcgacaaggccattgagaaaatcaactatgcctccggaatgagcgaggactggctgctcggcgatttcaccgcacaagaaaccgaaaacggttccgaagaactgctcgagtttaaagaagacgtaatcgacccgatcgtcgccttcctcaacggctcccaatccaggatcctcgcggacggattggagtggctgaagaacaacaagccgaacatcgactatgccttcggcactacggccagcctgtatcaatccgcggaacagctggcaaacgatccgaacatcttccgcaaaaccaacaaattcaagaccaccattgacgatctgcgcgaggaaacagacgcagccattcgaaccgaacgcgccaacgcgcttaaagatgtggaaggtattcgtgccaagattcacgattccgccgaataccagcatgccgcacaggctgcgcaagccgaggccgagacagaactggatcaagtggcggaacgcatgcagaacatgctgttcatctacaaaatgcgcgaaagcgtacacgaactgagcgaacgcacttaccctcaactcatcaacgcactagcagcctccgcgtcgaggccgaagaccgcgctcgcaggagaggcgcaggctgctacagctactacgccgatggatgcgaacattcctgaatcgcaacaaaaggaaaccccacgcgtggccgtgtcgttcgctaccatcagcaggcctcacaccaaggacgctttggagaccgaggacgatgtagacgacttccttgatgcctaccgccgtgagcttatcgccgccattgagaacggaaagaagatcctgctatga

SEQ ID NO: 302 - DNA, 3615 bp, Escherichia coli
atgaatattgaacaaatttttgagaaacagctaaaacgtaatattaacggcgtggttaaagccgagcagaccgacgacgaaagcgcctggatagaactggatgagtatgtcattaccagagagctggatggtcacctgcgtcagttctttgaagtatatgcccctgctactggccctggcagattacagcttgctgacaaaataggcgtctgggtttcaggcttctttggttcgggtaaatcacacttcattaagatcttatcctatctactggcgaaccgcgaagtaagccataatggtgtcactcgtaatgcactttccttctttgaagagaaaattgatgatgcactgctattggctgatattcggaaatcggtacaacatccgaccgatgtcatattattcaatattgactcacgtgcgaatgttgaagatggcgttgatgccatactcaaagtctttctgaaagtctttaacgaactagctggttattgtggcgacttcccacatattgcacatctggaacgtgagctcgataagcgtggacaatttgatacctttagggcagccttcgcggacattacagggtctcgctgggaagacgaacgtgatgtttatctgatgataaacgatcagatggctcaggcactgagtattgctacaggccagagtgaagagtcttctcgtcaatggatcgagcaacttgataagaacttcccattggatatcaaaaatttctgtacgtgggtgaaagagtggctcgacagccatggtaatcgcaatatcctgtttatggtcgatgaagttggtcagttcattggtaaagatgctcagatgatgctcaagctgcaaactatcaccgaaaacttgggcgttatttgtggtgggcgggcatgggtgatagttacctcccaggctgacattaatgctgctattggcggtatgagcagtcgtgatggtcaggacttctccaagattcagggacgtttctcaacgcgcttacaactctccagctcgaatacttcagaagttatccagaaacgtctgctggtaaaaaccgatgcggcaataccggcgctggaagctatctggcaggaaaaaggcgatattctgcgtaaccagttggcgtttgacacgacaacgaccgctactctgcgagcctatacaaacagccgcgagttcgtggataactatccgtttgtaccgtggcattaccagatcctgcaaaaagtctttgaatcaatccgtactaaaggggccgcaggtaagcagctggcaatgggggagcgctctttgctagatgccttccagtcggctgctgtgcaaatctccgcagatggtctggatagtctggtcccgttctggcgcttctattcagcgattgaaagcttcctggaacctgcagttagccgcactattattcaggcctgccagtctccgtcactgactgaatttgacggcaaactactaaagacactgttcctgatccgctacgtcgatgtgctgaaaagtactctcgacaatctcgtcacgctctctattgagcgtattgatactgataaagtggaactccgtcgacagattgaagccagccttaatcgtctgcaggctgagatgctgatctcgcgtattgatgacaaatttgtttttctcactaacgaagaaaaagagattgaaaacgaaatccgcaatattgacgtggaattcaccaccatcaataagcaactctcaaccatcattttcgaagagatcctgaaaaacaaaagatatcgctatccggccaataagcaggattttgatatcagtcgtttttgtaacggacatccgctggatggtgcgaatcttaacgatctggtggttaaagtgctcacgccactggactcgaactacgagagctataagggtgcgcattctaatagtctgctgatgacggacagtaaagactgcatcttaatttgcctgcctgatgaggctcgtacctggcaagacctgaccatgtacgctcagaccaaagctttcctcagcaggcaaagcggccagcgcccggaacaggcaacgctgttggcggaaaaaggccgtgaaaatagtatgcgtgaaaaaacgcttaaggcgcagattgaaggcttgctggctcaagctgatgtctgggcgctgggcgaacggctggataagaaatcctcttcgccgttagctatcgtggatgcagcctgcggttacgttatcgagaacagtttctctaaactaaaattgctgcgtcttagtaccggagacgtaaatcgtgaaactcacgcgctgttgacagtagaaaatgatacccagctcgatctcgggggtatggaagaatccaacccagaggcgatgcgtgaagtggataactggatcagcatgagtattgagactcataagccagtttacctgcgggatattctcaccacttttggccgtcgcccgtttggctggccggaagatgaagtcaaattgctggttgctcggctggcacgcagcggtaaatacagcttcactctgcaaggcagtgaaatcgcactgaagcaggcgtgggacgcgtttaataattcacgtcgttacagcgatttgcgtctgcataaagttcgtcgccatgatgaagcacagttgactaaagctgcgcagctgatggcagagattgctggagagccgtttaacgagcgtgaagaacagtcgttggtctctcatattcgcgaactctttggccgctggaatagcgagttgactgtttttaaaactcgtgcagagagtggacaaaaccctggccgtaaagagatagaagaaggtctggtattgctgaacgggatccttaacgagaaagaggaatacgcggtcattgaaaaaatcaccgcagcggctgacgatcttaaagatttctcggaagactgggacgatttggttagcttctacaaaaaccaatacgctacctggcagcgcttgagtatggcgttgaatggcagttttaaagctaaccgtaacgcgctggataaagacgaaacggcccaaaaggcgttacaggaactggaagggatctacagcaaggcacgaccttatggagaactgcatcggattatcccgctgattgaaaccgttgaaaccatcaaccagcgtctggtcgaagaatatcgaagccatgcgctgctacagatcgatggtcatatcaatgaacttaagcaaagcatgcaggagatgcacgtccctgctgacttgcaacactcgcttttacacccgatgcaacaatcgcgtaagaaagtggagcagaacggcctgatcccacagattatggaagaacaggctgaggttcgagcgctacaatttaaagcgaatgaacggctgaacggctgggttgaggatcagcgtaagaaagtgtctgatccaaaacctgctcctcagcctgggattatcgaccccgtagttaagcctgaacccaagctgaaaaaaaccatctacgtaaacacgcgtaaaacgatggaacgagcggcgggtgtgacaacgctggataacgccgaacaggtagacaaagcgctggaacaactccgtaaaacgctaatggatgccattaacgcaggtgaacgcgtacagcttcagtaa

SEQ ID NO: 303 - DNA, 3642 bp, Salmonella enterica; identical to SEQ ID NO: 8

SEQ ID NO: 304 - DNA, 3678 bp, Vibrio cholerae; identical to SEQ ID NO: 122

SEQ ID NO: 305 - DNA, 3663 bp, gamma proteobacterium
atgaatattaaggaactcttcgtcaaaccattggatcggtcaattaacggcgttgtgaaggctgaccagaatgatgatgccacggtgtatcaggaattggacgagtatgtcgtcaccaacgaacttgagcgccactttcgtgattttttccagtcttatgccaccgacctgaaagatccgtcgattgcgaaccgcgttggggtttggatctcaggcttctttggctcgggtaagtcgcattttctgaaaacactgtcgtatatcctggcaaacagaccggttcatgacgacaacggcaatgaaagatattcggtctcttttttcgacgatagcaaggtccgagacgcgtttatacgcgccgacatcgacaaggccgtgagcactcatgcagacgtcattctgttcaatatcgacagcaaggccagctcaaatgacgacggcaacccgattctgaatgtcttccttcgggtatttaacgagcaccagggcttcagtggtgaccatgcccacattgcccacatggagcgccatctgtctcagaagggagtgtatgaggacttcaaggcggcttttgagaaatcttccggccattcctgggaatcggagcgagacggctttcagttctatcaagatgacgtagaggccgcaatttcagaggctttgaaaatgtcacccgatgcggcgcacaagtggtttgaggcatcggaagagaccttcagcgtttcggtagaaaatttctgccattgggtaaaggaatacttagaggaacaaggcaaagacagccgcattctcttcctggtggatgaagtcggccagtttatcggcagcgataccaaactgatgctgacactgcagacccttaccgagaatcttggaacgatttgcaagggacgcgcctggatcatcgtcacctcgcaagcggacatggacgcggtattgggtgaattgtcgtcgtccaaggccaatgatttttccaagatcgccggtcgcttcaagacgcggctttctttgtccagctcgaacaccgatgaggtcatccaaaagcgcctactgcgcaaaacccctgaagcgaccgaagcactgaaagccgtctttgagcaaaagggcgacatcctgaaaaatcaaattacgttcgatcggtctggaccgacgctcaagaacttcgacggcccggacagcttcgtcaacaactacccctttgcaccctatcactttcagcttgtgcagaaggtctttgaggagatccgcaaagtcggcgcgactggcgctcacttggcgtatggggagcgttccatgctcgatgccttccagatggcggccggtgcaatttcaaatgaagaaattggggccctggtcccaatgcaccgcttctatagcgcggttgagggctttctggatacggccgtaaagcgcaccatcgatcaggccggggaaaacgctacgctggatagcttcgacgtccagatgctccgaacactgttcatgattcgctatgttgatttaatcaaaggcaccctagacaacctggttacgttgtccattgaaaaaatcgacgacgacaagctgggcttgcgtaagcgtatcgaggagagcttgcaacgccttgaaaaggaaagtctgatcacccgtaatggcgatgagttcctgttcctgaccaacgaagaaagggacatcactcagaaaatcaaagccacagagatttccagttcggaagaaaacaaggagcttagcaacctgatcttcaaagatcttcttcgagataccaacaagtatcgccaccaacccaacaaaatggattacagcctcggccggtatctcgacgcccattcgctagatggcaagtacgagacggacctgcgagtcgaagtcatatctcccctggacagcgattacgcgctgtactcagaggcgggctgcatcaataaaagctctgaaggtgatggcctgatcctgttcaagctgggcgacgacaaacaatttttcagtgagctgaaaacctggctgcgaaccaataaattcatccgtctgaatgatgatggttcccaggcggacatcacccgcattctagccgaccgtggcagagagaatcaggagcgcaagaaaagactgcgcgcgcgcatcgaggatatttttctgaatgccgaggcctacgcccttggtcagcatctcgccttatcatcggctaatcccctgagcaaactggacgaagcctgtcgctacctgctggaaaacacctacaccaagctgagctacattaaggtctaccagcaagacccctggcgggagctcaatgcggtattaacggtggatgatattggtcagattggcttgtccctggaaggcgaagagggcaacccgaaggccacgcgggacgtggagcaatacatcggccttcgcgccagcggtaccgagcgcatcttgctgtccgatattgtggaccgtttcagcaagcggccctacggctggccagatgcggaagtcttattgatcgtaggccggctcgccgcagctgggcggatttcctttcagctcggcggcggcaccttgcccgtgcgtgaagccctggagcccctgcagaacacgcgccggaggcgtgaggtctccatcatcaagaagcgccagactgatgaaacggtgctaaagcaggcacgtaacctgactcagggcctgttctcttcgatggggccggccaccgagaaggagcttttcgaattctacacaacccacttcagcaaatggctagccaacctaaagtcctacaaaagcaaaacggatgttggccgcttccccggcaaggcggtaatagaacagtccatcctgagcttggaacgcctgctcagtaatgacgatagcttcgatttcttcaagcaggttgtggataaaaaggacgactacctcgacctggaggaagactatcgcgacatacacgagtttttcagcaatcagatccatacgtggcaacagcttcaacaggcgctccgccactttgataagaaccgtcaggcgctggaaagggatacgcaagccagcaaggccctgtcggagctgcaagctattgagtcggcgaatgcgccttacggaatgttacacaacgtcgctacgttgatcagtgcggtcgagagcgtcaatgagcagctactgacagaaaaacgcgcccatgccattagtcgtgttgatgagaagatccagcagcttgaagccgagattgccaaaagcggcattggcacacccgagttgagcaatcgactcctccgacccctgcaaatagtcaaagccgacatagaggccgagaccgggattgccggtatctacatgctgcaaaccgagacggcaaccgagcgctttgatgatggattgtacgaacttgagcgggccgttcaggcagagatcgagcgtcgggctaaagcccagcaagccgccgccagtaaacccgatggcacgcctgacacgggctccccctcaacacccgtcccacaagcagcacctcaagcaccagtggccaagccaaagcctgtggttgaggtcaatgtcgccagcctctacaacaaaaccggtgaaggggtatatctggaaacagaggaatccatcgaccagttcgtggaggcattgagaactgagcttcgggccgctattcgggcagacaagcgggtgcgcctccggtga

SEQ ID NO: 306 - DNA, 3639 bp, Pseudomonas psychrotolerans
atggaaatcaaacagctattcgaccccagcaaagacatctaccgcagcatcgaaaaggtcatcacctacggcgtctctcaggaggaacggctcaaggcggagatcgccgagtacgtggtgactgacagcatcgatgagcaattcaacaagctgctgctcaagatgcaggctgccatggatgcaggcggtgagaacgaggtgggggtctgggtttccggcttctacggctcgggtaagagctcgctgaccaaataccttggtctggctttcgacgacagcatcaagatcgatggcaccccgttcattcagcacctgcaagaccgcctgaagaagaccactacacgccagctgctgagtactgtcgccaagcgctttccggcggctgtcctgatgcttgacctagccagtgagcaggtggctggagccaccatggaagaggtttccaccgtcctctactacaaggtgctgcaatgggctggctactcacgcaacctcaaggtcgcggcgttggagcgcagactaaaaaaagagggtcgttatcaggagttcctcgacctgttcaaggacatggccgggggcgaggaatggcacaactatcgcaacgatgaattggtcgtagacagcctggttcctgccctggctcaccagctttacccgaacctgttcaagaccgagagctcgttcagcaccgaagccagcgaggttattcgctttgagaatgaccgtgtccaagagatgttggaagttgcccgcgaggcatcgggtaaggattacatcatcttcattatcgatgaagtaggccagtacgttggctcgcgtccgaacctcattcttaatctcgacggccttgccaagaaccttaaggcattgggtgatggcaaggtctggatcatcggtacagctcaacagaccctgacagaagacgacccgcgcgcctcgcttaactcgccgcagctattcaagctcaaagaccgcttcccgatccaaatcgatctggaagccaacgacatcaaagagatctgctacacccgtctgctgggcaagtcaccacaaggtgctgccgagttgggggcactgttcgatcagaatggtcaggcactgcgtcatcacaccaagctggaagatgcccgtgcgtacggtacggactttgacaaggccgcctttgtcaacctctacccattcctgcctgcacacttcgacatattgctgcacctgttgggtgccttggcgcgctctacaggtggcatcggcctgcgctcggcaatcaaggtgatccaggatgtgttggtcgagccaggcgaaggcaagactcctattgccgatcagccggtgggatggctggctaccactgtgaccctatacgacgccctggagaaggatattcagcgtgctttcgccagcatccacaaggctgtcgacagtgtttgcaaaaaccgcttcattgactcgccgattcaccagaaaatcgccaaaaccgtgggtgttctgcaaatcttggggaatctgccgatcactcgacagaacatcagcagtctgatgcatggcagcatcaatgaacccagccaatctgaagcaaccaaccaggcggtcgaggaattgatatccgaccggtacgtggcttttggcgagcaggatggtttcctgcgtttcttcagcgaaaagctgaacgatatcgaacaagagcgcagccagattccgctgcgtgccgttgagcttaagcgccttgccaacaatgctctgactgctgcttacaacccgctcccgagtacccagcttcatggctctttggctgtacagaccggaatcaaggcgcagacccaaggcggtatgccggtggcgttggcgggtgatcgcaacactattcagaccatcgtcgagctggttgatccgaaggattacgacaccacacgcacccgcctggtggatgagtcgcgacacaagcaggcgcagtaccagattttcctgtttggccgtaccactccggaaattgatgatctgactgcggagatttaccgctgtaaagagattgccaacaaataccgaaccgatcccgaccaggagatcaaggagtactgcaacggccagtcggatcgtgccagccgtctgactacagaattggagcgcctgatcaaacgcagtttgctgcaaggctcattcatcttccgcggccaaatcaacgcggtggaaaatctgggtagtgaacttgtagatgctgcacgcaagcatttgggcgaagtcgctgagcaggttttcgaccgttacggtgaagctcctgtgcgagcggccactgagcttgccgagaaatttctgcgagcaggcagccttaccgctatttcgacgccaatcgatccgctgggcttggtgcaggccaacgccggcaaggcgagtatccgcactgaccacaaggcgttggtcagcattcgagatcatatcgaccgctttggtgtcgttgagggtaagagcctgagcgacaggttcgccgatgcgccgttcggctggtcgcaggacacgcttcgctatctgctggccgctttgttggtggcgggagaaatcaagctgaaggtgggtgggcgtgaagtcaccgtcaatggccaacaggccattgacgcgctgaagaccaacaacaccttcaagagcgtcggtgtctccctgcgtgaggacaagccctccatggagatgctcgctctggcctcgaccaggctgaccgagctttgtggtgatttggtcgtgccacttgaggacgcgatcagcaaggcagccaccaagttgttccccaacctgcaacagcgctatgcacccctggcagaaaagctcaaaagcctaggtctgccaggtgtagatcggctggatagcttgagtcgcgatatcgctgatgtgttgctcacggatgcctctgatgcgccccaacggctgggtaagcaggactcggcactttacgaaaacctgaaatgggctgccgaggtacgcaatagcctggagcatgggcttgagcagaccctgcgtgacttgcgtcagcatcgcagggccatcgaagggctgccgcaaactgatattcctgcacagttgaaagatgaactggcagagccctttgctcagctagagcagcgtttgcaacagttggacttccactgccactcagccgacttcaatacccgcctgacccacctacgtgcccaggtaagtacagccgccacctccatgcaatctgcccaggccgagcgtctgaaagaggcggaagtcgatttgcagcgtgtgcctgagtgggtcgagttgacactgcaagagcagcaagaactgcttggtaagcttgagggattgattctccaggttgagccgaacatcggcggcctgcaagcactggtcaaccgagactacgagatccacaaccaggtgcaacagctcaagcagcgcattgagcgcttggggcgcgagcgtctgcaagagcggatcaagtccgaacagcaggaaaaggagcaggagggtgctccagaggccaagaccattactcgcagcttcaaagcccgtgcccgtatcacctcactgtccgaactggatgtgatgattcaagcgctgcaaaagctcaagagcgaactgaaattcgcacacgcctttgagctggatgtgcaggtggaggagtaa

SEQ ID NO: 307 - DNA, 3552 bp, Acetivibrio cellulolyticus
atgtttatcaagcacatgtttgccaaaagcatagaacggcctataaaaggagttatcaaggttgcacagacagatgatgaaaatatacatcaggaactggatgagtatgttgtcacccgtgagattaatgagagactttcaaaattctacgataattatcaaaaagggattgatggtaagactgataaaatgggagtttggatttctggattttttggttcaggtaaatcccactttctaaagatattatcttacttattggataacaaaggcattaaagggaaaaaggcattagattactttgatggtaagattcaagaccccttgctgcttggtaacatgaaacgcattggaaatgtcgatacggaagtaattctttttaacatagattcaaaaagttcaatagatggaaaatcaaaagaagatggcatcttaaaggtatttactaaagttttttatgagcacaggggtttttatggagaaaatccgggcgtggcggaaatggaaaaatacttatcaaaggaaggtaagtttgacacctttaaagcttcatttaagagaataaaaggtgatgaatgggtaaataggagaagaaccttcaggtttgatacggatgctgttgtaggtgcattaactgaggcaactggaatgtctcaggaatcagcaagggaatggttcaaaaatggtgtcaatgattatgtgatgagcattgaaaagtttgctcaggatgttaaagaatatatcgacagtaagggaccgaagttccatcttgtttttcttgtagatgaaattggtcagtatattggcggagaatcaaaactgatgctgaacttgcagacaataactgaggatttgggtacatattgtcagggaagagtctggataatggttacatcacaggagagcatagatgatctgttcaaggtaaaaggcgatgatttttccaaaattacaggaagatttgataccagactttcactatcttctatttctgttgatgaggtaataaaaaagcgtattttagaaaagaacgaaacagcaacagatactttaaaagtactttatcatgacaaagctgcaatactaaaaaatcttataagctttaaagatgctgcaacagatcttttgggctttgaatgtgaacgggattttattgacgtatatccatttattccatatcagtttaaattgctccagaatgtatttgaacagatcagaaagcatggtagttcaggaaagcatttatcagaaggagaaaggtcaatgctttcagctttcaaagagtcggcacttaaatataaggaagctaaggatggtgccttaattcctttttatgctttttatgagactataaaagagttcttgaaccctgcagttgttagggttatagaaggagcatataaaaatccggcactaaaagacgatgactttaacatggagctactaaaggtgctctttatggttaaacatataaaagagttgcctaagaatgtggacaatattgcaacactgatgattacacatattgatgaagacaagcttgctttaagagaaaagattaaaatttcattaggaaaactaacccgcgagactcttattcagaaaaatgcggaggaatatatcttcctgactgacgatgagcaggatataaaccgtgaaattaaaataatcaatattgatgatgacattataaaaaaagaacttcgtacgtatgtgtttgaagagttttatgaggataagaaattcagatactccaagcaatataatttttctttcaataaaaagatggatgaaaaggaacacggtaatcagacagctcatattggaattcatatactttcaccaaagtcagacctttatgatcaagctgatacaaaccttattatgagaacctcaggtagtggagaaatgattgtcaaacttggtgggaatggtgtttatcttgaagagttagaagaagcactaaaaattagtgaatacacaagcagaaaaaatataagccagctaccggagaatattcaaaatataattaacaacaaaaaggcggaagaacgggtacataggataagagcaaaagaataccttgaaactgcgttgaaggatgcaaccttctttataaatgggcaaaaggaagagattaaaggaagttcggtaaaggaaaagatcaatgctgggctgaaaatacttgtagaaactgtatataccaagctgtcttatgtgaaagtgttttgcgaagacactcgggagctgctgaatctaatcaatggtgacttcgaacagacgaatattgatggatttgaaaaagtggataacagcttggcaacgggagaaatttttgaatttattaaaattcaggatgatatcaataagcaggtcagagttaaaatacttattgatagattttctgataaaccttatggctggagagaatttgatatttcggcactgattgctactttattaaaggaacaaagaatccgtttgaaattgaatagtgagtacctggaaattggtgattccaatttaattaacgggttgacaaaagcttccgatattgaccgtgttatcgttacaaaacgtgttaaggtagatgaagctttgatccgtagtgcaaaaaacgtttgcaaggaactttggaacagcactaatatcgctgatgatgaggatggattggctaaagacataaaagcattgattaagtcacagatggaagaaataaatgctttgaaaaataggtatgaaggtagaaagtatcccggcgagagtcttttagacaagggccttgaatatttcgaagctttcagacatctgggggataatgcaagcttgttcttcaagcttcaggagatggaagaagacttattgacctgggaagaagacttctcttacgtcaagaatttcttcgacaaccaaaagacaatatttgataagggtttggaagctgcaaagaagtttgaggataacaaactatatttaagtgagggcgatgttaatgaaaatgcaaccaagcttaatgatattctcaatcactatttgccttatgggagaataaaggaaatcccagaatatgtgaaggtaataaatgaaggaattagcagggttgtagaacaaaagaaggctgaggctacagataagataaatgctgattttgaaaacatgaagctaaaaataaatcaatatggcgttaaggaagatacgaaagaaaggattaataagttttataatgacttgctatcagggctttcaggatataatgatatatataaggtagatgcaactattactcacagctctaattttagaactagaaatgaaactataattgaggacgaaataaagcagtttaatgatgaactccaaaagggagataatactgttacaaaggaaaaacctgaagaagcagattccgtagtagaagagattaaactcaacagatatatttctataagaactatcaagacagaggctgaagtagatgtgtttgtaaaagaactttcagagaagctgaaagcagtaattaggaataataagcagatcaagtttagtgagtag

SEQ ID NO: 308 - DNA, 3723 bp, Fusobacterium sp.
atgaagaattatttaatacaaaatacttttcaaaaagatattacaaggaaaattaatggagtcattaaagcggatagcaaagaagaagatattgttgtaacagaattaagtgaatatgttgtgacagaagaaattcaaaagtacttgaacattttttttcatcgttatgtagattctctacaatctcctacagaagatattggagtttggatttcggggttcttcggttccggaaaatcccactttttgaaaatgattggtcgtattttggaaaataaagaatatcaaggaaaaaaagtcgttgatttttttgaagaaaaaatacaagatagcattttacaagagaatattaacaaagctgcaggagctcctacagatgttattttatttaatattgataatgtaagtgatcaaaatacccaacaaaataaagatactattcctattgcttttttgaagaagtttaatgaatatttaggattttcaagagataatatcaaaattgcagattttgagagaatgctgtgggaaaaggggaaatttgaagtttttcagaaaacattttcagaaatcagtggaaaaatttggaaagaagaatatagaaatttggatttctatgcggatgactttttagatactatagaaaaattagagattatgagccgggaagctgctatccgatggcttgagaaagaaacagatatttcaatcagtgcagaaagtttagctgatttattggaagaatacttaaagcaacaatctgaagggcatcgaatagttttcttagtggatgaaataggacagtatattggagaaaattctcaattaatgttaaatctccaaactttagtggaaaccttgggagtaaaattcaaaggaagaatttgggtaggagtgacttcgcaacaggatttgggaaatattctaggaaaagctaaggaaaaaagcaatgatttttcaaaaatacaagatcgatttaagacaatattgcctctgtccagtgcaaatattgatgaagtgattaagaaaagactattggaaaagaaactgttgcaacaggaagaattggaaagtttgtatgataaaacgagaatttatattgaaaatgctattacttttgacaaaacaggaatgaccttagctctttttaaagacaggaaagactttgctgaaacttatccttttgttggctatcaatttaacttattacaaaaagtttttgaaaaagtgagaaatatgggatattccggacaacatatgtcgcgaggggaacgttcccttttgagttcttttcaagaagcgggaattcgcataaaagatatggaagtaggttcattggttccttttcaatatttttatgcatccattgaacaatttttggaagataatgtcagaagaccttttattcacgctaaaaatgaaaaaggaattgatgagttcggtttagaagtattaaagcttttatttttactaaaaggaatgaaaggaattactccaaacatcaacaatttgacgagctttatggtagattccgtagattgtgatcgtttggcattggaagaaaaaataaaaaaagctttgggaaaattagaacaacaagttttaattcagaaagatggagagggatactatttcctaacgaatgaggagcaggatatcaacaaagaaatcaatcaggagttcatcaatgaacaagatgtctataaagagttgaatacctatattttcggacaaatctttacaagtccgatagtgacgatggaagatacgaaaaacaaatataattttagtcaaaaaattgatgaaattccttttggaaaaataggaggacaattggatattctcattttaactcccagatcagacgaatatgacaacattgccattcttggatatcgtgacggttatgatttaattcttcgacttcctgaagaaatgacatactgggaagaaatccaacaatccctaagaatagcttcctatgtacaaaaaacattgcgaggaaataatagagaaattgttcatcaaattttacaaaggaaacaacaagaaaattcaaagagaaaacagagaatacaaaatgaagtggaaagagttttgtcggaagcggaaatctacattcaaggtcagaaaataaatattatgactgcacaagcggataaacgtgttgcagaagctttaaaagctgtagcaagacaccgatttaataaagcaaaattggtacaaagaccttattctgaatcagagattagaaatgtactaagttatgaatacgatgccggaaccaatttatttgatgtcaaaaaagatatgagtacaaactctaattatgcagctttacaggaaatattaacctacattactttacatacaagtcgaggaaatgttatcactttgaaaaatattgtagaatatttttcaaagaaaccttatgggtgggaaacattttctattcatggcttggttgcagaattgtggatatataagcaaattcaaatagaagagtctaaaaatcccattcataatgcagaagagttaaagactcttcttgtgaaatctcaatccaaaacagaagaaagacttgtgatcagtcttagagaagaaattgataccgaacttcttcaaaaggtaaataatcttttaaaaaaattatttggaccggaaaaagaaatttccgtagatcagccgaaagaagacattttggaaattttaaagaaaaaaatagatttgcctaaaatgtatagtaaagaatgtgaaagtggagtatatcctggaaaaaaagaattacaagaatggattgatttattggaagagattttactttccaaagaaaaaacagaaaaattgttgaaacatttcttagagatggaagaagaattattggaagcttatgataatcaaggaatcgtacttgatttctttcgttcttctaaaagaaagaaatttgatgaaggattggaaaaaagaaagaagataaaagaatacgaagctgtgattggaagtatccaagaaatgaagccatatcaagacttggtatccattttaacaagcaagagtccatacaatcaaattaaaaatattgatgccttattagaagaaatacaagtggaagaagaaaagttaatcttagaagaaaagaatatgcttcttcaaagaatagaagaaaaagcaaaagaattttccactctttttcaagaacgagatgctatgttggaaaaaacgctcgaaaaattaaaagaatttaagaataaaatagagaaaacaagcagtctttcaatttttttcagtatgagtgattggaataaagtattatcttctatcgaaacagaatatcgaaaacatattcaggaagaattacgaagtcttgaaaaagctgcttttgaagtgaccgaagataagacgggggtcaaagaattagtcgaggatattagaaacaccttccatgcttatcaagaagaggcgaaatccaaggatgtgaatcaattggaacagttaattcaaaaggcaaaaaaagatgaagaaggatttatcttacaaggaaacggacgagcaaagaaaaaagagagggtacaattccgtaaaatacgggttgtggaaaaatccaatattgaaacgatggaagctgtggaggagtatatttcaacgttagaaaaagaaatacaaaacttaaaagaaaaaatgttacaagcaatacgagaaaataagattgtggatatacaatag

SEQ ID NO: 309 - DNA, 3672 bp, Enterococcus faecium; identical to SEQ ID NO: 296

SEQ ID NO: 310 - DNA, 3690 bp, Vibrio cholerae; identical to SEQ ID NO: 123

SEQ ID NO: 311 - DNA, 3642 bp, Salmonella enterica; identical to SEQ ID NO: 8

SEQ ID NO: 312 - DNA, 3456 bp, Vibrio cholerae; identical to SEQ ID NO: 239

SEQ ID NO: 313 - DNA, 3753 bp, Fusobacterium nucleatum
atggaaaatttaactattaaaaatattttgcaaaaggatattgaaagaaaaataaatggggttgtaaaggcagatagcaatgaaaaagacaccgtgattacagaattaaatgaatatgttgttacagaagaaattagagaaagattaacaaaattttttgataaatatgttgaatcaattaattttccaacagaggatatgggagtatggatttctggtttctttggttcaggaaaatctcattttctaaaaatgataggacatattttagaaaacaatacctatgatggaaaaaaagttgtagatttttttaaagaaaaaatagatgatgcaattttaatgggaaatattgaaaaagctgctgaaattccaactgatgtaattttatttaatattgataatgtaagtgaccaagatacatatcaaaataaagatagcatagcagttgcttttttaaaaaaatttaatgaatatttaggttttacaagagacgatatagaaatagcagaatttgaaagaaaactttgggaagatggaaaactagaagaatttaaaaaagtttttgaagaagaatctggaaaaacttggaaagatgcaaatagaaatttagattttcattcagatgattttcttgatgttatagaaaaattaaaaattatgagtagagagagtgcagaaagatggcttgaaagagatgtagttaggtctataagtgctgaaagttttagagatatacttgaaaattatttaaaaatgaaaggacctaaacatagaatagtttttttagttgatgaaatagggcaatatattggtgataattcaaaacttatgttaaacttacaaaccttagttgaaactttgggagttaaatttaaaggcagagtctgggttggagttacatcacaacaagatttaagttctatattaaataatagtgaacatagaaaaaatgatttttcaaaaattcaagatagatttaaaacaatgcttgctttatcaagtggaaatattgatgaagttattaagaaaagactgcttattaagaaaaaaattgaaggagaagatttagaaaaaatctttgataaaaaaagagttgaaattgaaaatttaatacattttgaaaaaacaatgactttacctctatatgatgataataaagatttttcagaaacatatccttttgttgcttatcaatttaatctactacaaaaagtatttgaaaaagttagaaatatgggacattctggacaacatatgtcaagaggagaaagatctttattgagttcattccaagaagctggaataaaagtaaaagataaaaatataggaatacttgtgccatttaattatttctatgaatcaatagaacaatttttagaagacaatgtaagaagaccatttattcacgcaagaaatgaaaagggaatagatgattttggtttagaagtattaaaacttttattcttattaaaaggaattaatgggatagaacctactttaaataatttaacaagttttatggtaaactctatggattgtgataggatagaacttgaaaagaaaataaaaaaagcattagaaaaattagaaaaagaagtcttaattcaaaaagatggagaaaattattattttttaacaaatgaagaacaagatataaatagagaaattgaaagagaagatattgatttaaagaaaattgatgaaaagatagattcatatatttttaaggaaatatttacaaagaatagtattctaatggaagaaacaggaaataaatataattttactagaactattgatgaaacagtttattctaaatctggagaagatttagcaataactatttttaccgaaagagcagatgattatgataatgttgctatcgtaggtacaagagcagaaagtgacctaatattaagattagcaaaagacgatgaaacttatagaaatgaaattaaactatttttaaaggtggaatcatatattagaaataaacaaaaggataatgaaagagaaactattatcagaatattagaaataaagcaaagagaaaataaaataagagatagaagaattaagaatgaattagaaaggcttatagtggaagcagaagtatttgtttatggacaaaagcaagatattaaaacaaaagatgcttctaaaaaaattgaagaaagtttaaaagccttagcaaatcacagatttcataaagcaaaacttgttaaaaagccttatgatgaagctgagataagaaatatattatcttatgtttatgacacagaaaaaaatggagtattatttgccattaaaaaagatgttgaaagtaatataaattctgaagctataaaagaagtattagaaagaataacattacttgaaaaaagaggagatactccaataacattaaaaaatataagtgaatattatttgagaactccttatggttggggacaacttacaatcaatggtttagttggagaattgtggaaatataagttaatagatttacaggaatcaaaagtctttgttacagatgaaaatatagcaacaaatttattaataaaattacaaaataaaaatcttgaaaaaattgtaatttcattaagagaagaaatagatcctgaacttattagaaaagttaataatttattaaaagaaattaagacaattaaagaagatacaggtgaagttactcttgattctccaaaagaagatttattagagatattaaaaagaaaaattggaatagcaaaaagttataaaatagaatgtgaacataatagctatccagggaaaaaggaattaaatgattggatagaccttttagatgaaattattttatctaaaagtaatgcagaaaagactcttaaaaatttcttagaaatggaaaatgaactatcaaaagaatatgataaggttgatagggtttttgatttctttacaagttctaaaaaagaaagatatgacaaagctattgaaaaaataaataaaattgaagagtataaagattatattggcagtttaaaagaaactgatgcctataaaacaattgaagaaatcaagcttgataaaaatatttatgaaagaattagagaatttgatgatttaatttctgaattagataaagccaaagatgaacttatagaaattgaaaaaacttccttaaaagaaaaagttgaaaaatataaaaaagagttctctgaaaaattaaaagataatccagaaataataaaaaaattaaaagaaaagttaaatgaatttttagaaaaagaagttaataataaagataattctaatgatatggcaatatttatgaaatctaaaaagttagaaaatattgttaataattttgaagaagaatataaaaattctgctaaaaaagaaattgagaaattagaaaattatcttaatgaagttgcagaagataaaactgatattgatgagcttagaaaaagtataaaatctacatacagtaattataaagatgaaatagctaaaagtgatataaaaaatgtcagtgtaactattgcaaaagcaattaaggataaagaagattttaatgctgaaatcaatggaaaagctaagaaaaaagaaagaataaaattaagaaaaatttctataaactcaaaaagtaatatagaaagtgaagaacaagtgaacgaatatatttcagctattgagaaagatattgaaaagttaaaaaatgaaatgcttgaagctattaaaaataataagattgttgatattggataa

SEQ ID NO: 314 - DNA, 3750 bp, Fusobacterium sp.
atgtctgatttaactattaaaaatattttacaaaaagatattgaaagaaaaataaatggagttgtaaaagcagatagtaatgaaaaagatactgtaattacagaattaaatgaatatgttgttacagaagaaattagagaaagattaacaaagttttttgataaatatgttgattcaattaattttccaactgaggatatgggagtatggatttcaggtttctttggttcaggaaaatctcattttctaaaaatgataggacatattttagaaaacaatacctatgatggaaaaaaagttgtagatttttttaaagaaaaaatagatgatgcaattttaatgggaaatattgaaaaagcagctgagattccaactgatgtaattttatttaatatagataatgtaagtgatcaagatacataccaaaataaagatagtattccacttgcctttttaaaaaaatttaatgaatatctaggtttttcaagagatgatataaaaattgcagaatttgaaagaaaactttgggaagatggaaaactagaggaatttaaaaaagtttttgaggaagaatctggaaaaacttggaaagatgcaaatagaaatttagattttcattcagatgattttcttgatgttatagaaaaattaaaaattatgagtaaagaaagtgctgaaagatggcttgaaagagcagaaaaatctttgagtgttgaaagtttcagtgatctaatagaacattatttgaaaataaaaggacctaaacataggatagtttttttagttgatgaaatgggtcaatatattggtgataactcaagacttatgttaaatttacaaaccttagttgaaactttgggagttaaatttaaaggtagagtttgggttggggtaacatcacaacaagatttaagttctatactaaataatagtgaacatagaaaaaatgatttttcaaaaattcaagatagatttaaaacaatgcttgctttatcaagtggaaatattgatgaagttattaagaagagactgcttattaagaaaaaaattgagggagaagatttagaaaaaatctttgataaaaagagagttgaaattgaaaatttaatacattttgaaaaaacaatgactttacctctatatgatgataataaagatttttcagaaacatatccttttgttgcttatcaatttaatctactacaaaaagtatttgaaaaagttagaaatatgggacattctgggcaacatatgtcaagaggagaaagatctttattgagttcattccaagaagctggaataaaagtaaaagataaaaatataggaatacttgtgccatttaattatttctatgagtcaatagaacaatttttagaagacaatgtaagaagaccgtttattcatgcaagaaatgaaaagggaatagatgattttggtttagaagtattaaaacttttattcttattaaaaggaattaatggaatagaacccactttaaataatttaacaagttttatgatagattctatggattgtgataggatagaacttgaaaagaaaataaaaaaagtattagaaaaactagaaaaagaagtcttaattcaaaaagatggagaaaattattatttcttaacaaatgaagaacaagatataaatagagaaattgaaagagaagatattgatttaaaaaaaattgatgaaaagatagattcctatatttttaaggaaatatttacaaagaatagtatcctaatggaagaaacaggaaataaatataattttactagaactattgatgaaacagtttatggaaaaatgggagaagatttagcaataactatttttactgaaagagcagatgattatgataatgttgctatcgtaggtacaagaccagaaagtgatttaatattaagactagcaaaagatgatgaaacttatagaaatgaaattaaactatttttaaaggtagaatcatatattagaaataaacaaaaggataatgaaagagaatctattatcagaatattagaaataaagcaaagagaaaataaaataagagatagaagaattaaaagtgaactagaaaggcttataggggaagcagaagtatttatttatggacaaaagcaagatattaaaacaaaagatgcttgtaagaaaattgaagaaagtttaaaagccttagcaaatcacagatttcataaagcaaaacttgttaaaaaaccttatgatgaagctgagataagaaatatattatcttatgtttatgacacagaaaaaaatggagtgttatttgatataaagaaagatgttgaaagtaatataaattctgaagctataaaagaagtattagaaagaataacattacttgaaaaaagaggagatactccaataacattaaaaaatataagtgaatattatttgagaagtccttatggctggggacaacttacaatcaatggtttagttggagaattgtggaaatataaattgatagatttacaggaatcaaaagtccttgttacagatgagaatattgcaacaaatttgcttacaaaattacaaaataaaaatcttgaaaaaattgtaatttcattaagagaagaaatagatcctgagcttattagaaaagttaataatttattaaaagaaattaagacaattaaagaagatacaggtgaagttactcttgattctccaaaagaagatttattagagatattaaaaagaaaaattggaatagcaaagagctataaaatagaatgtgaacatagtaaatatccagggaaaaaagaattaaatgattggatagaccttttagatgaaattattttatctaaggataatgctgaaaaaactcttaaaaatttcttaggaatggaagatgaactatcaaaagaatatgataaagttgatagagtttttgatttctttacaagctctaaaaaagaaagatatgacaaagctgttgaaaaaataaataaaattgaagagtataaagattatattggcagtttaaaagaaactgatgcctataaaacaattgaagaaattaggcttgataaaaatatttatgaaagaattagagagtttgatgatttaatttctgaattagataaagccaaagataaacttatagaaattgaaaaaacttccttaaaagaaaaagttgaaaagtataaaaaagaattttctgaaaaattaaaagataatccagaaataataaaaaaattagaagaaaaattaaatgaatttttagaaaaagaagttaataataaagataattctaatgatatggcaatatttatgaaatctaaaaaattagaaaatattgttaataatttcgaagaagaatataaaaattctgctaaaaaagaaattgagaaattagaaaattatcttaatgaagttgctgaagataaaactgatattgatgagcttagaaaaagtataaaatctacatacaataattataaagatgaaatagccaaaagtgatattaaaaatgtcagtataactattgcaaaagcaattaaggataaagaagattttaatgctgaaatcaatggaaaagctaagaaaaaagaaagaataaaattaagaaaaatttctataaactcaaaaagtaatatagaaagtgaagaacaagtgaaagaatatatttcagctattgagaaagatattgaaaagttaaaaaatgaaatgcttgaagctattaaaaataataagattgttgatattggataa

SEQ ID NO: 315 - DNA, 2382 bp, Acinetobacter lwoffii
atgctggatgcgttccagatggccgcgaatgcgattgctacaaatgaagtcggtgccctggttcctttccaccgcttctatacttcagtggaaggatttctggatacagcagtgaagcgtaccatcgaccaggcagagcagaataagaccctggatggttttgatgtgcagatgctgcgtaccctgttcatgatccgctatgtcgatatcatcaaaggtacgctggataacctggtgactttgtcgattgagaaaattgatgaagataagctggcattgcgcaagcggattgaagagagcctgcagcgtctggaaaaagagagcctgattacgaggaatggcgatgagttcctgttcctgaccaatgaagagcgggacattacccgcaaaattaaagccactgacttagcagcttcagaagaaaataaagagttagccaatctgatctttaaagatttactgcgcgatcagaacaaataccgccatcaagccaacaagatggactatcagattggtcatttcctagatagccatagcctggatggcaagtatgagagcgatttaaaagttgaaatcatttctccgctggatacggaatacaacctctacagtgaagcttactgtattggtaaaagtactcaggccgaaggacaagtgctgtttaaactggcagacgataaacagttctttaatgaactgcgcacctggctgaaaaccaataaattcattcgcttaaatgatgatggcactcagtccgatatttcccgtattctggcagaccgtggccgtgagaaccaagaacgtaaaaaacgcctgcgtgtccgggtcgaagaaatgttgctggacgcggaaagttatgccttgggtcagcatctacaactatcatcttcaagtccaaccaccaagctggatgaggcttgtcgttatttgctggaaaacacttataccaaactgagctatctgcaggtctatcagcaggatgcttggcgtgaactgaacgccgtcttgactgtggatgatatggcgcagctaggattgtctctggatggcgggcagagcaatccgaaagccctacaggaagtggagcagtacattgcactacgcgccactggtacagagcgtattctggtgtcagatgtggtggatcgttttgtcaaacgtccttatggctggccagatgccgagattttactgttggtgggtcagctggctgcgatggggcggatttcactgcagttaaatggcggcagcttacagttaaaagatgcctttgagcctttacaaaacagccgccgtcgccgtgatgtgtcgatcattaaaaaacgccagactgatgatcaggtgttgaaacaggcacgccaactcacccaagacctattctcggccatgggaccagcgacagaaaaagagctgtttgagttctatacccaaaactttaagacctggttagccaactttaagtcgtataagagcaaaaccgatgtcgggcaattccctggcaagaaagtcattgagcggtcgattctgactttagaacgcttgctggccaatagcgacagcttcgatttctttaaagcggtggttgataacaaggacgactatctggatctggaagaagactaccgtgatattcatgagttcttcagcaatcagatgccaagctggcagcaactgcagcaggctctacgtcattttgagaaaaataaacaggcattgggcagtgatgaggtggcaaagaaagccctctctgaattacatcgtatatccacccttgaatcgccctacggcctgttaaataaaatcgctgatttggttcgcaccgtggaaagtgtcaatcaacgcttactaactgaaaaacgcagtcaggcgctagagcagctggatgacaagatcaaacagctggaagctgaaatcaagaacagcggcattgctacagctgagctgagtaacaagctactgcgtccgctgcaattgctcaaagcggatattgaagtggaaagcagcctgtccaccatttacatgctgcaaacccaaaccgccgtcgagcgttttgatgaagccttgtatgagctggaacgagaagttgaggcggaaatccagcgtcaggccaaagcggcacaactggctcagagcaaagcagagagcgtaaccagcacagcaaccaccgccagcccagtagcagctgctgtgagtccggtaaagcccgtgatcgccgtagtgccgccgaaaccggtggtggaagtcgatgtcgccagcatttacaacaaaacctctagcagtgtctatctggaaacggaagagtctgtggatcagtttgtagacgcactcaaagttgaactgaagaaaatcgtgggtgacaaaaagcgtgtgcgtattcgctaa

SEQ ID NO: 316 - DNA, 3648 bp, Lactobacillus casei
atggaaattaaagagctttttaaacgaccaattgatcgtaacatccaaggtgttatcaaggttgatcaagatgatgaagcaaatgtaaagcaagagttggacgaatatgtcgtaaccagtgaactaagagatcatttttcggcctttttcaatgcatttgataatagtcttcagacgccaacggatgacatgggtgtctggatttctggtttctttggttctgggaaatctcacttcttgaagattatttcatatattcttgccaacaaggttgttgatggtaaaaatgccgtcgattacttcgatgacaagattgatgaccaaatgattctcaacgagatgcacgcggcagcttctgcaaagaatgatgtcattttatttaacattgatgcaaaagccaaagataccgttggttcagataaacaaagcatcttgaaagtgtttatgcgtgttttcaatgaaatgcaaggatttactgatgccgatttttggattgctgaccttgaacgccagctgacagaagctggtaagttagatgcttttaaggaacaaattaccgcgattgatgctaatcataaatcttgggaagacttgcgagatgcctattaccttaacaagggcaccattaaagcagcaatgattaattctggtttctcagacgaagcaaatgcgcaaggctttattgatacattgagcacagaatatcaaatcagcattgatgattttgctgagttagttaagcagtacattgataaaaccggccatcgtgtcgtctttctggctgatgaggttggtcagttcattggcgatagcgttcaacgcatgcttaatctgcaaacaattgttgagcagttagggacaatgacacgtggcaaggcatgggttgttgtcacatcccaacaagcaattgacaaagtaacggacattgcctcaggacaggatttctccaagattcaaggccgtttcaagacacgcctgtcgatgagttcggctaatgttgatgaagttattcgcaaacgtttactagaaaaaacagacgtggcggaaaaaatgcttgaagatcaatattcggcgaacgctgctgctattaacaactcatttgatttcgatgatgatgttaaacgtccaaagtatgaatcgccgaaagatttcgcccaaaactatccatttgttccctatcaatttaatctcttacagttggtgttaacggcgattcgcgaaaacggatcggatggcaagcacttgtctgaaggagaacgctccatgctttcgcttttccaagagtctgcggaggctatgatgagtgagagcactgagactttagcaccatttagccgattctttgacgggttggaccagtttttggatcacacacatcatattgtgttagttcgcgcacacgataatcctgctgttaatccgaataaggaaaagaatccatttgctctgcaactactcaaagtattattcatggttaaatacgtttctaacttcacagcatcattaaataatttaattactctgatgattagttcagtcgatgctgatcgcattgcgcttaaaaagcaggttcaggatgcgttagatgttttagtaacgcaaggctacgttgagaaaactgttaaagggtatgactttttaacagacgcagaacaagatattacccgtgaaatttcaaagcaggaagtaacggataatgaagttgctaaagagattggcgactatttatttaatgctaagccgggtgttgccacaaccttgacttacccgaagcttaatggtcgctatgtctttgcctttaatcggaaaactgacaatatcttcggtgcgcaacgtaataagttgtcagtgcacatcatcacaccagtcaacgacgactttcttgaagataacgattatctacgagtatcgactggtttatggaatcacgatgtcttgatagccttgccgcggtcatcaaactttgtcggtgaaattcgaaacgctttgcgcattcgaaaattcgttgtcaacagcaatgtttccactgatccacgctatcaagcgatggtttcaacacgacaagctcagcaaaatgaggagtttgctcatgcccatgaacagctgattgctgcattggataacgcagaaatttatgaaaatggccaatctgttagtagtgaagcaggctttgatagtcgattagagaaggcaatgaagctgctggtcgacaatacctatcgaagtttgcaatatatcacggttgcaaagtctgaaaaggatattcgagaactttttgaaaatatctcgagtttggcgcttgatgaaaaagacaatcaagcagccgtagatgctgttctggactacatgcgtcgtgagtctcaaaacaatgcgcatatcacgatggaaagtgtcctgtcgaagtttaacgatataccatacggttatactgacgaggacattcaatggcttgttgcgaagttagtcgctattggcaagttaaagatgttttacaatggaagttctattaacccgatggacgataaacatacgacgcaagacctagctggtttctttactaaaaagcaggcgatgaggaacctagctttccaaattaaagaagaagttgccccatcaaagattaaagctatgcaaacggtcgcgtctgcagtgtttggcaagaagtcgtttaagtccgataacgatgaacagcgggcttctgaacttaaggatactgtcgaagacaatttagaaaatttggtagattttgaggcaaaaccgcaggggtatccgggtcacgttgtgttacagcaaggcattcaaatgttgcaacaacttttgaatatgcccgattctggtgcgttttatgattacatcggcaaacataaagatgatttgttggattggaacgacgattttcttgacgatggtattcgtgatttctactttagtgtttcaatgcaaaaaatttgggataagggattaaatgcattgagggtttatcgcgactcaagtgattttctgagtgatagcaaattgcaaaatatcgttgaagagatgggtaaacttctccgattgcagaaacttcagggagacacggcagtcaaaatcagcgaattaaacaatgactttgatactttatttactgcggcttttgataagaaggcagctgaatatttagcacaaatcgacgaactcaaggatcgtggcattaaacgaattttggagtcgggtatttctaatgaagaaacgaaagaccggttaaagcgtgattttgaaaataagatcaaaatcattcgtaatgctgctcagaacgcagtaactttaaacgaagtcgttgcaaagcctgcgcaggcacatgctcagttggatcaactaagtgatggcatccagaaagaaatcgaacgagaagttaaactcgttgagccagtttctccagatgaccatgataagactaatccaccgataccagatccgggtccagatccagagccagagccaataccaagggcaaaggaagagaagtttattaagcttgatcaggttcttcgtcgtggtgattacaagttggaggattccgcggatgtggctgagctgactgccgagtttaaaagattgctagaagcacaactgtcagacaatacaatcgtgacattgcaggtcgactga

SEQ ID NO: 317 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgatatggcacaagcattaagccaggccacgcagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattaccgaaaaccttggggtaatctgcggtggccgcgcatgggttatcgtgacttcgcaggccgatatcaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggctatgggtgagcgttctcagctggaggcattccagactgcggcgcagcaaatctcagcgcaagggctggattctctggtgcctttctggcgcttctatgccgccattgagagcttcctggaacctgccgttagccgcaccatcactcaggcttgccaaaatggcattcttgatgagttcgatggcaacctgcttaaaacgctgttcctgatccgctatgtggaaacgctgaaaagcaccctggataacctggtcacattatctatcgataggatcgatgccgataaagttgagttgcgccgccgggtcgaaaaaagtctgaacacgcttgaacgcctgatgctcattgcgcgcgttgaagataaatatgtgttcctgaccaacgaagagaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggcgcagtgcttaacgatctggtggtgaagatcctgacccctaaagatccgacctatacgttctataacagtgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgaacgcttaccgaaaaaatcctccacgccatcgaacattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaaccccgacgccatgcgcgaggtagaaacctggatcagcatgaatatcgaatacaataaacctgtgtatttacgcgatattctgaaccattttgcgcgtcgcccttatggctggcccgaagacgaagtgaaactgctagtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcatcgccagcacgccctcgaacgcattgacgcccgcattgaggaaagccgtcaacgcttgctggaagcgcacgccacgtcggagctgcaaaacagcgttctgctgccgatgcaaaaagccagaaaacgcgctgaagtcagccagtcgattccggaaattttggcggaacagcaagagacaaaagcgctgcaaatggatgcagataaaaagattaacctgtggatcgacgagctgcgtaaaaagcaagaagcacaactccgggcagcaaatgaagctaaacgcgctgccgactcagaacagacttatgttgtggtggaaaaaaccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgtcattaaagcaggcgatcgcattcgccttcagtaa

SEQ ID NO: 318 - DNA, 3681 bp, Acinetobacter sp.
atgaatattaaagagcttttttacaagccattagatcgtgcaattaacggggtcgtaaaagcagaccagaatgacaataccacggtttatcaggaactcgatgagtatgtggtcaccaatgaactggaaaagcattttcgggactttttccagtcttatggcacagacctgagcgatccttcgattgctaaccgtgtcggcgtatggatttcaggcttctttggttcaggtaaatcacatttcctgaaaaccttgtcgtatattctggccaataaagtggcacgcgatgcgcaaggtaacgaacgcagtgctgcagaattctttgatgaaagcaaaattcgtgatgcgtttatccgtgcggatattggcaaggccgtcagccatcatgccgatgtcatcctgtttaacatcgacagtaaagccagctccaatgatgatggcaatccgatcctgaatgtgtttttacgcgtgtttaacgagtatcagggttttagtgctgaccatccacatattgcccatatggaacgtcacctgagccagaaaggtgtctacgaacgctttaaacaggcgtttgaggaatccagcggtatgtcctggctagaggagcgtgacggctatcagttctatcaggatgatgtcgaaaccgcgatttcccaagccctcaacttatctgctgaagctgcgcataaatggtttgaggattctgagcagacctttagtgtttcggtcgaaaacttctgtcagtgggtgaaagaatacttagatagcaaaggaccacagcaacggatattgttcctggtggatgaagtggggcagtttattggcagcgatacccgcttgatgctgactttacagaccattactgaaaaccttggtacgatctgtaaaggccgtgcttggattgtcgtcacctcacaggcggacatcgacgcggttctaggtgagatgtcttcttccaaagccaatgatttctccaagattgctgggcgttttaaaacccgtttatcactgtccagttccaataccgatgaagtcatccagaaacgtttattacgtaaaaccccggaagcagaagcattgctcagatcggtgtttgagcaaaagggcgatattttaaaaaaccagattacctttgaccgttcaggcccaacactcaacaactatgagggtccagacagctttatccataactatccttttgcgccgtaccatttccagttggtgcaaaaagtatttgaagaaatccgtaaagtcggtgcgaccggtgcacacttggcctatggtgaacggtccatgctggatgcgttccagatggccgcgaatgcgattgctacagatgaagtcggtgcactggttcctttccaccgcttctatacctcagtggaaggatttctggatactgcagtgaagcgcaccatcgaccaggcagggcagaatcaaaccctagatagttttgacgtacagatgctgcgcacgctgtttatgatccgctatgtcgatatcatcaaagggaccttggataacctggtgactttgtcgattgagaaaattgacgaagacaagctggcattacgcaagcgtattgaagaaagcctgctgcgtctggaaaaagagagcctgattacccgcaatggtgatgagttcctgttcctcaccaatgaagagcgcgatatcacccgcaaaattaaagccactgatctggctgcttcagaagaaaataaagagttagccaatctgatctttaaagatttactgcgcgatcagaacaaataccgccatcaagccaacaagatggactatcagattggtcgtttcctagatagccatagcctggatgggaagtatgagagcgatttgaaagttgaaattatttctccgcttgatacggaatacaacctctacactgaagcttactgtattggtaaaagtactcaggacgaaggacaagtgctgtttaaactggcagacgataaacagttctttaatgaactgcgcacctggctgaaaaccaataaattcatccgcttaaatgatgatggcacccaatcggatatcagccgtatcctggcagaccgtggccgtgagaatcaggagcgtaaaaaacgcctgcgtgcccgggttgaagaaatgctgctagatgcggaaagttatgccttgggtcaacatctacaactttcatcttctagcccttccaccaagctggatgaggcgtgtcgttatctgcttgaaaatacctataccaaactgagctatttgcaagtctatcagcaggatgcctggcgtgaactgaacgccgtcttgactgtcgatgatatggcgcagctcggattgtctctggatggtggtcaaacgaatccgaaagccctacaagaagtggaacagtacatctcgctgcgggcaacaggtacagaacgtattctggtatcggatgtggtggatcgttttgctaaacgcccttatggctggccagatgccgagattttattgctggtaggtcagctggcggcaatggggcggatttcactgcagttaaatggtggcagcttgcagttaaaagatgcctttgagcctttacaaaacagccgccgtcgacgcgatgtgtcgatcattaaaaagcgccagactgatgatcaggtgttgaaacaggcacgccaactgacccaagatctattctcggctatgggaccagcgacagagaaagagctatttgaattctatacccaacattttaaaaactggttagccaactttaagtcgtacaaaagcaaaacagatgtcggacagttcccaggcaagaaagtgattgaaaagttgattctgactttggaacgtctgctggcgaatagcgacagcttcgatttctttaaggccgtggttgatcacaaggacgactatttggatctggaagaagattatcgtgacattcatgaattctttagtaatcagatgccaagctggcaacaactgcaacaggccttacgtcattttgagaaaaacaaacaggcgctgggcagtgatgagctcgctaaaaaagccctctccgaattacatcatatttcaacccttgaatcgccctacggcctgttaaataaaatcgctgatttagttcgcacagttgaaagcgtcaatgagcgactgttgagtgagaagcgtagccatgcggtagagcaaattgatgacaagatcaaacagttagaagccgagattaaaaacagtggcatcgctaccgctgagctgagtaacaagctattacgcccactacaactgctgaaaacggatattgaagtggaaactagcctgtccaccatctatatgctgcaaacccaaaccgccgtggagcgttttgatgaagccttatatgagctggagagcgaagttcaggcggaaatccagcgtcaggccaaagcggcacaactggctcagagcaaagccgagagtgtaaccaacactgcaaccacctccagcccagttacatcaacacctgctgcgagtccggtacagcctgtgacagccgtagtgccaccgaaaccggtagtcgaagttgatgttgctagcatttacagcaaaagctccagcagtgtctatctggaaacagaagagtcagtggatcagtttgtagacgcactcaaagctgaactgaaaaaaatcgtgagtgataaaaagcgtgtgcgtatccgctaa

SEQ ID NO: 319 - DNA, 3456 bp, Vibrio cholerae; identical to SEQ ID NO: 239

SEQ ID NO: 320 - DNA, 3543 bp, Holdemania filiformis
atgaaaattcaaaatatgttcgttgatgacatcaaccgaaaaatcaacggcgtcatcaaggttgaccaagatgcagacgacgttctggttcaggagctgaacgagtatgtcatcaccaaggaactgaaaaaacacttcatcacattttttaattattacagcgattcctttcaggagccgactgcggataccggagtatggatttccggtttctttggaagtggtaaatctcacttcctgaaaatgctgtcctacattttagaaaaccgttctgtcgaaggggtacctacggtggagcgtttccgtaagaaatttgaggatgaccctgccacctttatgttgattgataattctactaagtgtgagacagagaccatccttttcaatatagatattgagggttccatcaataaggacaagaccgccgtgctgcgtgtctttgctaagatgttttataaccatctgggcttttatggtgaaaacctgaaggttgccaagctggagcagtttatcgccaagcgtggcaagactggggagttccgccgtgtattcgaggagaagaatggtggcagctgggtttccacccgcgatacctttgccttctttgaggatgatgtggtggaaacgttgatggaagtcctcggcatgagtgagaccgctgcacataactggtttgatggtaccgagaccaccgaaatgagcattgcacagctggtttcggaaatcaaagactatgtaaataccaagcctgccaacttccgtatgctgttcatggtggacgaggttggacagtatgttggcgcagataccgacctgcttttgaacctgcagtccctgattgaaaaaatcggcagcgagtgcggcgagaaggtctgggttgtttgcaccgggcaggaagccatcgacgaaattatcaagacccgtcaggatgagttctcccgtattcaggcacgtttcaagacccgtctgtctctgtcctcttcggcagtagatgaggttatccagaaacgtattctgaataaaaagccggaagctacccagatgctggaacaagtatatgacaagaatgattctgtacttcgtaacctgtttagcttcaccgattccgtgctggatatcaagggctacagcggtgccatggagtttgcagtgaatttcccgtttgtaccgtaccagttcatcatcatgcagaaggtgttctccgaggtgagaaagcatggcaatgccggaaagcacttctccggtgcggagcgttccatgctgtccggtttccaagaggcagcacagaagattcaggacagggacgagtatgcgctggttccgctgttccgtttttatgacactgtacatggattcttggatggctctatccgccgggttatcgagcgttgcgctaaggcagcagaggacggtaacggcatcgaggcttacgacgtggatgtgctgaagctcctttatctggtgcgctacatagacgacatcaaagccagcattgataacatcgtcattctgatggcagacgatatccgggtggacaaaatcaccctgcgtgaaaaagtaaaagcctctctcgaccgtctggacagccagaactatatcggacggactggcgatacctataacttcctcaccgatgaggagcaggacatcgcccgtgagattaaaaataccaatgtggataccgcttccatcgtggagcgcattgcccacatgatttacggtgatatttataccacgaagaaatatcgctatgggaaatacgacttctcctttgaccagatggtggactccacaacggtcggagcagtcactggcggtatgcgcttgcgcttcctgaccatcgcagcagattctaacgagcgtcaggaactgcgactgatgacggattccaacgactgtgccatcgttgttctggcagaaacgtcttattatgaactgctggaaaacgccatgaaaatccgcaagtatgtgaaacagcgcaatgtggcgcagctggcaaaatccgtgcaggacatcattcgtgaccagcaggacgaagctggcaaatatgagctgcttgccaaggaaaagctggaggaagccattgtcagtgcgaccttctatgtggatggtgagcgcattgaaatcaagagtggctccgctgtatcgaaaatcgagcaggcgctggaatatctggtgacccatgtatacagtgacttgaacctgataaccaagaatgcagaatccgatgcagacatcgctgctatcctgaccggagctgtgcagcagattcccggcacggaagataaccgggacgctgcagccaagatggaagaatatctggaaatgcagcacatgaaacgcctgcctacctcgatggcagatgtccagagcaagtatcagggcatcccctatggctggaaggaaatcgacattgcagcggtggcagcattacttatttaccagcagaaggtcaccatcaagtatggcggcgtcaccatccagccggataatagcagactgccggatatgctgcgtaagaagagtgaaatcggcaaggttagcatttccaagcggcaaatcgtgtctgtttccaatatgaaggcagtcaagagcatcctgcgtgagtattttgatgtgatggatgtgccggatgacgaggacggactggttgcctttatcgtgaagaaattcaccgaacagaaggagcattacgaaaagctgctggcacgttatacagggcacaagtatcctgaccacaataaggtgtccgaagctatcagtctgatgcaggatgtcctctcccagcaaaaggataatatctctctgatacagcgtgtgttggatgatgaaaataaactgtttgacagcaaagatgacttgcagggtgtggaggggttctttgccacacaggtgaccgtgttcgatgcggcggtcaagatggaagaagacctgcgcaatgacctgtcctacctgcagcgtgaggaggaagcaaacaaggctctggggcagattcgtttgattacgatgacgcagaccgacagccgcaccgtgtataagtgcatcccagaactgaatggtctgatggcaacggtgaaagctggacatgatacactgctggctgccaagcgtgaggagctgttggaaattgtgcgccagtgtatggaagaaattcataccaccgcaggcggcgatgtcaactgcaagatgattatccaaaaatcggataccttcttcacccagtgcaagcagcgtattgccgagcttcagagcttggctctgctggatggtatggtgccgcagatgtggtcgtacaaggatgacagcgtggataggctggaaaccatgaagcagccgtcgaagcctgttgacccgaagccacacatcaatcctgccactccgccgaagcctgcaccgaagaagcacatcaaaaccgtgtatcgtcaggctgccttcccgtccaaggtgctggaaagccaagcggatgtggatgcctatgtggaacggatgagagcgtacttgaatgctatgttgaaggactgcgacggcatcaagctcaactaa

SEQ ID NO: 321 - DNA, 3672 bp, Enterococcus faecium
atgctaattaaagatatttttgcaaaaccaattgaccgaaatattcaaggagttattaaggtcggtcaagcaaaggatgaaaatgttcaacaagaattagaagaatacgtggttacgaaagaactacaaaaacactttaaaacaatttttgatgcctaccaacggagtatcaatacaccaacagataaaatgggtgtttggattcaggggttctttggttcaggtaaatctcatttcttaaaaattatttcttacttactcgcaaatcgagaaataaatgacaagaaagccattgattacttcaaagaagatgggaaaatcaaagatccactgactttggcaacgatggaacggtgctcacaaataaatacagatgttattctgtttaatattgattcaaaaagtgatgcaggtggtaaaaaagacaaaaacggaatcgtgaatgtttttttaaaggtatttaacgaaatgcaaggattaagcacgattccacatctagcagattttgaacgtcggttaattaaagaagaaaagtttgatgcattcaaagctgcttttgaagagattaatggggcaaaatggcaagaagagcgccatgagtttgattggatccaagatgatatcaaagaagcggcacttaaaatcgattttatgagtgaagccgctattgataattttttagaaaaagcatcaggaaattatttaataagcattgatgactttgcaaatctagttaaaagctatcttgattccaaagaagcagaccatcatattgcctttctagtcgatgaggttggacaatatatcggcggtaatcgtgagttgactttgcagttacaaaccgttgtggaagatttgggtcgaatttgtgaaggtaaggcttgggtattagtgacaagtcaggaagcgattgatcacgtaacaaactttgataacaattctgataatgatttttctaaaatcaaggatcgttttgccacaactgtgagtttatcttcagcaaatgccgatgaagtaattaaagaacgtattttgaagaaaaaagagtttgccaatgattctttagccttacaatttgaaactgttcaaacagaattgaaaaataaattactctttgttgatagtcctgaattaaagctcttccaagatgctgaaaattacgcagaagtttatccatttattccctatcaattcaatttattggggcaaattctaaccgagattcgtaatcacagctatcaaggatcaaacttatcgtctggtgaacgttcattactagcaatgtttaaagaagccgctgaacgaaataaggaaaatgatacaaccagtttggtttctttagatcagttttattactcgttagaacgttggattgatacagcaattagccgagtgattacacaagctacaaataattctcacattcaaagaccaactgatatagatgactttaacgtaaatgtcttacgaattttattcatgattaaatatgttgatcaagccatcaaaccaaatgttgaaaatattacgagcttgatgataagaaatatcaacgaagaccgcctggaaactaaaaaacgagtagaagaagcattggaccttttaattaaggaaaactttgtgcggaagaacttagatagttatatttttcaaactgatgaagaacaggaaattactcgtgagattaaaaatcaaaatattacagatagtgatttgatcgtagaactatctaaacgaatttttgacggcgttctagaccgaaatagttttgcctatgaaaaattaggcatgtcaggtggtaataaatttaaaaaccggtatacatttacttatgcacaagtgttagatcaacgtccatacaagcaagctggaaatgctgaaatgacagttaattttatttcaccatactctgatttagcaggtcaagaggcagaacttgcgcttaagagttcccgtaacttattattcgtagaattgccatcagataaagaatttaaagatgatatagcaatgtatgctagaatgaatctttatttaacaacgacttattcgagtgtagtaaagaactttgacgcgattcgttcggaaaaatctggtgaattacaggaactaagtgcaagtatcaacgatcaattaaatgaactgttgaaatctgcaaaatttttctataacggtgcagaaattcaactgacaggctccgactttaaagcaaaattccaatcagcacttcagaaaatggctgaagaagtataccataaattaaaccaaattgatgcgcctaaagaaaaagaagatatcttatatttagtgaaagaaagcaaaaatgaaattattgaagatccatcaaatgagcaagcagttcaggaaattttcaattttatcaatgatcaaaagagaaatcacctaacgattacgatgaaaacaattcgtgatcgttttgaaacaaaacaaccgtatggattcacagaacttgatgtggaatggtgcatcgctaaacttttcatgtctggtaaaattgatttactttataacaatgtacaaatttcacggatggatgatccaaatagtattgtaatgattattcaaaaacgacgagaaagtgaaaagataaaaattgaaccaagcgcggtgatttcgccaaaagcaaaaaaattggttgacgaaatcggtagagaactgtttcaaagtcgtaatattgttgatgaaaataacaatgaacatacaatggaaaatttcaagaaacatttaaaaggtcaattagacaatttacgctcttattttgatttacaaaacacttatacctaccctagtgcttatgaatatgagcaaataaaaaaatatcttgaagtaattgttcaaacgtcagatgttgaagactttttttatacaatcaaaaaatatcgcgatgaattattcgactgggctgaaacatatgataaaattaaaaatttccacaagcaaaatagtactcagaaaaaaatctgggagaatgcacaagataaaattagattaatcgaaaaaagtcggtgtcaaacttctagccaagaaattgatcaattgattcatgagatgaaaaccattttgaaaaaggctgatccttattcagatatgatgaaactaaatgagttgattcaagaatttatcgaacaatataaccaactgttagagttggaaagtcaggaaatattaaataagctaacggaagaaaaacaagcaacatttaaattattagaaggaaaagattttaaagatcaatttgtaccaatagttgaccaagaatttcaagaactgaaagcaaaaattgaacaagcgaatactatagatgatcttgttttcttatcattaaacgtagcagaacagtattcgatctttaatcaacgtttcgataaagaagaaaatcgcagacgtcaagaagaacaagcacgtaaacaaattgaagcagcaaacttgattcgtgaaactgaaaaagatgaaatagactctgcagcagaagctgaagaaatagcgatagtaaaacctactattcgacagaaaacagtaccaatgagaacacttaacgttcatgttaaaactattaagtcagcagcagatattgatgagttaacagctgaaattaatcaaaaactgaaggaacaacttcaagaaaatacagaaatcacgattcaattctag

SEQ ID NO: 322 - DNA, 3753 bp, Fusobacterium sp.
atgtctgatttagctataaaaaatattttgcaaaaagatattgaaagaaaaataaatggggttgtaaaggcagatagtaatgaaaaagacactgtaattacagaattaaatgaatatgttgttacagaagaaattagagaaagattaacaaaattttttgataaatatgttgattcaattaattttccaactgaggatatgggagtatggatttctggtttctttggttcagggaaatcacattttttaaaaatgataggacatattttagaaaacaatgcctatgatggaaaaaaagtcgtagatttttttaaagataaaatagatgatgcaattttaatgggaaatattgaaaaagctgctgaaattccaactgatataattttgttcaatatagataatgtaagtgatcaagatacatatcaaaataaagatagcatagcggttgcttttttgaaaaaatttaatgaatatttaggttttacaagagatgatatagaaatagcagaatttgaaagaaaactttgggaagatggaaaactagaagaatttaaaaaagtttttgaagaagaatctggaaaaacttggaaagatgcaaatagaaatttagattttcattcagatgattttcttgatgttatagaaaaattaggaattatgagtagagaaagtgctgaaagatggcttgaaagagatatagttaggtctataagtgctgaaagttttagagatatacttgaaaattatttaaaaatgaaaggatctaaacataggataatttttttagtggatgaaataggtcaatatattggtgataattcaaaacttatgttaaacttacaaaccttagttgaaactttgggagttaaatttaaaggtagagtttgggttggggtaacatcacaacaagatttaagttctatactaaataatagtgaacatagaaaaaatgatttttctaaaattcaagatagatttaaaacaatgcttgctttatcaagtggaaatattgatgaagttattaagaaaagactgcttattaagaaaaagattgagggagaagatttagaaaaaatttttgataaaaagagagttgaaattgaaaatttaatacattttgaaaaaacaatgactttacccctatatgatgataataaagattttgcagaaacatatccttttgttgcttatcaatttaatctactacaaaaagtatttgaaaaagttagaaatatgggacattctgggcaacatatgtcaagaggagaaagatctttgttaagttcattccaagaagcaggaataaaagtaaaagataaaaatataggaatacttgtaccatttaattgtttctatgaatcaatagaacaatttttagaagacaatgtaagaagaccgtttattcatgcaagaaatgaaaaaagaatagatgattttggtttagaagtattaaaacttttattcttattaaaaggaattaatgggatagaacctactttaaataatttaacaagttttatgatagattctatggattgtgataggatagaacttgaaaagaaaataaaaaaagcattagaaaaattagaaaaagaagtcttaattcaaaaagatggagaaaattattatttcttaacaaatgaagaacaagatataaatagagaaattgaaagggaagatattgatttaaaaaaaattgatgaaaaaatagattcctacatttttaaggaaatatttacaaagaatagtattctaatggaagaaacaggaaataaatataattttactagaactattgatgaaacagtttatggtaaaataggagaagatttagcaataactatttttactgaaagagcagatgattatgataatgttgctattgtagggacaagaccagaaagtgatttaatattaagattagcaaaagatgatgaaacttatagaaatgaaattaaactatttttaaaggtagaatcatatattagaaataaacaaaaagataatgaaagagaatctattatcagaatattggaaataaaacaaagagaaaataaaataagagatagaagaattaaaagtgaattagaaaggcttataggggaagcagaagtgtttgtttatggacaaaagcaagatattaaaacaaaagatgcttctaaaaaaattgaagaaagtttaaaagccttagcaaatcatagatttcataaagcaaaacttgttaaaaaaccttatgatgaagctgagataagaaatatattatcttatgtttatgacacagaaaaaaacggagtattgtttgatattaaaaaagatgttgaaagtaatataaattctgaagctataaaagaagtattagaaagaataacattacttgaaaaaagaggagatactccaataacattaaaaaacataagtgaatattatttgagaagtccttatggttggggacaacttacaatcaatggtttagttggagaattgtggaaatataagctaatagatttacaggaatcaaaagtccttgttacagatgaaaatactgcaacaaatttacttacaaaattacaaaataaaaatcttgagaaaattgtaatttcattaagagaagaaatagatcctgaacttataaaaaaagttaataatttattaaaagaaattaaaacaattaaagaagatacaggtgaagttactcttgattctccaaaagaagatttgatagagatattaaaaagaaaaatgggaatagcaaagagttataaaatagaatgtgaacatagtagttatccagggaaaagagaattgactgattggatagaccttttagatgaaattattttatctaaggataatgctgaaaagattcttaaaaatttcttagaaatggaagatgagctatcaaaagaatatgataaggttgatagggtttttgatttctttacaagttccaaaaaagatagatatgacaaagctattgaaaaaataaataaaattgaagagtataaagattatattggtagtttaaaagaaactgatgcctataaaacaattgaagatattaggcttgataaaaatatttatgaaagaattagagagttcgatgatttaatttctgaattagataaagccaaagatggacttatagaaattgaaaaaacttccttaaaagaaaaagttgaaaagtataaaaaagagttttctgaaaaattaaaagataatccagaaataattaaaaaattagaagaaaaattaaatgaatttttagaaaaagaagttaataataaagataattctaatgatatggcaatatttatgaaatctaaaaaattagaaaatattgttaataattttgaagaagaatataaaaattctgctaaaaaagaaattgagaaattagaaaattatcttaatgaagttgcagaagataaaactgatattgatgagcttagaaaaagtataaaatctacatacaataactataaagatgaaatagccaaaagtgatattaaaaatgtcagtgtaactattgcaaaagcaattaaggataaagaagattttaatgctgaaatcaatggaaaagctaagaaaaaagaaagagtgaaattaagaaaaatttctataaactcaaaaagtaatatagaaagtgaagaagaagtaaaagaatatatttcagctattgagaaagatattgaaaagttgaaaaatgaaatgcttgaagctattaaaaataataagattgttgatattggataa

SEQ ID NO: 323 - DNA, 3648 bp, Clostridium butyricum
atggatattaaattaaaatcaatgttttataagcctattaatagagatattaaaggtgttattaaggttggtcaagcagatgatgagaatataaagcaagagttagaagagtatgttgtaactggagagttaaacaaacatatagataggttctttgaggcttacaaggcaggaatagtaggacatactgataaaaatgcagtatggatatcaggattctttggtagtggtaaatctcacttcttaaagattctttcctatcttttagaaaatagaagtattgaaggacaaaatgctattaattactttgatgataagggattagatagttttattctagcaaatatgaaacaagcaggggatatatctagtgatgttatcctatttaatatagattctaaatcagattcagataacaagagtaataaggatgcaatagttaatgtatttaataaagtatttaatgaaatgcaagggttctgtggttctatgccttggcttgctgatttagaaagacaaatggttaaggatggagtttatgaaaacttcaaaactgtgtttgaagagatttctggaaactcgtggatagaggcaagagaagatttttattatgaagaagattcaataatagaagcattatctaaaacaacaaaaatgagtgaagatgcagcaagaagttggtatgagaagtgccaagataactactcactaagtatagaaaagtttgcaaaaagagttaaggaatactgtgattctaaaggtaaaaatcatcatgttgtattcttagtagatgaaattggacagtatattggcgacagtagagatctaatgcttaacttacaaacagttgtagaagacttaggaactgcttgtggtggtaaatgttttgttatagtaacatctcaagaagggttagatgaatttgcagttgtaaagggaagtgacttttctaaaattcaaggtagatttgatacaagattatctttatcatctgctaatgttgatgaagttattaagaaacgtatacttagaaaaacagaaggtgcaacaagccacttaaaagcattatatgagcaaaaggaatctattattaagaatcttttaacctttacatcagatactgctgaaatgaagttatataagaattcagaggattttgctgatgtgtatccatttataccatatcaatttaatttattacaagcagcatttaatggtgtaagagagcatggcgcatcaggtaagagtttatctaagggtgaaagatcacttttaggtgcttatcaacaagtcgcagtagattatatgaactgtgactcaagtatactagtaccattttcagccttctataaaacaatagaaacgttcttagattcatctatcagatctgttattattactgctgaaaaaaatgatagattagataaatttgatatagaagtattaaagttattattcctagtaaagtatgttaaagagattaatgcaaatataaacaacttagcaactttattagtagataatatagatgcatcacaaaagggattaaaggataaagttaatgagtcattaaagaaattaattagagaaactttagttcaaaaaaatggtgatgaatatatcttccttactaatgatgagcaggatgtaaataaagagattaaaaacatggctgttgataatggtgaggttatccaaaaggttggagaaataatatttgatgatatatatgtagagtctaaattcaattattcaaagaaatatatgtttactttcaataagatagttgatgatagaactagaggccctcaaaacaatgaaattggagttaaagttgtaactgctaactttgatttagttggaggaacatcacaaggagaacttaagcagttatccattagagaaaataacgtaatcgttaatattgctaaggatgttaattacttagaagaaatagaaaatgttttaaagatagatgcctatttaagattaaaaggtggcacaaaatctactactgctattgaagatataaagagtaaaaaaggtagagaaagagaagaaagaattaaaagagcgaaattcttaattgaagaatctctaagaacagcagaagtttatgtaaatggaagtttacttgatataaaagaaaagtctggtgtagatagagttaatgaaggattaagagccttaatagattcaaagtacaataaattaaactatgtaaaagagtttaaggataatactaaagacttattcgatattatggatacaagattaaatcaaatgtcattagtagacaatgatccaaatagacttgcagtagatgaaattaaaacacatatagaaactagtacatcaagaaatcttcaagttacagttaagagtgcattacagaagttttcaaatgctccatatggatggaaagagattgatatacaggctattatagttgttttatttaagaagcaagatattaaagtagtattaaataatgaggtgttagcaccaaacaatagagaagtagtaaactatgtaactaagagagactacgtagatagggtaatcttaaaaactagagaaaaggttgctacaaagtatatagaggcgttaaaggatttaaacaaagatttattcggattctcatcattacctgctgatgaagatggaatgataagtatgtttaaagaacatagtaagacagaacttcatagaattgaattaatgctaaacaactttagtgtagtaagtaaatatccaggggaagaaactcttaaagaaggtaaaaagttatttgtagaagtaattgaaagaaaggatactttagagttttttaaaatggtttatgatttagaagatgatttcttagattatgctgataatatagataatattaaaggattcttctttaaaaaggataatggagttattgatataaactctaagggtgaacaaagacaaatatttgataatgctatagagaagttaaaaaactatgatgacaataaagagtatattgttaatgatgaaataaaagaaattatagaggaaattggtgctattttaagaatgaaagaaccttacgggaagattcctacaattcctttacttatagaaaagtataataataagattttatcattattagaggaagaaagtattccagttttaggattcattcaaacctgtaaaaatgaagttatagagacattagaaggttatgagtttaaaaataaatttataaatagagttagtgaagattttggaaatctaattaagaggacagaatcagcaagtagttttgcagttctttcatcaatgtcagaccttgcagagaagttaaaggttagatttataaatgaaatagttgcagaagatgaaactttaaaaagaatcaaggcaaaagagatagaagaagcaaatagagttaaggaaacaccattaacaaaaggaacggatacaacatatgtagcagcaacagtaaaaccagagcctaaagttgttataaaaactaaaactataagtatgagagagttagttaaagggcaaaaggttattaaaaatgaagaagatattgatgctgtagttgaggcattaagaagaaagttaaaagaagagttagaaaaagatactataataagtttaatctag

SEQ ID NO: 324 - DNA, 3681 bp, Acinetobacter baumannii
atgaacattaaagaacttttttacaagccattagatcgtgcgataaacggggtggtcaaggcagaccagaatgacaatactacggtatatcaggaactcgatgaatacgtggtcaccaatgagctggaaaagcattttcgggactttttccagtcttatggcacagacctgagcgatccttccattgccaaccgagtcggtgtgtggatttcaggtttctttggttcaggtaaatcacacttcctgaaaaccttatcgtatattctggccaataaagtggcacgtgacgcggaaggtaacgaacgcagtgctgcagaattctttgatgaaagcaaaatccgggatgcgtttatccgtgcggatattggcaaggccgttagccatcatgccgatgtcatcctatttaacatcgacagtaaagccagctccaatgatgatggcaatccgattctgaatgtgtttttacgcgtgtttaacgaatatcaggggtttagtgctgaccatccacatattgcccatatggaacgtcacctgagtcagaaaggtgtgtatgagcgctttaaacaggcgtttgaggaatccagcggcatgtcctggctagaggagcgtgacggctatcagttctatcaggatgatgtcgaaaccgcgatttctcaagccctcaacttatctgctgaagctgcgcataaatggtttgaggattctgagcagacctttagtgtttcggtggaaaacttctgtcagtgggtgaaagaatacctggacagcaaaggaccccagcaacgcatgttgttcttggttgatgaagtggggcagtttattggcagtgatacccgcttgatgctgacactgcaaaccattactgaaaacttgggtacgatctgtaaaggccgcgcttggattatcgtcacctcgcaggcagacatcgatgctgttttaggtgagatgtcttcttcaaaagccaatgacttctccaagattgctggacgttttaaaacccgtttatcactgtcaagttccaataccgatgaagtcatccagaaacgtttattacgtaaaaccccagaagcagaagcattgctcagatcggtgtttgagcaaaagggcgatatcttaaaaaatcagattacctttgaccgttcaggcccaaccctcaagaactatgaggggccagacagttttattcataactatccttttgcgccgtaccatttccagctggtgcaaaaagtatttgaagaaatccgtaaagtcggtgcgactggtgcacatctggcctatggtgaacggtccatgctggatgcgttccagatggccgcgaatgcgattgccaccgatgaagtcggtgccctggttcctttccaccgcttctatacttcagtcgaaggcttcctggatactgcagtgaagcgtaccatcgaccaggcagggcagaataagaccctggatggttttgatgtgcagatgctgcgtaccctgttcatgatccgctatgtcgatatcatcaaaggtacgctggataacctggtgactttatcgattgagaaaattgatgaagataagctggcattgcgcaagcggattgaagagagcctgcagcgtctagaaaaagagagcctgattacgaggaatggcgatgagttcctgttcctgaccaatgaagagcgggacattacccgcaaaattaaagccactgacttagcagcttcagaagaaaataaagagttagccaacctgatctttaaagatttactgcgcgatcagaacaaataccgccatcaagccaacaagatggactatcagattggtcgttttctggatggtcatagcctggatggcaagtatgagagcgatttgaaagttgaaatcatttctccactggatacggaatacaacctctacactgaagcttactgtattggtaaaagtactcaggccgaaggacaagtgctgtttaaactggcagatgataaacagttctttaatgaactgcgcacctggctgaaaaccaataaattcatccgcttaaatgatgatggcactcagtccgatatcacccgtattctggcagaccgtggtcctgagaatcaggagcgtaaaaaacgtctgcgtgtccgggtcgaagaaatgttgctggaggcggaaagttatgccttggggcaacatctacaactttcatcttcaagtccaaccaccaagctggatgaggcttgtcgttatttgctggaaaacacttataccaaactgagctatttgcaggtctatcagcaggatgcctggcgtgaactgaacgccgtcttgactgtggatgatatggcgcagctcggattgtctctggatggcggtcagagcaatccgaaagccctacaggaagtggaacagtacattgcactacgggccaccggtacagagcgtattctagtctcagatgtgatagaccgttttgccaaacgcccttatggctggccagatgccgagattttattgctggtaggtcagctggcggcaattgggcggatttcactgcagttaaatggcggcagcttacagttaaaagatgcctttgagcccttacaaaacagccgccgtcgccgtgatgtttccattattaaaaagcgccagactgatgatcaggtcttgaaacaggcacgccaactgacccaagacctattctcggcgatgggaccagcgacagagaaagagctgtttgaattctatacccaacattttaaaaactggttagccaactttaagtcgtacaaaagcaaaactgatgtcgggcagttcccgggcaagaaagtgattgaaaaatcgattctgactttggagcgcttgctggccaatagcgacagcttcgatttctttaaagccgtggttgagaacaaggacgactatctggatctggaagaagactaccgtgatattcatgaattctttagcaaccagatgccgagctggcagcaactacagcaagccttacgtcattttgagaaaaacaaacaggcgctgggcagtgatgatgtggcaaaaaaagccctctccgaattacaccgtatttcgacccttgaatcgccctatggcctgttaaataaagtggctgatttggttcgcacagtggaaagcgtcaatgagcaattgctgactgagaagcgcaatcaagcgatagaacacattgatgacaagatcaagcagttagaagccgagattaaaaacagtggcattgctagcgctgagctgagtaacaagctattacgcccactacaactgctgaaagcagatattgaagtggaaagcagcctatccaccatctatatgctgcaaacccaaaccgccgtggagcgttttgatgaagccttgtatgagttggaaagcgaagttcaggcggaaattcagcgtcaggccaaagcagcacaactggctcagagcaaagcagagagtgtaaccaacactgcaaccacctccagcccagctacatcaacacctgctgtgagtccggtacagcctgcgacagccgtagtgccaccgaaacctgttgtcgaagtcgatgtcgccagcatttacagcaaaacctccagtagtgtctatctggaaacagaagaatcagtggatcagtttgtagacgcactcaaagctgaactgaaaaaaatcgtgagtgataaaaagcgtgtgcgtatccgctaa

SEQ ID NO: 325 - DNA, 3663 bp, Cellvibrio sp.
atgacaattaaagatttatttattaagcccttggatcgccccattaacggcgtagtaaaggcagatcaaaacgatgatgcaaccgtccaccaagagttagatgaatatgtagtcactaacgaattggaaaagcacttccgttcgttttttgaatcctatagtacggatttgagtgatcccagcattgcaaaccgtgtaggcgtgtggatctccggtttctttggttcgggtaaatcgcattttctaaaaacgctgtcttatattttggcaaataaagatgcggtagatagcaacggtaatcataagcaggcagttcaattttttgatgagcaaaaaatccgcgatgcgatgattcgtgcggatatcagcaaagcagtaagtaacactgccgatgtcatgctctttaatatcgacagcaaagccagctccaatgacgatggcaaccccattctcaatgtatttttgcgcgtatttaacgagcaccaaggctttagtggcgatcaccctcacgttgcccacatggagcgccatctaagccaaaaaggcgcttatgaagctttcaaaaaagcctttacggcctctagtggtttgcaatgggaagttgaacgcgacggttaccatttctaccaagatgatgtagaaaaagctcttgcagaatcgctaaatttatcgccagaagccgcccacaaatggtttgaagaatctgaaaaaaccttcagtgtttctgttgaaaatttctgtacctgggtaaaagaatacctggatactcaaagcccaaaacaccgcgtactctttttggtggacgaagtagggcagtttattggcagcgacaccaaattaatgctcacgctgcaaaccatcaccgaaaacttgggcactatttgtaaaggtcgcgcctggattattgtcacctcgcaggccgatatggatgctgtattgggtgagctctcctctgccaaagccaatgacttctcaaaaatcgcaggccgttttaaaacgcgcttgtcactttcaagctctaataccgatgaagttattcaaaagcgtttattgcgtaaaaccccagaggcagaagcagagctcaaagccatttttgataaaatgggcgatgtactaaaaaaccaattgtcgtttgatcgctctggccccacgctcaaaaattttgatggccccgatagctttgtaaaaaattacccatttgccccataccacttccagttggtgcaaaaagtctttgaagagatccgtaaggtaggtgctaccggcgcacacttggcctacggtgaacgctccatgttagatgcctttcagatggccgcaaatgccattgcggggcagccagtaggcgcactgattcccatgcaccgtttttacagttcggtagagggctttttggatacggcagtcaagcggaccatcgaccaggctaaagaaaatacaacgctcgacgattttgatgtgcaaatgttgcgcacactcttcatgattcgctatgtggatttagtaaagggcaccttggataacttagtcaccttatctatagcgcaaattgatgaagacaagctcagcttgcgtaagcgcatcgatgaaagcttgcagcgcttagaaaaagaaagcctcattacccgcaacggtgatattttccaattcctcaccaatgaagagcgggacatcacccggaaaataaaatcgacagaaatcgcaagttctgacgaaaataaagcactcagcgaattaatatttaaagatctgttacgcgacaaaaacaaattccgctataacgccaacaaaatggattacggtattggccgctatttagatggccacacgctggatggtcgtttggagacggatttaaaggtagaagttatttcctcattaggtgctgattacaatttttatagtgatgcacaatgcattacaaaatcggttgagggctatgccatcctcaaaatgacagatgaagtgagcttttttggcgagcttcgtacttacctcagaaccgataaatttattcgtttaaataacgatggttcccaagccgacattacccgcattttggcagaccgtggccgcgaaaatcaggagcgtaaaaagcgcctgcgtgcggcattggaagacatgctcctgcaatctgaagtctatgcgcttggccaacacctaaaactcaacagcaacaatatccacaccaagttcgatgaggtatgccaatacctgctagaaaacacctacaacaagcttggttatttacgtgtgttgcagcaagacccttggcgtgagctcagtgctgtattaaatacagacgatataggccagctcggattaacgcttaatggtgaagaaggcaacccgcaagccactaaagaagtggagcaatttattgcgctacgcacccaacacgacagtattattttggccgaaattgtggagaagttcagcaaaaagccttatggctggttagatgctgaaatcatattaattttaggccgcttagcagcagcagggcgcattagctttatgctctctggcgcaacgttgccactaagagaagcatttgatcctttacaaaactcgcgtcgccgccgcgaagtcacggttattcgtaagcgccaaaccgacgaaggtgtattaaagcaagcgcgcaatctcacgcacgatttattctctgctatggggccggccacagaaaaagaattgtttgaattctatgtggcaaaatttgcagaatggcttagaaatttaaaaagctacaaaagcaaagtggatgtaggccgcttccccggtaaacgcgtcattgaaagttcaatgctcaccttggagcgtttgctcaatcacagcgatagctttgaattcttcaaacaagtggttgaaaagaaaaatgactaccttgacttagaagaagactaccgcgatatacacgaattttttaccaaccaaattcacacatggcagcagctgcaaaaagccttgcgccaattcgacaaaaacaaatccgccctagaggccgatgccggagcaaaagcggcacttgctgaactgcaaaccatagaggcggccgaatcgccctatggcatgttgcacaaagtggccgggcttattaacacggtagaaaccgttaacgattcaatcgtcacccagcggcgcacacaagcactcaccgtgttggaagaaaaaattacacaactggaagcagaaattgctaaaagtggtgtggcaacaccagagctaagcaataaactcttgcgcccgttgcaacaaataaaagaagacttgaacgatgacagcagcattgccggtatctacatgctgcaaagccaaaccattggcgaacgtttagatgaggcactttacgaactggatctcgccatccaaaaagcccaagaagctgaacgtaaaaaacaactcgcggcggagcaggcaactaaagcagcgtcagccacaacccaaactccagtggctgtgggcgcaattagtgaaacacctgcgcctgtgtacgttccaccaccaaaacccgtggtggaaattacgccagccagcattttcagcaaagtcagcagcagtatttatgtagaaacagaaagcgatgttgagcagtttgtagcagcactcaaacaagagttgcaacaagccatagccaacaacaaacgtgtgcgcattcgttaa

SEQ ID NO: 326 - DNA, 3669 bp, Faecalibacterium prausnitzii
atggaggaaactgttatgcagatcaaggacatgttccgaaagaaaattgaccgtgagatacagggcgttatcattgtcggtcagggtgaagaaacaaatgtagcgcaggagctggaagagtacgttgtgacccgtgagcttcagcgtcattttgcggatttctttgcagcatataaaaaaggtattcagggaaccacaccgaaaatgggtgtctggatttccggcttctttggaagtggtaaatctcatttcctgaaaatcctgtcctatctgcttcagaataaacaggtcggagacaaacatgccatcgactactttatcgaggatcagaagattaccaatcagatggtgctggcagatatgcagctggcagcaaacaccccatcggacgtaattcttttcaatattgattccaaaagcgattctaatggcaaagaaaataaagatgccattgtgaacgtattcctgaaggttttcaatgagatgcagggcttctgcggttccatgccgcaccttgctgacctggagcgcaggctttccgaggaaggacgttttgaagagtttaaggaaaagtttgaagaagagtatggcgatccgtgggaaagctctcgtcaggacttcgatttcattcaggattccgttgtcgatgttctttctgacatggatttcatgagcgaatcagctgcccgtaactggtgcgagaaagcaaccgagagctaccagatcagcattgaggatttcgccaagcgtgtaaagtcctatattgataaaaaagggaacaaccatcatgttgtcttccttgtggatgagatcggccagtacattggtgatgattctaagctgatgctgaaccttcagacagtgacggaagaactgggcaaggaatgcatgggcaaggcttgggtaatcgtaacgagccagcaggatatcgactccattaccaaggtgaagggtaacgacttctccaagattcagggacgtttcgatacacgtctttctttgtcctctgccaatgtggacgctgttatcaaaaagcgtattctggataagacagagaccgcagcacagagcctgcgtctgctttatgaccagaaagcaaccatcatcaaaaatctgattgtcttcaacgacggcgtggagaaaaaactgtacgccaacgcagaagattttgcagaggtttatccttttgttccataccagtttaatttgcttgccagtgtgctgaccagcatccgtacccacggtgcatccggtaagcacctgtccgaaggtgaacgttccatgctggctctgttcaaagagtctgccatgcagctgatggacgatgagatgggagcaatcgtgccgttctatcgattctatgatgcattggagaattttctcgaccacagccacagcagcgtgatcatccgcgcctatgacaacagctatatcaacccggaaaagaaggaaaaagatgtctttgcgatcaatgtgttgaagacccttttcctgattaaatatgttctggagatcgaagccaatgtagacaacatcgtcagcctgatgattaccagcattgacgatgatcgcatctctttgaaagcacaggtggaggatgcactgaaagtgttgatgcgccagatgctgatccagaagaatggctccatctatgtattcctgaccgatgaggaacaggaaatcaacaacgaaatcgaaaaagaaaatgtggagatgccggaggtcatcacgaagattgcggagatgatctatgaggacattttctccagtaagaagtatcagtaccccagctttggtgggcggtatgcattctccttcaatcagacagtggatgaccgcccctataaggcaaaccagaattacgatatcggcctccgtgtgctgaccccgtggtatgagggcggcaccgatgatggtacgctgcgcctgctctccggccagggcaaggaagtccttgtggttctgccgaatgatgatgcgttcctgacggaaatgcgggcatacttgaaaattgagcggttcctgcgcaagaatacctctgtgcagcttgccaagtatgagaccattaaggaagcaaagcgcgtggagatgcgggaacgcaacggtaacgccaagctttatctgacggaagctctgaaagaggctaccatctatgtcaatggcgatgtgctgcacacctccggcaaggaagtgaccagccgcatcaacgaggctatcggacgactggtgcagacggtttaccacaagctgtcctatattgatgcagcgatgggtgaagcagacatccggaagatgttcaagaccagcaaccagctgtcgctggcactgggagataccggagaatccaatgttcacgcactggatgatgtgctgcaatttgtggcaggcaattcccggatgcacatgaaaacttctatgaaaaccatcaaggatcgctttatgaaagcaccctatggctttgtggaagatgacatccattggctggtggcacgtctctttaagcgtggagatctgtcctttacggtcaacggtgagagcgtcaatctgaacaaccgctccgaagaagaaatcatcggctacatcacgaagaagcagttcgtggataaactgctgacggaagtgcgcgtccgtgtgccggaaaaccagaaaaaggccgtccgcaccgtgatgaaagagctgttcaaggtggcaccgcctgccgatgacgaagataccatcatgaagaacttccagcattactgcgagaatcgaatcaccgagatcgagcggctggaaccaaaatatgagaattacgcctatcccggaaaagaacttctggaaaagggcaagaagcggctttccgcactggtgcagattcaggcaccgcttgaattctttaagaccgtatttgacgagcaggatgatctgatggattttggcgaggactatgagcctatccgtgatttctttggcggtgagcagctgaccatcttcacccgtgcgctggatatgctgaatatctacgaggacagtaagacctacatcgtggatgcagaactggaagacgtggtggccaagatgcgcaccatcgtccggatgccgaagccctacaaggagattccgaagctgccagagctgcgcgagaagtttatgaactgctatatgcgcattctggaagagcaggcagagccggtcaaagattccatcaatcaggatcggaaccgtgtctttgaagtgctgaacaccaagccctataaggatgcgaagttcaaccgttatctggaactctttaaggagatcatggacggtgcggagcactgcaacaatgtttccactctgcgcagttatgcagataaggcggaggcactgaagctgcgcctgctcaacgagatgaacgcagaggacattcgccttgcgaaggaggcagcggcaaaggccgaggcagagcgtaagcgtcaggaagaagaggcggaaaagcgcggcgagaccgtgaaaccggcagaaaagttggcagaaccgcagccggtatataaggtgcgcaccacgaagaatgtttccatcaagacggttgccaagactgcatcgtggcggctggaaagtaaggatgatgttgataaataccttgctgcattgcgtgaaaacctgctgaaagagatggacgaagatacaatcgtcaacattgaactataa

SEQ ID NO: 327 - DNA, 3615 bp, Fulvimarina pelagi
atgacttccacgaccattgccgatctcttcgaccgtccgatctcccgtcagatcaacggcgtcatcaaggccgaccaggacgacgccaagagcgtctggcaagaactcgacgagtacgtcatcacccaggaactcgaccgctacatgcgccagttcctatcggcctacctcgccccagagacgctcgcccgcagcggcgatgccgcatgcagcaacggcgtttgggtttcgggcttcttcggctccggtaagtcgcatttcatcaagatcatctcgtacctcctcgaaaaccgggcggtggagcagaatgggacgatgaagaccgcgctcgatttcttcaagtcgaaggtggtcgacccgatgttctcggctgacatcgatcgcgcgacccgtattccgaccgacgtcgtgctcttcaacgtcgacagcaaggcgtcgtcgaacgacgagcgcgccatccttcaggtcttcatccgcgtcttcaacgagaagctcggctactgcgccgattttccgtacatcgccgacatggagcgctttctcgagcgcaagggcaagtacgaggagttcaaggccgctttcgaaaagaaggcgggatcgccttgggtcgtcgagcggagtgccattcgcttccatgaggacgctctcattgaggcagtcgccgaagtactcggaaagccgcgctcggatgccggggactggctcgacaagtacgaagcgaatttccaaccgacgcccgaaaacttcgcgaactgggtcgccgagtacctggcgcgcaaggggccggatcaccgcatcgtcttcctggccgacgaaatcggcgccttcatcggcaagaacggcaagatgatgctgaacctccagacgatcaccgagaatcttggcaccgtctgcaaaggcggggcctgggtcgtcgtgacctcgcaggcgaacatggaggcgattcttggagagatgaggcatgccgtcgaggacgacttttcgaagatccaggggcgtttcaaggctcgcctgtcactttccggatcgcatgcggacgaagtgatccagcgccgcattctcgcgaagaaggacgaactgaagcccgagcttaaggcccgctacgacaccaacggcgagatcctccgccatcaggtcaccttccgcgacaatcggatgaccctgcgctcctacgacggcgaagaggatttcatccggcactacccgttcgtcccgtatcagttccagcttgttcagaagatcttcgatgccagccgaacgcacggcatgaccggcgcccatctcgccaagggcgagcggtcgatgcttgatgccttccagacggcggcgatactcaatgcatcaaaagccgttggcgcgctaattccactccatttcttctatcccgccatcgagagctttctcgaggacatcgtccggcgcgccataaatggcgtcgtctcgaatcccgccctcgaacccttcgatgccgaggttctcaagacgctcttcctcatccggtacgtcgacgagatcagcggaaacgtggacaacctcgtcacgctcttcctagacaggatcgatgccgaccgtgtcgctcttcgcaacaagatcactgcgagcctaaagcgcctcgaaagcgagacgctggtcagccggaacggcgagaacttcttcttcctgaccgacgaagagcgcgacatcgggaaggagatcaaggcagtcaggctggcgccgggagaagagaagcgactgctcggcgatctcgttttcgacgacacccttcgttgcgtcgaccgcggacttttcaattacaaggtgatcaacagcgatctcgacgtagtgcgcttcgtcgacggttcgccgcgctccggtccgaaggacaaggcgatccccctcaagatcgtcactccactcgccgacgactacgcggatttcgccgatgcgtctatcactatgcgcagtcatgacgaggtcttggtcgtgctcgacaacgacaacgatctcgcccgcgacgtctatgactatctgaaggtcgagaagtacgccacgcagaagatggacggcacgcagtccgagtccgtcaagcggatcgtccggacgcgtcagcacgagaattccgagcggcgaaagcgattgaaccagtcgatggagtcgctcatccgcaatgctcgtgtctatgtcaacggtcggcggctggatccgaaggcgaccaccgcagacgccatcgtcggcgaagcgctcgactattatattgccaacaccttcaagaagatcggcctcctcgcgcacctttccgacgatccgatccgagatgctcgggtcatcctgacgacttcggacgacacgctcgacctcaaggacgaagatccgaacaaggcggcgctcaatgaggtgctcgatcatatcggcctgatcgagaggcagagcaagcaggccgttatcttcgacattgccgagcatttcaacaagaggccgtacggctggggtcagcgggaaaccgtgctcctcgtggtcaaactgttccgacagggatccgcggatatcctgatgaacagcgagcggctcgaccgtggtcagctttcatctgaaatcgatggcgcgaacaagtggcgcaaacttgtcatccaacgtcgaaagatgctcgacgaaacgaccctccacggcgctcggcagcttgccaaggacgttttcggccgaatgcccggcgtcggcgaggacgcgatcgccgaagacatccgtctgaatctaacgaactggcaaaacgatctgaaaacgtggggcgctctcgccgacgacggagagcttccggggaaagcgacggtcgcaacgatccagggcatcatcgccccgatcatgcagaagcgcggaagctacgaactgatcgaggctttcgttgccgcgaagagcgaactgagcggagtctttgaggactacgaggatctgtccgacttccactcctcccagaagcaggcttggtacgccatgcggaaggcggtcaaggagttcgcgatcaatgagaaggagatcgagaaggacgacgcggccgcgagggctctcgcatcgatcaaggaaatcctgacgctcgaagcaccgtattcgcgggtacgcgaaggatcggcactcatcgcgacggtggccgaggccaatcgggttctgctcgagaagcgtcgtgagcatgccttcggaatcatcgatccattgatcgccaaaattcagaccgaactggacagcgtttccgccgaggccgaactacgcaatcgatcgctttacccgatccaaaacatccgcaaacgcatcgaaacaactccgagcgtttcggccatcttcatggcgcagaccgaagcgcgggatgcctacgatgacgcgttcgaagttatcgcgaaagcggtcaagctcgcgaaggaacgggtcaagaccgccgagcctgtcggcatcggatcgcaaccacagactccgagtggagggttttcggaaacacctgtgttcagacccagacttgttgtccaaccgtcgaagcttgtgtcggcgggtggctacatcgaaagccaggcgcaggtcgacgatttcatcgaccgcttgcgagcccggcttctggaagctgtctccaaaaacgaacgcgtcgaaatccgctga

SEQ ID NO: 328 - DNA, 3642 bp, Escherichia coli; identical to SEQ ID NO: 56

SEQ ID NO: 329 - DNA, 3648 bp, Delta proteobacterium
atgaagaagattcgcgacatctttgccaagccgattgaccgaactatcgaggaagtgatcaaggttgaacaggccgatgagaaggccgtcctggtggagcttgatgaatacatccccaccgattatttgcaggaacagtatgcccgtctctttgacgagatcgcatccggaccggcaagtccgcgcgaaggaatcggcatttggatctccggatttttcggttccggtaaatctctttttgccaagatcctgggctacactgtggccgccagaaaggtgggggcaaaaaccgcttccgaaattttcaaagtcaaactcaacaacccgaaaattgcggccctgatggactccatcaattcgcgcattccttttcatccgattatttttgatgtctccatggatcggggggttcgcctggccaacgagcgccttaccgaaatcatctacaaggccctgctccgggagcttggctattcggaagatttcgatctggccgaacttgaaatcacgcttgagggcgacggcaaactggacgctttcgaaaaaaaatttcaggaaatctacggcgaaccatggcaaataaggcgtttgctggggctcgccatcaacgaggcgggcgccgtcctccacgatcttgagccggccacttaccccacagccgactcctacgccatttccgtgggaagcggacgcgcggatatcgatcccaataaacttgcgaaaagagcttatgaactgactgaaatacgtcgccccggccatgcattgattttcattatcgacgaagtgggccagtatgtttcgcgaagtgtggataaaatgcttgatttgcaggccattgttcagtctttaggcgtggaaagcaagaatcgcgtggagcataaacaagccgtctcgccgtgctggattgttgttacttcccaggaaaaactagatgaggtggtcaacgcgcttgactctaagaaaattgaactggccaggcttcaggatcgttttcgcctgaccgttgacctcaaacaatccgacatcgccgagatcacggcaaaaagaattcttgaaaagacagcggaagcggtgggcgacctcggccgattgtatgacgacaacgaaggtcgggttaatgaactgggtcggttggagcgcacgagccgtgataccactataacaaaagacgcttttgttcgcctttatccctatctcccttatgagatagacctttgcgtggatatcgtggccggcttgcggctgcgtcgcggcgcgcatcgtcacgtgggaggaagcaaccggactatcattaaacaagcccaggagttgatgatcaatccccgtacccgcctgggcgaagcgcccttaggtgatcttgtcaccctcgacaaagtttatgaactcctttatctcggcaaccttcttcccagtgaagtgagtagggaaatcgacgacgtggcaagaaatcttcccgacaacccaatggcgaaaaaagttgccaaagccatcgcgctcctggaaccggtcaaggatttgccgcgtacgccccacaaccttgcggtggtgttgtatccttccatcacatccggcgccatcttaggtgacgtggaaaccgcaattgcggtccttgaaaaggcccaggtgatccgaaactctgaagagggttacaaacttctgaccgtccaggagaaaacgtgggaaacgaagcgtaacagtctcgacccccgtgaggcggaccgcaaccgaatcaagcgggaagttctgaggcagattttttccgatccccaattgaggaagtatcaataccggaagctgcggaatttccggaacacattggtcgtggaaggtgacacggttgagtcggccggtgagatcccattgaacttgcttcttgccgaatccgttcagtcaaaagcggatcgaatcagcgaggcccgcgatgaaagcagcacagagcggaacaatctgttctggatcgtcacccagaccgatgagatacatgatctgattgtggaggtttaccgctccagggagatggtttccgaatacgaacgtcttgcatcccagcaacgtctgagcggggaggaatcctcctgccttgctgaagaaaagaaccgtcgggatgttcattatcgaaaactccgagccaaaatgctcgaagccgtccagtccggaacaggctttttccaaggggtccaacacgatgccacggctctgggttccggatttgtggacatctttcataaactttttgatatcgtggttcctgttctttatccaaagcttgaagtcggcgtgttgcccctcaagggcgatgagcctgaaaaactcatcaccgcagccaatttaaacggccttccccccgtcttttacaatgacaagccggaacaaagtctggttgtgaaacaaagcggaaaattcttgcccaacctgggagcggacctttgccgtgaaatgttcgattatcttaaaaaagaacacgcttacggcaacaaggtcaccggcaagatcctggaaacgcatttttccggtattggatatggttgggaacgagaagctctgcgccttggtctggcggtccttttcagaggcggggccgtggaagtcacccaccagggtcgcaagtacagaaactatagcgatcccgcatgcagacccccctttgtgaacaacccggcgtttcgagcggcctcctttgctccgagggaaaccctggatctcaagattctggcaagggcggcccaagcttatgaggagatcaccggcaaggatgtcaacatcgaagaaggcgacattgctaacgcttttcaggaaatagcagcggcggaccgggaaaagttactccccgtggtagcccgcctaacggccctcaaggttccgggggcggactccgtggcggcccatcttcaatgggtggaaggtatcctcgatatggctccggacgactgcgtgaagacgcttgccggtgagggaaggtcctatcttgaaggcaggaaaaatgcagcgatcctggagtcactggcttcggagacgaaccttgaaatcctgaaaaccgcccgccgggtgttgatcgagcagtggccggttcttgcggaccgttcacccagcccggaacttgaagaatctgccaatgaactgaccgaggcttttgattctgaaaacgtgctggatcaactggaaagggttcggcaagcatcggaaaaactgggcaatgaatacggcaacctctaccgggctacgtttgaacagcgtaataaagcctatgagacggccattgatcatgtaaaggggcttccggagtgggcggcctttaccgaggataccgatgttaccaaaatagagcaagaagccttgcttcgtcccctgacgtcgcgtttgggcgaaaagttggatctgcaaaagggagacaccgtttgccgcatcaaccatgccacaatttcccagatggagagcgacatagccgctgtggaaggcctgacctgggcggtgatccttgcgctgcaaaagtccgtggagcccgaggaaaaggtggagaggttccgggtctcacaacatttttccggaaaaatcggaaacaaggaggatttggattccgtcatcactgtcctgcgcgacaagctggaaaagcttctggcccaaggctgcaaagtgatactggaataa

SEQ ID NO: 330 - DNA, 3672 bp, Enterococcus faecium; identical to SEQ ID NO: 283

SEQ ID NO: 331 - DNA, 3732 bp, Lactobacillus johnsonii
atgacaaaaataaagaatattttcaaaaaagatattgatcgagatattcgcggagttattaaaattggtcaagatagtgaaaaaattaagaaacaagaacttgaagagtatgttattactgatgaattaaagaatgattttactcgcttttttgatgcttatgataaaagtattgatgcacctacagataaaatgggagcatggattagtggtttctttggttcaggtaaatcacacttcttaaaaattttatcttatcttttagaaaatgatatagttgatggacgtaaagcagtagactattttttagaagatggaaaatttgatgataaccatttatctaatgctattgaaaaagctacaagtgtatcaactgatgttgccttatttaatattgattctaaagcagactccaattcagccaatgatagtagtgctattttaaacgtatttcttaaagtatttaatgaacagttaggatattctccaattgcagaagttgctgatatggagcgctggctggatagtattggaaaatacgatgcatttaagaaggctttccaagatcttgatccagaaaatcactcctcatgggaagaaactagaagcagatatgcgattatgttaaatacacgtattaaacctgcattgattagttctggcgcattagatgaagtagatgcacaaaattatatcaatgaatttctaagtaaaaagttcagtattgatgctattggatttgccaaattggtaaaagactatcttgataaaaaggatggtaaccatcattttgtatttttggctgatgaagtagggcagtttatcggtgaagatgataacaagatgcttaacttacaaactattgttgagcagctcggaattcaatgccatggacgtgcttgggttgtagtaacctctcagcaacaaatggatgaagttacaggcaatttccataaacatgaacgtgatttttcaaagattcagggtagatttaatactctaatctcaatgagctctgctaatgctgatgaagttatccggaagcgtttattggataaaaagccattagctaaggaagaattagacgatctatttactcaaaatgaatatagcattaacaataagattaatttcagtgatgctataaaaagggaaaaatatgaggattcgcaatcttttgttgataattatccatttataccatatcagtttagtttgctaaaagatgtgttatcagctgtccgtaaacatggtgctagtggtagtcatatgtcggatggtgagcgttcaatgctagctactttccaagaggctactagaagatacgaagatgatgatctaggtaaacttgttccgttttctgctttctttatagggatgaaagaattccttaatcatgatcatcaagctgtatttgatcgggcaatgacagatagatatgtagccggtaataaaggcggagatagttttaatattcaagttttagccgttttatttatggttcgctatgtcgataattatccatcaactcttgaaaatattactacgctgcttttggacgacattaatcaagatcgtcaagaattgactgccaaggttaaagatgctttgagtgttttaattaggcagaatcttattcaaaagaatcttgatacatatgagttcctaactgattcagaacaagaagttaatgaagcaattaatgcgattgatatagatgatcaaaaaattgttcgtgaaataggtagttacttgtttacgtctaatttaatagattctaagtatgtttatcctaaaaagaaaaatcaatatatttttgaatttaatatgtatattgatggaacaggattgaatcctctaaaaaatgatttgaatattaggatcgtatccccactgcaatctggaaactatcgtgaaattgattataagcagcagtcaggtgataaccgtaacatcattgttgttttaaaagatgatgatcggtatattgagaactacagacaagtagaaaaaatcaaagaatatatgcaaaagccggaatcaagatctgatgaaaagattagatatattgcggctaatcgaaacagtcaagcaaaagatatcgagcgtaatacacaaaaaatgttggaagatgatttgcttgatgctgatatttatgttgatggcgatgtattagctaagggcaataactttgctagtcgtttagctgaagctaaaaagacaattattgacgctaattaccgaaatctgcaatacattgatgatgttaaatctgatcaagatattcttaatgtattaaaaggtactcaaaatgatgtacttttaactgataatgagcaggcaattaatgcggtaatcgaatatataaatggacaagctggtttaatgaataatatttccttgtctagtgtggttgatcgttttggtaaaattccgtatggttataagccaaatgatactgcttggctagttgctaaagcattttctgacggtaagcttaagatctatttcaataattctaagatctctttagatgaagcgcgtaaggatccaaaatcaattcagcgatattttatcagtaagagtaatctatcaagattgacgatgaagcctgttaaagaaatctctgcacgcgaaaagaaagatgccaaagaatttgcaagtgatgttttagaagtcagtttagttcttccagatggtgccacttctgagcaattagctgatgagattaaaaagaagacacaacaaaaagttagaattcttgaagatatactaaattacaaccatgataataaatatcctggtaaagatattctacatgagggaattaacagcttaaaacagatatctatggttcctgatagcgatcaaatcttttcaattatttctaaacacttagatgatttagaggattggcgtgatgaggttgaagataaagctattctacaattttatggtgatattggtaatattagtgaccaagaaaaaatttggagaaaatctaatagctatttagcacgttttaatcatgctaaaggatttattgaagatgaaaatttaaaggaaatagctaatgaacttgagaagtatttagatatggatcaattcaatatttctattcctaaattgaaaaatttgaattctgaattcgtttctttatatagtgatgacatggataaagtccatgagaaaatcataggcaaggttaatgaaagctatgatcgacttaagagtttagtaactgatgcagaatttcctaaaaaagaaagcgatgaactttttgctgaagttaataacactcttaaatcaataagtgatcgtgcagatcaatataatgaaagtagcgatgaaaatgcattcttgaacttaattagtttagataatgctattgagtctgctaatgatagattaagaaataaaatttcagaagtaagccaaaagttagctgagaaggctcaagaggaacaagaagttgctgcaaggaatgttgtagaagaagccactaatccagataacaagcaagaagaaacggttaaagtttcaccttcacctcaacctaagccaactgtaaaaattaagaaaaccatctttaagaagatttatgatgtggttctagaagatagctggaaaattgaaaatgaagcagatattgataaatatttaaacgctttgaaagtaagtcttgaaaaagaattagaggataacgatattatcaatattgactttaagtag

SEQ ID NO: 332 - DNA, 3630 bp, Thiothrix nivea
atgaacgtcgaacacattttcaataaaccgttgacccgtgacatcaacggggtggtcaaggccgaacaactggataacgccagcgtttatgtggaactggatgaatatgtggtaacgcgggaactggagcagcatttccgccatttctttgaaacctacaccccctcactgaccagccgtagccctgccatggcaggcaagatcggggtatgggtatccggtttcttcggttccggtaaatcgcacttcatcaaaatcctgtcttacctgctggaaaaccggcagaccgataaagacgggcagcaacgccgagccatcgacttctttcaggaaaagtgtgatgccagcgccatcgacgcaacgctttactccgacatgcatagtgccgcgcatcatgccgccgatgtcatcctgttcaacattgattcccgcgccaataccgatgaacaggaaaacgccatcctcaaggtgttcctcaaggtgttcaatgagcgcgtgggctattgtgctgatttcccgcatatcgcccatctggagcgggaactggatggcagggggcaatatcaggcgttcaaggacaaatttgccgggctgacgggttcaacctgggaaaaggaacgcgatgctttcgacttttaccgcgatgaactgatgaccagtctggctgccgccagcaagcaaagcgagccttcggtcaggcagtgggttgaacaactggaaaacaatttcccactcgacatccgcaatttctgcaagtgggtgaatgactacatcgagcacaacggcgggcgcaatgtgctgttcctggtggatgaagtcgggcagttcgtgggcaagaattcgcagatgatgctcaagctgcaaaccattaccgaagatttgggcacctattgcggtggccgcgcctgggttatcgtgacggcacaagccgatattgatgccgccatcggtcagctcgacaagcgtcagggggatgatttttccaagattcaggggcgtttttacacccgcttgcagctttccagcaccaatactgccgaagtcatccagaaacgtctgttggaaaaaacggagcctgccagggcgcagctggaggctctttttgccgacaaaggcgacatcctgcgcaaccagctcagtttcgacaaaaccaccacggcggaactgaaaagctataccgatacacgctcgttcgtcgataactaccccttcattccctaccattatgcgctggtgcagaaggtgttcgagtcgatccgcaccaagggggcaaccggcaaacatctggcgatgggggaacgctccttgctggatgctttccagtccgccgccaagcaggtcaaggatcaggcgctggatgtgttgatcccgttccaccgcttctatgcgcccatcgaaagctttctggagcctgcggtcaagcgcaccattgatcaggcgtgtgagctggattccctgactgcctttgacgccgacatcctcaaaaccctgtttctgatccgctatgtggaggcggtcaaaagcacgctcgacaatctggtgacgctcacggttgagcggattgataccgacaaggtggcgttgcgccgtcagattgaagagagtctgaaccggctggaacggcagttactgattgcccgcaatggcgatgagttcattttcctgaccaatgaagagaaggaaattgaaaacgaaatccgccacaccgagattgagtcatccgaacagacccacaagctgtcacagatcgtgtttgataccctcttgcaacgccaaaccgcttaccgctacccggtcaacaaacaggatttcagggtcagccgcttctgtaacgggcatccgcgtgatggggcgaatctggaagatttggtggtgaaagtggtgtcaccgctagaccctgcctacgacagttaccatctggaagccaattgcatcaagcacacgctggcaaacgatggctgcatcctgatcaggctgggcgaaaacaagcgtttgtgggatgagctgaccaccttcatcaagaccgagcgttttctgaaagtggcgtccggccagcgcccggaacaggaacacctgttgcgcgacaaggcatttgaaaacacccagcgcgaaaagcgcctgtataccgaattcactgccctgttcacggatgcggatgtctatgccattggcgcaaggctgcaacccaaaaacaccacaccctccaccctggtggatgaaacgtaccgttatgtgctggagaacaccttcagcaagctgaacatgctgcgcccgacccagggcgacctcaaccgcgaactgcaagcggtgctgactgctgatgatgtggcgcaactggggctggatttgaatgtaccggaatgcaacccggaagccatgcgcgaaatcgagaggtatgtcagcctgaaaatcagccgcaatgatgccgtgtacctgaaagatgtgctgaaccagtttacccgccgcccgtatggctggcaggaaaacgaaatcctgctgttgctggcgcggttggggttggcgggcaagctcagttttaccctgcaagccgccgatttgccgttgaaaaaagcctatcagccgtttaccagtgtgcgttcacgcgctgacatccgtctccagaaaatccgccagcatgacgagcgccagctccagaaaacggcggcgttggtgaaagacctgttccagaaaccgttcaccggctccggggaaaaggagctggcggaattgatccgccgcgagttaagccaatggcatgacagcctgaaaaccttccgcagcaaggcgcagaccggtcagtaccccggtaaggccgacatcgacaagggtattgtgctggtggtgggtttgctggaacaaagcaacagtttcaccctgattgagcagatgttgcaagatgctgcggcgctggaagactttgccgaagacttcgaggatctggacaacttctacaacagccagttccagacctggcagacgctggcgacagccctgcataaccagtttaaagacaatcggcaggcgcttgaaaaggatgacaccgcccgtaatgcggtggcggaactagaaggcatctacaacagcgcatccccctatggacagttacggcgtatcagtccgctgattgaacaggtacaaaagatcaaccagcaattgttggaagaaaagcgccctcatgcgttgaatcgggtcgctcagcgtatcaacaatatcaccgctgccttggacgcagcaggcgctccttccgaattgcggaaccgcgctctgcacccattacaacaatgccgccagactattgagaaagcagtttctatcccgctgatcctctcccaacagaccgaagccaatacgctggaagatgaagcttacgacctgatcaaccgccacatcgaggaaaaggtcaagcagccgtctccaccaccgccatcacccggcaaaagtggtgatactccaccacctccaccacccaagcccgttacaccggtcaagaaaaccatcaccgtgcgggctgtgggcagccatggggaaactattctggaaaccgaggcgcaggtcggggaatacatccgccagttgcaggagagcctgttgaaagctgtccgcgccggggatcgggtacgggtgaaatga

SEQ ID NO: 333 - DNA, 3642 bp, Escherichia coli; identical to SEQ ID NO: 53

SEQ ID NO: 334 - DNA, 3537 bp, Brevibacterium mcbrellneri
atgcagctcaccgagattttcgctaaggacgtccagcgtcccatcgagggcgtcatcaaggccgacgacgttgcgcaccttgccaccgaggtcgacgagtacgtcctgaccaacgaggccgccaaggggctggagttgctgctggaggcgtacacgaactacaccaacgcgaacggcgtgtggatttcgggcttcttcggctccggtaagtcgcacctcttgaagatgctcgcacacctccttggtgatgtggagggcgacgacttcccccgcgagcgtgtctcggcgagcttccgcgccaaggcgacggatgcgttcttgccaccgctgctcgacaaggctgaccgcatcccggcgaagagtctgctgttcaacatcgaccagaaagcgaccttgatcagcaaggatcagaccgacgcactgctacgcgtgttcgtgaaggtcttcgatgagtcccgcggctactacggcgaccagggacacatcgcccgcttcgagcgccagctcgacgacgagggtcagctcgacaccttcaaaaaagccttccttaaggtgtcgggccgggactgggtggagcgccggccgagcttcgggctcccaaccgtgcgacgccaggtcaacgaggcatacgcacagatcaccgggttggacgcgacgaccgcgcccgacatcctgaagacctatcaggacacctactcggtgtcgattgaggacttcgccgacgaggtgcgcgcctggctggacaagcagccggccggctaccggctcaacttcttcgtcgacgaggtcgggcaattcatcggctccaacactcacctgatgctgaaccttcagacgatcgccgagtcgctgaacacgaagtgtggcggacgggcgtgggtgttcgtgacctcccaggaggacatggacaaggtcgtcggcgaccgcaccaagcagcagggcaacgacttctcgaagattcaggcccggttcaagacccgagtgaagctcacctccgcagacgtcgaagaggtcatccgcaagcgactgctggagaagaacgacaagggcacccaggtactcgaagccgtctacgcgcaggagtctgcgaacttcaagacactgtttgacttcgtcgatggagcgaagacctaccggaacttcaccgacgagacccacttcgccggcacctacccgttcgtcagctaccagttcccgctgttccaagccgcgatcgagggcatctccgaccacaacgtcttcgagggccgcaacagttccgttggtgagcggtccatgctcggcgtcgtccagcaagtcgccaaggacatcggcaatgtcgagatcggcacgttggccaccttcgacgccatgttcgccggaattcgcgcgtcgttgaagtccgcggcacagcgctcgattgaccgcgccgagcgcgacctgcccgacagcggttcaccggtaaccaagctcgcggtgcggctactcaaggcgctcttcctggtgaaatacgtcgagagcttccgggccaccccgcgcaacctaacagtgctggtctacgaccgattcggactcgacctgcccacgttgtccaagcaggttcaagacgcgctgatgctgctggagacgcagacctacgtgcagcgcaacggcaacgtctacgagtacctgaccaacgaagagcaggtgatcgaggaagagatcaagaacgtcgagatcgactcatctgaggtctcgacccggctgaacaagattctctccggcgatgtggtcaagacctccaaactccgctacgccaagaacgggcaagacttcccattcggatacaagctcgacgaccagccgttcggtcagcaacgcgaactctcacttcacttcatcactcccgagtacccgtacggtccggaagagattcggatgcactcggcaggcaaagacgagcttcgtgtgatcctcgctcccgacgaccgggtgctggccgacctgcggctgctgatcaagaccgagaagtacacgaagcgcaagcagaccagttcactctctccggtcgaggagcagattctgcgcgccaaggcgactcaaaacgcgcagcgcgagaaggagcttgtagagcgaatccgccgcgccgtcgggcgagccgatctcgtgatcaacgccgcagacctcacatccgggtcgcaggaagcagtcacgcggatcaccgaggggttccaagacctcatcgcgcgtacctacacgcagctcagcctgctcggtggacgcacctacagcgcgcagcaggttgccgggttcgcgaaccccgaccaagccgccatgattgacgactcctcaatgcacgcgctcgcggccccggcagatgaggtgctgtcgtacgtcctgcagcgcgaccgtctcggggagcagatcaccgtcaagaagatcgtcgatcacttccaggccaagccctacggatgggacctcgcctccatcgagtgcgtgacggcctggctcgtcggcacctcgaagatcaccctcaccgtcgactcgaataccctcaagcgcagcgaagtcgccgccgtgttgcgcaacacgcagaagcactcccatgccgtcgtcgcccctcagaagaccttcgaccagcgcaggatcgcagcgctgcgcaccttctgcacggacttcttcgatgagcccaacgcaccgaaggacccgctcgaactggcccggcacgcgagcgaacgcctccgcgccaagtgtgaggagctcaaggcgcgagtcagcggctcgaagtaccccttcgtgactcaactcgaagccccgatcgcactgctggaatccgtggcgggcaagcccgacgactggtttctgaccgacttcgtgctcactgacgacctcctcgatgcgaagaccgacatcatcgatccgatccaggccttcttcggtgacgagaagcagcgaggcgctcagcgcaagatttatgacgaggccacccaactgctcgccgacaacgccagcaacctcaactacctcccatcggggagcagtcaggaggtggcgcagctcctcgccgacccgcaagccttccgcgggaaccggatgaccaagctcaagggcgctgcccttgagctccaatcccgcatcgacgaggcgctcgtagccaaccgtgatggagcagtcctggagatcgactcccggtgggcgcctctacagaccagcacgatctatctgggagccgccgacgacgcacagcgaagcgtgagccagaaggtcaacgcgattctcgatcggatcagccgggagaaccagatcgccgtcgtccgcgagatcgcgaacaccttcgaggaatgcacctacccagccatcctcgaccaactcgccgcattcccaagcatcagcagtgcggacgatagcgacgagctggcaccggcaccgatcaagaagcagaccgtctcagtcaagagcatcagtgccaccggcatacacggcgtgctggaaaccgaagaagacgtcgatcgctacctggacgcgctgcgcgcagcgctggtccaggctctcaacgacgacaagcgcatcgcactgtag

SEQ ID NO: 335 - DNA, 3642 bp, Escherichia coli; identical to SEQ ID NO: 56

SEQ ID NO: 336 - DNA, 3585 bp, Geobacillus thermoglucosidans
atgcaaataaaacaattatttaaaaaagatatttttcgcaatattaacggcgtagtccaagccggtcagctagatagtgaaacaattcaaaatgaattagaagaatatgttatgacggaagaagtaactgaatacttacatacattctataagaattatttagctgtatataaaactccgtcagcgaacatcggtgtatggatttcaggtttctttggttccggtaaatcacatttcctaaaaatcctttcttaccttttagacaacaaaccaattaacggcaaaaaaccagtggaatacttctacgataaaacgaataatcaagagcttttatcaatgatgaatgaagttgcagcaaaggaatctgatgcactattattcaacatcgattctatgtcatcatcggcatcaacacataaggaacgcatcgttgaagtattcctacgtgtattcaatcgtcatttaggttattccgatacattatggcttgcggatatggagcgacagctagacgaagaaggaaaatatgaacaatttaaatcggttattcgtcaattatatggtgtagaatgggaggaatttcgcttaaaagctttattacgtcgtaaaaaaattattcaagctcttgtagagattggatacgatgaggaaacagcaagcagctttttcgaagttagtaaaaatacatttgatataacatcagagcaattttcaaaaatggttgccgattattgtaaaaagcgcggcctagagtatcgtcttatctttttagttgacgaggttggccaatatatcggtacagatgttaacttaatgctaaacctacaaaccgttgttgaagatttagggaatcgctgccgtggccaagcttgggtaattgtcacttcacaagaaaaaattgatgcagttacgaatttacatagtacaaatgacttttcaaaaattcaaggtcgctttgccacacgtattaacttgacaagttccaatacagatgaagttatcaaacgccgattgttagaaaaaacggagacagctgacaaaacattaaaagcaatttatgaaccgattgaacaattaattcgtggccgcttagcttttgatccaaattcaactcaattacgttctggctatcgttcagcagaagagttcgttgcgctttacccattcgttccgtatcaagtagaactattacagaaagtatttaataaaatacgtattcatggtgaaggcggtactagcttagctcacggagaacgctctcttttaaaagcattccaagaagcggttcaattaaatgctaatgaagatagtggtaacttagtcacgttagcagaattttttccttcaatccgcaatttcctagaaacaacaataacaaggacaatcagtcgagctgaagatcgtgccaaaaacggagaagggttaaaacctgaagatgtcgatgtattgaaagttctctatctcattaaagggattgatgagataaaagcaacaccaaataatatcgctacgttgttggttgaaactattcatgatgaacgcggaccgttagaatatcgtgtaaaagagtcattgaaccgtcttgaacaagcgatgttcattgaaaagcatgcagatgggacatattcgttcctttccgatgaagaacaagaaatcaacaaagaaattaaaaatgtagaggttaatccaatcaaaattaaagaacagcttggtgatctgttctttacaaaaatgtatccaaaaacgaaatatgaatacaaaaaagacataccgccatttgattttaataaacgctttgacaattatacaaagggacatatgacatatcctttaacattgcaagtgttttcagtcgctatatccgacatggaagcagcaatgaaagccaactcgggacaacttgtaatctgtcttgatgaagagcttgttgcagaagcagaaagcgcaattaaatattccgaacaagttcaacgttatgtccaattaaagcgtaataatagcacaactctgactcaacatcgaatttatgatgcaaagctcgcgcaagttgatgagtttgagcgtaaagcagaagaattattgcggaaagcttgtgaaaaagctcgtttttatgtccaagggcaagaacgtatttttaaaggttcttttgaaaatcaagtaaattctgcttttgatatgcttataaaaaacacgtacacaaaactcgattatattgatgtgccaatttcatttaaggcacataaagaagaatggaaacgccttgccgagcatggaattgatcaagacctgttaaatatgacaggcaatcgcaacgcctatgacgagttaaaaacatactttgaagaccttgctcgaatgcatgaaaaaccgtctttaaaaacggtgattgaaaagtttagtgacgtaccatacggatggagtgaatatgatattatcgggcttatattagccttaatgcatgatggtaaagtcaatttatatgttggtgacgaacgctttacgccagcacatccacaattttttgaccgtctctctcgcatatctgagagggaacgaatccgtattattccggagattgaagttgatccaaaaataaaaaaagaattcacttcactgatgcgcgaatttttcggtcgccaagaggttggagaaacgtatcaagactttgcggaaattattcagcaggaaataaatgaacgttttactatgccgcttgaagagattcgctcacgtcgccgtgaaagcaagtcagctgattacccgtatccgggcgaaagagaaattaatactatctcgatgggagtacaaaaattactacaaattcgcgatgctgaacaacttgtcaataaatttatcgaagcacaagatgaaattgatcaatggcttgaaatgattgaaaaactattaggcttctataaaaaaacaccgatttctgtgtttgatgatgctgttagcacgcttcaactctatcaaaatgatttaatattaattcaaaatagtgatgttcaaatcattaagaagcaaattacagacattttaacgaaacaagaaccgtatcgtgatatcccaaaactgccgcaacttatcaacgaattagaagaaaaaatcaaagcagaggtaaatgaacaacgcaaggcaattcaagtacaagtacaaacccttgaagaaaagttagtcgaattaaaagattattaccaacacgaatcatctattgtccaatatattgatacagaatggcagacattcaatcgtttaaaatcaaatattgtaacagaaacaagcattgtcacgattcgcgccctagttcaacagttaaatgaacatgcgaaactagttcaagacagagcaaaacaaatggaagaagaattacgtaagaaaccacttactgtggttgatagcgatggagatactccttctgttgtgagggaaaaaacaacaaagaaattatctgctaatgagttgcatcgtatgttctttaatggtcggacaaaaattgaaacacaacaggatttagatgctgcattggaacaattgcgcactaatcttttacgagagctaaaagatcacattctcgagatagaataa

SEQ ID NO: 337 - DNA, 3456 bp, Vibrio cholerae; identical to SEQ ID NO: 239

SEQ ID NO: 338 - DNA, 3672 bp, Enterococcus faecium; identical to SEQ ID NO: 296

SEQ ID NO: 339 - DNA, 3672 bp, Enterococcus faecium; identical to SEQ ID NO: 296

SEQ ID NO: 340 - DNA, 3678 bp, Vibrio cholerae; identical to SEQ ID NO: 122

SEQ ID NO: 341 - DNA, 3573 bp, Sporosarcina newyorkensis
atgctactaaaagagatgttcttaaaagatattgaacgtgatattcgtggggttattaaagttgctcaaacaaacgaagcggatatttatcaggagttagatgagtatgttgtaacacaagagctacatcgacacttttccaagttctatgaaaactatcaaaaggggattaatggcaaaacagataaaatgggagtttggatctcagggttcttcggatctggtaaatcacacttccttaaaattcttgcttacttattagaaaacagggctgtacaaggaaagaaacctgttgatttttttgaggaaaaaataaaggattcgcttgtatatgcgaatatgaaacgtacagcggatgttgatacagaagtgattctttttaacattgattcaaaaagctcacttgataacaaatcaaaggaagatgctattttacgtgttttcatgaaggtgttttacgagcatcgtggctattatggggatattcctggcgttgcggagatggaaaagtatttagacaaacaaggagtttatgaaacgtttaaaacggagtttaaagctcttgcaggtgagtcttgggaagatcgtcgcaacagcttctattttgatgcggattttgttatcggtgcattagtgaaggcaacgaatatgacagaggaatcagcccgtaattggtttgaaaatggtgtaaataactttgaaattagcatcgagaaatttgccaaggatgtaaaagagtacattgatagtaaaggccctaatttccatttagtattccttgtagatgaaattgggcaatatatcggagatagtcgcaacttaatgctaaacctccagacgctaactgaggatttaggaacctttgcccaaggtaaagtgtggatcatggtaacttcacaagaaagcattgattctattgtgaaggtaaagggtgacgacttttcacgaattcaaggtcgttttgatacaagactatcactatcatctatttcagtagatgaagttattaagaagcgtatattagaaaaatatccgcatgtattgaacaagcttagagctgattatccgaataagagtgcaatcctcaaaaatttaatcagcttccgagagagtacagcagacttacggggttatgataacgacttagaatttggggatgtgtacccatttgttccataccaattcaagctattgcaaaatgtttttgaacaggtacggaagcatggttcttcagggaagcatttatccgaaggagagcgttctatgctatcagcatttaaggaagcaggacttcgttataaagatgctgaagaaggttcgcttattccgttctatgcgttctacgatacgattaaggaattcctaaacccatccatttcaagggtaatagagggtgctaaagaaaatcccgcattaaaagatgatccatttaatgttgatttgttgaaagtgttattcatgattaagtatattaaggaacttccagcaaacattgataatatcgcaacactgatggttacacgtattgatgaggacaagcttcagctaaaagaaaaaatcaaagcttctttacgaaaactgatttcacaaacacttatccagaagaatggtgacaattattcgttcctaactgatgatgaacaggacataaataaggaaataaaagatacaaaaattgaagaagaaatattaaagcgagaattaagatcgtatatttttgacggtttatatggtgataaaaaatttgtttattcaaaacaatatatgttcccattcaatcaaaaaatggacgaaaaaaatcatggtagccaaacagcgagtatcggggttcaaattttctctcctctttcggagcattattataaatcagatcaggaattaatgatgatgagttcgggaagtggagaaatgattattaaacttggtggcaatgaaatctatgttgaggaaatggaagaagcattgcgtattgaagaacatcgtagaaaaaagaatattccgcaacttccagaaaacttgcaaaacattttaaacaataaattggctgaagttcgtgatcgaaaacgaagagttcaggagttgttagaagatgctgtgaaagacgctgttttctttgtaaatggtgagaaaatggatattaaaggctcaactgtaaaagagaaattcaatacatcattaaaacaattagtagataacgtatatacgaaattaggatatgtaaaagagcatcttgaaaatgaacgagaattgatttccatattggcatccaatgatcagcaaatctcgtttgatgaacaaattatttcaaatcccaatgaacttgccaaacgagaggtgtatgagtttatcgacttacaagagcaaattggtaaacagatgcgagtaaagcttgtgtatgatcgtttccaggacaaaccatatggctggaaacagctcgatatagcacgtctggtagctgagttactaaaagaacaaagaattcgtattcgctacaactctgaatacatggagccagagaaggatacaaacaaattattgactgtctttggaaagacaactgaagcggacaaaggaattattacaaaacgagtgaaagtggatgaagcactcattcgtacagctaaacgggtttgtaaggaagtattcaatacaacagatttagctgatgatgaagacggtcttgtgaaggatatacgtacgcttatcgctaatcagattgctgaaatcaacgcttataaagatcgcttcgaggggcggaaataccctggcatgagcctccttaacaaaggctttgagtattttgagcagtttaataaccagctcgataatgcctctttcttcacaaaattaaaagatcttgaagatgatttagctgattgggaagaagatattgtgtatgtaaaaagctttttcggaacgaaccagaaggaaatctttgatcaagggttggctggtttaatcaaatttgatgaaaataaagcttatttatctggaaaagaagtagaagaagcaatgaaccagcttcgaaatatcattcaagatccaattccttatcgaaaaattaaggatatcccagagttgcttcatgcattggagcaacagataaattcagtattagatgagaaaaaggcaaacgcccttgaaaaactacaagctgattatagtgaattaattctacaagccaaacaatatggagtttcaaatgaaacaaaacagcgtgtagaaggttattatgatgggctaaaagcaaaccttgaccaatttacggacatttttaaagtagatgcaacaatttctcagagcgatagttttagagatagaacgattaaagagattcaacgggaaattactgaatggcaacgtaaaaaggcggaagaacagaaaagaaatgcaggtactgttgttgagactcctgttaaaacggttgttcagaaacagacggtaaaagtaaccgatcttgttactgtgaaaacattatcgaccgaagaggatgtagacctgtacatcaacacgctatccaataagttaaagcagatcattaaggcaaataaacaaatagagtttgttgaataa

SEQ ID NO: 342 - DNA, 3456 bp, Vibrio cholerae; identical to SEQ ID NO: 239

SEQ ID NO: 343 - DNA, 3456 bp, Vibrio cholerae; identical to SEQ ID NO: 239

SEQ ID NO: 344 - DNA, 3456 bp, Vibrio cholerae; identical to SEQ ID NO: 239

SEQ ID NO: 345 - DNA, 3456 bp, Vibrio cholerae; identical to SEQ ID NO: 239

SEQ ID NO: 346 - DNA, 3615 bp, Desulfotomaculum gibsoniae
atgctgattaaagatatgtttgtcaagcggattgacagagatattaaaggcgtaatcaaagtcggtcaggccgacgatgaaaatatccggcaggaactggaagaatatgttgtgacacgagaactgcaaaaacactttgcagatttttttggaagctacaagaaaggcatcaacggttacaccgataaaatgggcgtttggatttccggtttcttcggaagtggtaaatcgcacttcttgaaaattttgtcctacctgctggagaacaaagaagtgaacggtaagaaagccctggactattttgtcgaggacaacaagataatcgatccaatggttctggccgacatgaaactggctgccggtgtatctaccgatgttatcctgtttaacattgactccaagagtgaaataaccggcaaacataataaggatgccattgtctctgtttttttgaaagtgttcaatgaaatgcagggtttctgtggctccattcccttcctggctgacctggaaagacagcttactgaaaaagatcgctataaagaattcaagcaactatttaaaaaagattttggcggcacatgggaagcatccaggcataagtttgatttcatccaggatagtattgtggatgttctgtctgaaatgggctttatgagtaaatcagccgcccgaaactggtgtgaaaaagcaaccgaaccttatcggattagcatagaagactttgccaaaatggtcaaagaatatcttgaccgcaaaggccataatcaccacatcgtctttttagtggatgaaatcggccagtacataggagatgattctaaactaatgcttaacctgcaaaccgttaccgaagacctgggtacggcttgccggggtaaagtctggatcgtagtgaccagccagcaggatattgattccgttaccaaaacgaagggcaatgatttctcaaaaattaccgggcgttttgatacccgtctgtctctttcatcagccaacgtggatgaagtgattaagaagagaattttggctaaaacggctactgctgaacaaacactgagattgctttacgagcaaaaagcaactatcattaaaaacctgatagttttcaatgatggtgtagagaaaaaactatattccgatgatgatgactttgctgccgtttacccctttgtgccttatcaatttaacctgctggccggtgtcctgacctccatcagaacccacggggcttccggcaagcatttgtccgagggagagcgctccatgattgccctgttcaaggaatctgccatgaagcttatgcatgagcagtccggcgccatgattcccttcaatgtcttctacgatgcgctgcaccagttcctggaccacagccataagggggttatctccagagcgctggacaatgacttcattaatcccgaccatgaagttgactgcttcaatgttaacgtcctgaaaaccctctttatgattaaatacgtcaaagagattaccgccaacattgataatatcaccagtctcatgattcctgatattgacaccgaccgcattgctttgaaaaagcaggttgaggaagctcttaaaattctggtccgccagatgctggtgcaaaagaacggcgacatctatgtcttcctaacggatgaagaacaggaaatcaaccgtgaaattgaaaaccagcacgtggaaatgtccgaggttctcggcaaggtttctgagctgatttttgaagatattttcagcggtaaaaagtatcgctatcctgcctttaatggacggtatagttttgcctttaatcaaattgtcgacgaccgtcattataaggccaaccagaaccacgatattggtgtgcgggtactgaccccaaattccgattatggggcacaggaaacaactctgcgtctgatgtccggacagggcagggaagttctggtcgtgttgcccaatgacgctgcatttttaaacgaaatgacaagtgcgctgaaaattgaaaaatacctgcgatttgcatcttctaataatgcactggttaaatttgagcagatcaaagaagccaagcgggtggaaatgcgggaaagaggcgcaaacgccaagctatttctaattgaggccatgaagaacgcagatatttatgtcaacggtgacaaagcgccaataggcgcaaaaggtgtcaccgtcagaatcaacgatgcccttggccgtctggttgccacggtgtatcacaaactgccttatattgacgtagcaatgagtgaagctaacatcaaagctttgtttaataatacaaaacaactgaccctgacgctggaaggtggcacagaacccaatattcatgccctgaatgacatgcttaattatattggaggaaattcctccatgcacatgaaaacttccatgaaaagcttaatggatcgcttcatgaaagccccttacggttttgtggaagatgatgtggaatggttggtggccaagctattcaaaaacggcgatattacattgaccgtgaatggcagcacggttaccctgctcaataaaaccggggatgaaatcgttcgttatattactaagaaagaatacgttgaaaagctgctggtcgaacgtcgggaaaaagccacagataaacagaaaaaggctgttcgtgaagttatgaaggagttatttggcgtatccagtatccacgatgacgatgattctatgatgcgttccttccaaagctacagccagactatgctcaacgagctggagaaatttgaaatcatgtataacagccaaaatctgcccggtaaaaagactgttgcaaccggtaagggtttactccgcggggtcatccagattctgtccccggtggaattcttccaaaaaattaatcatgacaaagatgattaccttgattttgctgaggattatgagcctgttaaatcgttctttgccggtgaacagaagactatatttgaacgtgcattgcgtttaatgaaaatttatgatgaaagcaagacctttattgtggatgaaaaagttgaagaatatgtcgctgcggtaaaagctattttgcataaagatgcgccttacagtgacatacccaaactccctgaactgctggataactttaacgaggcatacgccggtgtcctggaaagcatggtagctccgattattgcagccattgatgatgccaaagccagggtatttgaacttttaaacaccaaaacttacaaggctgagttcagagagcgcttcatcaagctttttgatgaacttcatgataaggccactcattgtaataatgtggcgactttgcagaatatcaaagtggaagctgatgccctaaaagtacgtttgctcaatgagatggacaaaaaggacgaattgcttgcagctcagagtgtgaaggacgtacgggtgaaatatgggcaaaatggtggcaaaatcgttgttcctcagcctaagcctaaaatgaagaaaaagaaaaatattagtatcaaaactatcagcgtttcttcttcttggcgcattgaaactgccgaagacgttgaaaaatatatggctgctctgaaagaacggattttaaaagagctggaagaggataccatcgtaaatattgaattttag

SEQ ID NO: 347 - DNA, 3456 bp, Vibrio cholerae; identical to SEQ ID NO: 239

SEQ ID NO: 348 - DNA, 3672 bp, Enterococcus faecium; identical to SEQ ID NO: 296

SEQ ID NO: 349 - DNA, 3678 bp, Vibrio shilonii
atgaatattaaacaactttttacgaaagatatcgctcgccctatcaatggcgttgttaaagcagatcaaaccgaaaatgaaaccgtctttgtcgaacttgatgaatacgtcatcacgaatgaactaaaagagcatatagagaacttttttaaattttatatgccctctgtgtacgacccagaacaagctgcgatcactggcaaatcagggatttgggtttctggctttttcggtagcggtaaatcgcacttcatcaagatcctgtcataccttttgaaaaatgtgtcagctactgatggaataacgactcgcacagcgtttgattttttctctgaaaaattgaaggacgatgcattcctagttggtgacattgaaaaagcgatccagaaagacaacaaagttatcttattcaatattgatagccgagccgacactgatgacaaagaagatgcgattcttaaggtcttcctaaaagtatttaatgaagaaatgggctactcaggcgatcatgcgcatattgcccacttggagcgagaactcgattctcgtgggcagtttgaaggctttcaaactgcctttgagtcaattacaggtgaaagttggctagaacaacgggattcctatgatttctaccgtgatgacatggcagaagcactggcacaggttacggggcaatcattagattccactaaactgtgggttgagagaattgaagaaaacttccctttggatattgcgaatttctgtaagtgggtaaaagaataccttgatgggaatcccgatcgccgcttgctcttcttcgtcgatgaaatcggtcagtttattggtaaaaacacccagatgatgctcaaactacaaactatcaccgagaatctcggaacaatttgtggtggtcgcgcttgggtgatcgtgacatctcaagccgatatcgactccattgttggcggtatgcaaggctcaaaaagccaggatttttccaaaatccaaggtcgatttgaacgtatttcgctttctagctccaatacgaatgaagttatcgaaaaacgtctactaagtaaaacagaggaagccaagagtcacctgtctgaactctatgatgccaaaggcgatatcattcgtagccagttgagctttgagcaaagcaatgcggctgagatggcgaactatcaaagtagcgatgatttcatcaatacttatccattcgtaccgtaccaatacaacttggtacaaaagatcttcacaggcatcagccgtgctggtgcttcagggcagcacatgagtcgtggtgaacgttcgttgattgacgccttccaaatcgcctcaaaagagtttgccgataaaaacgtgggtcgcttgatccctattcacagtttttatcactctattaagaagtttcttgatgatgctgtcgtgcgtgacattaaccatgccgcagacaaatcttccatcgatgaatttgcagttcaagttctgcaaaccttatttatgatccgttacgtcgatgaagtgaaatctaatattgataacttggtaaccctttgcatcagcgaaattgatcaggacaaacgcgcgttgcgactggctattgaggctcgtcttgaggtactagagcgtaacaacttaattgctcgacaaaacgatgagtacattttccttactaatgaggagaaagagatcgaggaagcgattaagaagaccgatatcgaaccttcagatgagacaaccgaactgagtaacatcatctttaacgagatattgcgtcgcaacaataactatcgttacccagagaacaagcaagacttcccagtagctcgtttttgtaacggtgttccttttgagcgcaatttagacagtgatattttgctgaaagtcgtttcgcctattgataacagttacgacgaatacaacgacgctacctgtgcaaacttttcatcagattgcattcttgtcaaactgaatgatcaccctcgcctatttgatgatcttcgcacttatattaagacggaaaaattcattcgcaaaagcagtagcgcctcaggctcgagtcaagaacagatccgccgcgataaagccaacgagaacatgaatcgtcgtaagcgattagtcggagatctcgaagaactcatcaaagagtctgatttttacacgcttggctctggctttgatgcaaaaggtagctcacttgccgtgatgctagagggagcctaccgctacatcattgaaaatacttttggtaagctcaaactgatcaagccattccctggaaacatcttaaatgaaatccagcaaactttagccgctggcgatacggcacagattggcctcgacttagcgggtgaagaagccaatccacttgcagtccttgaaatcgaacaacacgtttctttaagtgatgaccacggttacgcggtcacggcggccgatatcatcaaaaagttctcaaaacgtccttatggctggaacaccgatgagatcatcctaatattggcacgtcttggtcttgccaataaacttgtgtttcaggctaaccaacaggaagtcccgttaaaaggcttatatgagcatctaagtaagtctcaaaaaagagcgaacctgcgtattcgccgtatcaagcaacaatctgaagctaatcttaaaaaggcagcgaagctgtataaagatcttagctttggcaccgctcctagcgccgaaaaagagttatttaactcagcagttgaaaagttaaatcaatggctgactaaattgagacgattcaaatctatgtcatcgactggccattaccctggtggtaacgagatcgatgatggcgttatgttgttatcaggcttaacggaaatcaaaaccagcttccagttcgttgatgaattcatcgctaaaaccaacgacctgctcgattttgaagaagactatgagttactggaaaacttctacgaaactcagtttacaagttggcaagggctagagcgagctttaaatatcaccttctccgcaaaccgtgcgttccttgaaaaaaatgcagaggcaatggctgcacttgataaactgactgctatttatcacaacgcatcaccgtatcgagatattcgcaatattcaacctctggttgagacgctgacctcaatcaataaccaactgattgaaaaacagcaaagttacactattaaaaagctcgaacaacgtattggtgaagttaaagaactgattgaaaacgctggagcaagtgcagagatcagcaataaagcattattgcctttccagaacgcaattaaacgcgttcaacgtgaaaacagtgtttcgcagattaaacatgagcttatcgaagcggatgattggtttaacgatgcggaaaaggcagtgaacgcctacattcttcagcagcaagcgctagcggaaaaaacgcaagaagcacaatcttcaaattcagaagccaccgactcaccatcatcaacgagtccgtctactgcgaattatggttcatcgacgacagaagcaatgcctgtccgcgaaaaagcgcccaaggcaaagcctactcaagcaattgatgcgatggaagtctacagagaagtctctgaggcgacttatatggaaaccgtcgaagatgttgaaaattacctgaaggcgctgcgcgataaactggtcactctcgttgagagtaaccataaagtacgcattaaatag

SEQ ID NO: 350 - DNA, 3483 bp, Brachybacterium paraconglomeratum
atgaaactcagcgagatcttcctcaaagatgtcacccgctcgatcgagggcgtcgtcaaggccgacgacgttgaccacctaggtaccgaggtcgaggagtacgtcttcaccaacgacgccgccaagggtgttgcgccgctgctggaggagtactccaactacacgaacgctaacggcgtctggatctcgggcttcttcggctccggtaagtcgcacctgctcaaaatgctggcccaccttctcggcgacgtcgacggccaggcgttctcccgcgagaaggtgagcgaggccttcctcggcaagaccgacgatgcgatgctcattgcttcgctgaggaaggccgccgcgatcccggcgaagagcttgcttttcaacatcgatcagaaggcgacgctgatcgccaaggaccagactgacgcgctgcttaaggtcttcgtcaaggtcttcgacgagagccgcggttacttcggtaacgacggtgctgtcgcccggtttgaggaggatctcgacaatcgcggccagtatgaggcgttcaaggccgccttcgccacgcacgccggtatcgactggtctcaggggcgcgagcagaccgccctggaaggccacaacatcgacaaggcgttcgctgaggtcaacggcgaggcgaaccccgggatcatcgggcagtaccagaagtcctatgccgtatcgatcgaagatttcgccacctcggtcaaggcatggatcgacaagcaggaaccgggctaccggctcaacttcttcgtcgacgaggtcggccagttcatcgccgacgacgtcaagctcatgctgaatctccagacgatcgccgagtctctgaacacgaagtgcaaggggcagtcgtgggtctttgtgacctcccaggaggacatggacaaggtcatcggcgaccgcaccaggcagcagggcaacgacttctccaagatccaggcccggttcagcgccaaggtcaagttgaccagccaggacgttgaggaggtcatcagcaagcgtctgctggagaagaatgttgtcggcgctgccgccctcacgtcgatctactccaaggaagcggcgaacttcccgacgatcttcaacttcgtcgatggcgcgaagacctatcgcaactacgttgacgaagcccgcttcatcaatgcctacccgttcgtcacttaccagatcccgatgttccaagccgcgatcgagggcctgtccgaccacaacatgttcgagggcaagaacagctcggtcggcgagcgctcgatgctcggcgtcgtccaggaggtcgctaagcgcatcgacggcgagcaggtgggctacctcgccacctttgaccagatgttcgcggggatcagcgccgcgctgaagtcgagcgctcagagcgccatcctccaggctgagaagcatctgcctgaccccggtaccgacgtcacgatcctcgctaaccgccttctcaaggccatgttcctggtcaagtacgtcgacaccttcaaggccacgcctcgcaacctcaccgtgctcgtctacgaccgcttcggtcttgacctcaccgggctgggcaagcaagtgcagcaggcgctcaacctgctggagggtcagtcgtacgtccagcgcaacggcaacgtctacgagtacctcaccaatgaggagcaggagatcgagaaggagatcaaggcggtcgacgtcgactcctccgaggtctcaagcaagctcttccggtacctctcgtccgaaatcctgagggtcaacaagctcaagtacgcgaagaacggccaggacttctccttcggctacaagcttgacgacatcgtgcagggaaaccagcgtgagctgaccatccacttcatcacgcccgagacgagctacagcgactccgagatagtggcgcacagcctgggtagaaatgagctgcgggtatttctcggccgcgacaaacggctgctcacggatctgcgcctgcttctcaagacggagaagtacaccaagcagcgcaccaactccggcgtcacgccctcgatgcaggcgatcctccagtccaagcaggcactcaatgccgaccgcgggaaggaactcatcgagcgtcttcggcaggccgtcggcaaggcgcagctgatcatcaacggcgccgaagtcgcttccaacgcgcaagacgccgtcacgcgcgtggccgacgggttccaggaactcgtcaaccgtacgtacacgagcctcggcttgctcggcggcaaggtattccccgagcagcaggtcgccagtgctgtgcagaacgacaagggactgttcggcgcggggacgctcagcgcgctgaactcgccgggcaccgagatggagtcttggatcattacccagacgggcctgggcgaacaggtgacgatcaggaagatcgtcgaccgcttcgagaccaaaccctatggctgggaccttggttccatcgaagtcgtgctgggatggctcgtcggcaatggcaaggtgacactgggcgttgactccaacccggtagtccggactgaggcagcggccctcatccgaaacactggcaaacaccagcacgtcgtcgttgccccgcagaaggcctatgaccaggcgaaggttgccacgttcaagaggttctgcagtgacttcttcgacgagggtgcagtaccgagcgaccccaccgaactcgcccgattcggcaaggacaagctcgcggccaggcgcgacgaacttaatgcgctcgtcagcagcagccggtaccccttcgtcggcgagctcgccggcgtcgtcgctctgctcgacgaggtcgccggcaagaaggccgactggtacctcaccgacttcgataaggccgatgaactgctcgaagccaaggaagatctgatcgacccgatcaagtcgttcctcaacggccagcaggccaagatcttcgacgaggcacagctcctcctgagcaccaacgccggaaacctcggctacctccccacaggaagcgccgatgcggtaagagccctgctctcggatgccaacgctttccgcggcaacaagatgaaccagctcaaggccgctactgacaccctgcgggggcagatcgacgaaatcgtcacggacaagcgtgaggaggtggccgcggcgatcgagggtcgcaaggcggagattctcgggagtgcctactacgccaacgccacgctggccgcacaggagagcgtgatccggcggatcgacggcattcttgcgcgtcttggtggcgagactcaggccgcgctcatcctccaggccagagcaagcttcgagcaggacgactacccggagctgctgagcatgctcgtcgaggcgcagcagggcggggatgacgacgccccgccgccgaagccgatcgtgtcagtcaaatcgattagcgtgcccggcgcggcgggcgtactggagtccgagactgacgtcgacaactacctcgccaagtaccgggccgcgctcgtcgcgacccttgatgacggaaagcgaatcacgctctga

SEQ ID NO: 351 - DNA, 3642 bp, Salmonella enterica; identical to SEQ ID NO: 8

SEQ ID NO: 352 - DNA, 3633 bp, Eubacterium cellulosolvens
atgaaaatccagaatatgtttgagaaaaagattacccgtgagattaaaggtgtaatcaaggttgggcagaaagatgacgagaacgtatatcaggaattggatgaatacgttgtcactgctgagttggaaaaatacatgaaccgttttttcgatgcgtataagcgaagtgttaccggtagaacggacaatatgggtgtctggatttccggtttcttcggaagcggtaaatctcacttccttaaaatcttatcttatatcctcagcaatagagtggtggaagatgaaaatggtgcaaaaagggaagcggtttctttctttacgcagggtatcaaagtcgaggacagaaaactgaaagacaagatcgcagaggtcgcttccgatcgtggagacatcgatgtaattctttttaacgtagattcaaagagtacaactgattccaagattaataaagaagctatcaaagatgtattcatgaaagtttttaatgactatcttggatactgcggttcaattccgtttcttgcagatttcgagcgtaagctggatgatcagggacagtacgaagcttttaaacagaagttcgaggagatagaagggatttcatggaaagaaggtagagaagattattattttgtgcaggattccattgttcaggctattactgaacttggaatcatgagtgaggagtcggctcggagttgggcagataatgcagaaaagtcttatagcttatcgattgataagtttgctgagtatgtgaaaaagtactgcgataagaagggcaagaatcatcatattcttttccttgttgatgaaattggacagtacattgcagatgacagcaagttgatgttgaaccttcagactgtaacagaagatcttggaacagcttgcggaggaaaagcatggattattgttacatctcagcaggatattgattctataacccagacaatgggagaagatttttccaagattcagggacgatttgcaacaagaatagctctttccggagcagatgcagcagaggttattaagaagcgtatcctctacaaaaagcctgaggcaagacctattcttgagaacttgtataaggaatacgagtcctcaattaaaaatattatcacctttagtgaaggtacaccgaacatgccgctttatacagatgctgaggaatttgcagatgtctatccgtttattccttatcagtttaagttggttggagatgtccttactgcagttcgtcagttctcttccagcggtaaacatcttgctgatggtgagagatcacagcttgctttgttcaaagaagctgctgttgcttatgccgatgagagagagggtttattagttccttttaacgctttctacagtgcgttggatgactttattgatcacacccatagaatcgtcatcactcaggcatcaagaaataccagactcaacaattttgacgtcgaactccttaaggttctcttcatgacaaagcaccttaataactttaagcgtgacgtagagaatcttactactcttatgatctcaaaagtagatcaggatagattggaattatctaaggctgtagagaagtctttgcgtgctctttgtgatgaagcacttgttcagaagaatggtgatgagtacaccttccttacaaacgaagaacaggaagcggaaattagaatccagcattacaatatcgaccctaaagatgtggttgattatgtagcacaggttgctttcgaggaagtaatcgtattcccgaacaacaaatacagatataactctcgttatcaattctcctttaatcagttgattgatgacaaggcatatagaaataatgtgtctcataaaatcgggcttaaacttctgactgcatatagtggtaaagaagatgagcgtgttcttagtttgctttcatatcaggagaaatgcgttgtcgttcgtttgtcagatgattatgcatacctttctgaaattgatggcatgaagaagattgaagcttttttgaatgatccgacatctgcaaaccttactgacttcgatatcatcagtgcaaataagagaaaagagcgttctcagaaagcaaaaagggttagcgattacatacgtttttcgttagagaatgcggatatttatgtggctggttccaagatttctacgaaggcaaaaggggttacagctcgtatttcggaggcatttgaaaagctggttaacagtgagtaccacaaattgaaatgcatggagtccaagccatcacagtcagacatcttaagtctattaaagcagacgaaaactcagatgaacacgagtgattttggaaccgggaatgaagagaatcatgatgcgcttctggcgatgatagatgaaatcagatatgccggtgctcatgctgcacagtattctgtaaagcaggcattggatcagtttatggatcctccttacggatatacagaagaggatattgagtttcttatcgctactttgtatcggaggggaatgatcagtttaaaggttaacagtatcatatatacgcctgcgagtacaacaccagaggatgcatacaagtatattaccaagagggagtatcgggaaaaggttctcattgagataaaggaggttgctccgccacagcatataaaggcggtaaaagatgttatacgcgaattttacgggaagacggtaaccacagatgatcaggattccttaatgcgcgattaccgcaactatgcaacaacaaaaaagggtgctatcgaggaagtgcttcgtgaggactatggagttagttcaaaacttcccggaaagaaagtccttgaaaagtcgttaagacttattgatgagactttgaaaattagtgatccaatcagcttctacaaacgagtagatgaactgtgtgatgactttattgaggtaggccttgatattgctgatctgaacagtttccttggcggcgtgcagaagaataagttccttcatgcagttaaggtgcttggaatttatgagaacagtaaaaactatatctctgatcaggagatcattgattatgctacagaagtaaagcggattctcagtgtcgaaaggccttactcattcataccgaagcttgaagagtatgataacaagctttgggatgcaatcatgaaacttcttgaaaaggatacacagcgtattcagcccgatgtgtatactgactggaagactgtaaaaacaagtattccttctgacaggccttacgcacagagagtgctggataggattaatccgaaattccaggatcttattgacaagcttgagaagatcacagatatagcaactttaaatggtattcctgctgagagtaatgcattgcttcagaattgcttacgcatgattcagaccgaagaggatgcattccaggcggaagttgagcgcaagaagaaagaagctgagaaacagggtggcggaagtgatgctccggtagtatctcctgtggaaccagttaaggttatcaagaacaagcctgtttctttcagaacaattacaggaaataaaacatattcgattaagacggaagctgatattgatcacatgttggaggaactaagaacggcactgaaagctcagctggaagagaatacgattatcaaacttagttaa

SEQ ID NO: 353 - DNA, 3714 bp, Pseudoalteromonas luteoviolacea
atgcaaattaaagacttatttataaaagacataaatcgtccaatcaatggcgtagttaaagctgatcagttagaaagcaacactgtctttaccgaacttgatgaatacgtcatcaccaaagaactcgcgacccattttgaagagttttttgatgcttatatgccttcggtccgcgatcctaagaaaaaggccgaatcaggtaaaatcggtgtttgggttagtggtttctttggatcgggtaaatcgcattttattaaaattctttcttatttactgcaaaacatcaaagcaacgaatggtgagattgacagatcagctattgagttctttaaagacaaaaaccttgatggttttttacttggtgaaattgacacagccgtaaccaaagaaaatacggtgatcttatttaacattgacagccgagcgaacaccgatgaaggtgttgatgccatactaaaagttttccttaaggtctttaatgagcaaatgggctttagtggtgatcacccgcacatcgcacatttagagcgagaattggatcaacgcggcgtattccagcagtttaaagaagaatttaataccttaacttcatccaattggcttgaagaacgcgatgcctatgacttttatcgtgacgacatggcagaagcgttaggtaaagtgactaaccaatcaactgaatcggctcgccaatgggtagaacagttagaaaataactttacgctcgatatcgccaatttctgtaaatgggttaaagagtatttagatgctgacttaaatcgtcgagttttattttttgttgatgaagtggggcagtttatcggcaacaacactcaaatgatgctaaaactacaaaccattactgaaaacctcggcaccatttgtgaaggccgagcgtgggtcgtagttacctcgcaagaagatatcgactctgttattggccacatggcaggctcaaaaggccatgacttttcaaagatccaaggccgttttgaacgcctatctttatcaagttcaaataccagtgaagttatcgaaaagcgtctgctatctaaacaagaacaagctcgtccggttttacaaacgttgtacgaccaaaaaggcgatattcttcgtaatcaactagcatttgatagtacaactaccgcagaactagccaattacaaagacgccaccagttttattcatagctacccatttgtgccgtaccactacaatctagttcaaaagatatttgaagcaattcgtaaggcgggggcaaccgggcttcacttaagccgtggtgagcggtcattgttagatgcattccaaagtgcggccaaacaagttcgcgatcaagaagttggggtattaatccctttgtattacttttatccagcaattgaaagctttttagatacgtctgttaaaaaagacatcgatcaagcagcagagaaagactcaatttcagactttgcgctaaacattctcaaaacactattcttgatccgttacgttgacgtaatcaaatcgactatggataacttagtaaccttgtgtgttagcaaggtagatgaagaccgtttaacgttaagacgcgatatcgagcaagcactcaatgcacttgaagccaacttactcattgcacgccaaggtgacgaatacatcttcttaaccaacgaagaaaaagaaattgagaatgagatccgagaaactgaaattgaattatcggatgaaactaaaaaactcagcgatttaatttttgatgatgtactgcgcagagataatatctaccgttatcctgaaaacaaacaagattttccaataagccgcttctgtaacggtatgccgcgtgatggctctcaggaaaatgacttagtagttaaaatcatttcacctatcgatcctaattacagtgaatatgattctacggtttgtgccaatcaatcacaggatggcctatcttctggtggagccggagcgattattattaagcttgctgataacagcaaagttttcgatgaaattcgtacattcataaaaaccgataaatttttacgcagaaacacaggtaataggccagagcaacagcagttgttgcatcaaaaaggttctgaaaaccaagatcgcaatcgccgagttaaattagccattgaagatctgttaaaagatgcggaattctatgccttaggttcacaacaaaatccaaaaggtggtgcaatcagcaccatcttacaagagctatacaagtacgttatcgaaaacactttcagtaaattaaaactggttaagccgttcgaaggtgatatacgcagagaaattcaaaacaccttggtcgccgatgacatcggtcaaataggtttagatctgcaaggccaagaagttaacccacatgctattttagaagtcgagaaatttatttcgcttggtgatgatgccggaagaccaatcacagcggaagacattgtaaaacgtttctcaaaacgacctttcggctggaatgatgaagaaattgtactgatcatttctcgtctagcattagcaaataaaatctgcttccaaagccgtcagcaagacgtttcgttaaagagtgcttatgacaacttaatgcaagtgcgtaaacgcgcagagcttcgagttcgtcgtattaagcaacagtcagaagcaaatctaaagcgtgccgcgaaattgtttaaagacgtattccaaaagaatgcgcctgaaagtgaaaaagagttgtttaacgttgcgcaatcaaactttgccaatgtaaaaagcaagttagatgcgttcgccaacaaagcttctaccggtcattatccgggagttagtgaaattgaaaatggccgagtgttattggctggattaattgaaacacaatccagcttccaatttattgagcaatttcttgcaagcgaaaacgacttactcgattttgaagaagactatcaagatatagaagacttttatgaaacccagtttgcaacttggcaaaagcttcatagagcgctaaccattgactttgatagaaaccgaactgcattagaaaaagataacgatgctttagctgcattgaaaaagctcgaaaatatctacaacaaacctcgtccatatcgagagattaaagatattgagccgttaatcgaatcagtaagcaaagttaatgatcagctattacaagacaaacgagcgcatgcaaaatctcgcattgaacaccgtattgagcaagtgcaaaagcaaatcacggcggcacacgtaccaagtgaactaagtaacagagcattacgaccattgcaattagccttacaaaggctcgatggcttaagtggaattgctgagatcttacaagaacaagcagattcgattaatttagaagaagacgcttatgatttgatcaacaagcatatcgaagatcagcaagcgttagcagcaaaacaacctaaagaggcagcatctaattcaacttcggattcaagcgctgcatctggttctactacaaacacaggaagtggcggctacgaatcgccatcgactgagcctcagcaagtcgcagagccagcggtaaacacgccaattccaaagaaaattgtgtctatcgataccgcgagcattattcgcgatgtgaatgccactggcgtcattgaaaccgagcaagacatagacacttaccttgcggcattaaaagaaaagctcacctcgttagttaacagcaataacaaagtgcgcattcgttaa

SEQ ID NO: 354 - DNA, 3666 bp, Clostridium perfringens
atggaagcaaatttaggatccatgttttataagaagatagatagacctattaaaggggttataaaggttggacaatcagatgaggaaaatgtaaagcaagaacttgaagagtatgttgtgactagagagcttagtacgcatatagataaattttttgaagcttacaaggaagggattcttggaattactgataaaaatggtgtttggatatcaggattctttggaagtggtaaatctcacttcttaaaaatactttcttatcttctagaaaacaagaagattgacgaaaagagagcagtagaatattttaatgataaggatttagacaatttcaccttaggcaatatgaaacaagcaggtgatatttcaagtgatgtaattttatttaatatagattcaaaatcagattcagactcaaagtcaaataaagatgctattgttaatgtatttaacaaggtatttaatgagatgcaaggattttgtggttctatgccttggcttgcagatttagaaagacaaatgtgtaaagatggagtctatgaagatttcaaaaaagagtttgaagaaatatcaggaacaccttggatagaagctagagaagacttttactatgaagaggattctataatagaagctttagcaaagacaacaaaaatgagtgaggaagccgctagaagttggtatgataaatgtcaagataactattctttaagtatagacaagtttgcttctaaagtaaaggaatattgtaaatcaaaaggagcaaatcaccacgttgtattcctagtagatgagattggtcaatatataggagacaacactcaattaatgctaaatttacaaacagttgtagaggatttaggaactaagtgtgaaggaaagtgttgggttatagttacttctcaagaaggattagatgaatttacaaaagtaaaaggaaatgacttttcaaaaatacaaggaagatttaatactagactttcactttcatcagcaaatgtagatgaagttattaaaaaacgtatattaagaaagaaggattgggctacaagtcacttaaaagttttatatgagcaaaaggaatctataataaaaaatcttttaacttttacatctgacactgctgagatgaaattatataaagatagtgatgattttgcagaggtttatccatttgttccttatcaatttaatttactacaatcagcctttaatggagtaagagaacatggagcatcaggtaaaagtttatcaaaaggggaaagaagtttacttggggcttatcaacaagttgcaattgagtatatgaataaggaatcaaatattcttataccattttcagcattctatagtactatagaaactttcctagactcatcaataagatcagttattatgaaggctgaaataaatgataagttagaagagtttgatattgaagtattaaaacttttattccttattaaatacgtaaaagaaataaaagccaatatagaaaacttagcaacattattagttgatgatattgatatatcaaaaaaagaattaaaagataagttaaatgattcattaaagagattaatgagggaaactttaattcagaaaaatggagatgaatatatattccttacaaatgatgagcaggatgtaaataaggaaatagataatatatttatagaaactggtgatgttgtaaacaaaattggagagataatttttgatgatatatatggagaagctaaatttagttattcaagaaagtatatattctcatttaataaggctgtagatgatagaccgagaggaagccaaaataatgacataggagttaaggtcataacagctgcctttgatttaagtggagatggagatcaatttgctttaaaacagttatctgtaagagaaaataatgttatagttgatatttcaaaggattcaaattactttgaagaaatagagaatgttttaaaaatagattcctatttaagagttaaaagtggaagtaagtcttcaattgctatagaggatataaagactaagaaaagcagagaaagagaagaaagacttaagagatctaaatttttaatagaagaagatttaaaaacttgtgatatttatgccaacggaaatcttttagagataaaagaaaagaactgtgtagatagaataaatgaaggattaaaaagcttagtagattctaaatataataagttaaactatgtaaaagagtttaaaaatggaatagatgatttatatggaatcatggataagagagtaaatcaattatcaactcttgatatggaccaaaatagattagctgttgatgaggttagaaatcatattgagcagaactcaacaagaaatttaccaataacagttaagagtgttttaaccaaattctcaaatgctccatatggatggaaagagatagatatacaaggaataatagtaaccttatttaaaaatcaagatataaaggttatttataatagtgaggttttatctccaaacaatagagatgttgttctttgtgtaactaagaaagatagagttgagagagtaaacttaaaaataagagagaaagttcctaataagtatgtagataatttgaaggatataaatagtgaattatttggattttcatcaatgccaagtgacgaagatggaatgatgaacttatttaaagatcaatgtaaaacagagcttaataaaatagacgcaatgctaagttgttttggaataatgagttactatccaggagaaaaaactcttaaaaaaggaaagggactttttgaagaaatattaagcattggagatactttagagttcttcaaaacagtttatgaattagatgatgattttgcagattatatagaggatatagaggatataaaaaaattcttctttaataaagagaatggaagaatagacactaatacaaataaaggggagcaaagaaaaatctttgatgatgctattaagactgtaaataactataaaattaatgaagcatttatagtagatgaagatgttgatatcattataaagagtatagaagtaatcctaagaatggcaaaaccttatggaaagataaaagatattccagttttaattggaaaatataatgataaaatagttgaattattagaaataaagagtgaacctgttatagattttatagaaggttgtaaaaaagaggttttagaaactttagataatgaagaggtaaaagaaaagttttctaataagatattagaagaattcaactcccaaatagaaaaggttgaacattcaaaaagttttatggaattatcttcaatgaaagaaccagctgaaaatttaagattaaagtggattcaaaaaataataactgaaaatgaagttattaaaagaagagaagaaagaaagctttccgaattaacttcaacaaggggagttggagaagaggaacctaaaaatagttacggaaatgataatgaggttccagtagataaagtaaaaccagtagagattatacaagttaaaactaaagctgttagcgtaagggaacttgtaaaaggggaaaaaataataaagaacgaagcagatattgatgctgttattgaaagcttaagaagaaagcttaaaaatgaattagaagaaaatactattataaatttaatataa

SEQ ID NO: 355 - DNA, 3672 bp, Enterococcus faecium; identical to SEQ ID NO: 296

SEQ ID NO: 356 - DNA, 3678 bp, Vibrio cholerae; identical to SEQ ID NO: 122

SEQ ID NO: 357 - DNA, 3642 bp, Escherichia coli; identical to SEQ ID NO: 56

SEQ ID NO: 358 - DNA, 3456 bp, Vibrio cholerae; identical to SEQ ID NO: 239

SEQ ID NO: 359 - DNA, 3456 bp, Vibrio cholerae; identical to SEQ ID NO: 239

SEQ ID NO: 360 - DNA, 3729 bp, Fusobacterium ulcerans
atgaaaagtgatttgagtataaaagatatacttcaaaaagatattacaagaaaaataaatggagtagtaaaagcagaaagtaatcaagaagaaactataataacagagttaagtgaatatgtggtaactgaagaaataagaaaacatttaacaaaattttttgataaatatgtagattctttaaatagttcaactgaagatataggagtatggatttcaggtttttttggatcaggaaaatctcatcttttaaaaatgattggtcgtatattagaaaataagaaatatggagagaaaaaagtaacagaattttttgaaagtaaattaaaagatgcaatattgcaaggaaatatagaaaaagcatctgaagttccaactgatgtaattctttttaatatagataatgttagtgatcaggatacttatcaaaataaagatagtattgcagtagcatttttaaaaaaatttaatgaatatttaggcttttcaagagatgatataaaagtagctgaatttgaaagaatgctttgggaagaaggaaaatttgaagaatttaaaaagttttttgaagaagaatcagggaaaacttggaaagatggaagtagaaatttagattttcatgctgatgaatttcttgatgttatagaaaagatgcagattatgactagagaaagtgcagagagatggcttgacaaagaaagtataaaatctgttagtgcagaaagttttagagatttaatagaaggatatttaaaaataaaaggagctaagcaaagaatagtatttttggtagatgaaatagggcaatatataggtgaaaattctcaacttatgttaaacttacaaactttagtagaaactttgggagtaaaatttcaaggaagagtatggataggagtaacatcacaacaagatttaggaacaattttaactgcaaacgatagtagaagaaatgatttttcaaaaattcaagataggtttaaaactattttaccattatcaagtgggaacatagatgaagtaataaagaaaagattattagaaaaaagagaaattgaaagagaagatattgaaaatttatacgaaaaaaagagaattgatattgaaaatttaataagttttgataaaaaaggaatgactctttctttgtataaagataagtttgattttgctgagacttatccttttgtagggtatcaatttaatttattacaaaaagtatttgaaaaagttagagaaatgggacattctgggcaacatatgtcaagaggggaaagatcgttattgagttcatttcaagaagcaggaattagagtaaaagatatgtcattgggaacaatagttccatttaattatttttatgaatcaatagaacaatttttagaagataacgctagaagacctattattcatgctaagaatgaaagaggtattgatgaattcggattagaagttttaaaattattattcttattaaaaggaatcaatggaatagaacccaatttaaatactttagctagttttatgattaattcaatagaatgtgatagaattaatcttgaagcaaaaataaaaaaagctttagaaaaattagaacaacaagtattaatccaaaaagatggagataattattattttcttacaaatgaagagcaagatataaacagagaagtaaatcaagaagaaatagattttaatgatatatataaggaacttgattcatatatttttaaggagatttttaataaaaataatatttcaattgaggaaacaggaaataaatacagctttagtagaaaaatagatgaatatccttttggtaagctaggagggcaaattgatatagttatttttacccctagtgcagataattataataatatagaatttattggtttgagagaagggtatgatcttattattaagcttccagaaaatcaagaaggatatatggaagaaataaaaaaatctttaaaaattgagtcatatataaagagaaaacaaagagaaaatgtaagagaagctgtaattagaatactagaaagcaaacaaagagaaaatcaaaatagaaaaagaagaatacaaaataatatagaaatagctttacaagaagcagaagtatttatatatggacataaaatcagtataaaagcaaaagatgctgggaaagtaatagaggaagcacttaaagctgctgctaattatagatttaaaaatgcaagattaattgtaaaaaaatatgatgaaaataaaataaaagaagtattaacatatgatttttctggaaatgatcaacttattaaaatagaaaaagatttagagactaatgtaaattgtgaagcaattaaagaagttttaaataagattacaatacaagaaaaaagagggatgaatataacattaaaggatttatctgattattttacaaaaataccttatggatgggatcaattttcaatcaatggaataatagcagaactatggacatataaatatattaatttagaagaatcaaaagtaatagttacagaagcaaaagaagcaaaagaacttttgataaaatctcaaaatagaaatttagagagagtggtaataactttaaaagaagaaatagatatagaacttataaaaaaagtgaataatatattaaaaagtttttttggaaatggagttgagattaccaataattcacccaaggaagaattatttgttattcttaaggaaaaaataggttgtgttagcaaatatgaaagtgaatataacgaaaaaaattatccaggaaaaaaagaattgaaagaatggaaagagttattaaaagagatacttttttctaaaggaaaagcggaaaaagtattacaagattttttagatatggaagaagagttgtatgatttatatgaaaagcaatcaactgtagtagatttttttactaattctaaaaaaagaaaatatgatgaagctcttgataaaataaaaagaattgaagaatatattgattttgttgggagtttgaaagataattctgcctataatattcttttagaaatagttagggataataatccgtattcaagaataagagaaatagatgatttgatatctgctataaatttagaagaaaatatattgattgaaaatgaaaaaaataatttaaagaaaaaagtagagaaaaaaaatgagtttttctcagaagtattaaaagatagagatgctattttaaatagggttaacaataatctgcaagattttattgaagaaataaataaaataaaagatacaaatatttttttgagaggaagaaagttagaaaatattatatttaatatagaaacagaatatagaaatagtattaaagaagaaattaatagtatagaaaaagagcttattagtatattagaagataagacagatatagaagaacttgtaaaagagataaaagtaacatataatagttttaaggaagaagtagaaaaaaaagaattagaaaatttagagaaaataatagaaatggcaaaaaaagataaagatggattcattcaacaaagtaatggaaaagctaaaaaaaaggaaagaattaaactaagaaggataaatgtaacttcaaaatataatttagaaacagaagagcaagtacaactttatataactgaattagaaagagaaatagaagaattaaaatttaaaatgttagaagctattaaaaaaaataagatagtagatataaattga

SEQ ID NO: 361 - DNA, 3519 bp, Roseobacter sp.
atgaccactgctctgagaaccattttcgccaagcccgttgaccgcccgattgatggcgtgatcaaggctgacgatgaagcgagcctgcgcatcgagctcgacgagtacgtcatcacagacgaaatcggcaaacgcctcgagaccttcctcgatgcctataataactacgacaccgccaacggtgtctggatttctggcttctttggctcgggtaagtcgcacctgctcaagatgctggccctacttatggaaaatcgggaaatcgatggcacgcaggcttttgaccttttcgaggaaaagctgaccggtcagccaatgctcttgggcgcgttgcgcaaagccgtctccgtgccgtcaaagtcgatcctcttcaacatcgaccagaaggctgacgtcatctcgaagaccgatgtggatgcgctgctttccgtgttccagaaggtctttgacgaggcctgcggctactacggcaagctgccccatatcgcgcagtttgagcgcgacctcgatgatcgcggccagctggcagcgtttaaggacgcctatgctgctgccgcaggcaagccttgggagcgcggccgcgaacaggcagcgctcgagcgcaaaaacatcgccaccgccttcgcatccgtgacaggcggcgacccagcagatgcggcggacattttgggacagtaccgcgccgacacccgcgtttcgattgaggacttcgccaacaaggtgaaggcttggatcgacaagcaggcgccgaagttccgactgaacttcttcgtggacgaggtaggccagtacatcgctgaaaacgtcaagctgatgacgaacctgcagacgatcgccgaaagcctgaacacgaagtgtaaaggccaggcctgggtcatcgtgacctcgcagcaggacatggaagccatcatcggggacgggaaggcgtttcagtcgcaagacttctcgaagatcatggcgcgcttcggtgtgaagatgcccctgaactcggctgatgtggccgaagtcatccagcgccgccttctgtcgaagaccgacgaaggccaggtgcgacttggcaacctgcacgatcgtgaagagaacaacctcaagaccctgtttgatttcacggacgggtcgatcaagctgaagaactttgatgggcgtgcccatttcgtctcgagctacccgttcccgccttatcaatacatgctgttccagatggcgatcacgtcgctctcgcagcacaacgcctttgagggaaagcacagctcggtcggtgagcgctcgatgttgggcgtgttccaagaggtcgccaagaagatggcagaccaaccagtaggcggcctcgccacctttgatctcatgttcgagggcatccgcacggccctcaaatccgccgtccagcagtcgatccagattgccgagaaggaaatccaggacatcgaccccttcgcggttcgtgtgctgaaggcgctcttcctcgtgaaatatgtcaaggagttcaagccgacggttcgcaacatcagcgtgctgctgctctccgagttcgacaccgatcaggtcaagcagcggcgcaagatcgaggaggcgctgtctttcctcgagcgcaacacgcttattcagcgcaacggcgaggtctatgagttcctgacgaacgaagagaaggacgtcgaagcggaaatcaaggccctggatgtcgacccctcagagctttccaaggaaatggagacgctggcgttcgatacaatcctgcgtcaccgcaagatcaagcatctgaccactggcaatgaatacagctttagccgcaagctcgacgatcacctgctgggccgggagtacgagctttccatcaacgtgatcagtccgttcaatgatgatgttgcatcacccgaagcggtgcgcatgcggaacatgagccgggaagaattggcggtcgtgctgcaacccgatgtgcggttcatccgcgacctgacgctcttcaagcagaccgacaagttcatccgccaagcccgtgcgggttcccagcagccaggccgtgatcgcatcgtggccgagaagggggatcaaaacagccgtcgctacaaggacctcgaactgcgcctacgcaagctgatggcagagacgcggatgtttgtgcggggcgatgagctcgatatcgggggcgaggagccccaggaccggatcgtgaaaggcttccagggccttgtcgacaaggtctatgtcaacctgccgatgctgcgaggcgtaacctatgccgaagccgacatcctgaaagcggcaacgcccgagagtgggctcttcggcaacaatggcgaggggcttactgaggccgagcaggatgtgctgaactacgtccagtcgcaggcccgcaacggcgtgaaggtctcggtgaaatatctcaccgaacgctttggtggcaaaccctacggttggccgacaacagctattctgtgcctcgcggccagtctctcgggcaaaggcaagctggaagcccgctcggacggcaccgtgcttgagcgcgcagaactcgccaaggcgctgaacaacagccatgccctggccaatatcttgctcaccccacagaccgaatttacttcggctcagatccggaaggcgaaagagctctacaaggagctgtttgaccttccctcagatggcactgacgcgcggacgatcggcgcggaatggctggagagcacgcgcacgctctctgaagacctgggcaaaatgctggcgcagaaagcgcagtacccgtttgtggtggcgctcgagccattggcgacaaagattgctgcaatggtggggaagcccgcgacttggtacatcaccgagcccgcggcgcaggaagatgaccttctcgacgccaaggaagaagtcctcgacaaaatccgcagcttcatgggcggttcccagcgcgaaatctatgacgatgcgcgcgaatttctacgtgatcaggaagccaatatttcctacgtggatgcggcggctggcgaagcactggcccgcgctttggctgatcctgcttgctacaagggcaccgccattcaggcgcttaaatccgatctctatgggctgaaagaccgtgtggagttgacggtgcttgaggagcgcaaagccgtcatcgcggcggtcgaggattgcgcagccaaggtcacgcagacgccagagttccaggcgctttctgcagatgatcaagcgcacatcaaacgcaacatcgatagccacaaatctgggctcgatagcgtcaagatgatcccgatcctgcgcgatcgggcgaatggagcgaagctcgacctgttgccacgcattttggcggaggttgagcgactgaaccgaccggttgtcgatccaaaactcgtcccgcccgggccgccacagccggagccaccgcagaccacttacgttaacgcctcagaaatcaaggtgggtttcgccaagccctacctgactgaagaggctgacgtcgaacaatacgtcgaagaaatgaaaaagaccctgctggagcagatccgcgcgggcaagaaggtgattgtctga

SEQ ID NO: 362 - DNA, 3642 bp, Escherichia coli; identical to SEQ ID NO: 56

SEQ ID NO: 363 - DNA, 3564 bp, Paenibacillus elgii
gtgctaattaaagacatgtttgtgaaagacattgagcgtagtattaaaggcgtaatcaaggttgctcaaaccgatgaagataacatttaccaggaactcgatgagtatgtcgtaacacgtgagctgaacaagcacttatccaaattttacgaaaattatcagcatagcattgatggaaagaccgataaaatgggcgtttggatttcgggcttctttggatcgggtaaatctcactttttgaagatccttgcttacttgttggaaaacaagaaggcaaaggacaaacgagcagttgatttctttgcagataaaattcaagatgaactcgtttatgccaacatgaagagaacggctaatgttgaaacagaggttatcctgtttaacattgattcaaaaagctccttggataacaaatccaaagaagatggaattcttcgggtatttactaaagtattttatgaacatcaaggattctatggtgatattcctggtgtggcggagatggaaaagtatctgaccaaagaaggcgtatatgaagattttaagagggagtttcaagcggcggcaggtgaagactggatagaccgcagaaatactttctattttgatgctgattatgtcattggggctttaacgaaggttacttcgatgtctgaagaaacagcaagaaactggttcgaaaaaggtgtaaataactttgagatcagcatcgaaaaattctcgaaggatgtaaaggaatacattgcacagaagggtggcaacttccatctaatttttttggtcgatgagattggtcaatatataggtgatagccgccacttgatgattgatcttcaaactcttgcagaagatcttggaactcattgtcagggaaaagcatggattatggttacgtcgcaggaaagtatcgacaacattgtgaaagtaaagggtgatgacttttcacgaattcaaggacgtttcgatacgagactatcgctttcttccatttcggtagacgaagttattaagaagcggattcttgaaaagaaagagcatgttaccgataagttgaagcaaatctatcacagtgagagtgcaacactcaaaaacctgatgagctttaaggatagcactgccgatttacgtggatatgagaacgacctggaatttgcggaggtatatccattccttccttatcaattcaaattgcttcagaacgttttcgaacaagtacgtaaacacggaagttcaggtaagcatttgtccgaaggggaacgttccatgctctcggcattcaaagaagctggcttgcggttcaagaatgctgaggaaggcacgctgattcctttctatgcgttctatgatacgatcaaagaattcttaaccccttccatcgcaagggttattgaaggtgcgtatgagaacccagctttacgtgatgatgagtttaacatggatctgctgaaagtgttattcatgatcaaatatatcaaagaacttcctgcgaatatagacaatattgctacgctgatggtaacaaagatagatgaagataagttggcattgaaggaaaaaatcaaggttgctcttcgcaagctgatttcgcagacgctcattcagaagaatggtgaattttacttgttcctgacggatgatgagcaggatattaaccgtgagatcaaggcgatgaagatagaagaggatgttatcaagcgtgaaattgcgaattatatctaccaagacttgtacgatgataagagatatcgttattcggcacaataccaattttcgtataatcaaaagatggatgagaaaaatgtcggtaatcaaacatcgagtatagggatcaatattctctcgccgctgtctgatcattatgctaaatctgaacaagagctgatgcttatgtcttctggcacaggcgagatgatactgaagcttggtgcgaatgaggcctatgtagaagagatggaagaggttctcaagattgaggagtatcggaagaagaaaaatccgactcaacttccagagagcattcaaaacatcttaaacaataaacaagctgagacaagggatcgcagacgtagagtgcgagatatgctggaagaagcgattaaaggcggcatattctttatcaacggcaataaggcagagattaaaggtgcgacggttaaggaaagaatcaatgcgggattcctttcattggtcgagaatgtgtatacgaagcttagttatgtgaagacattcctggatacggaaaatgatttgagatccattttaagaagaaataccgaacaactgaccattgatggaacagcgacgaatgcaaacgaattagcagtaaaagaagtcatggactatattagtttgcaggatagcatacagaagcaaatacgagtgaaaatgttagtggatcgctataaggataagccttatggctggaaagatctcgacatcgctggtctaattgcagaattaatgagagaacaacgaatccgaattcggcttaactcggaatatttggagccagaagacggcaataccgttaatgcgttgaccaaggcgagcgaaatcgataaggtaattgttgtgaagcgggttatcgttgatgaatccttattgaaagtagccaaaaacatttgtaagcaagtgtttaataaaactgacgttgcggatgatgaggatggactcattaaagacattcgagggttgatcgaagatcagttaaaagagatcaatgcactcaaaaatcgttatgaaggtaggaaatatcctggaggcagtctattgaaccgaggactggaatacttcggggagtttactaagggattggacaatgtatcgttcttcaccaagcttcgtgatttggaagataacctgttagactgggaagaggatgtaacatatgtgaagagcttcttcgcctcgcaaaaggacatctttgataaaggacttcgtgcaatcgagaagtataaagagaacgatgtttatttatcggggaacgaaatcaagggctacgctgataaactacaagagatcttaaaggacgtacagccgtataagaaaatcaaggacatccctgaacttgtgaataaaatcgatgagcaaatccagagtgttcttgaagagaagaaagtggcggcgaaaaccgttattaaagtggatattgaccatcttacgttacgtgctaaagaagatggtgtttccgaagagacgaaaaaacgggttcaagcttattatgaaaatctgtttagcggtatgaaagaccttgtcgatatatttaaggtggatgcgacaataacgcaaagcactgcttttagagaaaaacaggaaatcataattaatcgtgaaatccttgaatttgaggagaaacaagtggagcggccagttacaggaggtggagtagataaacctcaagtaatagtaaagcctgttcctcagagagaacgagtgaaagttaacagtttacttgccactaagaccttacggacagaagaggatgtcgatatgttgttaaacacattgtcggcaaaattgaagcagattattaagagcaacaaacaaattgaatttattgattga

SEQ ID NO: 364 - DNA, 3642 bp, Escherichia coli; identical to SEQ ID NO: 56

SEQ ID NO: 365 - DNA, 3558 bp, Pseudomonas mandelii
atgaaactcaacggaattttcaagagcccagtcagtcgtccgattgagggcgtcattaaggccgacgacgaagctagcttgttcaacgagctcagtgaatacgtcctgactgacgaagtcgccaagcgtctggagcacttcctcgatgcctataccgactaccaccatgccaatggcgtctgggtctccggcttcttcggctcgggtaagtcgcacctgctgaaaatgctcgccctgctgctggaaaatcgccaggtcgacggcagtactgcactggacatcttcctacccaagatcaaggacgacgatgagctgttgcgcgctcagctgaaaaaagctgtcgttatcccctcgaaaagcatcctgttcaacatcgaccagaaggccgacatcatcagcaagacccaggtcgacgccttgctctcggtattcgtcaaagtcttcaacgagatgtgtggttattacggaaagcagggttacattgcccagtttgagcgcgacctggacagtcgcgaactgttccaaccgttcaaggaagcctaccagagcatagccaataaaccctgggagcgtggtcgcgaacaggcgctgctggagacaggtaacatcgccaaggcctacgcccaaatcaccgacgaagacctggcgctggccaagggcatcctcgataaataccgcactcaacacagcgtttccattgaagacttcggcaatcaggtaaaggaatggctggacaaacagccgtccaacttccgcctgaatttctttgtcgatgaggtcggccagtacattgccgacaacaccaagctaatgaccaacctgcagaccgtggccgaaagcctggccaccaagtgccagggtagggcttggattatcgtcaccgcacaggaggatatggactcggtgatgggggacatgagcaagcagcaaagcaacgacttttctcgggtccaagcgcgttttgccaaccgtctcaagctcactagtgccgacgtagccgaggtgatccagaagcgtttgttgaccaagaatgatatcggcgccgcgctgttgaaaattgtctacgaccagcagctcaacaacttcaaaaccctattcgactttgccgacggtggccagcactaccaaaacttccgcgatctggagcacttcacttactgctaccccttcgtgccgtaccagttcccactgttccagtcggccattcgtggcatatccatgcataacgggtttgagggcaaggccaactctgttggcgaacgctccatgctcggcgtgttccgagaagtggctatggctatcgacaacgagccagtgggccagctggccacctttgatcgaatgttcgaaggcattcgcggcgcgctgaaaagcgctattcaaagcgctatcaacaatgccgagcggcaccttggcgacccatacgcggtgcgcgtgctcaaagcattgttcttggtcaagtacgtcaaagagttcaaggccactctacgcaatctcaatgtgctgatgctggagcgttttggcgaagacattccagcccaacgcaagaagctggaagcggcactcaacttgctggagcagcaaacctacatccaacgcaatggcgagttctacgagtacctgaccgacgaagagaaggacatcgaagaagagatcaaaaacacggagatcgaaactgccgatgtcatcaaggagctggaaaccctgctgtttgatggcgtgatcaaacagcgcaaagtccgctatgaaaacgcccaggactatgcctatacgcgcaaaatggacgaccgttcgctcagtcgcgagtttgagttggccatccacattgtcactccgcttagtgacaacttcgataacctcaccgtgcagcgcatgcagagcatgggacgtgatgagctgcgtgtggtgctgccggctgatgcccggttcatgcaggatctcaccctgcacaaacgcactgagaaatacatacgacagaacagcagcactcaacaggaagcggttaaacgcatcatcgacgccaagggcttccagaacaccgaacgtctagccgaattacaggatcgagccaaggagttgcttggcaaagcgcacttgatcattaacgccgcggatgtggaggccaccagcagcgacggtcagacccgtattctgaaaggcttctaccagttgatcgaaactacttatccgaacctgcgcatgctgcgcgatgtgccgttcaacgagaacgacattggcaaataccttcgccaggcgcaggacggtctactcggcaacgacgctactagcctgaccgagcccgagcaggagctactagcctatatccagaacaatgctcgaagcggtgtgcgcactacggtcaaaaccctattggagcgattcgagcgcaagaactacggctggtattatgccgccattctttgcaaccttgcgctgctctgtgcgcgtggcaaggtggaggtgcggcaagacagcaatccgctggaaggcgacaacctggagcgcagcttgcgcaacaccaacgctcacaccaccttagtgttggagccgcaaatcgagttcagcgcctctcaggtccgccatctcaaagagttctttgccgacttttttgaccgtcccgccagctgtaacgaagcccgcgctctggcgcgtgaaaccatcgacgccatcaaagaactggagattgaattagcagacctgcatgggcaaaaagccttatatggtttcctcaatgtgctggatggcgtgatggctaccctcaaggagattgccggcaaaaacgccagttggttccttaccgacttgtctcgcgcctccgatgccatgctcgacaccaaagagcagatcattgagccgctacgtcgcttcatgggtagtccgcaaaaagctatttacgatcaggctcgccaactggtgcaggagcaggaagacaatttcgcctatgtcgtgacgggagaggttgaagtcatcaaggcattactcaccgagaataaaccctggcaaggcaaccgcctgcagcaggctaaaccgcaactggagtccttgcagcaagccattgctaaccagctaaccggcgaaaaggctgccgcagtcggccggcttgccgagttggagttgcgtttgcaggggagcaacgagtacggcagtcttaagccggagcagcaggctcagctcgctgtgccgtttgttgaagctcggcagtcaatgcaagggcagaagcgtatcgccatgatccgtgatcagttgcgtgccttcgaggacaatcaatacgcacagttgctgctcaaattggagcgactggctcgtccgcaaccggtaccagatccaattccacccttttctccgccgccagcgggaaatcaggacaacgattatccgccgcaaccaagcgcagaaccaccccaagaggccgaaccgcgcttggtgcccgcacgttctatcaaggtgggttacagcaagccttggctggccagtgagtctgagctcgatgattacctacggcagcagcgcgaagcctggctgaaggaaatccaagcaggcaaccgcgtacagatttga

SEQ ID NO: 366 - DNA, 3678 bp, Vibrio cholerae; identical to SEQ ID NO: 233

SEQ ID NO: 367 - DNA, 3456 bp, Vibrio cholerae; identical to SEQ ID NO: 239

SEQ ID NO: 368 - DNA, 3456 bp, Vibrio cholerae; identical to SEQ ID NO: 239

SEQ ID NO: 369 - DNA, 3573 bp, Geobacillus sp.
gtgttagttagagaaatatttaaaaaagacatttttcgcccgattaatggggtcgtacaagctggacaacttgatcacgatacaattaaaaatgaattggaggaatacgttttaaccgatgaagtaactggctaccttcaaacgttttatgaaaactatttatccgtatataaaacacctacaaaagatataggcgtttggatatcaggcttctttggttcaggtaaatcgcacttattaaaaattctatcatatttactggataataaggaaattgacgggaaaaagccttatgaatatttttatgagaaaacggataataaaaaattgctatcgatgatggaggaagtggcacagaaagaatcagatgctattttattcaatattgattcattatcttcttccagttcgacaaataaggaaagaatcgtggaggtctttcttcgcgtttttaaccgtcatttgggctattctgacacattatgggtagctgacatggaacggcaattagatgagataggaaaatatcaagaatttaaagataccattttccgactttatgaaaccaaatgggaagattttcgattaaaagctgttttgcggcggaaaaaaattgtccaagcattaattgaaatcggattggatgaagaaacggccaatagtttttttgaaattagtaaaaatacatttagcatttcttcaacgcaattagcacaattaattgcgaactactgcaaaagtcgtggacctgaatatagaattgtctttttagttgacgaggttggtcaatacatagggactgacggaaacctcatgttaaatttacaaacagtagtagaagatattggaagtgcaacaatgggccaagcatgggtcattgtcacatctcaagaaaaaataaaagcggcagttaatgtccatagcgaaaaagatttttccaaaatccaaggacgttttgcgacccgaattaatttatctagcgcaaatacagatgaagtcattaaaagaagacttttagaaaaaacagatactgcaacaaaaacattaaaagccacatatgagccaatcgaacaaattgtaaaaaatcgtctttcatttgatccaaattcaacgcaatttcgttccggataccgttctgccgatgaatttgtgtcactttatccatttgtaccgtatcaagtggaacttttacaagatgtattcaacaaaataagaatccatggtgaaggcggaaccagtttggcacacggggagcgttcattattaaaagctttccaagaagcagcaaaacttaattcgaatgaagaaatcggaaatttagtaacattagcagagttctatccttccattcgaagctttttagaaacgacaattacccaaacgatcacacgtgcggaagatcgtgccaaaaataatgaaggattgaaattagaagatgtcgatgttttaaaagtgctttatttaataaaaggaattgacaaaataaaagctacaccaagtaatatcgccactttattattaggatcaatatatgatgaccatgatgactaccatataaaagagtcgttaaaccgtctagaacaagccatgtttattgaaaaacatgcggatggtacatattctttcctttccgatgaagaacaagaaataaataaggaaattcgaaatgttgaagtaaaccctataaaaattaaggaacaattgggtgacctgtttttcaccaagttatacccgaaaccgaaatttgaatatcggaaagatactcctccgtttgattacaataaaagatttgataactatacaaaagggaatatgaccaatgcattaacattgcaagtatttactgtggcaatgtctgatatggaagctgctttaaaggccaattccggtcagttagtgatttgtttggatgaagaaattgtggctgaagctgaaagtgccattaagtactctgagcaagttcaaaaatatgtaaactttaagcggaatagcagtacaacagaaacacaaaagcgaatttttgaagccaagttgtctcaagtagatgatttcgagcaaaaagctgaggaattattaaaaaaggcagctgagaaagcccgtttctttatccaagggcaagaaagatttttcaaaggctcatttgaaaataaagtaaatagtgcgtttgaacttttgatcaaaaacacctatagccggctggattatgttgatgaacctattccttttaaaacacataaagaagcttggcgaaaactcgcagaacacggtattgaaaatgatttattacaaatgaccggtaatcgcagggcttatgaagaaatgaaggactactttgaagaaattgcccgttggcatgaaaaaccgtcattaaaatctgtgattgataagtttcaggctgtaccatacggttggagtgaatatgacataatcgggcttatattggctttaatgaatgccggcaaagtaaaactttccattggagatgagctgtttacacctgaacagtcgaatttttatgatcgtttggcacgtatttcagaacgggaaagaattcgtgttattcccgaaattgaagtggatccgaaagtaaaacgagaatttatttccattataagagaattttttggcgatcgagactttggtgaaacgtatcaagactttgcaaacgtcattgtcaaagaattaactgaacgttttgccgctccgctagaggaaatcaataaaaaacgtagagaacaaaaattgtatgaattcccatatccgggagaaagagaaattaatgctctttcaatgggtattaatcaaattttacaaatccgtgatccggagcaaatggttaatgcgttcatcaatacagaagacgatttagaatcttggttagaatcgatagaaaaattaaatggtttctataataaaacgccaatcaccatatttgatgatacggtagatgtattagaccgtttacaaaaggatttaacaatcatccaagacaatgatgtacttcttattaaaaaacaaattacggatattttaacaaatccgaatccttatcgggatatacctaaattaccgcaattaacgagtcaattagaatctaaaataaatgagatcgtaaatgaacagcgacaagcgataaacatacaagttgaaaaacttgaaaagaaattaaatgagacaaaggaatattatctggaaatacctgcaatcgttgattatattgacacggaaatgcaaaagttcaacaggctgaaaagcaatcttgaacatgaaaaaagcttagtcattatacgtgtactattacaagatcttacagatttgaccaatcaaattgaaaatcgggcgaaacaattagaagtcgaatacaggaaaccgccgattgataatccgtctgacgagccaacaaccgttatccgggaaaaacaaagcaaaaaattaaacgctaatgaactgtaccatctgtttttcaatgggcggaagaaaattgaaacacaacaagatttagatcatgcacttcaagaattacggaaagctttattacgtgagttaaaagattatacgttagaaattgaataa

SEQ ID NO: 370 - DNA, 3615 bp, Escherichia coli
atgaatattgaacaaatttttgagaaaccgctaaaacgtaatattaacggcgtggttaaagccgagcagaccgacgacgaaagcgcctggatagaactggatgagtatgtcattaccagagagctggatggtcacctgcgtcagttctttgaagtatatgcccctgctactggccctggcagattacagcttgctgacaaaataggcgtctgggtttcaggcttctttggttccggtaaatcacacttcattaagatcttatcctatctactggcgaaccgcgaagtaagccgtaatggtgtcactcgtaatgcactttccttctttgaagagaaaattgatgatgcactgctattggctgatattcggaaatcggcacaacatccgaccgatgtcatattattcaatattgactcacgtgcgaatgttgaagatggcgttgatgccatactcaaagtctttctgaaagtctttaacgaactagctggttattgtggcgacttcccacatattgcacatctggaacgtgagctcgataagcgtggacagtttgatacctttagggcagccttcgcggacattactgggtctcgctgggaagacgaacgtgatgtttatctgatgataaacgatcagatggctgaggcactgagtattgctacaggccagagtgaagagtcttctcgtcaatggatcgagcaacttgataagaacttcccattggatatcaaaaatttctgtacgtgggtgaaagagtggctcgacagccatggtaatcgcaatatcctgtttatggtcgatgaagttggtcagttcattggtaaagatgctcagatgatgctgaagctgcaaaccatcaccgaaaacttgggcgttatttgtggtgggcgggcatgggtgattgtgacctcccaggctgacattaatgcggccattggtggtatgagcagtcgcgacggtcaggatttctccaagattcaggggcgtttctcaacgcgcttacaactctccagctcgaatacttcagaagttatccagaaacgtctgctggtaaaaaccgatgcggcaatacctgcgctggaagctatctggcaggaaaaaggcgatattctgcgtaaccagttggcatttgacacgacaacgaccgctactctgcgagcctatacaaacagccgcgagttcgtggataactatccgtttgtaccgtggcattaccagatcttgcaaaaggtctttgaatcaatccgaaccaaaggggccgcaggtaaacagttggcaatgggggagcgctctctgctggatgccttccagtcggcagctgtgcaaatctccgcagatggtctggatagtctggtcccgttttggcgcttctactcagcgattgaaagcttcctggaacctgcagttagccgcactattattcaggcctgccagtctccgtcactgactgaatttgacggaaaactactaaagacactgttcctgatccgttacgtcgatgtgctgaaaagtactctcgacaatctcgtcacgctctctattgagcgtattgatactgataaagtggaactccgtcgacagattgaagccagccttaatcgtctgcaggctgagatgctgatctcgcgtattgatgacaaatttgtttttctcactaacgaagaaaaagagattgaaaacgaaatccgcaatattgacgtggaattcaccaccatcaataagcaactctcaaccatcattttcgaagagatcctgaaaaacaaaagatatcgctatccggccaataagcaggattttgatatcagtcgtttttgtaacggacatccgctggatggtgcgaatcttaacgatctggtggttaaagtgctcacgccactggactcgaactacgagagctataagggtgcgcattctaatagcctgctgatgacggacagtaaagactgcatcttaatttgcctgcctgatgaggctcgtacctggcaagacctgaccatgtacgctcagaccaaagctttcctcagcaagcaaagcggccagcgcccggaacaggcaacgctgttggcggaaaaaggccgtgaaaatagtatgcgcgaaaaaacgcttaaggcgcagattgaaggcttgctggctcaagctgatgtctgggcgctgggcgaacggctggataagaaatcctcttcgccgttagctatcgtggatgcagcctgcggttacgttattgagaacagtttctctaaactgaaattactgcgcctgagtactggggacgtgaaccgtgaaactcacgctctattgacggtagaaaatgatacccagctcgacctcggggaaatggaagagtctaacccagaggcgatgcgtgaagtggataactggatcagcatgagtattgagactcataagccagtttacctgcgggatattctcaccacttttggccgtcgcccatttggctggccggaagatgaagtcaaattgctggttgctcggctggcacgcagcggtaaatacagcttcactctgcaaggcagtgaaatcgcactgaagcaggcgtgggacgcgtttaataattcacgtcgttacagtgatttgcgtctgcataaagttcgtcgccatgatgaagcacagttgactaaagctgcgcagctgatggctgagattgctggagagccgtttaacgagcgtgaagaacagtcgttggtctctcatattcgcgaactctttggccgctggaatagcgagttgactgtttttaaaactcgtgcagagagtggacaaaaccctggccgtaaagagatagaagaaggtctggtattgctgaacgggatccttaacgagaaagaggaatacgcggtcattgaaaaaatcaccgcagcggcggacgatcttaacgatttctcggaagactgggacgatttggttagcttctacaaaaaccaatacgctacctggcagcgcttgagtatggcgttgaatggcagttttaaagctaaccgtaacgcgctggataaaaacgaaacggcccataaagcgttgcaggagttggaaggcatctacagtaaggcacgaccttacggagagctgcaccggattattccgctgattgaaaccgttgaaaccatcaaccagcgtctagtgaaagaataccgaagcaatgcgctgcagcagatagataaccatatcaatgagcttaagcaaagtatgcaggagatgcacgtccctgctgacttgcaacactcgcttttacacccgatgcaacaatcgcgtaagaaagtggagcagaacggcctgatcccacagattatggaagaacaggctgaggttcgggcgctacaatttaaagcgaatgaacggctgaacggctgggttgaggatcagcgtaagaaagtgtctgagccaaaacccgcccctcagcctgggattatcgaccccgtagttaagcctgaacccaagctgaaaaaaaccatctacgtaaacacgcgtaaaacgatggagcgagcggcgggtgtgacaacgctggataacgccgaacaggtagacaaagcgctggaacaactccgtaaaacgctaatggatgccattaacgcaggtgaacgcgtacagcttcagtaa

SEQ ID NO: 371 - DNA, 3642 bp, Salmonella enterica; identical to SEQ ID NO: 8

SEQ ID NO: 372 - DNA, 3555 bp, Collinsella stercoris
atgcgcatccaggacatgttcgaacgcgacatcgaccgcaacatcaacggcgtcatcaagatcgagcagaacgacgaggaggtcatcgagcaggagctcgccgaatacgtggtgaccaacgagctgcgcgggcacttctcaacgttcttcgatgcctacgagcgcgcgctcgacgcccccaccgacaagatcggcgtatggatctcgggcttcttcggctccggtaaatcgcacttcctcaagatgctctcgtacctgctctcggggcagacggcaaacgggcgcgcggccatcgacatcatcgcgccgcgcttcgaagaccccatgatcgaggtcaaggcgcgacgcgccgtggacgtccccaccgagaccatcctgttcaacatcgactccaaggggccatccaacaaggacaagaccgccatcctgcgcatcttcgcccgcgtgttcttcgagcacctcgggttctacggcgaggatctcaagctcgcgcgactggaacgcgacatcgaccagaagggcaagaccgaggcgttccgcgccgcgtatcgcaagatcacgggcaccgaatggctcgacgagcgcgacgcctacgacctcaacagcgacgccgtcatcgacgcgctcgagcaggcgggcgccatgagtcgcgaagccgcggagcgctggttcaacaacaccgaggagttcgaattcaccatcgattggctcgtgcgccagatcaaccaatacgtgaccgagcgcgccgagcaggaaggcggcgagtttcgcctgttgttcatggtggacgaggtgggccaatacatcggcaccgacacgagcctcatgctcaacctccagaccatcgtcgaggacttgggcgcgcagtgcgccggccgcgtgtgggtggtcgtgacgagccaagaggccatcgacgagatcaccaccgtggcggggcaggacttctccaagatccagggacggttcaacacccgcctgtcgctttcgagcaccggcgcgggcgaggtcatccgccggcgcattctctccaagaacgagcacgcgcacgacctgcttaccgttgagtacggcaagaacgccaccgtgctcaaaaacctgttcaccttcaagggggcgcgcaacgacctgggcggctatgacggcgcggagagcttcgcggacgcgttcccgttcgtgaactaccagttcaagctcatgcaggacgtcatcaacggcctgcgcaaccagggcagctcgggcaagcacctgagcgccgagcgctccatgctctcgggcttccaggaagtcgcccaggcgctcgaggaccgcgacgagcacgccctggcgcccttatggatgttctacaacaccgtgcagtccttcctcgagggctaccatcgccgcgtgatcgaccgcgccgcggccgccgcgcgcgacggcgccggccttgaggaatacgacgtcgccgtgctcaagctgctgttcctcatcaaatgggtgagccaggagatgccgggcaacgtggacaacatcgccaccctcatggcagacgacctgcgcgccaaccgcgccgaggtgcgcgagcgggtgcaggccgcgctcgagcgcctggagcgcgagaactacatcacgcgcaacggcgagtgctacctgttcctcaccgacgacgagcaggaaatcgcgcgccagatcgcccgcacgcaggtggacgcggcaaagctcaccaagaaggccgccgagattgtgttcggccagattttcgagacgcccaagatcaccgtgggcaagaacaacttccccgtggcggaatggctggacgagacccgtgtgaacaacgcggccggcctcaccctgcgcgtgctcgcccgcatggacggcaacgacgcccccggccgcgacgagctcatcttgcgctcgagccgcggtgaggcgatcgtgctgctctccagcgaggtcgatttttacagctgccttatggaggcggcgcgcatccagcagttcgcgagcgcgaccatcatcgccaacctgcccgccaaccagcaggacgtgatccgcgccaagcagcaggagcgcaccgcactcgagaccaaggcgcaggcgctcatggaggaggcggtgcgccgcggcgagttctacgccggcgggtcccaggtcaccatcacgggcaccaactccgccaagaagctcatcgagcaatgcacggcaaagctggtggatgccgtctacaccaaactcggctacatcgaccgcaattacgacgacgatgcccagatcaggcagatcctgaacggtgccgcacccgcgctcgagggcatcgagcccaacaagcgcgccatcgacgacgtgcgcacgttccttggcgcccaggccatgcgcgcggtgagcgtgtccatggacgacctgcagaagcgctaccaggcggccccctatggatggcgcgagcgcgacatcgccgccgtggtcgccgagctcatcaccgccggcgaggcgcgcgtaagctacgccgggcaggtcgtggacgcgcacgacgccaagatgatcgactatctgcgcaagctgagcatgacgcagcgcactgtggttgagatgcgcgtgcgcgcctcggcgggagatatgacccgtgcccgtcgcgcgatcgagacgctctgccgcgttcacgacctccccaccgaggaggaaccgcttgccgccgcctgccgcagcgccctgcaggagcgcctgaatggtctaaacggcctcatcaccggagcgtacaaccgcaatcccaactacccgggctatggcacggtggcagacgccgcagccctcatcaatgagctgctcgccattcgcggggactccggcgatttgctgcgcgccatcgccaaggaggaaaacgctctgcgtgacgcaggcgaggacttggaggacgtcgacgggttcttccccgatatgcagcgcatctacgacaacgcctccaacctgctcaagcgcctcgatcaagaccgcagttaccttgccgcccacgaggaggcgaccaaggcgatcggggatatcgagcgcatcctgggcagcgagcggccgtataggcagatcaccgacctcggcccggccatgcaggcgatcgaaagcgcgcacgccgagctgctcgagtccaagcgcgcggacgtgagcacgcaggctcaggacatctttgcgagcatccacgagcacgggcgggaactcgacgtgtccctcagcctgatcgagcagaccgaactcgcacgccgcgaggccatcagccgcgcagacaccctcacgcagctcgacgccctggcctcccggctcggctccgaccagacgagcctgttccaaaagctcgatgaggagcatgagcgcattcatcgcccgggccccgcatgcgagggtgtcacagtcgccaccgagcaccctacacccaggcgcccggaacgcagggtcaaagaggtgcgtcgcgcactggcattcaagcccaaaagcaacctatcaagcaaagaggacatcgacgcgtatttggagaatgcccgcgcgtacctgctcgaacagctcgccggcaacgacgccatctcgctcaaatag

SEQ ID NO: 373 - DNA, 3570 bp, Glaciecola punicea
atgaagttatctcaattatttgccaaaaaagtagacagacccattgaaggtgttatcaaagctgatgacgatgttgctttatatctcgaactagacgagtacgttattactaatgaggtggctaagaggctcgatatattcttagatgcttacctaaattattgtggtgcaaacggtgtctgggtatcagggtttttcgggtcaggtaaatctcacttattaaaaatgctagcattactcttagagaatgcgcccatcgatgatgttacaccattagatatattcttagaaaaacgcccactgaatgaaggtgggatttttgccaatgatcttaaacgtgctgttgacatcccatcagaaagcattctatttaatatcgatcagaaagctgatgttattagtaaaactgaacttgatgcattaatagcggtatttgtaaaagtatttgacgagcactgcggattttacggcaagcaagcttatatcgctcaattcgagagagaactgaaagatgacgggcttttagaaaactttaccaaaatattcgagtcagtcagcggcatggagtgggaaaaaggtcgtgcaagagcgaagcgcatggcagatgctgttgatagtgcttataaccaagtttctggtcagtcggtcataggaattttagataagtatcgtgatgattacagattatcaattgaagattttgccgagcaggtacaaagctatattgaaaagcaagaagacggctttagactaaacttctttgtggacgaggttgggcaatatattgctggcaacaccaaacttatgactaaccttcaaacagtagctgaaagtctagcgacaaaatctaaagggcaagcttgggttatcgttactgcacaagaagatatgtcgaaagttattggtgaatctgaccagaatagtgaaagtgattttaccaaaattcaagctcgttttaaaaatagaatgaagctcaccagtcaagatgtcgcagaagttatccaacgtagattgctcgaaaagaaagaagagttccttccgacgttgtctgacttgtaccatgagcaagagaataattttaaaacattatttgattttgcagatggctcccaatcgtatagaaacttcaaagacaaagagcattttttacaaagttacccttttatcccatatcaatttggcttgttccagtcagctattcaaaacttgtcaactcatagcgcgtttgaaggtaaacatagctctgtgggtgaacgttcaatgctgggtgtttttcaagaggtagcgattgcgattaaagaccataatcttggtgacttagctacatttgaccttatgtttgagggtattcgaacagcgttaaaaactgcaaatcaacagtcgatattgaaggccgagctaaatctagataatacatttgcagttcgattactgaaggtattgttcttagttaaatatgtaaaagaatttaagccaacgataagaaatttatgtgtgttgatgcatgatagtttttcacgagatatctcctcccttaagcttgaagtagaagaagcgttgaacctgcttgagaaggaaacatacattcagcgtagtggtgatctattcgaatacttaacggatgaagagcaagatattgaaaaagaaattaaaaatactgaagtcgactcagatgttgtcgcttcagaattagaaaagctcatttacgatggagtattgaaaaatcgcaaaattcgttggcaagaaaataatcaagattatccatttagccgtaaactagatgacaaaatatcaggccgcgaaaatgaattggctattaacgttatcacctcttttcatgatcatcgtgatgcttttgaaaaacataaatccgatactttatttaatgatgaattgagaattgttttacctgaaagcgcaaggctagtaagtgatttagtactttacaagcaaacagagaagtatgttgcccatgaaacaaaagccacgcagcaagatactataaaacgtattttgactgagaaaggcattcaaaaccatgagcgatacaatcaactaaaaacgttaacatctaaacttgttggctccgctaaatattttgtggcaggagcagagattgagttatcaggtgatgatggtcaaaacaaaatggttcgtgcgtttggtgaattgattaagcacacataccccaacttgaaaatgcttcgggatatcacctatagcgagaatgatattaatgacattattaagaacgctggccaaggattattaggtgacgatgcacaactaccagaagctcagcaagagatgttctcgtttattcaaagcaatagccgtggtggtatccgaacaaccgtaaaatcgctattaaccaaatttgaaagcaaacctaacggttggtcttttgcagcaattttatgcaacttagcgcatttatgtgccagaggtaaaattgaggtacgagaggctacaaacttattggatgataccgacctagttcgtgcattaagaaacattgccacacatggtaatttaatacttgatcctcaggtggaatttaccccctctcaaattagagctgtcaaagacttctacagtgactactttgaaaaaatgccacatgctaatgaagcaaaagctattgcaaaagaattacaagaatcatttttggaacaagccacactactagataaattgcttgctcaatcagagcaatacccgttcttaagagcattagctgacattgtaactaagcttggcgagtttaaatctaagccgtatacatggtttatgaccgagttaacccagcaagaagaaatttggtttgatcacaaagaaaaaacaatcgatcccattataaagtttatgaagggagcacaaaaatcaacttttgataaagctaggcgggtaacaaccgaacaattagcaaatattgaatatgttactagcgatgaataccaaaacatcaaagatgccttggtgaatgcaactatttataaaggtagtgctattcagcagctgaaaactgacaccgagtcgctagaaaataaaatagccgagcaagtgaaagttgagcgagcccatgcaattgaaacaataaatttattaaaagataaattagaaacgtttgatgatttccaaacgttagataaagaaaaacagcagcagctaataacagaatttaccgttgttaaacaaaaattagagcaacaagctttaattgcaatgcttagagacgaagctaggcgttttgaagatgtgacctactctaaattggtacaaaagttaatggaatggtcgcagcctgcgccaactcctattactacaccagtcactgataataaaactaacaatcagccagaagatggcttgtttggcgggaaatcacagccttcatcatcagtgaatgagcctgttaaagcagaaattcaaagtatatctgctaagcagatcagagtggactataacaaaccatggctttcaacagaaaacgatgttgaagaatatgtagaagaatacaaaaaggcactgttgtcggccatcaagcaagggaagcatatacagttatga

SEQ ID NO: 374 - DNA, 3666 bp, Enterococcus faecalis; identical to SEQ ID NO: 264

SEQ ID NO: 375 - DNA, 3567 bp, Pseudoalteromonas flavipulchra
atgaaattatctgaattattcgcaaagaaagtcgataggccaattgaaggtgttatcaaagccgatgacgatgttgcgctatatctggaattagatgagtacgttattacggatgaagttgcaaaacgactcgacatttttctagacgcttaccttaattacaatggcgctaatggtgtttgggtttcgggctttttcggttcaggtaaatctcaccttttaaaaatgctagctttattactggaaaacaatccaattgaaggcattactccgctagaaatatttttagaaaagcgccccttgaatgaagggggaatttttgcgagtgaccttaaacgtgctgttgctatcccttcagaaagtatcctttttaacattgaccagaaagcggatgttattagtaagaccgagttggacgcgttaattgctgtattcgtgaaagtttttgacgaacattgcggcttctatggaaaacaagcctacatcgcccaattcgaaagagaactaaaagatgatggcttattagaagactttaaagcgatctttaaatctactagtggtatggagtgggaaaaaggccgagctagagctaaacgaatggctgatgcggtagataaagcatataaccaagtgtcaggccagtcagtaacgggaattttagataaataccgcgatgattacagactctcaattgaagactttgctgagcaggttcaaagttatatagaaaaacaagaagaaggcttcagattaaacttttttgtggatgaagtaggtcaatatattgctggcaataccaagttaatgaccaatctacaaacggtagcagaaagcttagcgactaaatgtaaaggtcaagcgtgggtcattgttactgcacaagaagacatgtcaaaagtcatcggtgaagtcgaacagaatagtgagaacgatttcacaaagatccaagctagattcaaaaaccgcatgaagcttactagccaagatgtcgccgaagttattcagcgcagattacttgaaaagaaagatgaatttattccagcgctttctgatctttaccatgagcaggaaaataatttcaaaacgttattcgattttgctgatggttcccaatcatatagaaactttcgtgatagggagcattttttacaaagctatccttttatcccatatcaatttggcttatttcaatctgcgattcaaaatctatcaacgcacagtgcttttgagggtaaacatagctcagtcggtgagcgttctatgcttggtgtattccaagaggtagcgattgcgattaaagatcatagccttggggaattagctacatttgacctgatgtttgaggggatcagaacagctttaaaaacggcgaaccagcaatcaatattaagagctgaaaacaatttagacagtgatttcgcagtcagactattaaaagcgctgtttctggttaagtacgttaaagagtttaaaccaaccattagaaacttatgtgtcttaatgcatgatagcttctcacgtgacataccttcgttaaaacttaaagtagaagaagctctaaacctacttgagaaggaaacttacattcagcgtaacggtgatttgtttgagtatttaacagacgaagaacaagacatcgaaaaagaaataaagaatacggaaatcgattcagatgttgttgccgctgagttagaaaaactaatttacgatggtgtgttaaaaacacgaaaaattcgctgggaagagaataaacaagattaccctttcagtcgcaaactagatgacaagttatctggtcgtgaaagtgagttggctatcaacgtgatcacgtctttccacgatcatagagatgcatttgagaagcataagtcagataccttattcaatgatgagttaagaattgtacttccagaaagcgcaagacttgttagtgatctggttttgtataaacagactgaaaaatacgtagcccatgaaactaaagcgacacagcaagatacaactaaacgcattttaactgaaaaaggcattcaaaatgttgagcgttataaccaacttaaagcattaacatcaaaattagttggttcagcaaagtattatgttgcgggtaaagaagttgaattgtctggagaagacggccagaacaaaatgttgaaagcatttggggagttaataaaacacacatacccaaatttaaaaatgttgcgagatatacaatttaatgaaaacgatatcgctgacattattaaaaaagcagatcagggactatttggtgacgacactcaactacctgaagctcagcaagaaatgttttcgtttatacaaagtaatagtcgaggcggtgtaagaacaacggttaagtcattaatcgacaagtttgaacgcaaaacttatggttggtcatatgctgcgatcctatgcaatcttgctcacttgtgtgctagaggtaaagttgaagttcgtgaatcaactaatttattagatgatggtgagcttgttcgcgctctaagaaatatggctttgcatgccaatcttatactcgatccgcaagtggagttcacgccatcgcaaatcagagcggttagagacttctctcaagattactttgataaaccactccttgctaccgaggcgaaagcgatagccaaagaagtgcaagagtcgtttttagagcaagctataacgctcgataaaatgcaagcgcaagcagcacagtacccatttttaagagcacttacagaaatcatagaaaaattaggtgagctaaagtcaaagccttatacatggtttatgaccgagttggctcaacaagaagatacttggttcgactataaagataaaaccatcgaacctatgactaaatttatgaatggccctcagaaagcaacttatgataacgcaagaaagttaatcacagagcagtcagccaatagtgaatatgtagaaggcgatgaacttcaaaagattaaagatgcattagtcaacgctagcatatacaaaggaagcgctattcagcaattgaaagctgattctgaactacttgcaagtaagatcactgaaaaggttgaagaagaaagaaaccaagcgttagaacaaattgattcgaagaagtcacaattgcaaggctttaatgaatttataaacttggatagtggtcaacagcagcaattattagctgagtttgaacgtattatagataaggtaaaacagcagtctttaatcgccatgatccgtgacgatgctcgtcgcttcgaggaacatacttattctcagttagtgcaaaaaatgatggcgtggtctcagcctataccaccaacaagcgagccttctaaaccaaactgcaataatgatggagcaggaagtgaactcaatggcggatcttctgatgttgtaacgggtgttaatgagcctgcgaaacctgagatccagagcgtatctgcaaagcagatacgagtcgaatataacaaaccttggttgtctacagaagatgatgttgatgggtatgttgcagaatataaaaaagcattgttggcagcaataaagtcaggaaagcacatacagatataa

SEQ ID NO: 376 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctggataaacgcggtcagtatgaaacctttaaagccgcgtttgccgatatcaatggctcacgctgggaagacgagcgcgacgcttactacttcatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattaccgaaaacctcggagtaatctgcggtggtcgcgcatgggttatcgtgacttcgcaggccgatatcaacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcacccaggcttgccagaatggcattcttgatgagttcgatggcaacctgcttaaaacgctgttcctgatccgttatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgtgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatattagccgcttcctgaacgggcacccattagacggcgcagtgcttaacgatctggtggtgaagatcctgacccctaaagatccgacctattcgttctataacagcgatgcgacctgtcgcccttatacgtcagaaggcgacggttgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgaacgcttaccgaaaaaatcctccacgccatcgaacattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaaccccgacgccatgcgcgaggtagaaagctggatcagcatgaatatcgaatacaataaacctgtgtatttacgcgatattctgaaccattttgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaagtcagagggcggaaacaatccggggaaaaacgagattgaatccggtctgcgcctgcttaatgccattcttaatgagaaagaagattttgccctgatcgaaaaagtgtcatcgctgaaagatgaacttctggatttcagcgaagatcgtgaagatttggtcgatttctaccgtaagcaattcgccacctggcaaaaactgggcgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcatcgccagcacgccctcgaacgcattgacgcccgcatcgaggaaagccgtcaacgcttgctcgaagcgctcgccacgtcagaactgcaaaacagcgttctgctgccgatgcaaaaagccagaaaacgcgctgaggtcagccagtcgattccggaaattttggcagaacagcaagagacgaaagcgctgcaaatggatgcagataaaaagattaacctgtggatcgacgagctgcgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgccattaaagcaggcgatcgcattcgccttcagtaa

SEQ ID NO: 377 - DNA, 3669 bp, Johnsonella ignava
atggaggaaactgttatgcagatcaaggacatgttccgaaagaaaattgaccgtgagatacagggcgttatcattgtcggtcagggtgaagagacgaatgtggtgcaggagcaggaagagtacgttgtgacccgtgagcttcagaggcattttgcagatttctttgcagcatataaaaaaggtattcagggaactacatcgaaaatgggtgtctggatttccggcttctttggaagtggtaaatctcattttctgaaaattctgtcctatctgcttcagaataaacaggtcggagacaaatatgccatcgactactttatcgaggatcagaagattaccaatcagatagtgctggcagatatgcagttggcagcgaacaccccatcggacgtaattcttttcaacattgattccaaaagcgattctaatggcaaggaaaacaaagatgccattgtgaacgtgttcctgaaggttttcaatgagatgcagggcttctgcggttctatgccgcaccttgccgacctggaggacaggctttccgaggaaggtcgttttgagaggtttaaggaaaagtttgaagaagagtatggcgatccgtgggaaagctctcgtcaggatttcgatttcattcaggattctgttgtcgatgtcctttctgacatggacttcatgagcgaatcggctgcccgcaactggtgcgagaaagcaactgagagctaccagatcagtattgaggattttgccaagcgtgtaaagtcctatattgagaaaaaaggtaacaaccaccatgtggttttccttgtggatgagattggtcagtacatcggtgatgattccaagctgatgctgaacctccagacagtgacagaagaactgggcaaggagtgtatgggaaaagcttgggtgatcgtaacgagccagcaggacatcgactctatcaccaaggtgaaaggtaacgacttttctaagattcagggacgtttcgatacacgtctttctctgtcctctgccaacgtagatgctgttatcaaaaagcgtattctggataagacggagacagcagcacagagcctgcgtctgctctatgaccagaaagcgaccatcatcaaaaatctgattgtattcaatgatggtgtggagaaaaagctgtatgccaatgcagaagattttgcagaggtttatccttttgttccgtaccagttcaatctgcttgccagtgtgctgaccagcatccgtacccacggtgcatccggtaagcacctgtccgagggtgaacgttccatgctggctctgttcaaggagtcagccatgcagctgatggacgatgagatgggaaccatcgtgccgttctatcggttctatgatgcattggagaacttccttgaccacagccacagcagcgtgctcattcgcgcttatgataacagctacatcaacctggaaaagaaggaaaaagatgtcttttctatcaatgtgttgaagactcttttcctgattaaatatgttctggaaatcgaagctaatgtggacaacatcgtcagcctgatgattaccagcattgatgatgaccgtatctctatgaaagcgcaggtggaagatgctctgaaagtgctgatgcgccagatgctgatccagaagaatggatccatctatgtattcctgaccgatgaggaacaggaaatcaacaatgaaatcgaaaaagaaaatgtggagatgtcggaagtcatcacgaagatcgcggagatgatttatgaggacattttctccagcaagaagtatcagtaccccagctttggcggacggtatgcgttctccttcaatcagacagtggatgaccgcacctataaggcaaaccagaattacgatataggtctccgtgtgctgaccccgtggtacgagggtggcaccgatgatggtacgctgcgactgctctcctgccagggcaaggaagtcattgtggttctgccgaatgatgatgcgttcctgagggaaatgcgggcatacttaaaaattgagcggttcctgcgcaagaatacttctgtgcggcttgccaagtatgagaccattaaggaagcaaagcgcgtggagatgcgggaacgcaacggcaacgccaagctttatttgacggaagctctgaaagaggctaccatctatgttaatggcgatgtgctgcacacctccggcaaggaagtaaccagccgcatcaatgaggctattggcagacttgtacagacagtttatcacaagttatcctacattgacgcagcgatgggcgaagcagatatccgtaagatgttcaagaccagcaaccagctgtcgctggcactgggaaataccggagaatccaatgtccacgcactgggtgatgtgctgcaatttgtggcgggtaattcccgtatgcacatgaagatttctatgaaaaccatcaaggatcgctttatgaaagcaccctatggctttgtggaagacgatatttattggctggtggcacggctctttaagcgcggagatctgtcctttaccgtcaacggagaaagtgttaatcttaataaccgctccgaagaggaaatcatcggctacatcacaaagaagcagttcgtagataagctgctgacggaagtacgcgttcgtgtaccggaaaatcagaaaaaggctgtccgcaccatgatgaaagagctgttcaagatgacgccgcctgccgatgatgaagataccattatgaaaaattttcagcgttactgcgagaatcggatcaccgagatcgagcggctggaaccgaaatatgagaattacgcctatcccggaaaagaaattctgaaaaaaggtaaaaagcggttttccgcattggtacagattcaggcaccgctggaattctttaagaccgtatttgacgagcaggacattctgatggattttagcgaggactatgaacctgtccgcaatttctttggcggtgagcagctgaccatcttcacccgtgcactggatatgctgaacatctacgaagacagtaagacttacatcgtggatgcagagctggaagatgtagtggcaaagatgcgcaccatcgtccggatggcaaagccctataaggaaatcccgaagctgccggaactgcgcgaaaagtttatgcactgctacatgcgcattttggatgagcaggcagagccggtcaaggattccattagccaggatcaaagcagagtgtttgaagtattgaacaccaagccatataaagatgcaaaattcaaccgctatctggaactgttcggggagatcatggacggtgcggagcattgcaacaatgtctccactctgcgcagctatgcagataaggcagaaaccttgaaactgcgactgctcaatgagatgacggaagaagataaccgccttgcaaaagaagcagcggcaaaggccgaagcagagcgtaagcgtcaggaagaagaggcgaaaaaacgtggcgagaccgtgaaatcggcagaaaagatggcagaagcgcagccggaatataaggtgcgcaccacgaagaacatctccatcaagacggttgccaagacagcatcgtggagactggagagcaaggatgacgttgataaataccttgctgcgttgcgtgaaaacctgctgaaagagatgaacgaagatacaatcgtcaacattgaactgtaa

SEQ ID NO: 378 - DNA, 3456 bp, Vibrio cholerae; identical to SEQ ID NO: 239

SEQ ID NO: 379 - DNA, 3456 bp, Vibrio cholerae; identical to SEQ ID NO: 239

SEQ ID NO: 380 - DNA, 3642 bp, Enterobacter sp.
atgaatattgaacagatctttgagaaacgtctggaccgaaatattaatggcgttgtgaaagccgaacagacggacgatgccagtgcctggattgagcttgatgaatacgtcatcacccgggaactggaaggacatcttcgccatttcttcgaatcttatgtcccggcaaccggtccggagcgtatacgcatggaaaacaaaattggcgtatgggtttcagggttctttggctcaggtaaatcacactttatcaagattctgtcgtatctattgtctaaccgcaaagtcagccataacggtacagaacgtaatgcatactccttctttgaagacaaaatcaaagatgctctgttcctcgctgatatcaacaaagcggtccatcatccgacggaagtgattctattcaatattgattctcgtgctaacgtcgatgacaaagaagacgccatccttaaagtcttcctgaaggtatttaacgaacgggttggctactgcgctgattttccgcacatcgctcatctggagcgtgagctggctaaacgcggccaatacgacgcgtttaagaccgcattttccactatcactggttcaagctgggaaaaagagcgcgattcctactatttcatcagcgatgaaatggcagaagctctaagccaggccacaggtcaaagcgttgacgcctcgcgtcaatgggtggaacagctggataagaacttcccattagatatcaataatttttgccagtgggtcaaagagtggctggatgaaaacggcaaaaacatcctcttcatggtggatgaggtcggccagttcatcggtaaaaatacgcagatgatgttgaagctacagactatcactgaaaacctgggtgtgatctgcggtggacgcgcatgggttattgttacctcccaggcggatatcaatgcggccattggtgggatgagcagccgtgacggacaggacttctctaaaattcagggccgtttctctacccgtttgcagctttcaagctccaatacatccgaagttatccaaaaacgtttgctggtgaaaactgatgctgcaagacccgcgctggcgaaagtctggcaggaaaaaggcgacatcctgcgtaaccagcttgcctttgatcctacaaccaccgcttctttgcgcccctacaccagtgaagaagaatttattgataactacccgtttgtcccgtggcactaccagattctgcagaaggtttttgagtctatccggaccaaaggtgccgccggtaaacagttagccatgggtgaacgctcgcagttagaagcgttccagactgcggcacagcagatcgccccgcgaggtctggattctctggttccgttctggcgtttctatgccgcaattgaaagcttcctggagcctgccgtcagccgtaccattactcaggcctgccagaatggtattcttgatgagttcgatggcaacttactgaaaacgctattcttgatccgctatgtcgatgttctgaaaagtacactcgataatctggtcaccctttcgatagataaaatcgataccgataaagtcgagcttcgccgccgcgttgaaaaaagcctgaacaaactggaacgggaaatgctgatagcacgtgttgaagacaaatacgtgttcctgaccaacgaagaaaaagagatcgagaacgagatccgcaacgtcgaaatcgatttctcagcgatcaataaaaaactggcgtcgatcatctttgatgacattctgaaaaacagaaaatatcgctatccagcgaataagcaggactttgatatcagccgcttccttaacgggcacccgttagacggcgcaatgcttaacgatctggtggtaaaaattcttacccccaaagatccgacctatacgttctataacagcgatgccgcctgccgtccttatacttcggaaggtgatggctgtattttgattcgcctcccagaggaggggcgcacctggaccgacattgatttagtcgttcagaccgaaaaattcctcaaggacaacgccggacaacgcccggaacaggccagcctgctttcagaaaaagcccgcgagaacagcgttcgcgaaaaaatgctgcgcgtccagctagagtcgcttattgccgaagcagacgtctgggcgattggcgagcgtttaccgaagaaatcttcgacgccgtccagcatcgtggatgaagcctgccgctatgtgattgaaaatacgtttgccaagctaaaaatgctgaagccgttcaacggcgatatcgcacgtgaaatccatgcgctgcttacagtagagaatgatacagagctggatctaggcgagctggaggaatctaatcctgaggcgatgcgggaagtggaaacctgggtcagtatgaacatcgagtacaataaaccggtctatttacgcgatgtcctgaaccactttgctcgtcgaccttatggatggccagaagaagaagtgaagctgttggttgctcgcctggcacgtaaaggcaaattcagctttagccagcagaataacaatatcgagcgtaagcaggtgtgggaactgttcaataacagtcgtcgccacagcgagctgcgtctgcacaaaattcgtcgtcacgacgaatcacaaattcgcaaagccgcacaacttatggcggatattgcccaacagccgtttagcgaacgtgaagaacccgcactggtcgaacatatccgtcaggtcttcgacgactggaagcaggagctgaatgtcttcagagcaaaagcggaaggtggaaacaatccaggcaaaaatgagattgagtcaggtctgcgcctgctgaattccattttgaatgaaaaagaagattttgccctgattgagaaggtcaccagccaggccaatgaactgctggatttcagtgaagatcgtgaagatttggtcgatttctaccgcaagcagtttgccacctggcaaaaactgggtgctgcactgaatggcagttttaaatccaaccgcagcgcgctggaaaaagacgccgtggcggtaaaagcgctgggtgaactggaaagtatctggcagatgccggagccttacaagcatctcaatcgcatcacgccgctgattgaacaggttcagaacgttaaccatcagttagttgaacagcaccgccagcgcgccctggaacgaattgacgcccgcatcgaagagagtcgtcaacgtttgcaggaagcgcatgccacatcggagctgcaaaacagcgttctgctgccgatgcaaaaagccagaaagcgcgctgaggtcagccattcgattccggaaattctggcggaacagcaagagacgaaagcgctacaaacggatgcagagaagaagattaaccagtggatcgacgagctgcgtaaaaagcaggaagcccagctacgagcagcgaatgaaaccacacgcgctgcagaatcacaacagacctatgttgtggcagaaaaacccgttatccaaccggtaccgaaaaaaacgcatctggtcaatgtcgccagcgagatgcgcaaagccaccggtggtgaagtgctggaaaccgccgagcaggtggaaaaagcgcttgatacgcttcgcgctgtgctgctggcagccattgaggcaggtgaccggattcgtcttcagtaa

SEQ ID NO: 381 - DNA, 3672 bp, Enterococcus faecium; identical to SEQ ID NO: 296

SEQ ID NO: 382 - DNA, 3456 bp, Vibrio cholerae; identical to SEQ ID NO: 239

SEQ ID NO: 383 - DNA, 3588 bp, Bacillus cereus
atgcaaattcaaaaaatgtttgaaaaagaaattacccgtgatattaaaggtgttattaaagttggacaagatgatgaaaaaaatatttatcaagaattagatgagtatgtcgtaacaaatgagttgttacatcatatgggtgagttctttaaatcatataaaaaaggaattactggacatacggataaaatgggggtttggatttcaggtttcttcggatctggtaaatcacacttcttaaaaatcctttcttatttattagaaaataaacatgtaatggatgaaaaagaaatcgataaagatgcaatttcattttttaataataaaatattagatccaatggtccttgcagatatgaaattggcgggaaatacaacaacggatgtaattctttttaacattgattcaaaaagtgaatcggattcgaaatcagataaaaatgcaattgtaaaagtatttaataaagtatttaatgagatgcaaggattctgtggttcgatcccgtggatagcagatttagaacgtcaaatggtgaaagacggctgctatgaggaatttaaggcggagtttgaaaagatttcggggaatacatggggagaagctcgagaagatttttattatgaagaagattcgattatagaagcgttgtcaaaaacaacgaaaatgagtgaggatgcagcacgtaattggtatgaacgtgcggaagaggattatttcattagtattgatcgctttgctaaacgtgtgcgtgaatatgtagaatcgagaggaaataaccatcatgttgtcttccttatagatgaactaggacaatatatcggtaatgattcacaactgatgctgaatctacaaacagtggtagaagatatcggaacgcagtgtggagggaaagtatgggtactggtaacaagtcagcaagatattgactctgttgttaaagttaacggaaacgacttttcaaagattcaaggccgttttgatacaagattaagtctgtcaagtgctcatgtagatgaagtaattaaaaagcgtattttattgaaaaacgaaacgggtaagcaaactttaagacttctatatagcgataatagttccatcttaaagaatttaattacattctctggtgatacagcagaaatgaaaatatttaataacgaggaagatttcgtagatgtttatccgtttattccataccaatttaatttactacaaaaagtatttactggtattcgaattcatggagcatcaggaaagcatttagcagagggagagcgctctttattaagcgcattccaagaatcagcaatgaagtatgctgaaagtgagactggggctcttatcccattttcggtgttctatcaaacaatagaagcatttttagattcaagtattcgtactgtaatcatccatgcgcaaaacaattcacgtttaaatgaatacgatgtagaagtattgaaattactattcttaattaaatatgtaaaagaactacctgcaaacttagaaaatctagcaaccttaatgattcaaaacataagtgacgataaaattgagttgaagaagaagattgaaagttcattaattcgattaagtaaagaaacattaattcaaaaaaatggacaagagtatattttcttaacaaatgatgaacaagatgttaaccgtgaaattaaaaatatgcatgttgattcagcagaagttatccaaaaaattggtgatgtcatttttaatgtggtttatcaagataaaaaatatcgctattctcctaaatatcattttagttttaatacaattattgatgatcgtccgattggtatgcagacgaatgatattggtttgaagattattacgccatattttgatgcaacaactgaattaaatgattctgaattgaaaatgatgtctatacgtgagagtaatgtaatactaagattacctcaagatacatcttatttagatgaaatgacagagatattaagaatacaggcatacttaaaaatcaaaagtggcacggcagtttcgcaagcgattgaagatattaaagttcgtaaatcaagagaagcgaacgaacgaaaagaacgtgttcacacatatgtaaaagaagcattaaaacatgcggaaatctttgttaactcgcagcaattagatgtaaaagagaaaaatcctgttgagagaattaacgatgcttttaaagtattgattgataatttatataataagttgcattatgtgaagaaatttatcgacacagcgaagcaattaaatgaattgttagttgaaaattcaacgcagttaacgctgtcaggagataatgaagatgctaatcagttagcggttaaagaggtgaacgactatatcgctcgtttaacaactcgcaaccaacagattacgattaaaggcattacaacccattttacaaaacaaccatatgggtggaaagaccttgatattgtttcattcattattaaattgtttaaagggcaagaaattaaattacaattgaatagtagtaatttaacgacaagtgagcgcgatttagtaaactacttaacaaaacgtgattatgtagaacgtgtcattgtgaaaaagagggaacgtatttcaccagcactaatgaaggttgttaaaaatctatcaaaagaagtgtttgaagttactgctttaccggatgatgaagatggattaatgaatcgttttaaagaattactaacatctgagcaaaataaaataaatgtattgctagttcaatatcgtaatactttctatccaggtcaggatgtattgcaagatggtaaagaatcgattgaacagctactaaacatttcagatacaacaagtttctataataaagcaaaacaattacaaaatgatttcttggattatgcagaagatgtggagcctgtaaaagctttctttgaaacacagcgagatatttatgacgatgcagtgaaacgattaaacatctttgagaagaaccaaacatatgtaacagaccaaaaggtaactggtttcattgagagtatatcgaagattgtgaaacataaagaaccatatagaaatattcatcaattaccggggcttattaaagagtttgatgaactatttgtagaattgttagaaaaagaatgtgagccaattaagaaggtaattgaagctgattatgaaactgttttagaagaacttaataagcatgaagagattaaaagtgcgcttttcaacaaatttaaaaataattttgacggtataaaggatagattgaaccgagtaaacaatttctatgaagcaattgcaatgcaaaccgaaagtgatcgattgaaagtaagaagtattgatgatattgcaaatgaagtcgaaagacgtaagccactagtcacaccaccacctacagtaactactggtactggtggcgccactgttattgatccgatcgttgaatataaagctaaaaagaaaacaattagtaaaaatacaattcttcgtggaacgaaaataattgaaaatgaagaagatattgaagcagtactagatgaaattcgaaaacaattacaaaaagaattagaagacgcttcagttattaaattagtgtaa

SEQ ID NO: 384 - DNA, 3672 bp, Enterococcus faecium; identical to SEQ ID NO: 296

SEQ ID NO: 385 - DNA, 3642 bp, Salmonella enterica; identical to SEQ ID NO: 8

SEQ ID NO: 386 - DNA, 3456 bp, Vibrio cholerae; identical to SEQ ID NO: 239

SEQ ID NO: 387 - DNA, 3456 bp, Vibrio cholerae; identical to SEQ ID NO: 239

SEQ ID NO: 388 - DNA, 3642 bp, Escherichia coli; identical to SEQ ID NO: 249

SEQ ID NO: 389 - DNA, 3642 bp, Salmonella enterica; identical to SEQ ID NO: 8

SEQ ID NO: 390 - DNA, 3567 bp, Bacillus cereus
atgttgcaagattcttttacaattaaagaattatttaaaaaagaaattgatcgtgaaattaatggtgttgttcaggctggacagcgagatgaagatgttattcaaaatgaattagaagagtacgtaatgacaaaagaaattagcgagaatatggcgtacttcttcaaaaattatgcatatagctttgaaaatcaaacaacgaaaatgggcgtatggatttctggtttctttggatctggtaaatctcacttcttaaaaattttatcgtacttattaaacaatgaaaaagtatatggcaaacgagctgtagatttttttgtgaataagactgatgatcaggagttattagatatccttcaacaatctgcaaactataagagccaagcgatcttatttaatgtagattctaaatcagcaagtgggaaaaaagaaaaagcgacgatagtagatgtatttttcaaagtgtttaatgaatatttaggttactcttctacaccatggattgctaatttagaaaggcaacttgcagaagagggaatttataatcagtttgttgagcgttttgaagagatagacggtacgaaatggatagatagtcgtgcacgtttactattcaagaaaaaatcatttgttgaggcattaacacaattaggttacacagcggatacagctgaatctgtcttatctgcatctaataaaaatttcgagatgagttctacagacttcgctaagttagttgctcaacatgtgaagaatcaaggtgaagagtaccgtcttacattcttagtggatgaaattggtcagtatattggtgacgatactaatttaatgctaaaccttcaaacggtaacagaagatttaggaaatcactgtcacggtaaagtttgggttattgttacatcgcaagaacaaattgatgcagtgacaaaaattaaagggacagagagcttttcgaaaattcaaggccgttttgcaacaaaaattcatcttactagctctaatacagatgaggttattaaacgccgtcttttagaaaaaacagcagcaacagcagatcgcttacaaattgatttcgatcaaattggtcaaagtttaaataacacattgacgttcgagaaagataaatcagtactacaaaatggatttaaagaagcagatgaatatgcatctatttatccattcattccatatcaagtagaattactacaacgtgtatttaataaggttcgccgacagggagaagctggtgcacatttatcgcaaggggaacgttctttattgaatgctttccaagaagttgcgattcagttgaaagaggaagatacaaatcaattagcacgattctcacagttttacgaaacagtaaaacgtttcttaagcacgtctgtttcagctacgattattgaagctagcaagcgtgatggcattactgaatttgatatagaagtacttaaagtcttattcatgattaaaggcattgatgaagtaaaagcaactgttgaaaacattacaacgttgcttgtagatagtgtagactgcattaaaaatgaattagaaaaagatgtaaaacaatcattataccgccttcgccaaaaaatgctaatcgcagaaaatgcagatcgtacatttgttttcttaagtgatgatgagcaagaaattaaccgtgaaattcaaagtgagcatgtaaatgaagcgaatgtagtagatgcgctcggtagagttttctatgaagaaatcgtacaagtgaaatcatatcgttaccaaaaaacacatgactttgaatttaataaggcatttgacacatacaaccgtggtggaaagacaaatacattaacactgcaagtttatacaggcgatgtttcagaagaacaagctcgtgcagatgcaaattctggaacgatgattatgtatattccggatcactacgcagaaaagttctttgagccgatggaatatgcacaaaagatccaagcctttgctaataaaaagatttcaacgagcctaactgagaaacaaaagagagtattagaagaaaaacgtcaacaaattagtgaatttgagaaaaaagcaagagaagcattagccgaagcagcaacaaatgcaaaatactttattcaaggacaagattacgaatttaagagtacattagaaagccaattacaaagtgcatttgagattttagttcgaaatacgtatagctatttaggctatattgatgaaccagtacctgtgaaaaatgcaaatgacatcattcttgagtgggcaacaaaagggctgccggcaagattagatggaacatttggaaaccacttagcttatgatacagttgttcgcttcttagaggaaaatcgcggtagacaaattgttacaatgaaattgttagtagagaaatttaaagatgtaccatacggatggagtgaaaatgatatcgctggtatggtcgcagcagcgctctataataaaaaaattaagctgatgtatttaaatgaaagctttgatataacaaactcgcagtttatccctcgaattacaaaggcttctgaaagagaaaaagttgttattgaggcgcaaatcggtataccatcgcgtgtgcgtaaagaagttgtagaaacaatgcgcgaactatttaacttctatgatattggtgaaacttacgatgaagttgcgaaaagtattcgtaatcaaattcaaaaacatttcatagagccaattgaggatatgcagcgtatgaagcaacgtgaagaccaacaatatccatatccaggtggtattgcactttctaaaattaaaaatagcattgtagacttattggctattacaaaacaagaaaactttgtagaagaatttattgagctggatgaggatctagaagactggttagaagatgtgcagcatttaaactcgttctataatggtaatgcaattcgtcattttgatgaaagtgtacgtgtattaaaagaacgccgagatgatttagatgtagcacagcatgatgcagaagtgcaaaaggtaaagaatagcatcgtaaatattttaacaagtgataatccatacaagcagattccgaacttgccaattttgaatgaacaattaaaagaaggtctttctaacttcgttaaacgcgaacttggtacacagttaatgcaaatggaagtaattcgtcgtgatatggaaagcctacaaacacgatatgaaaatattgattccatcaaagaagtagttcaagagaaaattgttgaattgcagaaacgcattgaacaaatggaagatcttgaaagtatttcacgtgtgtatacttacacacaaatggccaacaatgattatcgccgtttggaagaaaaagttcaggagctacataaagattacactcatgatccagatgatccaaacggtactgatcaaattgtagttgtggaaatgagcgtttcacaattgatgtcagctgcagtaccaactggtaagattgaaattaagaatagtcaagatttaaagaagtggttaaaaaatcttgaagatgaaataaataaagaattagaccaaagaaaagtagtaatgattaaaaattaa

SEQ ID NO: 391 - DNA, 3633 bp, Lactobacillus rhamnosus
atgaaaattaaggatctttttaaacgaccaattgaccgcaacatccaaggggttattaaagttgatcaagatgacgaagcaaacgttaaacaggaactagacgagtatgttgttacgcgtgagttacgtgaccattttgcagcgttctttagtgcttttgataatagtttgcagaccccgactgacgatatgggtgtctggatttcaggtttctttgggtccgggaaatcgcattttttaaaaatcgtgtcatatattttggcaaacaaaattgttgatggaaaaccagcagttgattattttgacgacaaaatagacgaccagatgattcttaatgagatgcatgctgcggcggcggcaaacaatgatgtcattctgttcaatatcgatgctaaggcgaaagacacagttgggtcagataaacaaagcattttgaaagtcttcatgcgggtcttcaacgaaatgcaaggatttaccgacgccgatttttggattgctgaccttgagcggcgtctgaccgaagctggaaagatggatgcttttaaggagcaaattaaagcgattgatgccaatcatcagtcttggatagagttgcgtgacgcatattatctgaataaaggtacgatcaaggaagcaatggtgaaatccggattctctgacgaggcgaatgctcagggtttcattgaaacgctgagcaccgaataccagatcagtatcgatgattttgctgctttggttaaacagtatatcgacaaaactggacgccgggtcatcttcttggccgatgaggttggccagttcataggtgacagtgtacagcggatgcttaatttgcagacgattgtcgaacaactgggaacgatgacacgcggcaaatcatgggtagtcgtgacttctcagcaggcaattgacaaagtgacggacattgcatctggacaagacttttcgaaaattcaaggtcgcttcaaaacacgtttgtcgatgagctcggctaatgttgatgaagttattcgcaagcggttattggaaaagactgatgttgccgagcagatgcttgaagatcagtattctgcaaacgctgcagctattaataattcaattgatttcgatgatggtgtagagcggccaaaatataagtcgccaaaagattttgcacaaaactatccgtttattccatatcagtttaatcttctacaacaggtgctgactgcgattcgtgaaaacggttcggatggtaaacatttgtctgaaggcgagcgatcaatgctttccctcttccaagagtcagctgaagctatgatggatgcggacacagagacgcttgcaccatttagtcgctttttcgatggtttggaacaattcttggatcatacccatcacatcgtcctagtgcgtgcccacgacaatcctgctgttaatccgaacgacgagaagaatccgtttgcactgcagctgcttaaagtattgttcatggtcaagtatgttactgactttaacgcatcattgaacaatttgatcaccctgatgattagttcggtcgatgcagatcgaattgcacttaagaaaaaagttagcgatgcacttgaggttctagtcggacaaggttacgttgaaaaaacagtcaagggttatgactttttgactgatgctgaacaagatattacacgcgaaatttcgaaacaagaagtgattgacaatgaggttgccaaggaaattggggattacttgttcaatgccaagccaggtattgcaacgagtttaacttatcccaaactgaatggtcgctatgtctttgcttttaatcggaaaacggacaatatttttggcgcacagcgaaacaagctttcagtgcacatcattacgccagtgaatgatgaatttcagagtgacaacgattatttacaagtttcgactggtgcgtggaatcatgatgtcttgattgctttaccacgttcgtcaaactttgtcgatgaaattcgaaatgcattacgaattcagaagtttgttgttaatagcagtgcatcaagcgattcacgttaccagggaatggtgttggctcgccaatctcagcaaaatgaagagttccagcacgctcatgaacagttgatcgcatcgcttgataatgcagctatttatgaaaacggccaattgattaatggcgaagcagggttcgatagtcgattagaacaggcaatgaagctcttagttgacaatacgtatcgcagtttgcagtacatcactgttgccaaatctgagaaggatattcgcgaacttttcgaaagtatctccagcctggcgcttgacgagcaagacaatcaagctgcggttgatgctgttctggattatatgcggcgcgagtcacagaataatacgcatatcaccatggaaagcatcttgtcgaagtttaatgatattccatatggctacacggatgaagatattcaatggctcgtcgcaaaattggtcgctattggcaaacttaagatgttttacaatggtacagtaatagatccgctaagtggtgaacggacaccgcgtgaaattgcaggtttctttactaagaagcaagcaattcgtaatttggcctttcagattaaagaagaagttgcgccttcaaagatcaaagcgatgcaggcagttgcttctgaagtgtttggaaagaaatcatttgaggctgataacgatgaacagagagccgcagaactaagaaaactaatcgtgactaagtatcaaactttgaagacttttgaagataaacctcaagattatcccgggcatgtgttgttacaacaaggacttcagttactccgtccaatgactgaaatgtctgattctggtgcgttttatgattatatcagtaaacataaagacgacttactggactggaacgatgattttcttgatgatggcattcgtgacttttattactcgcagtcaatgcaagatatctgggacaagggtttaaatgcgttgcgcgtttaccgagagtcaagtgatttcttaagtgacaatcagctacaagatacagttgacaagatggcaaagttgcttcgcttgcaaagacttcagggcgatacagccgttaaaatcagcgaattaaataagcagtttgatgaattatttagtgcggcttttgataagacagcggctggttatttagcggacattgatgatttccgtgaacgtggcttgacacgtattgaaaaatcagcgatacctgatcagaacgtgaaagataaactagctcatgattttgaaaatagaattaaagctatttctgaggcagccacagatgccacaaccttaaatgaggttgtagcaaaaccagctcaagctagtgcgcaattagatcaactgacggaccgaattaaccatgcaaaggcgcaattaataccagtgcctgaccattcagatgaggacaacactggcggtaagcataaggatccagataagcctgtggttcccaaggtcgtttcaccacaagagaagatcgtcaaactggaagaggttcttcacaagggtgactacaaaatcacaacctcgactgatgttgataagctaactgctcagtttaagcgctcacttgaggctcaactgtcagataacacggttgtgacattgcaaatcgattag

SEQ ID NO: 392 - DNA, 3645 bp, Haloarcula japonica
atgagtgacactacttctacctaccaaatcaacgagatcttctaccggccgatcaatcggaagatcgaccgggtcgtcaaagtcgataacgatgacccgagcgtcgtcaagaaagaactcgaagagtacatcctcacaccgcaactcgaacggcacttctcggacgccctagaggccgtcatcgacacggaacacgcccaaacagaggacgttgggatgtgggtttccggattcttcggatccgggaaaagccacttcatgaagatcctcgggcacgtcttggaaaaccgggagttcggggatacgtatgcggcggagatgttccgcgatcggatcgagggcaacgagatgctcgacggggccgtctcgtcggtcacgaacaaattcgattccgaggtgttgatgttccagatcggcgcgaaggccgatgcatctggaagcgaatccatcaccgagatcattcaccgtgaattcaacacgtcccgcgggtacgcttccatgccctgggtcgcccagatggaacaggaactcgaatcacgaggcgtgtacgatgacttcgtcgctaccatcgagtcaaacaccgggaaagactggacagaggcccgtaaagatgcgatgttcgtgcggtcggatatggagactgcgctggtagaagcgacagacgagttcgacgacgaagacgacgcagcccgtgcgatcgatgacgttcaggacaacgttctgatcaacgcttcgaccctcgcggaagacatcgtcgaatacgtcgaacagcaggaacgcgaaacggggaacaactcccgatacttcgtcttcatcgacgaaatctcccagttcatcggagatgatggacagctcctcttggaactccagagtatcgtcgaggagttcggccagaaaggcaaggggaaggtatatctcggagtcacgtcccaggaacagctccagcagctcatccccggtgtgctcgaaaaagaagccgaggaatcgaaagtcatcgatcgattcccgcaccggttcgacctcacgtccgaaaacctcgacaaggtcgtccgtgaccgtgttctcagcaagaaaggcgacgccagggaagccatcgggaatctgtacgatcagcatgaaggcatcctttccgccaggtacaagctcgattccggtcagagtctgaagccaatcacgagagagaactttatcgactgctacccgttccttccgtaccagctcgacattctcccggagatgttcaaggcacttggcaaaggctcggatgaccaactcgcgggcagcgagcgaacgctcatcgatgtcacacagagcgtgctgaaagacgaggcccatctctacaacgacgaactcggggcactcgtcacgctcgatatgatcttcgacgagatcagcaacgacatcccgagcaacgatgtcaaatccatccgggaagccacaccaaagaacgccgatccagaaatcgccagccgcgttctcaagtcactctatctactccaacaactcccctggatcccgaacaccgccgacaacattgcaacctcactccagacggagctcggccccacgaagcagttagaaaacgacgtacaagatacgcttgatgcactcgtcgaagccgggctcgtcgggcgaagcgaagagggctaccggttccttcgagagaccgagcgtgaactcgaaaacgaaatcaaaagcatcgaggtcggccccggcgacatccgtcgctcctcgaagcgcttcctgaacgacatccttgacgaaacatcccgcgtcaattaccaagggaaaacgttccagttgaatctgagtatcgacggagaaaccatcacgtcgaacggacacgtcgatctcaaaacctactcaccgatccaccagcggtacgaagaccttgacccggatgggctgaagacacagagtttcagtgaagacgatacgctgtactggattgcagacggcgagaagcaacacagcatctacgagaagctaaaatcgatctaccagatcaataccgtcgtcaagtcaaaacgagggaacgaactcagccaagaggagcaggaagccctcgggcagaagcaagaagatctccagcgtctccggaacgaggtcgaacgcgagttcaaacggagcttccagcgcggcacactcatctacaacggtgacaccgaagaattcgacacgacaagcacctcacttagctcgctcgtgtcccggaagacggacaacgccattcccaaagtcttctccagtttcaaacacgggtcagccacggtcaaagatcgtcacatcgagcagatattcgaagatctccaaggctcgtcgaacccatctgtgttctcggacctcggcgtcgtccaagacggcgatctcatcgcagaggcccgcatcgcttccgaggtcgaagacgaaattcagcgacgcgagaaagccggagagtcccgctctggaagcgatctgatcgaccacttcgctgaaccaccgtacgggtggagccgggaagtcgttcgcctggccgctgccgtgctctttagaaacggatccgtcattccgacacacaaggagcgaacgtacgagacgtattccgaggacggcgcacaggagctgttcacgcaagtcacgaaattcaagtccacgtcgttcgatgagcgggagaccgtcgatgtcgaaacacgaaccgatgcgaagcaactcctcgaccgactcttcgaccggaaggtcaaatcgaccgaccaggccgtcgacgagggaatcagagaggcagcaaacgagtgggtttcaaccacgagcacactcctctcgcaactccagcgggtcgacttcccgctggcagacgacgtagagcaattccagacgcgattaaacaatctgctgcaacaacccacgtcggccaagcgtatcaaacagttcgtcgacttcgaagacgaactcgaaggcctcacgaaaaccgcgaaggatgtcgccgaattctgcggtgagaccggcggccaaaaccggttggagacctacgaaaccattcagcggttcatcacgaccgagtgggagtctctcgtcgacgaggccgatgaccacgctgggcttgtcgacatcagcgatgaagcgcgtgaggcggcccgccgcgttgctgatacgttagacacggaaggtgtcatcagccagtggaacaatgtcaagactgactaccgaactaccgccgaagccttcacgaccacgtacgaatccctgtacgagaaacgccacgagacgtacacagagtccatcgaattggttcgggcgtatgctggatccgacatcgatgaaaccgatcttgacactgctctgtccgatctgacggaacgacagggggatgggtcggtcgatctgaatatctccaatgaggagcacatcaatccgacaccgtcgcttccacggctcatcgagcatatccagaccgttgattcgtacgaagacgctgcgaaggccgagattgatgacctggaagatgatgaggacgacggcactgttcgagaaagcgtggacatcgactccatcttcggatccatcgtcgtcaccgatccggacgacatcgatcaaccgatctcagaacttcgcgcagagaccgaagaacttcttgatcaggatggagacatagagatccgatttagataa

SEQ ID NO: 393 - DNA, 3633 bp, Lactobacillus rhamnosus; identical to SEQ ID NO: 391

SEQ ID NO: 394 - DNA, 3642 bp, Salmonella enterica; identical to SEQ ID NO: 8

SEQ ID NO: 395 - DNA, 3660 bp, Vibrio tubiashii
atgaacatcaaagaactcttttttaagccactggatcgctcaattaacggcgttgttaaggctgaccaggatgatgatgccactgtttaccaggagctggatgaatatgtggtgaccaatgagctggagaagcattttcgggatttctttcagtcctacggtaccgatctcaatgacccctccatcgctaaccgtgtgggggtgtggatttctggtttcttcggttctggtaaatcgcacttcttgaagacgttatcctatattctggctaacacggtggcgcgggattcagagggtaacgaacgcagcgcagtagagttttttgatgaacacaagatccgcgatgcttttattcgtgcagatattgataaggccgtaagcggtcattccgatgtcattcttttcaatattgacagtaaggccagctcaaacgatgacggcaaccctatccttaatgtcttcctgcgagtgttcaatgagcaccagggttttagcggcgatcatccgcacatcgcgcacatggaacgccatttggcacagaaaggtgcctatgagaccttcaaggctgcttttgaagaatccagcggtctatcatggactgaggaacgagacgggtatcagttctaccaagatgacgtagagaaggccatttccaaggcattgaacctgtcaccagatgctgcccataaatggtttgaagaatccgaagaggcgttcagcgtctccgtcgaaaacttctgtcactgggtcaaagagtacctggacagtaaagatccgaaacacaggatactgtttctggtggatgaagtcggtcagtttattggcagtaatacccgcctgatgctgaccttgcaaaccatcacggaaaacctgggcaccatttgtaaggggcgtgcctggatcatagtaacctctcaggccgatatggacgcggtactgggtgaactgtcatcttccaaagccaacgatttctccaagattgccggtcgcttcaagacccggttgtcactgtccagctcgaacaccgatgaggttatccagaagcgcttgctgcgtaagactccggaagcagcggacatgctcaagtccgtgttcgaccagaaaggcgacatcctgaagaaccaaattaccttcgatcgttctgggccgacgctcaaaaactttgatggtccagatagcttcgtcaataactatccgtttgcgccttaccacttccagttggtacagaaggtttttgaggagatccgtaaagtcggggccaccggggcgcacctggcttacggtgagcggtctatgctggacgccttccaaatggccgccagctccatcgccaaggaagaggtgggagctctcgtgccaatgcaccgcttctatagtgccgttgaaggctttttggatacagccgtcaaacgcaccatcgatcaggccggtgaaaatgccacgctggacagtttcgatgttcagatgctccgcacattgttcatgatccgctatgtagacctgatcaaaggaactctcgataacctggtcaccctgtcgatagagaaaattgacgatgacaagctggcgctacgcaaacgtatcgaggagagccttcagcgtctggagaaggaaagcctgatcacccgtaatggtgatgagttcctgttcctgaccaacgaagagcgggacattactcagaagattaaggctactgacgttgccagctcggaagaaaacaaagaactgagcaacctgattttcaaagaccttctgcgagataccaataaataccggcatcaacccaacaagatggactacagcattggccggtacctggatgggcataccctggacggtaagtatgaagctgacctgaaagtggaagtggtgtcaccgctggacactgattacagccaatactctgaggctggctgcatcaacaaaagcgcagagggcgaaggtcaaatccttattaagctgggcgatgataaacagtttttcagtgaactccgcacctggctgaagaccaacaagtttattcgtctgaacgacgacggtacccaggcggacattacccgtatcttggctgatcgtggtcgggagaaccaggagcgtaaaaagcgcctgcgtgcccggatggaagacatgctgttgaaagcggaggtctacgctcttggtcagcatctttctctatcttcatccaatgcacttaccaagcttgatgaggcttgccgctacctgctggagaatacttacaccaagctgagctatatcaaggtctaccagcaagatccctggcgcgagcttaatgccgttctgaccgtcgatgatattggacaaatgggcctgtcattggaaggtgaagagggtaatccaaaggcaacccgcgatgttgagcaatacatcgggcttagggcgaccgggaccgagcgtatcctgctttcagacattgttgagcgtttcgcgaagcgaccgtatggctggccagatgccgagattttgttgattgttggccgtttggctgcggctggccggatctcgttccagcttggggggggaacgctgcctgtcagggaagcgctggagcctctccagaatacacgccgtcgtcgcgaagtctcaattatcaagaaacgccaaaccgatgaggcagtgctgaagcaggcgcgtaacctgactcaagacctgttctcttcaatggggcctgccactgagaaggagttgttcgagttttacactcagcacttcagcaagtggctggccaatctcaaatcctacaagagcaaaaccgatgtgggccgttttccagggaagacagtgattgagcagtcaatcctgactctggagcgcttgcttagtaatgatgatagcttcgatttcttcaagcaggtcgtggataagaaggacgattatctcgatctggaggaggattaccgggacatccacgaattcttcagtaaccagatccacacctggcagcagcttcagcaggcgcttcgtcactttgataagaaccgtcaggcgttggagaaggacgcggaagccagtaaggctttgtcggaactgcaatctatcgaatcagcagatgcgccttacgggatgttgcacaaggtcgcttctctggtaagcggagtagaaaccgtcaacgaacgtctgctaactgaaaagcgaacccatgccattgagcgagtggacgacaaaatcaaacagcttgaaggtgagatcgccaagagtggtattggctcccctgagctgagcaaccggctacttcgaccactacaactggtgaaagcagatttagagacggagaccagtattgccggtatctacatgctgcaaaccgaaacagccactgaacgctttgatgatggtctgtatgaacttgagcgagcggttcaggcagagattgagcgccgcgccaaagcagaacaggccgcgaaagctcagcaaactgccccaaccggtgcagatacgtccacaccgatcccggatacaaaaccagagccacccgttgctaagcctaaacctgttgtcgaggtgaatgtgtccagcgtctataacaagacctgtgaaggcgtgtacttggaaactgaagaatccatcgaccagtttgtggaagccctcaaaactgagttgaagagcattgttcgcaatgaaaagcgcgtgcgtattcgctaa

SEQ ID NO: 396 - DNA, 3456 bp, Vibrio cholerae; identical to SEQ ID NO: 239

SEQ ID NO: 397 - DNA, 3456 bp, Vibrio cholerae; identical to SEQ ID NO: 239

SEQ ID NO: 398 - DNA, 3642 bp, Salmonella enterica; identical to SEQ ID NO: 8

SEQ ID NO: 399 - DNA, 3642 bp, Escherichia coli; identical to SEQ ID NO: 56

SEQ ID NO: 400 - DNA, 3666 bp, Lactobacillus reuteri; identical to SEQ ID NO: 73

SEQ ID NO: 401 - DNA, 3456 bp, Vibrio cholerae; identical to SEQ ID NO: 239

SEQ ID NO: 402 - DNA, 3456 bp, Vibrio cholerae; identical to SEQ ID NO: 239

SEQ ID NO: 403 - DNA, 3642 bp, Escherichia coli; identical to SEQ ID NO: 53

SEQ ID NO: 404 - DNA, 3672 bp, Enterococcus faecium; identical to SEQ ID NO: 296

SEQ ID NO: 405 - DNA, 3456 bp, Vibrio cholerae; identical to SEQ ID NO: 239

SEQ ID NO: 406 - DNA, 3567 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaaaggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcacgctgggaagacgagcgcgacgcttactacttcatcagcgatgacatggcacaagcattaagccaggccacgcagcagagtcttgaagcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttttcaacacgcctgcaactttccagctctaacacatcagaagttatccagaaacgtttgttggtaaagactgacgaagcaaaagcagcgctggcaaaagtgtggcaagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggctatgggtgagcgttctcagctggaggcattccagactgcggcgcagcaaatctcagcgcaagggctggattctctggtgcctttctggcgcttctatgccgccattgagagcttcctggaacctgccgttagccgcaccatcacccaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcacccattagacggcgcagtgcttaacgatctggtggtgaagatcctgacccctaaagatccgacctattcgttctataacagcgatgcgacctgtcgcccttatacgtcagaaggcgacggctgtattttgattcgtctgccggaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagatgtctgggcgattggcgagcgcttaccgaaaaaatcctccacgccatcgaatattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaacaccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaagtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaatgagattgaatccggtctgcgcctgcttaatgccattcttaatgaaaaagaagattttgccctgatcgaaaaagtctcatcgctgaaagatgaacttctggatttcagtgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaacgcttgctggaagcgcacgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgcgtaaaaagcaagaggcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgaaccgccccgggtttcctggagagtgttttatctgtga

SEQ ID NO: 407 - DNA, 3570 bp, Sphingobium indicum
atgaccattttgcgcgacatattcgagaagcccgtcgaccgtccgattgaaggcgtcatcaaggcagacgacgacgcgagcctgcgtatcgagctcgaggaatatgttctgaccaacgagatcgagaagcagatcgaaaagtttctcgacgcctacaaaaactacacgaccgctaatggcgtctggatctccggctttttcgggtcgggtaaatcgcaccttctcaagatgctggcgatggtgctcgagaaccgcaaggtcgacggcgcaacggcctatgagctgttcaaggacaagtgcgcggataacgaaatcctatcggctgacctcaagcgtgccgttgcgatcccgtcaaggagtatcctgttcaacatcgaccagaaggctgatgtcatttcaaaggaccagatcgatgcgctgctgtcggtcttccagaaggtctttgatgaggcctgcggctactatggcaagcaggctcacattgcccagttcgagcgcgatctcgacagccgaaatgtcttcagtgcctttagagaggcctatcaggcgattgccggaaaaccctgggagcgtgggcgagaacaagccctgcttgaaggcactaatatcgccaatgcttatgcaaaggcgaccggtgctgatgcgtccgaggcagccgggattctcaccaagtaccgctcggactacaaggtttcgatcgaggatttcgccgacaaggtgaaggcctatatcgatgctcaaggcaaggatttccgcctcaatttcttcgttgacgaggtcggccagtacatcgctgacaacgtcaagctgatgaccaacctccagacgatcgccgagagtctgaacaccaagtgccgcgggcgagcctggattatcgtaaccgcgcagcaggacatgaatgccgtcattggcgacatgaacgagcgccaggaaaacgacttttccaagatccaggcgcgttttgccaatcgcatgccgctcaacagcgcggacgttgcagaggtgatccagaagcgcctgcttaagaagacagagctgggggtggagagcctctctgatctgtaccgccgcgagagcaacaacatgcgtacgttgttcgattttgcggatggttcgatccatctgaagaactttgaggaccgcgaccacttcatccacagctacccgttcatcccatatcagtacccgctgttccagatggccatacaggggctgtcgcagcacaacgcgtttgaaggccggcatagttcggttggcgagcgttcgatgctgggcgtattccaggaggtcgccattcatctggctgaactggagcttggccagatcgcgaccttcgatctcatgtttgaggggatccgcacggcactcaagtccagcgttcagcaatccattcagattgccgaacgcaaccttggggacgagtttgccacgcgcattctgaaggccctgtttctcgtcaaatatgtgaagccgttcaaaccgacggcccgcaatatcgccatcctcatgcgcgagaaattcgacgaggatgaaaccgcgctcaaacgccgggtcgaggcggctctgagcctgctcgaacaaaatacctacatccagcgcaatggcgacctcttcgaattcctgaccgacgaggaaaaggatgtcgaacaggagatcaagaacgtcgatgtcgatgccgccgaggtcgctcgggagttggaggcgctgatctttgatggggtcatcaaggaccgtaagatccgccatgacggggcggcccatgactactcatttgcccgcaagctcgacgatcgccttcaaggacgggattacgagctttcgatcaatgtggtcacgcctttccacgagcatagcggcaatgccgaggcgctgcgtatgggcagcatgtcaaaagacgagctggtgatccttctcaaggcagacgaccgcttcgcccgtgacctggtgatgtacaagcagaccgagaagtatgtccgccagacccgggcgaccgctccccaggcctcgattgaacggatcatcagcgagaagggtcaacagaacgcgaaccgctacagagatctctcaacccgcgcgagaacactggttgcggaagcgcagctgttcgtccgcggtgaggaactggatctgcgcggcgaggatccgcaagcgcgggtccggcgcgcattccagatgttggtcgacaaggtctacaccaatctgccgatgctgcgcggggcgacctttgccgagaccgatatcggccgcttcctgaggcagaccaatgacggcgcgctgatctcgggtgccagcaaccttaccgaagccgagcaggaaatcctgaactttgcgcaaggcaacgtccgcaccggtgttcgcacgtcggtgaaggcgattgtcgagaagttcgaggtcaagccctatggctggcccaatgccgcgatcctgtgcactgtcgccagcctctttgcccatggcaagctggaagcccgctccgatggcgctccgctggagggggacgcgctggaaaaggcgctgaagaacgcgcatgcactggcgaacatagtgctcgatctgcaggtggagttcaccgccaaccaggtccggaccctgcgggaattctatgccgagatgttcgacagccagcctgtcgcttccgaagcaaaggccctgggcaaggaaacgggagaggctatcacgaagctggtggctcaactggtagcgctggaggcgcaactccaggattatccgttcctcgcggcgatcaccccggtcatcgcaaatctgcgcgaagtggagagcaaggcctatggctggtacttcactgacctcgcccggcatgcagacgcattgctcgatgcgaaggagcaggtgattgaccctatccgacgctttatgggcggagcccagcgcaagatctacgatgaggcccgcaacttcctcgccgagcaggtaacgaacctgtcctacaccggcagcactcaagccgaggcaatccgcgcggttctggccgatccgctctgctacaagggcaatgcgatccagcaggtaaaggctgagctcgacaagctgcgtgccaatgtcgatgccctgctggtgcaggagcgagacagtgctctgaaggggctgaccgagctcaaggccaagatcgaggcagtaccagaattcgcgcagctggatgccgcagccaaggccgggatcctcagcgagtgcgaggccgccgagaccagcgtccgcaacgccaaactggtggccatgatccgcgagcgtaccgccaatttccgatcggaaacctatccagcactgcttggaaaggtcgcccggctggcaactccgccggcgccacccgcgcctcctgccaccgagccgccccagtcgggagaaagcaaggtgcgtgaggcaccagccggagggattgcgccgcagccagctcctgctccctcgcccgtggaatatgtctcgaccgccaatctgaaggtcagcttcgctagtccgtatctcgccagcgaggcggacgttgaaacgtaccttcaagcctaccgcgaaaccctgctcgccgagattcgcagcggcaagaggatcacggtctga

SEQ ID NO: 408 - DNA, 3456 bp, Vibrio cholerae; identical to SEQ ID NO: 239

SEQ ID NO: 409 - DNA, 3456 bp, Vibrio cholerae; identical to SEQ ID NO: 239

SEQ ID NO: 410 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctagataaacgcggtcagtatgagacctttaaagccgcgtttgccgatatcaatggctcacgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattactgaaaaccttggggtaacctgcggtggtcgcgcatgggttatcgtgacttcgcaggccgatatcaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctgacaaaagtgtggcgagagaaaggcgatatcctgcgtaaccagctggcttttgaccctacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccaacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgagcgcttaccgaaaaaatcctccacgccatcgaacattgtcgatgaagcttgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcacaggtgcgtaaagccgcgcaaaccatggctgacatcgctcagcaaccatttaacgaacgagaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgaaaaagaagattttgccctgatcgaaaaagtgtcatcgctgaaagatgaacttctggatttcagcgaagaccgtgaagatttggtcgatttctaccgtaagcaattcgccacctggcaaaaactgggcgctgcgttgaatggcagctttaaatccaaccgcagcgcgctggaaaaagacgccgcggcggttaaagcgctgggcgagctggaaagcatctggcaaatgccggaaccttataagcatctcaatcgtatcacgccgttgattgaacaggtccagaacgtcaaccatcagttagtcgaacagcaccgccagcacgccctcgaacgcattgatgcccgcattgaggaaagccgtcaacgcttgctggaagcgcatgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgtgtaaaaagcaagaagcacaactccgggcagcaaatgaagctaaacgcgctgccgactcagaacagacttatgttgtggtggaaaaacccgttatccaaccggtaccgaaaaaaacgcatctggtgaatgtcgccagtgagatgcgtaacgccaccggtggtgaggttctggaaacgaccgaacaggtggaaaaggcgctagacacgttacgcacaacgctgctggccgccattaaagcaggcgatcgcattcgccttcagtaa

SEQ ID NO: 411 - DNA, 3555 bp, Sporolactobacillus vineae
atgcaaatacgtgatatgttcaagaaaaagatcgaccgtgaaattgaaggcgttgtgaagatcggtcaggaagacgatgcacgtgtcaggcaggagcttgatgaatacgtcgtcaccaatgaattggccgggcacctcagtcgtttcttttcaacttataaagacagtattcatcatccgacagaaaagattggggtctggatctccggcttctttggctccggaaaatcgcactttctcaaaattctttcctatctggtagaaaatcgtgaagtcgacggccgacatgcagtcgatttttttgaagataagatcaatgatccaatcgtgctggctgatatgaaaagagcagcaaacggtgatacagacgtcattctgttcgatattgacgccaaatcggaatccagtataaaaacaaaaaaagatgctgtcgtgaatgtcctgaacaaggtattcaatgagaaacaaggcttttgcggctccattccctggattgccgacctcgagcggcagatgacacttgacggaaagtatgatgacttcaggaaagtcttccatgaaatttccggacgggcttgggaagaggcacgggacgacttttactatgaagaggatgccattatcaaggcgctgagccggtcgactcagatgagtgaaacctcagcacgtggctggttcgaccatgcggaaaatgactatacgatcagtatcgatcgctttgccaaacgggtaaaagagtacattgatcgaaaagggaacgatcatcatgtcgtcttcttcattgatgaagtgggtcagtatatcggtgacaattcatccgccatgctgaatctgcaaacgatcgttcaggaactcggtcggcaatgtcatgggcaggcatgggtggttgtcaccagtcaggaagacatcgactccgtcgtcaaggttaagggcgatgacttttcgaagattatgggccggtttacccggctcagcctgtccagtgcatttgttgatgaagtgattaagaaacgtattctggaaaaaacgccgaaggccgcgctgctcctgaacgacgtctttgagagtaaagaatcgatcctcaagaatctcctgactttttcagataaaggcgccgaaatgaaaaaatttagagatgctgaagaatttgtggcggattatccatttatcccctatcagtttaatttactgcagcatgtctttaccggagtccggcttcatggcgcatcggggaagcatctttctgaaggggaacgatcgctgctcagttcatttcaggaaacagcggtccactacgccgatcgggaggaaggactgcttgttccgttttctgctttttacgatacaattaagggccttctggattcgatcattaccaatgtgattgtccgggcttcaaacaatgaacgactgacaccggacgatgtcgacgttctgaaacttttgtttctgatcaaatatgtgaaagaagttccggccaatctggaaaacctggccacgctgatggttcgctcgatcgatgaagataaaattgatctcaaaaaaaagatttctgtatcactcggccgcttgattcatgaaacgctcgttcagaggaacggtgaagaatatgtttttctgaccaatgacgagcaagatgtcaataaagaaattaagaacatgcatgttgaacgttcagaagtgatccagcagattggtgaagatttatttcattccatctatcctacgaagaaatatcgttattctgcccattataacttcccattcaacacaatgattgatgatcgtccggtaggcagccagtctgcagagattggcctgaaggtgctgacaccggactacgatgctgagaacgatctgaatgatatgcagttgaaagctatgtcgatgcgtgagaataatgtcattttacatatgccggcggaaaccgattatcttgatgaaatggaagaagttctgaaaattcaggcttatctgaggctgaaaagtggtatttccgtgtcgcagacgattgaagatatcaaaacccgcaaaacgcgtgaagtcaccgacaggaaaaatcgaatcactctttccctgaataacgctcttgaaacggcggacatctatgtttatggagagcctttagccattaaggagaaaaatccggtcgaccgaatcaacgaagcattccattcattgatccggaatctttatcacaaaatcgattacgttaccaagtttactgaaaacaaagaagaactgcttcagttactgaagcacccggaagaacaaatgactgcattcgatgaggatgtccccaatcatttggcccttcaggaagtcgatgcctatatttcccggatggctgcccgtcatgaagatgtgaccgtgaaaagtgtcatccgttattttgccggaaaaccgttcggctggatggatctggataccgaagcacttctgattcgcctttttctgggtcagtcgattaaactgctgctggaccgtgtctacctgcagccaaacgatcgtcaattagctgatgcctttacccgacgcgatctgatcgatcgagtgattgttgcgaagcgggagaagatttctcctgtcctgctgaaagcagtgaaagacctctgccagatgctgttcgatcgatctgctgtgccgaccgatgaggatggtctgatgcaggcgttcaaacacttgcttaatcaggaattacagcatcttaatgccatgctcaacgtctaccgggaccataccgaatatccgggcaaagatgtggtgatttccggacagcaagcgatgcagagtctggcagctcttggtgatgccgggacgttctataagcaggcatataaactgaggaatacgtttgaagattatgcagaccggatcaaagatgtcaaaggcttctttggcaaccagcgtgacaaatttgattctgcctatcgactgatgaaagtttatgaaaaaaatagaacgtatatcacagaatctgatttgatcgagactgaaaaagaaatcgaacacattattgaaaatacaacgccctatggacagattcagaagttgccggtcctttgtgatgcgttccgcgactcctttatgaaccaaatcgaaaaagaaagtaaaccggtcgaaaaaaatatcgatcatgactaccaggatgtactggccgaattggaaaaagatccgatctcaaaagaaaagtttgcgacgacatttcgtcaagagtttcttgatttaaaagaccggttactgaaagcagacagcatcattgaagtgattgccggacgagaggagagcgaccggcttaaactgcgctgcatggatcaaattgaagatgaacgggagcaaagagtgacggtgcccgttggacctgatccggataatacaggaaaaccaccggtcgtgaaagaacggcaaaaaaagacgaaaacgatcagtaaacatgtaatcatgcgcggtacacaaacaatttcgtctgaagctgacttagatcaatttattaatgaactgagaaagaaactggaagcagaacttgatgagaacacgatcatcaagcttgtgtga

SEQ ID NO: 412 - DNA, 3456 bp, Vibrio cholerae; identical to SEQ ID NO: 239

SEQ ID NO: 413 - DNA, 3492 bp, Streptomyces sp.
atgcagttgaacgcgatcttcgccaaggacgtgcagcgtccgatcgagggcgtcatcaaggctgacgacaccgcgcacctgggcactgaggtcgacgagtacgtcctgaccaacgaggcagccaagggcctcgaacccctgcttgaggcgtacacgaactacaccaacgcgaacggtgtgtggatctcgggtttcttcggctccggtaagtcccacttgctcaagatgctcgcccacctgctcggcgacgtagacgggcaggagttcgcgcgcgagcgtgtgtccgagagcttccggtccaaggcgcagggagcgttcctcccagccttgttgactaaggccgaccgcattcccgccaagagcttgctgttcaacatcgatcagaaggcgacgctcatcacgaaggaccagggcgatgcactgttgaaggtgttcgtcaaggtcttcgatgagagctgtggctactacggtaaccagggtcacgtggctcgattcgagcgggacttggacaatcgcggccagtacggggcgttcaaggctgcgtacgcacagatcgcgggacgcgactgggcgcatggccgtgaggagggcgtactcgaagaggccaacgtggccaaggcatacgccgaagtcagcggccagaccgaggggacgccgaccaacatcctcacgaagtaccgcaacgagtactcggtgtcgatcgaggacttcgccaacgaggtcaaggcgtggatcgacaggcaggccgtgggcttccgtctgaacttcttcgtggacgaggtcggccagttcatcgggtccaacacgcacctgatgctgaacctccagacgatcgccgagtctctgaataccaagtgccaggggcgagcgtgggtattcgtcacttcccaggaggacatggataaggtcgtcggcgaccgcaccaagcagcagggcaacgacttctccaagatccaggcgcgattcaggacacgagtcaagctcaccagcgccgacgttgaggaagtcatccgcaagcggctgctggagaagaacgaggtgggtgagtctgcgctggcgacggtgtacgccgagcagcacgcgaacttcaaaacactgttcgacttcgttgacggcgcgaagatctaccgcaactacacggacgaggtgcacttcgtcggcacctacccgttcgtcagttatcagttccccctcttccaagcggcgatagagggcatctcggaccacaatgtgttcgagggccgcaacagctcggtcggtgagcgctccatgctcggcgtcgtgcagcaggtcgccaaggacgtcggcgacgtcgaggtgggcagactcgcgaccttcgaccacatgttcgctggcatccgtgcctcgctgaagtctgccgcgcagcgctcgatcgatgtcgccgagcgcaacctcgacaacgagcttgctgtgcgtctactcaaggcgctgttcctggtcaagtacgtcgagggcttccacgcgaccccgcgcaacctgaccgtgctcgtctacgaccggttcgggcttgacctgcccgcactgtccaagcaggtacaggaggccctgacgctgctggagactcagacgtacgtgcagcgcaacggcaacgtctacgagtacttgaccaacgaagaacaggtcatcgaggaagagatcaagaatgtcgacatcgacgcctcagaggtcagcggccgcctgtccaagatcctctccggtgaagtcatccgcaccagcaagctgcggtatgccaagaacggccaggacttcgcgttcggctacaagctcgacgaccaggtgtacggacagcagcgcgagctgacggttcacttcatcacccccgagtacccgtacggtcccgaagagatccggatgcacagcgccggcaaggacgagctgcgagtcatcctggaaccagacgagcgtgccttgtccgacctgcggctgctcatcaagaccgagaaatacaccaagcgcaagcagacgacctcgctctcgccgatcgaggaccagattctgcgctccaaggcgacacagaacgccgagcgcgagaaggagcttgtcacacgcatccgccgggccgtcggcaaggcagagctcgtcatcaacgccgccgatgtggcttccacctcgcaggacgccgtcgtccgtgtgaccgacggcttccaggaccttgtcagccgtacctacacccagctcaaactgctcggcgggatcacctacagcgagcagcaggtcgcctcgttcgccaaccccgatccgtcgggcatcttcgacgactcgtcgctgtcccagctcgccatcccgggcgaagaggtgctctctttcgttctgcggcgtgaccggcttggtgagcaggtgactgtcaagacgatcgcgggtgctttccaggcgaagccctacggctgggacctcgcctcgatcgaggtcgtcatcgcgtggcttgttggcgcctcgaagctcacggccatcgtcgacggaaacgccctgaagcgcactgaggtcgcggcggtgctgcgcaacacgcagaagcactcgcacgcggtggtcgctccacagaaggtcttcgacgggcgccaggtcgccgcgctccgtacgttctgcaccgacttcttcgacgaggcaacggccgcgccgaaggaccccctggagctggcccggcacgctagcgacaagctgcgcggcaagctcgatgagctgaaggcgcgggtgaacgggtcgaagtacccgttcgtggagcagctggccgccccgatcgcgctgctcgaacaggtcgtcgacaagcccgacgagtggtacctgaccgagttcggcctcggcgacgagctgctcgacgccaaggaatccgtgatcgaccccatccagtcgttcctcaacggaggccagcgcgccatctacgacgaagccgccaccttgctcgcggtgggcacgaacaacctcggctacctgcccgtcggcagcgacactgaggtgaagcggttgctcgaggaccccaacgcgttccgtggtaaccgcatgacccagctcaagcaagccgcggatgcactcggcaagcaggtcgacgaagcgctcgcgaccaaccgtgccacggtgattaaggccattgaggcacgaaagaccgaggtgctcggcagcgcttactacgagaacgccaccgaggacgcacagcagagagtcattcacacggtcgaccaggtcgtcgatcgagtctgtaacgagcggcagatcgggctcatccgtgagcaggggaacagcttcgaggaggagacctaccctgcgttgctcgatcagctcgtctcttcggcccgcccggcgggcgacaccgacgatcccgcacccgcgccacccaagcagacggtctcggtcaagaccatcaccgtgacaggtgctcacggtgtgctggagactgccgaggacgtcgatcggtaccttgacgcactccgtagcgccctgctgtccacactcaacgccggaaagcgaatcacgctctga

SEQ ID NO: 414 - DNA, 3642 bp, Salmonella enterica; identical to SEQ ID NO: 8

SEQ ID NO: 415 - DNA, 3672 bp, Enterococcus faecium; identical to SEQ ID NO: 238

SEQ ID NO: 416 - DNA, 3642 bp, Escherichia coli; identical to SEQ ID NO: 56

SEQ ID NO: 417 - DNA, 1278 bp, Bacteroides xylanisolvens
atgcataagatacaagatcttttcgacccgaccaaacaacttaatagaaccattgaaagcgtggttacgtttggagccaatacagaacaagatttaagttcagaaattcgtgaatatgtggtaacagacaaacttcataaaaactatgaagatgtaataacggatttgcagactgcatttgatgattccagcaaagaagtcggaatatgggtatctggattttatggatccggaaagagttcatttgcgaaatatcttggtctgtcattcgacaagagtgtaatgattgacggtgtatcatttggtgacaaattgatgagtcgtatccaggatactgccatcacggctatgcatcgaaccatcatatcacgccataacccacaagtggtaatgattgacctcagcacgcaatctgttgctggtaaaatcgcaaacgttagcgacatcgtttactatgaaacattgaaattactgggtgtaaccaagtgtacagaccaaaaggttatgtgtttcattgacttattgcatagcgaaggtaaatatgaagaattttgccgattggtagaaacagaaaagaataaatcctgggaatcggtagaatccaacgaccttgctgccaatcttattgcagctaatcttgctcctcgcgtacttcctgcttattttccagatagtgcaagtttcaagaatattaatttgagtagtgcattgaatgaaaaagaacgttttgttcgactacataaattggttaaggagaaaacaggaaaagacaaaatcatttatgtattggatgaagttggtcaatatgtcgcatccaacgttgatttgattttgaacgttcaaggcatgatgcaaattttcaaggatgaattccgtggtgatgtttgggttattgcaacagcacagcaaactttgacagaagacaatcgtcaggcccaactcaactccaacgaacttttccgtctgaacgaccgattccccgttaaagtggatattgaagcaaatgacatcaaggagattatcacaaaacgtttattgggtaaatccaaagacggaagtgattatctcaaacgtttgttctcgcagaatgaaggtttactcaaaaatagtatccatctaactttgcaagaacgaagcatctataatcaattgctgactgacgagacatttaccaatctctatccgttcttgcctgttcacattgatatcttattgtctttactgcagaagttagctagtagaacgggggggtcggcttacgttcagtcattcgtttga

SEQ ID NO: 418 - DNA, 2367 bp, Escherichia coli
atgggtgagcgttctcagctggaggcattccagactgcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctactgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagtcgcttcctgaacggacacccattagacggcgcagtgcttaacgatctggtggtgaagatcctgacccctaaagatccgacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggctaccctgctctcagaaaaagcgcgtgaaaacagcaaccgggaaaaattactccgtgttcagttggaatcactacttgcagaagcagatgtttgggcgattggcgagcgcttaccgaaaaaatcctccacgccatcgaatattgtcgatgaagcctgccgttacgtgattgaaaacaccttcggcaagctgaagatgctgcggccttttaacggtgacatctcccgtgaaattcatgcattactgacggttgagaatgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaatgagattgaatccggtctgcgcctgcttaatgccattcttaatgaaaaagaagattttgccctgatcgaaaaagtctcatcgctgaaagatgaacttctggatttcagtgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaatgcttgctggaagcgcacgccacgtcagagttgcaaaacagcgttctgctgccgatgcaaaaagccagaaaacgcgctgaggtcagccagtcgattccggaaattttggcggaacagcaagagacaaaagcgctgcagatggatgcagataaaaagattaacctgtggatcgacgagctgtgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgccattaaagcaggcgatcgcattcgccttcagtaa

SEQ ID NO: 419 - DNA, 1092 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgtgaactggaaaaccatcttcgccatttcttcgaatcctatgttcctgccacgggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgtgctgattttccgcatattgcccatcttgagcgcgagctggataaacgcggtcagtatgaaacctttaaagccgcgtttgccgatatcaatggctcgcgctgggaagatgagcgcgacgcttactacttcatcagcgatgacatggcacaagcgttaagccaggccacacagcagagtcttgaagcctcccgccaatgggtggaacaactcgataaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattaccgaaaaccttggggtaatctgcggtggccgcgcatgggttatcgtgacttcgcaggctgatatcgacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctggcaaaagtgtggtaa

SEQ ID NO: 420 - DNA, 3660 bp, Bacteroides sp.
atgcataagatacaagatcttttcgacccgaccaaacaacttaatagaaccattgaaagcgtggttacgtttggagccaatacagaacaagatttaagttcagaaattcgtgaatatgtggtaacagacaaacttcataaaaactatgaagatgtaataacggatttgcagactgcatttgatgattccagcaaagaagtcggaatatgggtatctggattttatggatccggaaagagttcatttgcgaaatatcttggtctgtcattcgacaagagtgtaatgattgacggtgtatcatttggtgacaaattgatgagtcgtatccaggatactgccatcacggctatgcatcgaaccatcatatcacgccataacccacaagtggtaatgattgacctcagcacgcaatctgttgctggtaaaatcgcaaacgttagcgacatcgtttactatgaaacattgaaattactgggtgtaaccaagtgtacagaccaaaaggttatgtgtttcattgacttattgcatagcgaaggtaaatatgaagaattttgccgattggtagaaacagaaaagaataaatcctgggaatcggtagaatccaacgaccttgctgccaatcttattgcagctaatcttgctcctcgcgtacttcctgcttattttccagatagtgcaagtttcaagaatattaatttgagtagtgcattgaatgaaaaagaacgttttgttcgactacataaattggttaaggagaaaacaggaaaagacaaaatcatttatgtattggatgaagttggtcaatatgtcgcatccaacgttgatttgattttgaacgttcaaggcatgatgcaaattttcaaggatgaattccgtggtgatgtttgggttattgcaacagcacagcaaactttgacagaagacaatcgtcaggcccaactcaactccaacgaacttttccgtctgaacgaccgattccccgttaaagtggatattgaagcaaatgacatcaaggagattatcacaaaacgtttattgggtaaatccaaagacggaagtgattatctcaaacgtttgttctcgcagaatgaaggtttactcaaaaatagtatccatctaactttgcaagaacgaagcatctataatcaattgctgactgacgagacatttaccaatctctatccgttcttgcctgttcacattgatatcttattgtctttactgcagaagttagctagtagaacggggggggtcggcttacgttcagtcattcgtttgattcgcgatatcttggtagataaccatcttgcagatgccacaataggccagcttgccggtccagaacatttctatgatgtgctccattccgacatggagcgtaattcagcgaaagagattgtgatttcagctgataaagccatatccatattcaacggagataaattggctgtccgtatctgcaagacaattgcggtcatgcagttactcgatgattttaatttgtctttcgacaacctatgtgccttgttatacaacaacgtgggtagcacttttgacaaatcaaaggttcgtgaagcgattgaaagaatcatggattctaccagtgtaactcttcaagagattgatggtaaatatcaatttatgaccaatgccattttgagcatacgtgaagaacgaaataagattatccctcgagatgcagagaaggctgatgttcttcaagaacaattaaaggatatgctttctccagctccttctgtcaatgtatattccagcaaaaccatcactgccggagtcgaactgactgagagaaaccgtccttataatattcatccaacaacaagcggtttgaaactgaacatccgttttgttgatggtagtgcttttgatgaaactcatcagcaattattgacagaaagtactcgccaagaaaataaccgcacactttattggttatgcactttggctaaagataaggaaacgatattacaggaaatcgtacgaagtcaaaatatcaagaatcgacatcaaaacgaaacaaataaagagatacaggcttacttgcgtgctcaaacagactttgccgatgaaaaaaagagagagttgaacaaaatcctgcgtgaggcacaagccaatagtgaagttatcttccgtggttcgccacaacaggttaatggcgagacatacaagacggttgcgctgaaaaccattgccgaaaaggtatttgagaaataccctttggcttcaagcaatatgaagggagactgcgtcaacaaattggcttcatacggagatttgacaactataccagacgctctgaatccatttaagatcatcaagaaaacagatggtaccattgacgtctctcatccggcaatctctgaaataaaggattatattgctacgctcaatgaagtgaccggctctgaaattatgaaccgatttgagcgcgatccttatggatggtcaaaagacactatccgctatattgttgcactcatgctgaaagcaaacattatccagattcgtgttgcaggaaagaatgttacagtctttggtgatacagctgttgaagcgatggcgactaataatagtttcaacaagattagtgttctacttaacacggaaggagctcttaccacaacagaattgttgaaggcagcacagagtatgactggtttattcaatagttcacgagtcgcacctgtcaaagaccaaattgcgaaagaagcatacaaaaagattaaattgtatttacaaaaattcaatcgactattgcccgatttcgaggtcttgaaattagatggtgaatccattgttcgccaagcaatcaactatgcacaacgtatcattgacagcgaaggtggtgaggcggcattcttgttgggtaaggatgtcgactgccaaaaggcttttaaatacgtgatggatatcataaaatgcaacgaacaagcttctctcattaaccatctgaagcatatcaaccatttggcaaatgaatctcatactcttcctgaagttgagcaactggcagactacatcaagcatgtcaatgatgtgcgccaattgtatcatgaatacattgccaatccggatttgcatctgatagtctctaatattacagatctacgcaatcagtttgatgcatacctcaatcaagcttgtatcgaattccagacacagacagaaaaattgttggatgaaagtcgcacgacaatgaagagtatgccagagtatgcaaagttggatgacaagcaacgtactcagatcgatactcagcttgatggtttaagcattgagtgcactcatccttctattagtaatctgcgcgaaatgatcaataagtttgtgacttattatctaccatctggaagtattaagacaatagagaatagaatcaggcaatatgctgcagacaatgcacctgcagtaaaggttataccgacacctcccacttctcctcaaaaaggtgctacccaagaggatgatgcgaccaaaccaaacaaagtggaagagccaacctatcagcctaaacgcttgcaagtgaaacgaaagattacaactcgaacagaattgcaacaggtaattgatcaactgacttcgttattgggcgaaatcagtgacaacagtcctgttgaatttaattttaatgaagattaa

SEQ ID NO: 421 - DNA, 3747 bp, Opitutaceae bacterium
atgcccgccatcatccgtgacctgatccgccgcgacatcaccgttaaggttgaaggtgtcgtcaaagtgttcgaccgctcggccctcgccacggaactccgcgaatacgttctcaccgacaagatcgaggaggagttgaagcgtatcctcgacacctatacctccgtgagtgactcgctccgtcgaggcggccactcgcgcgacgtctgcggtatctggctctccggctttttcggctccggcaaatctcacttcgccaagatccttggctaccttcttcaaaacgacgccgtcaccaccggctcgactgaaacctgcattgatcttttcgccaagcacctcaccgacacatcgcgcggtcgcgatatccggctacgtctcgccgaggtcgccaaaacaaccgtcgcccgcaccgtcgccttcgaaatcaagagccgccagagcctgaccaacgccaactccattggagaaatcctcatcggcgagttctaccgcagcctcggctactctgaaaacttcgtcatcgcccgcttggagcgccgtctcgaccgtgccggcctcctcggcaaactggaagccgccttccaagacaagcacgacgtcgcttggcgcacgcccgaaggccgcgacgatctcgccaccgttcgccgtcgtctttccaaagttttgcccgccgtcgatcctgccagcttccccaccgaggacgacgctctcaacggcctcgaagacgccttccagtattccaagctcaccgccgaaggcatcgctgatgaactcgtcgcttgggtggacgagcaaaaaccaagcggcggtcgttcccagcacctcatcttcgtcatcgacgagatgggcaccttcatcggcgactccaacgagaagatcggcgaactcaacagccttgccgagatgatcggcaacaagggcaagggcaaagtctggctcatctgcaccagccagcaggacctcgaaaaggtcgttgatcgcaccaatttccagcccgccttgatcggtcgcctcaacgcccgtttcgagctaaagccccacctcatttccgacggcatcaaccgcgtcatcgccgagcgcattctcaaaaaacacccctcgcgcgagtccgacctccaggcactctatcagcccagtcagggccttcttgcccagctcgccgacctgaaatccacccggaatctcggcacgctctccgagcgtgccttcatcgacgcctacccattcctcccgcaccagattcagctcgcccaggacatcggcgaagcgctctccggtttccgtatttcgggcggcgttcgttccatgatctcggtcatcatggaagccctgcaaaaactcgccccgctccccgtcgggcgtctcgccaccttcgaccaggttttcgacgctctcggcaacgacctcctttcccaggaatacctcggcgcatccggcgtcaaatccatcaccgatgccgatagccgcatcaccgcgcccacttcgctgccgccgtcccgcgtcatcaaggttctctacctcatccaacgcgtcacccacgttccccgcactgcggagaacattgcaaagctcctcaccgaaagcatcacgttcgacctgcccgccctccgcactcaggtcgagcagaccctcaccgcgctgcagcaggccggctatgtcgcccgcgacgaatcctccggcgagtggaaattcctcaacgagaaagaacgcaccgtagagcaggccatccaggatatgatccggcccggctcctcaaggagcatcaccaccaccgcgattcgccagcaatccatcgaactcatcaagggtggcgtcatcgcgaagcgaaacctcgacaattacgccgtcacctacggcatcaccaagaccgcctttttctatgccgtcgcgctcgacggcgaggccgtggacactggccccgagatcgaagtcgccttcgtcagccccctcgcaccgggtcgcaagcaggccatcgaagacctcaaacgcgaaaatcaggtcgccggccctaagagccgcaaactctggtgcgtcgctgcactccccgaaaacctcgaagcacgcctcaaacgctaccaggccctcctcaacgttaccggcgacaaacgcttcaccgacgatccatccaaggacaccgccgacgccctcgccgaaaaacgcaaagagcgcgacgacctccaaaaaaccctcactcgcgacctccacgccaccttcagctccggcacgctctactatggtggcaaggaagtcgccctcgacggcacctcgtccttctccgccgagttgcccaaggccgtcgcccaacagctccccaacctctttccccgcttcgccatcgccgacaagccggtggacttcaccaaacagctcaaagccctgctcaacccctcccaggccgccctccatcaggttgcgcccgacctgcacctcttcgacacccagggcagcctcaacaaggaatccgccctcgtcgccaccgtcctcgaagtcatcaaggacctcgaagccgacggcatcgacgccgccggcgctcgcctcctcgaagaccgggacgccaaaggattcaagggcttcacccgcacgccctttggctggccctcggaaaccctccgcctcgtcctcgccgcctgcttccgcgtcggcacgctctttatcgaacgcgccaccgccgccggcaccacgccgctctacgattacaaggaggccttcgacgacttcaccaagatcaggaccttcgagcgcacgatcttccgcctcgccgaggcctccctctcggtcgagcaactcaagtccgccagcaaggaactcatctccctcggcgtcaccggcacgcccgagtccggcaacgcccttgccgccgccatccgcggcctcggcgaaaaactcattgagggcgtgcgcgatgccgctctccgcgccgaggccggcctccccatcggcgacgccatcctgggcggggaaaagacgctgcaatcgcccgccacgctcaaagaccccaccaaggccgtcctcgccttccttaaagtctccgccgagtggcgcgcccttaagcagggcctcgacgagctcaaagccttcctcgatgccaaccggcacaaggacttcgagaccacgcaaaaactcgtcgccgtcatcaccgaccacccgctgcccgccgacgcagccgacaaagccgccctcgatcaatccctcgccgatctcgccgccatcaccacggccaagaccgtcgtctcccgctgggccgactaccgcgccgcccgcgaccaggtcaccaccgtttacggggccgcctaccactccgcctacggcgatctccgcaagcgggccaccgaggcggccgacaccgtccgctccggctccgcctacgccgccgcgcccgccgataaacgcgacgccgtggtcgccgccaccttcgactccggcggcagttgccacttccccgagatagacgtggccacgcttccggccctgctcgccgccaccgccaaggccagcctctcctccctcgccaacgccgccaaggccctcccggctcaccgcgccgaggtcgaggccgcgctccgcgccctcaagtcgccgcccccggctctcaagcccgaccaaaaaacctacacctggcatcccgccaccgaccttaccggtcgccgcttcactaccgaggccgacgtggactccgtcctctctgaaatcggcgactctctcaagaaacgcatccgcgagggttatagcattgatatcgtataa

SEQ ID NO: 422 - DNA, 3690 bp, Glaciecola polaris
atgacaatcataaatgacatactaacgttagatcttaaagaagatattaaaaacgttattgaccttgaagaccgttcagagacagaaattcaacacgaaatcgagtcatacatcgtaaccgaaggtattgggcggcacctctacgaatttacaaaccaattcacctctaatattaaagagacaggggtttggttatcaggtttttatggctctggtaagtcatatttcggaaagatgctgggttatataatagataaccagattataaatggtactcctgcacgtgagcgttttataccacgcttaaaaggtgtaagtgatgcaggtcttattgaaaacgccctacgtaatcttgacgcaattaacagccgcgtagtgttccttgatgttgctaagcaaaatactgaacgtggattggctttcaccttgtttgctaatctgcttaaaaatcttggttttcgtgatgatatttacggttatatggagtttgatctgctcctagatggtaaatacgacgagtttaaaactattgtccaaaaactagagtcgaaggattgggatgagctaaagaaaagtaatcggcatgtcgctagagttatgcgaaaggtctttgccgaaatggggtacagcgagtcagattatgaagataccaaaagcgtctacagtgcttcgatagaggatttttctgccagtaaatttaaaacggaactggaaaaatatcttaagtttaatgcagaagaaacactagtctttgttttcgacgaggcgagtgaagctattagccagaagaaatttacccttttagatttagaagggattagtgaatcgctatcgagtataagtaataaagtttggaccatagcgattgcccaagaaaagctcgacgacgtgattaataatgctaacgttagtcgcagtagtttgaccaaggttaccgatcgttttaaaaccaagattcaccttgagtctacagaagtagacgttatcattcgtagtcgattacttcaaaaaacagaacaggcaaaacaagatttagttgcttattaccaaaagaatgaaggcctaatcagcgacgccaccaacctaaaatcatcgttccctacgaaaacggaaacagctgaagattttgcggtgtattatcctttccacaaatatcaattcgatattttgcaaaagttcttgtttagctcaaacgctttagttgctacccaaattgcagctcgaggcatgattatcacaacatttgatgtgctacgtaagcaaatgcgtgacaaagagctgtatagctttacgccagggttcgctatatgtgatgaagcccaaactgcgccgccagttggattggtcaacaaatacgatacgagccgaaaaatattaaaggaaaatggcagcagcattgacggcgagaaactgctcaaaaccatgcatctattagccgactctgaagtagttgcgccaacggttgaaaatataaccaaaagctatattactgacattacgtcttactatgaagtaaagccagcaattgaagacgcgcttaagttactgcttgaagctaaagtactactactatcaaacaacaactacaaaatcacatcagatcttgaaggcaaaatgctcgaagaaatgaaagattttgatgtcgaacttttcagcaaaaagcgtgagttaattaagtatttgaaggactacaaaacctttaacgcaattgcatcctacaatgatggcagtgatgcattcaaatttagcgtgctgtcagaccaagacgatgagttagcacctgtaggaagcaaacacttaaagatcacagcctatagcttgttcaatatcagtgatgatcgtcaggattttattgaacaactgaagcttgatactcagtatcagaaagagcttattaccttggtgccagatacttcagagttctcccagattgataaattgataggcgaagttatgcgctacgcctacatggaggaaaaatactcgaatgaaaaagatgccgataagcgtcaaattattcgtgaatttgaagttatacgagaagagaagcaacgaactttaagagggctaattcaagacgcatatcacaatgcatccctgatctacatgttcgacgagcatctgttgaacgttgatacatttaagggaaccattgccgacaaccagcgaaaaatggtgaaaaacatctacaccaagcgtttatcaagtcaactttctgatagcctggtctcgaagattttcagcacacataaagaaagcctgaataagttatttaccgctaatgattttgcattcttcgacggtcacggcaattttactggcgatcaccttaaaattgttgaagaaatcaacgctaagataaagtcgcgctatatggatggtaaatctctagaagctgacttgtcaggtgctccatggggctatagctacggaacattagtaacgactcttgcagtactattccgtgccggtcgactatcggttaagtttaacggcgacacctatttttctcatgagcaaaaagcggttcacgatgcctttacgaataccaccaagtttaaatctgcgtcgttcaaatcgattactgcaacgctaaccgctgtgcagaagaaccaggcagtacaactactgatggaactcgaaacacaggaccatatcggcaaaaaggtagattggaatacaaacgattttgacttggctgacagtattcgtttgatggctgaacattttatcagtgctattaccaacctgagtgatactgttcaagattttgaagaactattccccaaagtggcaggtttaaaacaagacttgcaaggtttcgcgggtaaagttaccgagagtaactatatcgaaaaggttgagtatctacttaataacagcgatacgttcagcgatgcggttcaagccatattaaaagctcagaaattcattaaaaagaactttcctaaagttaaagaatttaagcgctttattgacgatgttcgaagcgagctgataaaagctgatcgcagtgacaataacattgatgaagcctatgaagaattcgagcgcttattcaaactggatatggtgaaaaactttgtcaatctccagcaacaagtacaagttgtaaaagatgcttattacaagttagttaagacagcatctataggtatgagtcacgagtacaaggtcctgagcggtaaaattgaggctgcttttcgtgaacttaagaattaccctgcggcgccgaaccgactaaatcagcaaaagcttgattccttaaaagcctacgcagaaaaacgagtagttggtgaaccagtacttgcgttcagcattagttgctcaaatagtggtttttctctctccgacattttgaattacacagctcaagcaccgctaaaagatagcgagctgcttatcgtgcaaagtagttttatcacagaagagccacagcccgagcctttacccacaccgcagcctacacctaatcgtgatcccgatggtagcgagcctgcaccggccccgactccagttcaatcacctgcaccgaaacaaccccgcaaagttgcttttaaagtttctagtaaggtgatgacagtgcaagagtataaaaccttgctgactacgcagctaacggcgcttgctgcggccaagcccgatgaagaaatcgaactaactatagatattaatagcgaaggactgtaa

SEQ ID NO: 423 - DNA, 3648 bp, Bacteroides coprophilus
atgaataccataaaagacctttttgattcgtccaaggacatcaatcgccggattgagagtgttgtcacttttgcagataatagcgaagagaatctgaaaaacgaaattaacgaatatgttgtcaccgataagttgcacgataactatgaaaaggttattgaagaattggagtcagcattccgtgattcttccaacgaagtgggcgtttgggtatctggattctatggttcaggtaagagctcatttgccaaatatttgggctactccttccaacagtcattaaaggtggatggtatcagctttggtgagaaactgatgaatcgaattcaggataatgcactaaagactctgcatcgtgcggttatccaaaagtatgatccactggttattatgattgaccttaccaccgaagctacagctggtattacatcgaccgtgagcgatattatgtattacgaaacgttgaagctcattggcatcaaagctaccgaccctaaactaatggattttatttccattcttcaagaagagggtaaatatgatcagttctgcgaattggtcaaagcagaggggaaagactgggaggttattcagtcaaagaagttgatagccaataaatatgctgccaaatttgcaccagtcatattgcctgaatatttctcctcttccgaagagtataacgcgatcaaagtggaatctgttgagaatgaaaccgatcgcttcaagcgactctgttctctggtcaaacaaaaatacggcaaagaacgcattatctatgtcctcgacgaaattggtcaatacgtaggaggcagtgaagatctgattcgtagtatgcagggaaccatgcaaatcctaaaatctcaatttaaaggaaatgtttggctcatcggtactgctcaacaaaccttgacagaagataatcctcaagcacaagttaactcagataaactctttaagcttaatgaccgtttccccatcaaggtggatatagaggctgatgatatcaaggaaatcatcacaaaacgactgttgggaaagtcaccacaaggaaaagaagtgttgaccgatattttcaatcgcaatgaagcgtccattaagttagaaacgcgattaaccaatatggagcgttcgctgtatatgaagccattgaccagcgaattgtttgccaacctctatccgtttctgcccgttcatatcgatatcttgctggctttgcttcaaaagttggcaagccgaagtggcggttccggtcttcgttctgttatccggttgatccgagatttgttggtagatggtcatttggcagaatgcgctttaggcaagatggctacaccggatttattctatgatgcgcttcatccgtatatggagaagaatcaagacttccgcgaaattgtcatttcggctaaaaaagccatcgaactctacagtagcaacccattggctgtgaaagtatgcaagacgattgccattatgcaattgttggacgatttctgtctgtcgttcgacaacatctgttccttgctattccaacagattggccatccattgaacaagcccgaactccgtgcgttgctggatgaaatcaaagatacagccggcgttacactccaggaaattgatggacgtttccgtttcatgaccaatgctatccttagcgtacaagatgaacgttccagaataaatgcaactgactccgaaaaattcaaagtcatgaaagagctggtgcatgatatactatccccggctccatctgtcagcatttatggctcaaagacgattagtgcaacggttgaattatgtcgtggaagacagaatcctgtgttgattccgggcggtgacatcaaactgaatgttcgctttgtggatgccagcgactttgagaaagtgcataacgcactcctcactgaaagtacaaaggtggagaataagcagaccctgttttgggtatgtaccttgcctcaggatatagaactcttgctgattgatgtggtaagggacgaaaccatttgcaacaatcaccggcatgacacgaataaggaaatccaggactatctgcgtgcccaacaagcggatgccgacaagaaccgacaggaaatcacacgcattttgcgtcaatcacaaaacaacagcgaaaccatctgcaagggttcgcctacgtcggtaaatggtgaaacttacaagacgcaagccttgaagagttttgccgaacaggtctataacaaatatcctttggcttcccgtagtatgtcaacttcggttgtaagtgacttgttggcttatgacgatgctaccaagctgcctgactcgctcaatccgtttggcattgttggcgataatggtgtgatagaaaccggtcatgccgcgtttgctgaaataaaggattatattgcctcaaacaatgatgctaacggtggacaactatccgaccacttcagccgtgctcagtatggctggagcaaagatactatccgttatttggtagcattgatgttaaaggcaggcattatcgtggtaagaagtggtgctcagtcctttaaaatgtttaccaagaatgcggctgaagccatgaagaataacacatcgttcagccaccttgggttgtctcttaatacggatgctcacttaaagcctgcagaaatgatgacggccatgactactctgaaggaattgtacaacccgcaagggttgacacccattccggccagcatcgccaaaatctctctgaagcttgccacgcaacgtcgtacgaaagtggagcaattgaaggatacatttgaaaacctgaaaatggctggaacatctactgtcagtcaagcggtgaattatttggttaagattatcgaatcagaaggtgccgaagcaccttatctctttgccaaagacaaagcttgtgctgatgcattaaggtttgtcaaccaggtgtttaaagctgaggaacaagggaaggttatcacttctatcaagaaaatacagaaacgactgaatgatgcccaacgcttgccgcaactccccactctggaaatattgaagaatcaattgggagaagatgaacaggccttcaatgatatgatgctcgatccaatctgttttaatcacactgcagaatatgcggatttggcttcacgcattgacaatgaaattgagcaggcttgcatgcacttctatacggaggctactctcttcatcaatcagaagaacaacgaaattcgtggttcggaagatttctcttcattgaaagaggaacagaaacaaagcatcgaagtcttgatgagtagaattgcgattcaggagggtaaaacactcgaacttttgcaggaaatgtgcaaccaatttaccgctttctacgctcctttagggctattcgatagtcttgagcgaaaagtgaaggattttgtaacagccaacaaaccggccgttacaacgcctgctgaggacgatgataccaatcgccctaatgaaagcagtaacgaaactaatgccgagagtgcttcaggagctaacgaacctatacctacagtcgttcgtcgtcagattaagcgtcgcctcactcagcgacaggatgttgagtcgcttattaatgagttgactcgtctattgcctcaaatggatgagggcgtatctatcgacctctcttttattgactaa

SEQ ID NO: 424 - DNA, 3153 bp, Bacteroides sp.
gtgactttggcaagacaccccactatatcgtcactgccaatgctcgccagaccattggcaaaattatcaatcactttgccagtggcattcattcgttttgcctcatcggctcgtatggcactggcaaatccagcttcatcctcgccttggaaaactgcctgtgtggaaagactgttggaaaaaaatgtcttactgagccaacgtggtcaattcaatagttttgagcaattctcgtttataaacatcgttggcgactacacatcgttggcgaatctacttgcgtcacatcttaatgcagaaagtaagaacgttatctctgtgctggacaaccactataacagacttcagaaaacaaatcaattcttagttattgttattgacgagttcggtaaagtgcttgaacatgcagccaagaacaatcctgaaaaagaaatgtactttttacagaagttctgcgagtatgtaaatgacacaagtaagaacattctcttccttacaacgctgcaccaaggttttggagcctacgccaagggattgaaagcagagcagaaacaggaatggacgaaggtaaaaggtcgcattcaggatatcgtctttgctgaaccgatagagcaacttctcaaccttaccgccactcatatatcttcggctgataaaaagccaacactcaacacagacaagatttacaacttagctgtcgcttctaagtttgccgccagcacacttgatgctaacgttgcccgtgctctctatccaatggatattgtctcggcttacgtttttacccaagctaatcagagatatggccagaatgagcgtaccttgttcacattcttggagacgcgcggtgaggggactgtcaacgattttgaagcttcaatcaatcgtttgtatagtcttgccgacgtccatgattatattgtttacaatttttactcttatttgcaagaggctcacgaagactcggcgaattggtcggctatcaagattgccatcgaaagaacagagggactcaatgcagatgccacaaccataaccgatgccatcaagattgttaaggccgtcggccttctgaacatctttgcctcgtctgctgctagcatcgacaagcagtttctgatagtctatgctagctatgctatggacgtttgtcaagtgggctcggtgatagacctcctcgaaaagaaccagatactgcgtttcgctaaatacaagtccaaatatatcctctttgagggaaccgatgtagatttggaagcagggctttatgaggctgctcgcgaatgcaagcgtcccgatgttatagcagaaaaggtgtgtgaatacttcgacgacaagatagcacttgccaatgcgcactattttcgcactggcacgccacgatacttccagtactgtctcacctcttcgcctattgaatacatcgtcagtggcgagaccgacggggttatcaatgtaatactgccccgtcaggaggaccttgttgctgtcaaagctgcttgcacggacataaatggtaaagccatcctctattgcatttttgagaacacaaccgaaatcgctgaccatctctttgagatagacaaactccattgggtgcgcgactattacgtggccgacgagaacgacaaagtagccaaccgagagatagctaacctgctggttcacgaaaagtcaatgttgaacaaaaacattatggagagcctcttctctgacaacgtgacgtggatttttaacggtaaaattcttgcgtcaatcacatcgcgtaagatgctcgcacagcaactttctaccatatgtgattctgtctattatgccactccaatctatcgtttcgagctcattaacaagcaccgccccactggtaatatgtcacttgcccgccagtcgtatttgcaggcattgcttgaccactcttccgagccataccttggctttgagaaggataagtacccacccgagaaatcactatatctcacacttctcaagaatacaggtattcatacgactgccggactgggctcaccgaccgaaccttcattccaaccactttgggacgcttgtgagaacttcctgcgctccactatcggcaaaccgcataagttgggagaactcttcactctgttagaggctgcaccttttcgtctgaagcaggggttgctctattgttggattcccacatatctgattattaaacgagatgatttcgcgctctataacagcgatgggacctatgtaccttacatcaacaaggaggtgcttgaccttatactgcgctcacccaatggttttctcattaaggcctttgctgttgacggtgtccgccgtacatttttcgacaaatatagagaggctatcaatatgggcagctcagaactctcgactcaatcgtttatcgaaacgattcgtccgttcctcaccttctataagaagttgaatagctatgctcgacgtacgaaggatatttcgcccaatgctcgtaagttccgcgatgtcatagcaaaggcaaccgacccagagaaaacattctttgaggtgttgccggatgagttgggctttaaggaaattacacttagccaaaacccagaagccattgagagctttgttgctgtcatacaagaggctatccgcgaactccgcaactgctactctgaattggttggcaatatcgagcaatatttgcttaaaacactgcgacttgaagaagtcggtttctctgactatcatcatctgatagcagaacgatataagtcggttaaaacggaattgatgcctgtaaatatgcgtaactttcaaacccggcttgttggcaactatgatgacaagaccacatggattgaagcggtgtcatacgttgccctcaacaagcctttgacagaaatacgcgacacagataaatcgttcctgctggctacattgaaagatatgctgtttcaactggatgactatgtggagatgcacaagactgcaagtgaggatgtcataagactgcatatcacacagaataagagtaaggctgtaactacgcaagtcattctttccgaagcaatgcgtcaagaggtcaacagccttgaaaacaaactggagtctattttgagtggtgacaactcgctcgacgttgctgcactgatagcaatccttaaaagaaattga

SEQ ID NO: 425 - DNA, 3582 bp, Bacteroides sp.
atgaaattagaagcaatatacgaaaaagatataaaccgtacggtcaatccggcagtatccgcaagcgacttttctgataaaacagtcaaaacagaaattgaagaatacgtatttacagacgagatcattaatggactctacaaaatactatcggctatcaaaaaccgcaatgtcagccatgatggaatttggataaatggctactttggttccggtaaatcccatttcttaaaatatttggattattgtctatcttcccaatatcgggaaatggctcttgaacgcttgttagaagcagtgaaacttcgtgacccgttacaaataccggaaagtaagtcggaagtagaaatttcggatatgcgtgatttaactatttggttaaaggatgctaccgttgacactattcttttcaatattggtacagtccataatattcatggcgatcagcaacgtgtctttttagatatattctggagcgaactgaatcaatttcgagggttcaataaattcaatttagcccttgcccaacatttcgaaaaggttcttctggagaaaaataaattcgatgagttcaaagagcgtataaaagaagaaggtttcgactgggatttgcaggcaagtgacctggctatcaatgaattagatttcattctcgaaatcggtaaagaactgataccgaccctatcaacagacattattcgtgaacgaatcattagagacgacactgctgttagcgtcgaaacgttcatgaatgagctaaaatcatatcttgcagacaaaggagataaatatcgtttaatcttccttgtggacgaagtcagtcagtttattgatgaccgaaaaggacttttattacagttgcaacagattgtcacagaattgcataaagcctgtgaagataaaatttgggtagcctgtacagcacagcaagatttatcggaaatcgtagaaagttgccagatatctgcaacttccgaagattatggaaagattatgggacgcttcgaagtgaaagtttctttgaaaggaacacagcccgaatacatcactcaaaaacgtattcttgaaaaaaagccgacagcagagttaagattaggagaattatatgataaaaagaaaaacgctatatcagcacaattccaacttcctacatcatacaatgcttatcaaacacgcgaagagtttatcggatactacccttttgtaccctatcaatttaaattgataatgcaggttttcaattccttcgttaatttaggatatgtagagaaagaggtaaaaggtaatgaacgaagtattattaaagtaacccacagtacggccaagcaaactaaagatcaggaagttggcaatttcattgctttcgatcaattcttcaatgctatgttccaaggtagtctgatggcaaaagggcagcgttctatccagaaagcaaacgatatgatacaagagtatagcgatcgtgctttcggtcaacgagtggttaacattttattcatgatatgtaatctttcggaaacagaccggttaatatttccggccactgtcgacaacattacctgcctattgatgagtgatgtcgatgctcaaaagttatcactcaaaaatgaagttcaaaaagtactagattttctatgtgacaaaaacattattcgtaacgaacccgccaagcagggagttcccgaaacatattgtttctattccgaagacgaaatagaagtagctcaattaataaaaactcaagtaatcgataataatacgatggccgaggagttgaaagaaatattcttcgcatatattactcctgctgcacgtgaagtattctattccagccgttttactgtaggagtaaatattatgggaaagaacttcttgtccaacaatgcagatatcaatgtcgaatttgtgatggattctgaccaagacaatccgcatacttacgcttttagcaatacaaacaataagatggtcttttttatgtcggaactttataaagaaaaccggacgctcaagaatgatttttattggtattgccaagtacaaaaatatatgcgaactcctgtcacaagcgaacttcgccagaaaacacgggaagagttcagtaaacgggctaaagacatctaccaacgtaagatagaaaagccattccgcgaaatcttcgattcttgtccagttatatccggtttgaacattctcgaagatttaggttccggtaaaggtccggatcgctacaaacaagtcctaaatcgccatttcgcaaacctatatccacaagcacgccttgttgattctacggatatgccacgcaattcggaagaactgaagtccaagattcaacgaaaagtagaaattggtgattacaatgaactgaataatacgctgacggaagctgaacgacaagtagaaaactatttgaatcggcaagtcaacgatgtaaacctcaaagatattgtgactcgttatgccgctgctccctatggatggaatgagatttgtaccatttacattgtcaatgagttggtacgcagacatcttcgcgatttctcttacaacaacaatccaaatgtagagcgatccatcatagcaaacaatatattgagagatcaagctaaatttgcggtccgtcctgcccaaaaaatatcgcaggatttaatcaaccgttttgttgaaagttggaaagatatattcggaacagtcagcatttcatcgggtatagatagcaatgaacttttcaaccaatgcaaaaccaagctggccgaaaatattcaaaatacagaaaacgattgcaagagaatagcccgctatccctttgtcacagttctcaatgacacaatcagcgaattgagccgttggaattcggaacgtgaaccaaagaaattcttcgaacagataatcaatgcgcgccaatctgctaaagcactaatagataagcgtaaaatgataggagaatttatcacagatcaattagctaaatataaaataatctgtgatttcgttgatgataaccgcgacaactggttatttcttcctgaatcatgcgcagatactgtcaaaagtttgaagtctataataaatgaaccttggcctattgataaaatggttccctataataaaatgatgcgtgaactgaatgcacacttagaagaggtcaaaaagattaagattcttgaaatagaacgtatctataacgatatattcgatcgattggagaagtttgctacatctaaaaatgtggatcgtaatagctttgcgaaaagagatatcagtattatgcagaaaaagaattcttctaatatcttgatgctcgaaaataatatcaatactagcaatgacttttataacgaacaactggatatcatcataaaacatattccaattccccatattccaaaagataaaccagaaagcaaagatactaaaaatgaaatagaaatagtaaagcaaacacgaaatgtcaaattaaacattcagacttttgaaccgctgaagtcagaagcagagattgatgaatatcttcaaggattgaaaaaacaattgatgaagttcatagacaataattatgaagtaatggttaccaaataa

SEQ ID NO: 426 - DNA, 2367 bp, Escherichia coli; identical to SEQ ID NO: 418

SEQ ID NO: 427 - DNA, 1092 bp, Escherichia coli; identical to SEQ ID NO: 419

SEQ ID NO: 428 - DNA, 2415 bp, Escherichia coli
gtgtttgaatctattcggacgaaaggtgcagcgggtaaacaattggccatgggtgagcgttctcagctggaggcattccagactgcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctactgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagtcgcttcctgaacggacacccattagacggcgcagtgcttaacgatctggtggtgaagatcctgacccctaaagatccgacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggctaccctgctctcagaaaaagcgcgtgaaaacagcaaccgggaaaaattactccgtgttcagttggaatcactacttgcagaagcagatgtttgggcgattggcgagcgcttaccgaaaaaatcctccacgccatcgaatattgtcgatgaagcctgccgttacgtgattgaaaacaccttcggcaagctgaagatgctgcggccttttaacggtgacatctcccgtgaaattcatgcattactgacggttgagaatgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaatgagattgaatccggtctgcgcctgcttaatgccattcttaatgaaaaagaagattttgccctgatcgaaaaagtctcatcgctgaaagatgaacttctggatttcagtgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcaccgccagcacgccctcgaacgcattgacgcccgcattgaggaaagccgtcaatgcttgctggaagcgcacgccacgtcagagttgcaaaacagcgttctgctgccgatgcaaaaagccagaaaacgcgctgaggtcagccagtcgattccggaaattttggcggaacagcaagagacaaaagcgctgcagatggatgcagataaaaagattaacctgtggatcgacgagctgtgtaaaaagcaagaagcacaactccgggcagcaaatgaagccaaacgcgctgccgagtcagaacagacttatgttgtggtggaaaaacccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgccattaaagcaggcgatcgcattcgccttcagtaa

SEQ ID NO: 429 - DNA, 1092 bp, Escherichia coli; identical to SEQ ID NO: 419

SEQ ID NO: 430 - DNA, 2415 bp, Escherichia coli
gtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgctgaaaacgctgttcctgatccgctatgtggaaacgctgaaaagcaccctggataacctggtcacattgtctatcgataggatcgatgccgataaagttgagttgcgccgccgggtcgaaaaaagtctgaacacgcttgaacgcctgatgctcattgcgcgcgttgaagataaatatgtgttcctgaccaacgaagaaaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccaacctattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgagcgcttaccgaaaaaatcctccacgccatcgaacattgtcgatgaagcttgccgttacgtgattgaaaacaccttcggcaagctgaagatgctgcggccttttaacggcgacatctcccgtgaaattcatgcattactgacggttgagaacgacaccgaactggatctcggtaacctcgaagagtccaaccccgacgccatgcgcgaggtagaaacctggatcagcatgaatatcgaatacaataaaccggtgtatttacgcgatattctgaaccatttcgcgcgtcgcccttatggctggcccgaagacgaagtgaaactgctggtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcacaggtgcgtaaagccgcgcaaaccatggctgacatcgctcagcaaccatttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgaaaaagaagattttgccctgatcgaaaaagtgtcatcgctgaaagatgaacttctggatttcagcgaagaccgtgaagatttggtcgatttctaccgtaagcaattcgccacctggcaaaaactgggcgctgcgttgaatggcagctttaaatccaaccgcagcgcgctggaaaaagacgccgcggcggttaaagcgctgggcgagctggaaagcatctggcaaatgccggaaccttataagcatctcaatcgtatcacgccgttgattgaacaggtccagaacgtcaaccatcagttagtcgaacagcaccgccagcacgccctcgaacgcattgatgcccgcattgaggaaagccgtcaacgcttgctggaagcgcatgccacgtcagaactgcaaaacagcgttctgctgccgatgcaaaaagccagaaaacgcgctgaggtcagccagtcgattccggaaattttggcggaacagcaagagacaaaagcgctgcaaatggatgcagataaaaagattaacctgtggatcgacgagctgtgtaaaaagcaagaagcacaactccgggcagcaaatgaagctaaacgcgctgccgactcagaacagacttatgttgtggtggaaaaacccgttatccaaccggtaccgaaaaaaacgcatctggtgaatgtcgccagtgagatgcgtaacgccaccggtggtgaggttctggaaacgaccgaacaggtggaaaaggcgctagacacgttacgcacaacgctgctggccgccattaaagcaggcgatcgcattcgccttcagtaa

SEQ ID NO: 431 - DNA, 1170 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggctactgcgctgattttccgcatattgcccatcttgagcgcgagctagataaacgcggtcagtatgagacctttaaagccgcgtttgccgatatcaatggctcacgctgggaagacgagcgcgacgcttactactttatcagcgatgacatggcacaagcgttaagccaggccacacagcagagtcttgaagcctcccgccaatgggtggaacaactcgacaaaaacttcccgctggatatcaataatttttgccagtgggtaaaagagtggctggatgacaacggtaagaacatcctctttatggtggatgaagtcggtcagttcattggcaaaaatacgcaaatgatgctgaagctgcagactattactgaaaaccttggggtaacctgcggtggtcgcgcatgggttatcgtgacttcgcaggccgatatcaatgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcgctgacaaaagtgtggcgagagaaaggcgatatcctgcgtaaccagctggcttttgaccctacaacaactactgcactacgtccttttaccagctaa

SEQ ID NO: 432 - DNA, 3627 bp, Thiorhodovibrio sp.
atggaaatcaaagcactctttgacagcaacaaagacatctatcgcaccatcgagaaggtcattacctatggtgtctcgcaagagacccgtctgaaggcggagatttccgaatacgtcgtcaccgagagtatcgaagatcagcttgggcggctgctcgacaagatggaagccgccatggaggccggtggcgagaacgaggtcggcatctgggtgtctggcttctacggctcggggaaaagttcctttaccaagtacctgggcctggcattcgatgatcgcgtcaccatcgacggcattccctttctgcaccacctgcaaaatcgcctgaaaaaaagcaccaccaaagcgcgcttggcggcggtggccaagaaataccccgccgccgtgctgatgctggatctcgccagcgagcaggtcgccggtgccaccatggaagaagtctccaccgtcctctactacaaggtgctccagtggggcggctattcgcgcaatctcaaggtggccgccttcgagcgccgcgcccaaaaagacggccgccacgaggaatttctgcgtctgttcagcgaactgacccaaggtcaagcctgggcggattaccgcaatgatgacctggtggtggacagcgtcatgccggaactcgcccaccgcctgtacccgaacctgttccacagcccgagcgccttcagcaccgaaaccagcgcaatcatccgcttcgagaatgatcgcgtagcggagatgatcgatattgcccgcgaggccagcggccgcgactacatcatctttgtcgtcgacgaggtcggacagtacgtcggctcgcggcaaaatctgattctcaacctcgacggcctgggcaagaacctcaaggccatcggcaacggcaaggtgttgttcatcggcaccgcccagcagcgcctgaccgaggacgatgccagcgccgcgctcaactcccagcaactgttcaagctcaaggatcgctttcccatccagatcgacctggaagccagcgacatcaaagagatctgcaccaaccgcctgctcggcaagtcgcccaccggcgaggcagaagtgggccggctgttcgaccaacacggccagagcctgcgccaccacaccaagctcgaagacgcgcgcgcctacggggccgactttgatcgccagaccttcatcgacctctatcccttcctgcccgcgcatttcgacatcctgctccacctcttaggcgccctggccaagtccaccggcggcatcggtctgcgctcggccatcaaggtgatccaagacattctggtcgaagggccggacggcaaaacccctatcgccaaccaacctctgggctggctggctaccaccgtgaccctgttcgacgccctggagcgcgacatccgccgcgccttcgtgtcctggcacctggcggttggcaaggtcaagatccgcttccccgattccgagctgcaccaacagatcggcaagagcgtctgcgtcttgcaaatcctcggcaatctgcccatctcccgccagaacgtcgccagcctgatgcatccgagcgtggcctcgcccgcccgcaaagaccacattgacgcagccatcgaggacctgatcaaggacgcgatcgtccccatgggggagaaagacggcgtcctggccttccacagcgaaaaactcaacgagatcgagcaggaacgcgccaagatccccctgcgcgccatcgaactgcgccgcattcacaacgaagcgctgaaagaaacctacaaccccctcccgtccacccaactcaacaacaccttctccgtgcaaaccggcctgaaggcgcaggccgccagcggcatcccggccagcctggccggcgagcgcaaccccatccagaccctggtcgaactggtcgcccccaccgaggtcgagaccgccaagacccgcctgaccgacgacagccggcagaagaccgccaagcaaaccatcttcctgctcgggcgcacgacgccggaaatggacgagttgattgcagagattgttcgcagccgggaaatcgtcaacaaatatcgcaacgacccggatcaggaagtcaaagactattgcggcgcgcaaagtgaccgagccgcccgactcatcaatgaactcgggcgccagatgagcaacagcctgatcaagggatccttcatcttccggggtgaactgagcgcggtagacagcttcaaccaggatctcatcgaagccgcccgcaagcacctcgcccaggtggccgcgcaggtgttcgaccggcatgccgaggcgccgatccgggtcagtaccgacttggccgagaagttcctgcgccagggcaacctgaccggcatgaccacccagatcgatcccttggggttggtgaaacttcagggcggccagggcagcatcgatgtccagcacaaagccctcaccagcatcaaggaccagatcgagcgccagggcagcctggaaggcaagcgcctcagcgacctcttcgccgatgcccccttcggctggtcaccggacaccctgcgctacctggtcgccgccctgttggtggccggcgagatcaagctcaaactggccgggcgcgagatcaccgtcaacggccagcaggccatcgacgccctcaagaccaacaacagcttcaaatcggtggggatcagcctgcgtgacaacaagccccccatggagatgctggcgcgcgcggccgggcgcctcaccagcctggcgggcgacaccatcgtcccgctggaagacatcatcagcaagactgccgccaagctgtttcccgacctgcaacaccagttcgcccccctggccggcacgctgcgcacgctcgacctccccggcgccgaccggcttgagcaactggccagcgacatcaaagacgtgctggccaccgatgcctccgacgcggtgcaacgcctgggcgcggaaacctctgttctgtttgacagcctggagtgggcgcggagcctcaagcaggccatggcgcagggtctggagacgaccctgcacgacctgcgccgccacctgcaagagatcagcggcctgcccaacaacggcacccccggccaactgcgccaggccctcagcgaaccgatcgccgacctggagcagcggctccagcatcccgacttcgccaaatacgccaccgaattcgccagcggcctcaccgaactccacacccaggtgcgcgatgccgtcaagctcatgcaacaagaccaggcccagcgcctgcttgacgccgaggacgatctgcgccgcctgccggaatggccggcgctcagccaccaggaccagaacaacgccctggcggatttacaaaacctggccaccaccgcgagcgaggatctcaccggcctgcgcgacctgatcaatcaggactacagcatccagaacgaagtccaagacatcaagcgccgcatccagcaacgcggccagaagatcctgcaggatcgcctgcgcgaagaacaggaacaggccgtcaaagacggtcaaacgaccatctgtcgtcagcaggccttacaaccgcgcatcaccagcatccaagatctggaccagctaatcagggacttgcagcaactgcgcggcgaactcaagtacgccgccgaatttgaattgcaactgcacatggaacaataa

SEQ ID NO: 433 - DNA, 3501 bp, Cylindrospermopsis raciborskii
atgaccttaaagactatttttcagaagccaattgaccgccccattgaaggagtcatcaaagcagatgacgaagcaagcctacggattgaaattgaagaatatgtactcactaacgagatagagaagcgactggaggaatttcttcatgcttacaacaattaccagggtgccaatggggtgtgggtgtcaggtttctttggttctggtaaatctcacctgctcaagatgttagcactgctactggaaaatagatctgtggatgggataccggtactacattccttcctacccaagtgcggtgaaaatcaaatgctccggggtgacctcaaaaaggctgtctccatcccatcaaaaagtattctctttaacattgaccaaaaggctgatgtaattagcaagactgaaatagatgccctcctagctgtctttgtcaaagtatttgacgagatgtgcggctattatggtaaacatggctacattgcccaatttgagcgggacttagatagccgtggtcaatatgaaagctttaaatcagcatacaaagaagtggcccatcgaccctgggaagaaggtcgggagcaggccctgttagagtccaaaaacattgcgatcgcctatggccaaaccgtaggtggcgatgcgatcgcaggtcaaggaattctggataagtatcgcaatcaatacaaggtttccattgaggattttgctaaagcggttttggactatgtggagcaacaagggaaaaacttccgtttaaacttctttgtagacgaggtagggcaatacatcgccgataatgtgaaattaatgaccaatctgcaaaccgttgcagaaagtctggctaccaagtgtaggggacgcgcttggattatggttaccgcccaagaagatatggactcagtactaggagaagatagtcgccaacagaccaacgatttttccaagattcaagctcggtttgccaaccggatgaaacttaccagccaagatgttgctgaagtcattcaaaagcgactgctcatgaaaaatgaagttggcaagaatgtgctctcaaaattatatgatgaccaagcgaataactttaagaccctttttgatttcgttgatggatcccagacctaccgtaattttcaggatcgggatcactttatccagagctatccttttataccttaccagtttccccttttccaagctgccattcaaaatctatcagctcacaatgcgtttgaaggcaagcacagctctgttggagagcgttccatgttaggtgtttttcagcaagttgctatacagattagtgaatatgaggaaggtcaacttgccaccttcgacctcatgtttgaaggtatccgttcagcactaaaatccagcatccagcaagccattttacaggcggagcgacacctgcgtaacacttttgctatccagctgttaaaagccctgttcctggtcaaatatgtaagagaatttaaggcaacacagcgcaacctctgtgtgttgatgtttgatcggttcaattgccatatcacggacttgcgtaagagagtagaggaaggactaaacctattagagcaagaaacctacatccagcgccacggggaactctacgagtatctaacggatgaagaaaaagacgtggaacaggagattaagaatacggaggtagacaaaagagctgttgctgaagagttagaaaagctagtcttcgatcacaccctcaagctgaaaaagattcgctccaactcacaggattatcccttttgtaaaaagatagatgatcgtctctatagtcgggaatgtgaattgacaatacacatcatctccccgttcaatgaaaatgctgagaatgaagataacctgtgcgcccagtccatgggacgtgatgaactggtagtgattataccaccagaggaaagactcatgcgcgaccttatcatgtacaaacagacatataaatatatcagccagaatgtgtccattacccaaaaggattcagttaaaagcatactcaccgataagaattcccagaataggcaacgctacacagatctccagcaacgggtacacacattattgagtaaatcaaaactcatccttaatggcagctatattgaagtagggggagatgacccccagaatcgcatcctcaagggatttgaggatctgatcctcaaaacctatcccaatttacaaatgctgcgcggtatggtttatacggaaaaagatctgtccgaggcactaaacaaacctgaacagcttcgtgaagacaccgaaccagagcaggaggtgcttgcttccattcagcgcaataaagatcttggagtaaggacaaccctaaaaacgctaatagacaaatttgaacgtaaaccttatggctggcatcatgcagccctattgcacaatgtagcgagtctttgtgcccgaggtaagctggaagtacgctgggacagcaatctattggatggtaatgagctactcaaagcactaaccaacacccgtgaccacatgaacatcattcttgaaccgcaaatagatttcactgcttcccaggtacgggcattaaagaaactatatactgacttttttaacgaaccagctcccagcggagatgccaaactactgggacaaaaaaccgcaaccgccatttccgacttaattgataggcttgaagccctttctacttcacactatccctttaaagaaaaacttagtagtgcgatcgccagactgagaaccataaatggcaaaccttatgcctggtatcttacagaccttatcaaacaagaagatgaactgcttgacctgaaagaacaaaccattgatccgatttgcacatttatgaacggttcacagcgaaacatattcgattgtgcccaggcgtttattgaagagcaggaagcgaactttttgatagtgaatgctcttcaagagaaaaaggtgcgggaaatactcgctgactctcactgtttccgaggcgatcgcatggagcagttaaaggaattggtgactaaactgaggaaagagattactactcggttaaatagagaaattgaggatgctgtagctataatagaatcactacgaagcaaactggttgctacggctgagtttcatgtccttagctctggtcagcaaactgagattgctagctcatttgataaatatataaaggttatcaagaaccagaagctcatcgctgtaatccgtgacagaaagagctcctttgagcaagaggaatacaaaaggttacggcaaatagttttttgtacccagcctggtgtggtagcagagaaggcaaatcaataccatactaatcaagaaaaaagattagtggggaattggcaagagatacaaagtctgtatgtaagtcatcgttccatccagtttagtttcgacaaagagtggctggcagatgaaacggatgtagagcagtatgtagctgttatgcgggaggcattattggcagaagttcgcagtgggagaagagtacaactatga

SEQ ID NO: 434 - DNA, 3567 bp, Microcystis aeruginosa
atgacaaatattatcgagcttttaacatttacgagtaccaagtttaagggagaactaattatgcagttaagtagaatttttgagaaacaagttagtcgtcctatggaaggggtaatcaaagcggatgccaatgatgaggcgagtctgcacgttgaactagaagaatatgtgcttacctgcgaggttgaaaaacgcctagaggagtttttgtcagcttataacaattatacaggagttaatggggtttggatatcgggattttttggctctggtaagtcccatttattaaaaatattggccctgttgttagaggatcgcaggctcgaaaatagccaagcaattgaaaaatttttacccaaatgtcggaacaatgaaattctcaaaagagacttgaggaaagccgttgctattcctgctcaaagtattttatttaatatcgatcaaaaggcggatgtcaccagtaaaacagaatttgatgctttattatcagtttttagcaaggttttcaatgaagcgcggggttattatggaaaacagggctatattgctcagtttgaaaaagaattagatgagcgggggttatatactgcttttaaaactgagtatgaatccgttgctggtaaaccctgggaaaggggacgggaacaagtcattttagaaagaaaaaatattgcgatcgcctatggaaaagtgaccggtgcatcggtggaaaattccaccaatattctcgatttatatcgtcaggattataaactttccattgatgatttttcccaagaggtaaaagcatttattgaacagaaaacctctaattttagactaaacttttttgtggatgaggtgggacaatacattgcggataatgttaaattaatgaccaatttacaaaccattgccgagagtttagccacaaaatgtcagggacgttcttgggtgattgtcaccgctcaggaagatatggaaacggtattaggagaaatgggaaatcatcgaactaaggatttttctaaaattcaagatcgttttgctaatcgcatgaaattaaccagccgggatgtggcggaagttattcagaaacgtctgctgacaaaaaatgaggatggtgttagaatactcgggcagatttatgagcaacaacggcataatttacctaccttatttcgcttttccgatggctcaagggatttccgtaatttccaagatagaaaccattttaccgattgttatccttttattccctatcagtttacccttttccagtctgctattagaggattatctatacatagtgcttttgaaggaaaacatagttcggtaggggaacgctcaatgttggcggttttccgtaaggtggtaatagcaattgaggggcaagaaattggtcatctagctacatttgatttaatgtttcaaggaattcgatcaacgttgaaatctaatattcagagtggtattactttagcggaagataaccttaataatccttttgccgtgcgtcttctcaaggcattatttctagttaaatatgtagagggatttaaggctaatttacagaatttatctatcctgatgttagaagagtttgaacaggatatttcccacctacaaaatcgagttcaggaagggttaaacctgcttgaacatcaaacctacattcagagaacgggggacttgtatgagtatttaacggacaaggaaaaagacattgagcaggagattaaaaatacagaattagaagataataggattttagatgccttaaataatttaatttttgaggagattctcaaaaccgcaaaaattcgcaatcaagaggggacacaagattatcaattctcccgtaagattgatggaatactttataaacgagaatacgagttaagtattcaaatcatcactccttttttctggcaacatgagcaagaaaaagccctacagatggagaatatgggacgggatgagttattagttattatcccttctgatcagcttttaataaaagatttaaccatgtataaaagaacagaaaagtatgttcaacagaatatatctgtcactcatcaggaagaagttaaaagtattttgaatcaaaaaaatcaaagcaatcaacaaaattacgaaaagattaaaaacaggctgaaaagtttattagtacaggctaagttatttgtatcgggaagagagttagagattagcagtagtgatgctcaaagccgaattattttagggtttcagaaattaattgccgaggtgtatcataactttcaaatgttagggggagtgacttataaagtcgaacaatttaagcactttttagaaccgtctcaagagggtttatttagtaatgatgtcaaggatttaagtgaaccagaaaaagaggtttttaactttactcaaaaggataaagaaaaggggttaaggacatctatgaagtctctaaccgataattttcaacgtaaaccctatgggtggagtgagggggcgattttatgtatggttgccaaactgtgcgccagaggtaagctaaaagtggaaagagagggcaatttgttagaaggaggggcattagttgaggctatttgtaactctcgtaattatagtaatattttactacagccacaacagaaatttacctcttcacaggtacgaaaacttaaggatttttatgaggaattttttgctcaaccctgtggagataatgaacctaaagctatttatcagaaaacgcaagcagcatttaaggaactcagccaatcgattcaagaaacactctcagaaatggataaatatccttttttatcggctttagaaccggctcgacaaaccctgaatgatgtatgtaataagccttatgattggtatcttaccgatttaaccgaacgagaggatgagttattagatcttaaagaggatgtaatagagccgattctgagttttatgcagggggaacaaaaacggatttatgatcgggctaaactgttattagagactcaaaagcccaattttagttatatcaacagcgataatctatctcaactgagaacagttctcacggatacccaatgctttaaaggaagccggatgcagcaggtaaaggggttaatagagtcggtagaggcagaaatttctagcgaagttaccagggaagtggaacaagcacaggaagaaatcgggttgttacaagagcgaatgggtaaaatggccgagttttcccaactttctccggtgcaacagcaggaaattctgaaatcttttcaggattgttgtgattctattgctcaagaagatttgattgctatgattcgcagtacccgtcagaagtttgaaacggatacctatcctcggttactctcaaaaatgactaagttgacgggggttgatggggtttcttcccaagcaacccgtcgggttaaggagtcagaaactcaatatatacccagtcagacaattaaggttaattttggcaaggcatggctggcagatgaggcggatgtggaggagtatctctcggcaatgcgtgaggctttaatggcagaaattaaggaaggtaaacggattcaaatttga

SEQ ID NO: 435 - DNA, 3456 bp, Vibrio cholerae; identical to SEQ ID NO: 239

SEQ ID NO: 436 - DNA, 3456 bp, Vibrio cholerae; identical to SEQ ID NO: 239

SEQ ID NO: 437 - DNA, 3615 bp, Enterobacter hormaechei
atgaatattgaacagattttcgaaaaaccgctaaaacgtaatattaacggcgtgattaaagccgagcagaccgatgacgaaagtgcctgggttgaactggatgagtatgtcatcacccgagaactggacggtcacctacgccagtttttcgaggtgtacgcccccgccacaggccccggtaggttgcaacttgccgataagatgggtgtttgggtttccggcttctttggctccggtaaatctcacttcattaaaatcctttcttatttgttggcgaaccgcgaggtcagccacaatggcgtaacacgcaatgcgctctctttctttgaagagaaaatcgacgacgcactgttattggccgatattcgcaaagcggttcaacacccgaccgatgtggtgctgttcaatattgactcgcgcgcaaacgttgaagatggcgttgatgcgatcctaaaagttttcctgaaagtctttaacgaattggcaggctattgcggggacttcccgcacattgcacatctggaacgcgagctcgataaacgcgatcagtttgatacgtttaaagccgcctttgccgacattaccggttctcgctgggaagatgaacgcgatgtctatctgatgatcaacgatcagatggcgaaagcattaagcatcgcgaccaaacagagtgaggaatcctctcgtcagtggatcgaacaactggataagaacttcccgctagatattaagaacttctgtacgtgggtgaaagagtggctcgacatccagggcaaccgtaacattctgtttatggtcgatgaggttggtcagttcattggcaaagatgcccagatgatgctgaagctgcaaactatcacggaaaacctgggcgttatctgcggtggtcgcgcatgggtgattgtcacctctcaggctgacatcaatgccgcgattggcggtatgagtagccgtgacggtcaggatttttccaaaatccagggacgtttctccacacgcttacagctctccagttccaatacttcagaagttatccagaaacgactattggtgaaaaccgaggcggcaaaaccggcgctggaagctgtttggcaggagaaaggtgacattctacgtaaccagctggcgttcgacacaacaaccacagccacgctgcgcgcttactccaacagcaaagaattcgttgataactatccgtttgtgccatggcagtaccagatcctacaaaaggtctttgaatcgatccgtaccaaaggggctgcgggtaagcagttggcaatgggggagcgctctctgctggatgccttccagtcagcagctgtgcagatttctgccgatggtctggacagcctagtcccgttctggcgtttctactccgcgattgaaagcttccttgaacctgcggttagccgcactatcattcaggcttgccagtctccgtcactgacggaatttgacggcaaattgttgaagacattgttcctgatccgctacgttgacgtcctgaaaagtactcttgataacctcgtcacgctctccatcgatcgtattgatactgataaagtggaactgcgtcgacagattgaagccagccttaatcgtctgcaggctgaaatgctgatctcgcgtattgatgacaaattcgttttcctcaccaatgaagagaaagagattgaaaacgaaatccgcaatatcgacattgagttcaccaccatcaataaacagctctcgactatcatttttgacgagatcctgaagaacaaaaagtaccgttatccggcgaacaagcaggattttgatatcagtcgtttctgtaacgggcacccactggatggcgcaaatcttaacgatttggtagttaaagtgctcacgccgctggactcgaactacgagagctacaagggggtgcattccaatagcctgctgatgacggacagtaaagactgcatcctcatttgtctgcctgatgaagcccgaacctggcaagacctgaccatgtatgcccaaactaaagccttcctcagcaagcaaagcggacagcgcccggaacaggcaacactgctggcggaaaaaggccgtgaaaatggcatgcgcgaaaaaacgctgaaggcgcagattgaaggcttgttggctcaggctgatgtctgggcgttgggcgagcggttggataagaaatcctcttcgccgttagctatcgtagatgcagcctgcggttacgttatcgagaacagtttctccaaactaaaattgctgcgcctgagtaccggagacgtaaatcgtgagactcacgcgctgttgacagtagaaaatgatacccagctcgacctcggtgatatggaagaatccaacccagaggcgatgcgtgaagtggacaactggatcagtatgagtattgagactcataagccagtttacctgcgggatattcttaccacttttggccgtcgtccatttggctggccggaagatgaagtcaaattgctggttgctcgattggcacgcagcggtaaatacagcttcactctgcaaggcagtgaaatcgcactgaagcaggcgtgggacgcgtttaataattcacgtcgttacagtgatttgcgtttgcacaaagtgcgtcgccatgacgaagcgcagttgaccaaagccgcgcagctgatggccgagattgccggggaaccgtttaacgagcgtgaagagcagtcgttggtgtcacacatccgcgaattgtttggccgctggaagagcgagctgaccgtcttcaaaacccgtgcagagagcggcaaaaacccagggcaaaaagaaattgcagaaggtctggtgctgctgaacgggatactgaacgagaaagaagaatacgcggtcattgaaaaagtcactgcagcagccggtgacctcgaagatttctcggaagactgggacgatttagtcagcttctacaaaaatcagtacgctacctggcagcgtttaagtaccgcgttgaatggcagttttaaagctaaccgtaacgcgctggataaagacgaaacggcccaaaagctgttgcaggagttggaaggcatctacagtaaggcacgaccttacggagagctgcaccggattatcccgctgattgaaaccgttgaaaccatcaaccagcgtctggtggaagaataccgaagccatgcgctgctgcagatcgatggtcatatcaatgagctgaagcaaagcatgctggagatgctcgttcctgctgacttgcagcactcgcttttacacccgatgcaacaatcgcgtaaaaaagtagagcagaacggtctgatcccgcaaattatggaagaacaggctgaggttagggcgcttcaatttaaagcgaacgaacggctgaacagctgggttgaggaacagcgtaagaaagtgcctgtccccaaaaaatcgcctcagccaggaattatcgaccccatcgataagcctgaacccaaactgaaaaagacaatctacgtgaacacgcgtaagacgatggaacgtgctgcgggtgtaacaacgctggataacgccgaacaggtcgacaaagcgctggaacagctgcgtaaaacgctcatggatgccattaacgcaggcgaacgcgtgcagcttcagtaa

SEQ ID NO: 438 - DNA, 3585 bp, Marinobacter sp.
atgacactgaagagcatctttttaaaacccgttgaccgcccgatcgaaggtgtcatcaaagccgacgacgaggccagccttcgcctcgaaattgacgaatacgtgctgacgaacgaagttgaaaagcgccttgaagattttctggatgcctacaacaactacgaaggtgcgaacggtgtttgggtttccggcttctttgggtcgggtaagtcgcatctacttaaaatgctggccctgttacttgagaaccgggtgctcgaaagtcaagagatggatggtgcttcaaccctggaacgtttccttccaaaatgcatcgacaacgaaattctccgagctggtttgaagagggcagtcgccattccctcaaagagtattttgttcaatattgatcagaaagccgacgttatcagcaaaacccaaatcgatgcgctgctggcggtattcgttaaagtctttgacgaaatgcgtggttattacggcaaacaagggcacatcgcccaattcgagcgtgacctggacagccgcgacttttaccagcagttcaaagccgaatatgaaaacgtggccgggcggccttggcagagaggtcgtgagcaggcgcttttggagggggcgaatattgctaaggcttacgctgcggtgaccggaaccgaccaacagtcggcaatgggtatccttgataaatatcggagcgattaccgtgtctcgattgaagattttgcggacaacgttaacgcgtatatcgagaagcaagcggctgaaggcgggcataaagaatttcgtctgaacttctttgtcgacgaagtaggccagtacattgccgacaacatcaagctgatgaccaacctgcagaccatcgcggaaagtttggccaccaagtgccggggccgcgcctggattgtggtcactgctcaggaagagatgaagaacgtcgtcggtgagctgggcaagcagcaggggaatgacttctcaaaaattcaggcgcgctttaacaaccgcatgaagctgtccagcgcagacgtggccgaagtgattcagaaacgcctgctgacaaagaccgaggagggtgttaatcagctatcggatgtttaccgctcgcagtccaacaacttcaaaacccttttcgactttgcggacggttcagccacctaccgtaattttcgcgatcgggaccacttcatccacagctacccgtttattccctatcaattcgcactcttccagtcggcgattcagaatttgtcgcagcacagtgcgtttgaaggcaaacacagctcggtgggtgaacgctccatgctgggcgtatttcagcaagtcgccatccacatcggtgatcaccagataggtcagttagcgactttcgaccttatgttcgaaggcatccggtctgcactgaagtcacaaatacaacgcgcaatcatccaggccgaaaaccacctggacggcccgttcgcgattcgattgctgaaagctttgtttttggtgaaatacgtcaaagagttcaaaccaaccgttcgtaacctctgtgtgctcatgttggacgcattcgatcaggatctgccgacacttcggaagaaaatcgaagaggcactcagcctgctggaacagcaaacctacatacagcgcaacggcgaccagtacgagtacctgactgacgaagagaaagacgtcgaacaggaaatcaagaatgtggaagtcgagtcatccgacgttgcagatgagcttgagaagatcatcttcgactacgtcatcaagcagcgtaaaattcgctacgatgcaggaccttcccagaaccaagggcaggactatacctattcgcgcaagctggatgaccggctgcacgggcgcgaatacgaactgggtattaatatcgtgagcccatttcacgagcataccgacaacgagcaaatgctccgcaccgcttcaacctacaaagccgatgaactcttcgttctgatgccctctgatgagcgtttggtgcgtgatctgctaatgctcaaacgcacagaaaaatacatcaaacagaacatctcggtgacccaacaggagtctgttaaacggattctgaacgacaaaggcttccagaatcgtgaacgtgaagcccggataaaacagcaagttcagtctctcctcagcaagtccaagctcctgattggcggcgcggatgtagaggtgcccaacgaagaccctcaaacccgcattattcggggttttcatgagctgattgcccgcgcttaccccaacctccgcatgctgcgaggtgtttcctactcggaaaacgatataagcaactgcctgaagcgggcagaagacggtttgtttggtaatgatgcgaccgccctggcggagtccgaacaggaagtgctggcctttattcagagcaacaatcgtggcggtgttcgcaccaccttgaagggcctgctggaaaaatttgagcgcaagccatatggctggtactacgccgctattctctgcacgttggccaacctgtgtgcacgcggaaaggtagaggttcgtctcgacggtaacatcctggaagacgctgaactcgaacgcgcgttacgcaatacccacgggcacaacaacctggttctggaaccgcaaatagagtttacagcgtcccaggtgcgggccctcaaggcgttctacgaggactttttcgacggcccgccccgaagcggcgaagccaaagccttgggcaaggaaactggcgaagccttccaggacatgttccatcagcttaatccactggcagcccaggctggccagtacccgtttctcagtgccttaaagcctgctttggaaacattgaaggacgttgctggcaaaccttacacctggcacctgaccgaattaagtaagcaggaagaccagctgctggatctgaaagaggacgccatagaccccattcgaaaattcatgagcgggtcacagaaagacatctacaaccaggcgcggtcactgctacagagccaggaacccaatttcatttacgtgcccggagatgagatcgagcaaattcgctcgattctcaacgatcccaagtgctacaaaggcggccgcatccaacagctcaaggggcaactggacagcctgaaagagcgcattgatgaaaaggttaaccaaactcgttccagagcggccgcatccctgaacaccatgcaagaacgcatgcagagcatggatgaataccagttgctgccggagccccgtaaggcggaactgaacaagccgttccaggatctgagcgagcacatcgacgggcaacagatcatcgctgtcattaatgaccgcctacgcttttttgaagaagagggctatcagaaggtcttggccagaatggtggacctggccaatcaaaaatctgcacccccgacagacccaaagcaagctcctggcttaaagggtgccgacaagccacaccaggttaaggaaccgcccgccgagtacgttcattcgcgcaaccttcacgttgcctacgacaaagcctggctggccgatgaaaatgatgtagaccgctacctagcgtccctacgcgaaaccttgctgcaagaaattcagcaaggccgcaaggtgcaaatttag

SEQ ID NO: 439 - DNA, 3642 bp, Escherichia coli; identical to SEQ ID NO: 236

SEQ ID NO: 440 - DNA, 3642 bp, Salmonella enterica
atgaatattgaacagatctttgagaaacgtctggaccgaaatattaatggcgttgtgaaagccgaacagacggacgatgccagtgcctggattgagcttgatgaatacgtcatcacccgggagctggaaggacatctgcgccacttttttgaatcttatgttccggcaaccggtccggagcgcatacgcatggaaaacaaaatcggcgtatgggtgtcagggttctttggctcaggtaaatcgcactttatcaagatcctgtcgtatctgctgtctaaccgcaaagtcagccataacggtacagaacgtcatgcctacgccttctttgaagacaaaatcaaagatgctctgttcctcgctgatatcaacaaagcggtccatcatccgacggaagtcattctgttcaatattgattctcgcgctaacgtcgatgataaagaagacgccatccttaaagttttcctgaaggtgtttaacgaacgggttggctactgtgctgattttccacacattgcccatctggagcgtgaactggctaaacgcggtcaatacgaagcgtttaaaactgcattctctactattactgagtcaagctgggaaaaagagcgcgactcctactatttcatcagcgatgaaatggcagaagccctaagccaggccaccggtcaaagcgttgacgcctcgcgtcaatgggtggaacagctggataagaacttcccattagatatcaataatttttgccagtgggtcaaagaatggctggatgaaaatggcaaaaatatcctcttcatggtggatgaggtcggccagttcatcggtaaaaatacgcagatgatgttgaagctgcagactatcactgaaaacctgggtgtgatctgcggtggacgcgcatgggttattgttacctcccaggcagatatcaatgcggccattggtgggatgagcagccgtgacggacaagacttctctaaaattcagggccgtttctcgactcgcctgcagctttcaagctccaacacttcagaagttatccaaaaacgtctgttggtgaaaaccgatgccgcaaaacctgcgctggcgaaagtctggcaggaaaaaggcgacatcctacgtaaccagcttgcttttgatcccaccacaacggcttctttacgcacctacaccagtgaagaagaatttattgataactacccgtttgtcccatggcactaccagattctgcagaaggtctttgaatcgattcgtaccaaaggtgccgccggtaaacagttagccatgggtgaacgttcgcagttggaagccttccagactgcggctaagcaaatcgctccgcaaggtctggattctctggttcccttctggcgtttctatgcggcaattgagagcttcctggaaccggcagtgagtcgcaccattacccaggcctgccagaacggtatcctggacgagttcgatggtaacttgctgaaaacactgttcctgatccgctatgttgatttactgaaaagcacacccgagaacctggttaccctttctatcgacaaaattgatgccgataaagtcgagctgcgccgtcgtgttgaaaaaagcctgaatacgctcgaacgcttaatgttgatcgcacgcgttgaagataaatacgtattcctgaccaatgaagaaaaagagatcgagaatgagatccgcaacgtcgaggtcgacttctccgcgatcaataagaaactggcatcgatcatctttgacgacattctgaaaaaccggaagtatcgctatccggcgaataagcaggacttcgacatcagccgcttcctgaacgggcacccgttggacggcgcaatgcttaacgatctggtggtgaaaattcttacccccaaagatccgacctatgatttttatgacaacgatgctgcgtgtcgcccttacacctcagaaggcgatggctgcattttaattcgtttacctgctgacgcacgcacctggaccgatatcgatttagtcgttcagaccgagaaattcctcagggacaacgccggtcagcgcccggaacaggccagcctgctttcagaaaaagcccgcgagaacagcgttcgcgaaaaaatgctgcgcgtccagctagagtcgcttattgccgaagcagacgtctgggcgattggcgagcgtttaccgaagaaatcttcgacgccgtccagcatcgtggatgaagcctgccgctatgtgattgaaaacacgtttgccaagctaaaaatgctgaagccgttcaacggcgatatcgcacgtgaaatccatgcgctgcttacggtagagaatgatgcggagttggatctgggcgaacaggaggaatccaatcctgacgcaatgcgtgaggtggaaacctgggtcagcatgaacatcgagtacaataaaccggtctatttacgcgatattctcaaccactttgctcgtcgtccttatggatggcctgaagaagaagtgaagctgctggttgcccgtctggcgcgtaaaggcaaattcagcttcagccagcaaaataacaatatcgagcgtaagcaggtatgggagctgtttaacaacagccgtcgccacagcgagctgcgtctgcacaaaattcgtcgtcacgacgaatcacaaattcgcaaagccgcccaaaccatggcggagattgcccaacagccttttagcgaacgtgaagaacccgcactggtcgaacatatccgtcaggtcttcgacgactggaagcaagagctgaatgtcttcagagcgaaagcggaaggtggaaacaatccaggcaaaaatgagattgagtcaggtctgcgcctgctgaattccattcttagcgaaaaagaagagtttgctctgattgagaaggtcaccacccaggcaaacgaattgctggatttcagcgaagaccgcgaagatttggtcgatttctaccgcaagcagttctccacctggcaaaagctgggggctgcgctgaacggaagctttaaatccaaccgcagcgcacttgaaaaagatgccgtggcggtaaaagcgttaggtgagctggaaaacatctggcagatgccggagccttacaagcacctcaatcgcatcacgccgctgattgaacaggtgcagaacgtcaaccaccagttagtcgaacagcaccgtcagcacgccctggaacgcattgacgcccgcattgaggaaagccgtcaacgcctgcaggaagcacatgcagtatcggagctgcaaaacagcgttcttctgccaatgcaaaaagccagaaaacgcgccgaagtcagccagtcgattccggaaattttagcggaacagcaagagacgaaggcgctacaaacggatgcagagaagaagattaaccagtggatcgatgagctgcgtaaaaagcaggaagccctgctacgagcagcaaacgaagcaaaacgcgctgccgagtcagaacagacttatgctgtggtagaaaaacccgttatccaaccggtaccgaaaaaaacacatctggtgaatgtcgccagcgagatgcgcaaagccaccggtggtgaagtgctggaaaccgctgaacaggtggaaaaagcgctggatacactccgtactgcgctgctggcagccattgaggcaggtgacaggattcgtcttcagtaa

SEQ ID NO: 441 - DNA, 3726 bp, Lactobacillus casei
atgcaaatacgcgacttatttgttaaaccgattgatcgaaatatccaaggcgtcatcaaggttggccaggatgcagacgctaacgtgaagcaagaactggacgagtacgttgttacccgagaattgaaaggccactttgatgacttctttgcggcctatgagaaaagcatcaaccatgatactgatgaaatgggggtctggatctccggtttcttcggttctggtaaatcacactttctgaagatcctttcctatctgttggaggatcggaaagttgacggcaagagcgccattgattatttcaaagagaaaatcaatgaccagatgacgatcaaccgtattgagctggctgcgcaacagccaaccgacgtggtgctgttcaatattgattccaaagctaagactggtgccaagtcagatgacaatgccatcatcaatgttttcctgcaagtgtttaacgaaatgcagggcttttcgagcaccaatttttggattgctgaaatggagcgccaactagttgcgcagggtaagtacgacgcctttaaggacaagttcacggagttggataacactcacatggattggacggttggtcgggatcatgccattttcaagaaaggcacgatcaaagatgccctagtgcaagtcgatgcatacagtgaagaggatgcccagggcttgatggatcaattgacgacatcttatcaagtcagtattgaggacttctctaaactggtggccgcctatatcaagaagaccggtaagcgggtcgttttcctggtggatgaagtcggccagtttgttggagaaagtacccagcggatgcttaacctgcaaaccgtcgttgaggacttgggggcagctacccatggtaaggcttgggtagttgtttcttcccagcaggctattgatactattacggacaaaatcagcggtcaggacttttccaagattcaaggccggtttgcgaccaagatcagcatgagttcggccaacgtggacgaagtcattcgcaagcggctgttggcaaagacagagccggctacaacacaacttgcggcagactacgaggctaacgcagccgcaatcaataacatgattgattttgacgatggcgtggatcggcctaagttccgttcaggggaagattttgcggcgacgtatccgttcgttccgtatcagtttaacttgctgcaaaatgtgcttacagcggtccggacccacggctctgatggtaagcacttgtctgaaggtgcacggtcgatgctgtccctgttccaggaatctgtggaagctatcatggaccagcaggatacggcactggtgccattcagcttgttctttgaaggcctgcgccagttcttggaccacacccatagcatcgtgattgcccacgcggtggacaacgacaccgttgatcccacccatgaagaagataacttcaacgtccaagtactgaaagcactgttcatggtcaagtacttgaaagactttgacgcgacgctgaacaacatcgtgacgttgatgattgactcagtggatactgatcgggttgaattgcagaaaaaggtccagaatgcgttagccattctgcggcagcaacggtttgtcgagaaaaacttggataactacgaattcttgaccgatgcggaacaggaagtcaaccaggccatcagccgggaagaagtcttgccgggtgaaatggaagaccggatgggcaactttatttttgatccgaagaccggcatgaccaataagtacacttaccccaagctgaaaggccgttacaatttcacgttgaatcaatacgtggatgaaactccccaggggcggaccaacaatgacatgacgatccaagtcatcacgtctttggatggcgccaataatcggaatgaagccaacctgctgcttctgtccatggatccgtctaaacataagatcgtggttgatctgccgagcacggacgactatctcggcgacttgcggcgggcggagcagattgggaaatttgtcatgcttggcaacgcccatgccgacgctcggttcaactttatcaaggaacagcggactgctgaacggcagcaactgttagtcaaggcccgggagcggattatgacggctttggaacaagcagacgtttatgttgccggtcataagattgagggcggcaaagacttccaggggcgcttcacagatggtttgaagatgttggtggatgatacgtatcgcagtttaggactcattgatgcggccaagtcgtcgtcagatattacgcaaatcctggatcaggataatgagtcggcagtatccacgcaggaaaacgagcgcgcggtccaagcagtgtacagctggctccagcagacgatgcaaaaggacaagcatgttacgttgcaggccatcttgaacaacttcaaggcaattccctatggctatattgaggacgacatcgaatggctggtggccaagctgctggcggatggcaagattcaagctaatctacaggatcaagtactttctccggtcaatccggcgtacaggtctcaggatattgccaatttcctgaccaagaagcaatacgcagaacagatttcaattcaggtgaagaaagacatcaatccgcgttacctgcgggaaatgaaggacgtcgccgatcaggtcttcaataagcggtcattcagtgcagctcagccggatctgatggtggctgaattgaaggagaagattgccaaggacaatgggacgctgcagttctttgatcaaaagaatagttccttcccgggccatgaactgctcaaaaaaggcagcaaaatgttcagtgaattactggccattaatgatgcggaaactttctacgacaagatccatactcgttatgatgatttgctgcagtgggcggatgacatgagcgacaagggtatcatggatttctatttcagcgatcagcagcagacaatttggacgcggggattggatgatattgcgcggtacaaggcatcccatgacttcttcaccagcacggctttggccgaggactaccagcagctgaacaaactgctgaatgaggaccgagctggacgtgttatccaagaaattgatggtgttcatcggaagtttgtggatacctttgccaagattatggacgatcaccagaaacaagtgaccgacaaaatccaagcagtcaatgaaaaggccaaacagcggattaacgattcttccaccggagatgacttcaaacagcaacggctggcgacgttgacggagcagatcaagcgaattatgaccgaggctgaggaagcaccagatctgacgcgcttagaggccaaacccgcagcagctgatgcggtgttaaggcgcattacgcagagcttggaaaatgaggagcagcgactagcagaagaacagaagctggctgagaaagagcggctggaagaactcgctcggaagaaagcggccgaggtggagaaagtatccccgaagccgagttcagacgaggaatccattaagcttgtggatccgcttcctgctcctggccccaatccggcgcctcaaccagaacctgcagcgtctgttgttattcaaactaagtatcttgaagccgatcaactccccattgaacgggaatggtccatttcctctgaagatgacgtaaactggtatgttgagaagcttcggcaggcattgctggatcaagttaaagaaaaccagatcacgaagtttaccctctag

SEQ ID NO: 442 - DNA, 3672 bp, Enterococcus faecium
atgctaattaaagatatttttgcaaaaccaattgaccgaaatattcaaggagttattaaggtcggtcaagcaaaggatgaaaatgttcaacaagaattagaagaatacgtggttacgaaagaactacaaaaacactttaaaacaatttttgatgcctaccaacggagtatcaatacaccaacagataaaatgggtgtttggattcaggggttctttggttcaggtaaatctcatttcttaaaaattatttcttacttgctcgcaaatcgagaaataaatgacaagaaagccattgattacttcaaagaagatgggaaaatcaaagatccactgactttggcaacgatggaacggtgctcacaaataaatacagatgttattctgtttaatattgattcaaaaagtgatgcaggtggtaaaaaagacaaaaacggaatcgtgaatgtttttttaaaggtatttaacgaaatgcaaggattaagcacgattccacatctagcagattttgaacgtcggttaattaaagaagaaaagtttgatgcattcaaagctgcttttgaagagattaatggggcaaaatggcaagaagagcgccatgagtttgattggatccaagatgatatcaaagaagcggcacttaaaatcgattttatgagtgaagccgctattgataattttttagaaaaagcatcaggaaattatttaataagcattgatgactttgcaaatatagttaaaagctatcttgattccaaagaagcagaccatcatattgcctttctagtcgatgaggtcggacaatatatcggcggtaatcgtgagttgactttgcagttacaaaccgttgtggaagatttgggtcgaatttgtgaaggtaaggcttgggtattagtgacaagtcaggaagcgattgatcacgtaacaaactttgataacaattctgataatgatttttctaagatcaaggatcgttttgccacaactgtgagtttatcttcagcaaatgccgatgaagtaattaaagaacgtattttgaagaaaaaagagtttgccaatgattctttagccttacaatttgaaactgttcaaacagaattgaaaaataaattactctttgttgatagtcctgaattaaagctcttccaagatgctgaaaattacgcagaagtttatccatttattccctatcaattcaatttattggggcaaattctaaccgagattcgtaatcacagctatcaaggatcaaacttatcgtctggtgaacgttcattactagcaatgtttaaagaagccgctgaacgaaataaggaaaatgatacaaccagtttggtttctttagatcagttttattactcgttagaacgttggattgatacagcaattagccgagtgattacacaagctacaaataattctcatattcaaagaccaactgatatagataactttaacgtaaatgtcttacgaattttattcatgattaaatatgttgatcaagccatcaaaccaaatgttgaaaatattacgagcttgatgataagaaatatcaacgaagaccgcctggaaactaaaaaacgagtagaagaagcattggaccttttaattaaggaaaactttgtgcggaagaacttagatagttatattttccaaactgatgaagaacaggaaattactcgtgagattaaaaatcaaaatattacagatagtgatttgatcgtagaactatctaaacgaatttttgacggcgttctagaccgaaatagttttgcctatgaaaaattaggcatgtcaggtggaaataaatttaaaaaccggtatacgtttacttatgcacaagtgttagatcaacgtccatacaagcaagctggaaatgctgaaatgacagttaattttatttcaccatactctgatttagcaggtcaagaggcagaacttgcgcttaagagttcccgtaacttattattcgtagaattgccatcagataaagaatttaaagatgatatagcaatgtatgctagaatgaatctttatttaacaacgacttattcgagtgtagtaaagaactttgacgcgattcgttcggaaaaatctggtgaattacaggaactaagtgcaagtatcaacgatcaattaaatgaactgttgaaatctgcaaaatttttctataacggtgcagaaattcaactgacaggctccgactttaaagcaaaattccaatcagcacttcagaaaatggctgaagaagtataccataaattaaaccaaattgatgcgcctaaagaaaaagaagatatcttatatttagtgaaagaaagcaaaaatgaaattattgaagatccatcaaatgagcaagcagttcaggaaattttcaattttatcaatgatcaaaagagaaatcacctaacgattacgatgaaaacaattcgtgatcgttttgaaacaaaacaaccgtatggattcacagaacttgatgtggaatggtgcatcgctaaacttttcatgtctggtaaaattgatttactttataacaatgtacaaatttcacggatggatgatccaaatagtattgtaatgattattcaaaaacgacgagaaagtgaaaagataaaaattgaaccaagcgcggtgatttcgccaaaagcaaaaaaattggttgacgaaatcggtagagaactgtttcaaagtcgtaatattgttgatgaaaataacaatgaacatacaatggaaaatttcaagaaatatttaaaaggtcaattagacaatttacgctcttattttgatttacaaaacacttatacctaccctagtgcttatgaatatgagcaaataaaaaaatatcttgaagtaattgttcaaacgtcagatgttgaagactttttttatacaatcaaaaaatatcgcgatgaattattcgactgggctgaaacatatgataaaattaaaaatttccacaagcaaaatagtactcagaaaaaaatctgggagaatgcacaagataaaattagattaatcgaaaaaagtcggcgtcaaacttctagccaagaaattgatcaattgattcatgagatgaaaaccattttgaaaaaggctgatccttattcagatatgatgaaactaaatgagttgattcaagaatttattgaacaatataatcaactgttagagttggaaagtcaggaaatattaaataaattaacggaagaaaaacaagcaacatttaaattattagaaggaaaagattttaaggatcaatttgtaccaatagttgaccaagaatttcaagaactgaaagcaaaaattgaacaagcgaatactatagatgatcttgttttcttatcattaaacgtagcagaacagtatttgatctttaatcaacgtttcgataatgaagaaaaccgcagacgtcaagaagaacaagcacgtaaacaaattgaagcagcaaacttgattcgtgaaactgaaaaagatgaaatagactctgcagcaaaagctgaagaaatagcgatagtaaaacctactattcaacagaaaacagtaccaatgagaacacttaacgttcatgttaaaactattaagtcagcagcagatattgatgagttaacagctgaaattaatcaaaaactgaaggaacaacttcaagaaaatacagaaatcacgattcaattctag

SEQ ID NO: 443 - DNA, 3690 bp, Glaciecola lipolytica
atgacaatcataaatgacatactaacgttagatcttaaagaagatattaaaaacgttattgaccttgaagaccgttcagagacagaaattcaacacgaaatcgagtcatacatcgtaaccgaaggtattgggcggcacctctacgaatttacaaaccaattcacctctaatattaaagagacaggggtttggttatcaggtttttatggctctggtaagtcatatttcggaaagatgctgggttatataatagataaccagattataaatggtactcctgcacgtgagcgttttataccacgcttaaaaggtgtaagtgatgcaggtcttattgaaaacgccctacgtaatcttgacgcaattaacagccgcgtagtgttccttgatgttgctaagcaaaatactgaacgtggattggctttcaccttgtttgctaatctgcttaaaaatcttggttttcgtgatgatatttacggttatatggagtttgatctgctcctagatggtaaatacgacgagtttaaaactattgtccaaaaactagagtcgaaggattgggatgagctaaagaaaagtaatcggcatgtcgctagagttatgcgaaaggtctttgccgaaatggggtacagcgagtcagattatgaagataccaaaagcgtctacagtgcttcgatagaggatttttctgccagtaaatttaaaacggaactggaaaaatatcttaagtttaatgcagaagaaacactagtctttgttttcgatgaggcgagtgaagctattagccagaagaaatttacccttttagatttagaagggattagtgaatcgctatcgagtataagtaataaagtttggaccatagcgattgcccaagaaaagctcgacgacgtgattaacaatgctaacgtcagtcgcagtagtttgaccaaggttaccgatcgttttaaaaccaagattcaccttgagtctacagaagtagacgttatcattcgtagtcgattacttcaaaaaacagaacaggcaaaacaagatttagttgcttattaccaaaagaatgaaggcctaatcagcgacgccaccaacctaaaatcatcgttccctacgaaaacggaaacagctgaagattttgcggtctattatcctttccacaaatatcaattcgatattttgcaaaagttcttgtttagctcaaacgctttagttgctacccaaattgcagctcgaggcatgattatcacaacatttgacgtactacgtaagcaaatgcgtgacaaagagctgtatagctttacgccagggttcgcgatatgtgatgaagcccaaaccgcgccgccagttggattggtcaacaaatacgatacaagccgaaaaatattaaaggaaaatggcagcagcattgacggcgagaaactgctcaaaaccatgcatctattagccgactctgaagtagtcgcgccaacggttgaaaatataaccaaaagctatattactgacattacgtcttactatgaagtaaagccagcaattgaagacgcgcttaagctactgcttgaagctaaagtactactactatcaaacaacaactacaaaatcacatcagatcttgaaggcaaaatgctcgaagaaatgaaagattttgatgtcgaacttttcagcaagaagcgtgagttaattaagtatctgaaggactacaaaacctttaacgcagttgcatcctacaatgatggcagtgatgcattcaaatttagcgtgctgtcggaccaagacgatgagttagcacctgtaggaagcaaacacttaaagatcacagcctatagcttgttcaatatcagtgatgatcgtcaggattttattgaacaactgaagcttgatactcagtatcagaaagagcttattaccttggtgccagatacttcagagttctcccagattgataaattgataggcgaagttatgcgctacgcctacatggaggaaaaatactcgaatgaaaaagatgccgataagcgtcaaattattcgtgaatttgaagttatacgagaagagaagcaacgaactttaagagggctaattcaagacgcatatcacaatgcatccctgatctacatgttcgacgagcatctgctgaacgttgatacatttaagggaaccattgccgacaaccagcgaaaaatggttaaaaacatctacaccaagcgtttatcaagtcaactttctgatagcctggtctcgaagattttcagcacacataaagaaagcctgaataagttatttaccgctaatgattttgcattcttcgacggtcacggcaattttactggcgatcaccttaaaattgttgaagaaatcaacgctaagataaagtcgcgctatatggatggtaaatctctagaagctgacttgtcaggtgctccatggggctatagctacggaacattagtaacgactcttgcagtactattccgtgccggtcgactatcggttaagtttaacggcgacacctatttttctcatgagcaaaaagcggttcacgatgcctttacgaataccaccaagtttaaatctgcgtcgttcaaatcgattactgcaacgctaaccgctgtgcagaagaaccaggcagtacaactactgatggaactcgaaacacaggaccatatcggcaaaaaggtagattggaatacaaacgattttgacttggctgacagtattcgtttgatggctgaacactttatcagtgccattaccaacctgagtgatactgttcaaaattttgaagaactattccccaaagtggcaggtttaaaacaagacttgcaaggttttgcgggtaaagttaccgagagtaactatatcgaaaaggttgagtatctacttaataacagcgatacgttcagcaattcggttcaagccatattaaaagctcagaaattcattaaaaagaactttcctaaagttaaagaatttaagcgctttattgacgatgttcgaagcgagctgataaaagctgatcgcagtgacaataacattgatgaagcctatgaagaattcgagcgcttattcaaactggatatggtgaaaaactttgccaatctccagcaacaagtacaagttgtaaaagatgcttattacaagttagttaagacagcatctataggtatgagtcacgagtacaaggtcctgagcggtaaaattgaggctgcttttcgtgaacttaagaactaccccgcggcgccgaaccgattaaatcagcaaaagcttgatgccttaaaagcctacgcagaaaaacgagtagttggtgaaccagtacttgcgttcagcattagttgctcaaatagtggtttttctctctccgatattttgaattacacagctcaagcaccgctaaaagatagcgagctgcttattttacaaagtagttttatcacagaagaaccgcagcccgagcctgtacccacaccgcagcctacacctaatcgtggtcccgatggtggcgagcctgcaccagccccgactccagttcaatcaccagcaccgaaacaaccccgcaaagttgcttttaaagtttctagtaaggtgatgacagtgcaagagtataaaaccttgctgactacgcagctaacggcgcttgctgcggccaagcccgatgaagaaatcgaactaactatagatattaatagcgaaggactgtaa

SEQ ID NO: 444 - DNA, 3654 bp, Oribacterium sp.
atgcaaatcaaagatatgtttgccaagaagattgatcgtgagattcagggagtcatcattgttggtcagggggaagaaacgaatgtggcacaggagctggaagagtacgttgtcacaagagaattgcagaagcattttgctgatttcttctcctcatataaaaaaggaattaatggaaatacagctaagatgggtgtctggatttccggtttctttggaagtggtaaatctcatttcctaaagattttatcttaccttttggataacaagcaggtcggagataagagagcactggattattttattgatgataaaaagattattgatcctatggttcttgctgacatgaaacttgcggcagaaacacctgcagatgtcgtactttttaatatcgattccaagagtgaatccaatggaaagcagaacaaggatgctattgttaatgtattcctgaaagtgttcaatgagatgcagggattctgtggttccatgcctcacgttgctgacttggaaagaagactcgcagaagcgggaatatttgatgagttcaaagctgcttttgaagatgaatatggtgatccttgggaagagtctcgtcaggattttgactttattcaggacagtgtagttgacgcacttgtgtctatagacttcatgagtgaagtagttgcgagaaactggtgtgagaaggcaatggcgccttacacaatcagcattgaagattttgcaaagagagtaaaagcttacatcgacagacagggaaagaatcgtcatgttgttttccttgtagatgagattggccagtatattggtgatgattcaaagttgatgctgaacctgcagacggtgacagaagaacttggaaaagaatgtatgggtaaagcttgggtgattgttacatcccagcaggatattgactccatcacaaaagtaaagggaaatgacttctctaagattcagggacgttttgatacacgtctttctttgtcatctgcaaacgtagatgcagttatcaaaaagagaattttggataagacagaaaccgcagctcaggctcttcgtcttctttatgaacagaaggctactattattaaaaatttgattgtatttaatgatggcgtagagaagaagttgtatgcaaacgaaaatgattttgcagaagtgtatccatttgttccataccagtttaacttactagcgagtgttctgacatcgattcgtacgcatggagcatccggtaagcatctatcggaaggtgaacgttccatgctagctcttttcaaagagtctgcagcaaagctaaagaattgtgagatgggagtgattgtaccgttccatcgtttctatgatgctttggagaactttctggatcacagccacaagggtgttatcagtaaggcgtatgagaatagctatattaatccggataataaggaagaagatgtatttgctatcaatgttttaaagaccttgttcatgatcaagtatgttcttgagattgaatccaatatcgataacatcaccagtctgatgattgaaaatattgaagatgaccgtatcgaactgaaggatagagtagaagaagctcttaaggttttgatgcgccagatgttggtacagaagaacggcaatctctatgtcttcctgacagatgaggaacaggagatcaataatgaaattgaaaaagaaaacgtggagatgccggaggttattacaaagattgctgagatgatctttgaggatatctttaccgataagaagtatcgttaccctgcattcaatggcagatattccttttccttcaatcaggtggtcgatgaccgtccttacaaatcaaatcagaactttgatatcggacttcgtatcctgacaccttggtatgacggtggaatggatgatgctacacttcgaatgatgtcgggtcagggaaaggaagtattgcttgtccttccgaatgatgacgagttcctgacagagatgcgtgtgtacttaaaaatcgaacgtttccttcgtaagaatacttccacacagcttgcaaaatatgaaactattaaggaagcaaagcgtgtggagatgagagagcgcaatgccaatgcaaagctttatcttacagagggacttaaggaagcaaccatctatgtaaatggtgatgtcgcccgcgttgctgcaaaggatgtcacatccagaatcaatgaagctatcggacgtttggttcagacggtttatcataaactgtcttatatcgatactgccatgggtgaagcagaaatcagaaagatgatgctcacaaccaatcagctttcgctacagttagaaggtggcacagaagcaaatgcacatgcgttggatgatgtgcagggttatattgcgatgaattcgcataaccatatgaagacctcgatgaagtcggttaaggaccgattcatgaaggctccatacggtttcgtggaagatgacatagactggcttgttgcacgtctctttaagagaggagatcttgcatttacagttaatggtgcgtctgtaaatctaaacaataagtctgaagaagaaattataggatatatcacaaagaaagcctttgttgaaaagcttctcatggaagaacgcgttcgtgtcagtgagaaggataagaaagctgttcgtgatgttatgaaagaagtattccataccactgtatcggcagaggatgaagataccatcatgaagactttccagagatatgcatccaacatggtaaatgagatggataagctggaagtctattataagcaatacgattatccgggaaagaaggtcttggatagcggaaaacgattgatgcagtctgtggttcagatcactagtgccctggagttttttagttatgtgtcaaagatgcgagaatccttccttgatctggcagaggattatgagccagtaaaagcattcttcaatggagaacagcagacaatttttatgcgcgctctggatatgcttgccatttatgatgacagcaaaacttatatcgtggatgcggatatagaagcagttgttgcgaagatgcgtgggattgtaaaacaagataagccttataagaatattcctcagcttccggaacttcgtgagcagttcatgaacgcttatacaaaggtactggaagctgaagaagcaccggtactggattctatagatcagtccagacagcgtgtgttggaagttttgaatacaaaggaatatgcagatcagaagaaggaacactatcaaaatcagttcgttgagattcgccagggtgcagagcactgcaacaatgtatcgtctctcagaagctttgcagataaagctgaagcattgaagattcgtctcatgaatgagatggacttgttggatcgccaaattgctgaaagaaaacaggcagaggagattcgtagaatcgaagaagaggcgaaaaagcagggcgctgatgtgacagatacggaagtggctcacaaggtcgctgaacagaaagcgcagtttaaggtacacaagacaaagaatgtttctattaagaagatgacaggtacttcttcttggagactggaaaatacacaggatgtagatagatacattgaagaactgagaaagactctcgtagctcaacttgatgaggatacgattgttaatattgagttctaa

SEQ ID NO: 445 - DNA, 3456 bp, Vibrio cholerae; identical to SEQ ID NO: 239

SEQ ID NO: 446 - DNA, 3642 bp, Escherichia coli; identical to SEQ ID NO: 56

SEQ ID NO: 447 - DNA, 3642 bp, Escherichia coli; identical to SEQ ID NO: 288

SEQ ID NO: 448 - DNA, 3690 bp, Vibrio cholerae
atgacaatcataaatcaaatactaacgttagatctcaaagaagacattaaaaacgttattgaccttgaagaccgttcagagacagaaattcaacacgaaatcgagtcatacatcgttaccgaaggtattggtcgacacctctatgaatttacaaaccaattcacctcaaatattaaagagactggtgtctggctatcaggtttttatggttctggtaagtcatatttcgggaagatgctgggttatataatagataaccagattataaatggcacccctgcacgtgagcgttttataccgcgtttaaaaggtgtaagtgatgcaggtcttattgaaaacgccctacgtaatcttgatgcaattaacagccgcgtagtgttccttgatgttgctaagcaaaatactgaacgtggattggctttcaccttgtttgctaatctgcttaaaaatcttggttttcgtgatgatatttacggttatatggagtttgatctgctcctagatggtaaatacgacgagtttaaatccattgtccaaaaactagagtcgaaggattgggatgagctaaagaaaagtaatcggcatgtcgctagagttatgcgaaaggtctttgccgaaatggggtacagcgagtcagattatgaagataccaaaagcgtctacagtgcttcgatagaggatttttctgccagtaaatttaagacggaactggaaaaataccttaagtttaattcagaagaaacactagtctttgttttcgacgaggcgagtgaggctattagccaaaagaaatttacgcttttagatttagaagggattagtgaatcactatcgagtataagtaataaagtttggaccatagcgattgcacaagaaaagctcgacgacgtgattaacaatgctaacgttagtcgcagtagtttgaccaaggttaccgatcgttttaaaaccaagattcaccttgagtctacagaagtagacgtcatcattcgtagtcgattacttcaaaaaacagaacaggcaaaacaagatttagttgcttattaccaaaagaatgaaggcctaatcagcgacgccaccaacctgaaatcatcgttccctacgaaaacggaaacagctgaagattttgcggtgtattatcctttccacaaatatcaattcgatattttgcaaaagttcttgtttagctcaaacgctttagttgctacccaaattgcagctcgaggcatgattatcacaacatttgacgtactacgtaagcaaatgcgtgacaaagagctgtatagctttacgccagggttcgcgatatgtgatgaagcccaaaccgcaccgccagttggattggtcaacaaatacgatactagccgcaaaatattaaaagaaaatggcagcagcattgacggcgagaaactgctcaaaaccatgcatctattagccgactctgaagtagtcgcgcctacggttgaaaatataaccaaaagctacattacggacatcacgtcgtactatgaagtaaaaccagcaattgaagacgcgcttaagctactgcttgaagcaaaagtactactactatcaaacaacaactacaaaatcacatcagatcttgaaggcaaaatgctcgaagaaatgaaagattttgatgtcgaacttttcagcaagaagcgtgagttaattaagtatctgaaggacgacaaaacctttaacgcagttgcatcctacaatgatggcagtgatgcattcaaatttagcgtgctgtcggaccaagacgatgagttagcacctgtaggaagcaaacacttaaagatcacagcctatagcttgttcaatatcagtgatgatcgtcaggattttattgaacaactgaagcttgatactcagtatcagaaagagcttattaccttggtgccagatacttcagaattctctcagattgataaattgataggcgaagttatgcgctacgcctacatggaggaaaaatactcgaatgaaaaagatgccgataagcgtcaaattattcgtgaatttgaagttatacgagaagagaagcaacgaacattaagagggctaattcaagacgcatatcacaatgcatccctgatctacatgttcgacgagcatctgttgaacgttgatacatttaagggaaccattgccgacaaccagcgaaaaatggtgaaaaacatctataccaagcgtttatcaagtcaactttctgatagcctggtctcgaagattttcagtacacaaaaagaaagcctgaataagttatttaccgctaatgattttgcattcttcgacggtcacggcaattttactggcgatcaccttaaaattgttgaagagatcaacgctaagataaagtcgcgctatatggacgggaaatccttagaagctgacttgtcaggtgctccatggggctatagctacggaacattagtaacgactcttgcagtactattccgtgccggtcgactgtcggttaagtttaacggcgacacctatttttctcatgagcaaaaagccgttcacgatgcctttacgaataccaccaagtttaaatctgcatcgttcaaatcgattactgcaacgctaaccgctgtacagaagaaccaggcagtaaaactactgatggaactcgaaacacaggatcatatcggcaaaaaggtagattggaatacaaacgattttgacttggctgacagtattcgtttgatggctgaacattttatcagtgccattaccaacctgagtgatactgttcaaaatttcgacgaactatttcccaaagtggcaggtttaaaacaagacttgcaaggttttgcgggtaaagttaccgagagtaactatattgaaaaggtagagtatctacttaataacagcgatacgttcagcgatgcggttcaagccatcttaaaagctcagaaattcattaaaaagaactttcctaaagttaaagaatttaagcgctttattgacgatgttcgaagcgagctgataaaagctgatcgcagtgacaataacattgatgaagcctatgaagaattcgagcgcttattcaaactggatatggtgaaaaactttgccaatctccagcaacaagtacaagttgtaaaagatgcttattacaagttagttaagacagcatctataggtatgagtcacgagtacaaggtcctgagcggtaaaattgaggctgcttgtcgtgaacttaagaactaccccacggcgccgaaccgattaaatcagcaaaagcttgatgccttaaaagcctacgcagaaaaacgagtagttggtgaaccagtacttgcgttcagcattagttgttcaaatagtggtttttctctctccgatattttgaattacacagctcaagcaccgctaaaagatagcgagctgcttatcgtgcaaagtagttttatcacagaagagccgcagcccgagccggtacccacaccgcagcctacacctaatcgtggtcccgatggtggcgagcctgcaccggaccagactccagttccaacaccagcaccgaaacaaccccgcaaagttgcgtttaaagtttctagtaaggtgatgacagttcaagagtataaaaccctgctgactactcagctaacggcgcttgctgcggccaagcccgatgaagaaatcgaactaactatagatattaatagcgaaggactgtaa

SEQ ID NO: 449 - DNA, 3543 bp, Methanoplanus limicola
atggatacaaaaatagaggatttattctataacgatattaaaagggagattaacggagtaatcaaggttgatcaggatgatgaagagaatgtatatactgaacttaatgagtatgttgtaacaaaggagtcactaaaacatattgacaccttttttgatagatttttaaagtcagtcacaactccgactgacaaaatcgggacatggatctccggagattttggttcaggaaaatcccattttctgaagacattatcttacctgcttgaaaataagacagtccgaggtaaaagcgcacctgaattctttgaagataaaatttctgacccggagatactgaatacaattgataaagctgtaaattccggaacaaaagatgtaatattattcaatattgattcaaaatccggggagacctctgagagaattgttgacattatgatgagagtcttcaatgaaaagaggggttatttcggagatgtattctggattgcggaacttgaggaagatctcgacaaaaaaggcctttttggtaactttaaagaggaaattctgaaaattaacgggaattgctgggaagagatacggaaaagttacgcctttgaacaggacgatattattgaggcactcacaaactgcggttttcagagcagggaagcctgtgagagaatgtttgaatctgacgggcagaattacaggattactccggaatcttttgcaaaggatattgagagatactgtaaatcaaaaggaagagatcataagataatatttctcattgatgaaatcgggcagtatatcggagatgacagccagcttatgctcaatcttcagtccgttgctgaggaattcggaacaatattaaaagggcgtgcctggataattgtcacatcccaggtaaatattgaagccactattaaaagagtaaaggataatgacaaaaagcaggacttttcaaaaattcaggcccgttttgatacccggctcagcctgtccagtgcaaatgtcgatgaagtgattaagaagaggattctgaagaagaaggccggagatgaggagatgctctccctgtattatgaagagaagaagataatcctgaaaaacctgatctccttctcgcagggcagtgctgagatgaaaaattacaggcaggcagaagacttcatttcagtgtacccgtttgtcccctaccagttcagcgtcctgcagaaggtatttgaaaagatacgcaccaccggttttaccggcaagcatcttgcaaagggcgagcgctcaatgctcaacgcatacaaagaatcggctgagaaatacggcagcaattctgtcggaacgctgattcctttttattcattctatgataccatagagagttttcttgatccgattattataaaaacggtcaggcaggcggatgagaacgataatcttgaggagtttgactgccggataatcaagaccctctttatgatccggcatgttaaggaattgcagccgaatctggacaatatagtggtgctctcactcacagatattgatgaggataaattagagctgagggagaaggttgcgcagtccctcaaccggcttgaaagagagaccctgataagcaaatccggggatactttccattttctgacaaatgaagagcaggagataagccgtgagataaaggatgtgcatattgaggaacgcaagattaccaatgagatttatgaagagattttcagttccggaaatatatgcccaaaagccattggcgattataaattcagcaggactgtggacgatattgtcaaaaatatttccggggctgatctgactgttaaattcttaactccgctctctgatgaaatttcaaggggcagcggacagcatacgcttgacggttcaaatttaagcaatattgattcaaaggatactctgctctttgtttttccggaagatagcagatttatatcacatattgaaagttaccttcagattcagaaatacttaaagcagagcagctccaccagggatgacgaacagattcaggagattctctttgcaaagaggcgcgaggcagagagacttaaagagctgtctcttaccgggatatctgacggtgtgagagagtcacgaatctttattgacggcagggaagtaaccaccattgaatccaaaaatcctaaggagatgattaaagagggttatgagaagcttgttgagaatgtgtacagcaagtcggattatgtcacacggaattttgagtctgagaacgaaatcctcagtcttctccggtctgatgaccttgagcggtacggtgcagggaggtcagatacaaataaacttgcccttgaagaggtgctgaattatattgccgtaaagtatgagaagaaaaattctgtccttctgagtgagttgaaggaatatttcatgaaaaagccgtacggctggagcagtatgactgtctccggacttcttgcagtgcttttcatgagtgaggatatcaaactgaggcatcagaagagatatctcgcatccgatactgcggagatgacaaaatatcttgcaagaaaagagtactctgacaaagtgattctggaaatccggaagaagaccggagctgagactgtcagcaatgttaaatctgttctgatggatgtctttgataaagctgtggtttcggataaggaaaatgatctctttgaatccgcaaaggagatctttgatgagcagagggggctgttgtcacagataatggggaaatattctgtggaagagagatatccgggcagaaaggcgattgaggattataacaatctgttatcttcactttccggggtgtctgatccgcagacctttctgcgaaaagtttctgatgagatgggtgagattgaggagctgcatagcagagcagggcctgtcatccggttttttgaggggaagcagtcagaaatattcgggagaattcttgggaagtatgaaaattaccggaggaatgagcagtttctggatgaggatgccagaagaagcctctcagagacggagaggatattatctctcgatgagccttatccggagataaagaggctttcaggtcttgaggcccggattgaatcatcgcttgctgaatcggttgagaatctgaaagaggaattcagggaagagcttgaatcctataagagtaagctgaacggggagtttacatatgaggattatccggaccgcggcagtaatccggtaaatgatgccttctcttattcacagaataaggttgagggatcagatgactgctctctgattaagcttgaaaccggaaggcttgcagaactgtataaaaaggctttcagggagactgaggagaagaggaagagtctgaaatctgtgcaggaggatttcacatatgagtctgagaagagagatgttgagatcattaataagacttcagttttcaggactgagaagataattgagactgagggtgaccttgaagattatctctctgctgtccggagtaagttaaaggaaattctgaagaagaacagcattcaggtgatctga

SEQ ID NO: 450 - DNA, 3468 bp, Methanoplanus limicola
atggtaacaataaaaaatagtgaagtatttttcaaagatccaacaacatatacaatacctaatgatggtgtcgcaaaggtagcaccattaagcaaaagtgataaaaacgactggattgtagccagatatgaacttgaaaattttgtctgtaagggttcatatcatgaagggcttagaagaattctccagtcataccttgaccatctggataaggcaagtcagcctgcggtctgggtaagcggcttttttggctgcggtaaatcacatcttgtcaggattctggactttttatggagaaatatcgaattttcggacgggactaaaggaagagacctctgtaacctccctgatgatgtgaaggtgctgttaaaagagttatcaaccgagaccaaaaggagtggaggaatatggtctgcggcaggtacaatgagtgccggaggcggagacgggccaagaacagatcttcttcagctcgttcttcgttcagcagggcttcctgagaatattgaagttgcaagagttcatctgtggcttgaagaatgcgggattcttgatgatgtccgtgaatatctgatctcaatagataaggaaaaggacctgctccatccttttgtttctccaaagtttattgaggctgttattaagtttcatccggattattccggagatgaagatccaaaggatgttaaaaacgatttaagacgggaattcaggacaagttcagggatttccaatacagagatggtttccatgcttaatcagatcttcctgatgcagtctgagaataaggataaactgcctcttgtgctgattatccttgatgaggtccagcagtatctgactattggtgatggttcggataaactgcttgattttcaggaagctgttgaagagtgctgcagaaggtttagcgggaaagtcctgtttattgcgacaggacaggaggcccttcaggcaaatacccagcttcagagacttcagggcaggttttctgaaaaggttattttagagtcaaaggatgtggatactgtccttagagagactgtattactaaagaaagaatccatgaaaccggaactgagatcagttctggacagggttaacggtgagatttcaaggcacatctccaactcaaagctggcacacagacaggaggatgacaggttcattctctctgattatcctcttcttccgacaaggaagcgtttctgggagagggttttggcatccgttgatccggacgggatgggtaatcagctcaggaatcagctcaggcttgtctttgacggactaaaggactatgccggctgtgatattggacattttattcctgcggattacatttatactcagaataagcggtatctgaggcagaattatattcttactcagaatgtcgatgacctcatcagcagagaaaatgacggaacagaaaaaggtgaactccgctcacgtatctgtgccacgatatttctgatacagcatatagacccttcgtatgggattaaggctgaacctgagactatctgcgatcttatggtaagcgatcttgtttccggtagtgaatctctcaggcagtctgtgcctttacttcttgaggatatgcatacaaggggagtgcttgcacatatagatacggagtatcgtattcagacagaagaaggtggtgtctgggaaggagattatcagaaaagaagagcgaaatttaagggtgatgatacaaggattattgatgaaagggtgaagttcatcaaaaacagaatgtcgggtattttaggcagtgtgaatcttattcagggtgaaagccggactccccgtaatgtcagtgttacatactttggagacgaaaggccaagaaccggtaaggaaattcccgtctgggtacggaacggatgggacatcccggaaaaggatgttattaatgagtgtgctgctgaggggaatgagagttctattgttacggtatttattccgcttgagtttaatgatgaactgaagaatgagattgctggttatcttgcagcagaccgtgttattgacagaaaagggacgccaaacactcaggacggtattcaggctaaacagaatattgagaccaaacgtgaaaggcataaggcaagagctgagagaattgttgatgatattttaagggatgcaaaggttattcttggcggcggaactgttgtacccggtgattctgtttctgaatgcattaaggatgcttcaaaccgggcaatggtccggatgtatccaaaattcgacgatggggacgctgccggatgggataaagtaataagagcggtagctaagggggaacagtccccgctctcaaagattggttttagcagagatccaaaggagcacccggtctgccgggagattttaaagaggctgaatagtgagaagaaaggcagtgaacttcttaaggccctgggtgaacctccgtttggatggcctaaagatgcaataaatgccgggctgattgtgcttgttgcttctgaatatgtcaatgttaagttaaataacagacccgcaggagcggtggacttaaacgccagaaatattggcaatgcatcttttgaagttgaggatgtggtcctttccactaatgagaaatttggtgcaaggaagatgtatgctgaacttggcctctccgggaagagcgggaaagagactgaggaggcaggtctgtttctggaaaagctgaatgctcttgcaaaaagtacaggcggggatgcacctcttccttatgctgcagaacctccttatctctctgaacttgccggatattcggggaacagtcttgttaaagagctgaatgaacgaagagagattattctttctgatattaagttatggaaggcgactgctgaactgatagattccaggagtaaggagtgggctactttttcaaggcttcttgatcactctgaaggtctgcctgattatgacctgtttgatggtgaagcaaagagtgttattgccgggagatcactgctcagtgatcctgatccggttgaacctctgctgtctgatctgagaaacagtatcagggattattatactgccggtgctggcagtgtcaataaagcaaggaaggaagtaacggactcacttgagtcagacagttactgccgggaacttgcagatgataaaagagagagtctgttaaaggaatacgggcttgatgatgagtttactgtcactgtcgggagtgatgaggagatatttactcagctgagaaaaattccggtaaacagccttaagtccagggctgaacttacgaggtcttatcttcccaagattaaggagaggattgccagaatgcttgagccggagacggttgttatttcacttaaatctccggttacgattaaatcttctgaggaacttgaggattatcttctttctgttaaagaagaggcagagaaggctttgaatgacggaaatccggtgatgctgagatga

SEQ ID NO: 451 - DNA, 3456 bp, Vibrio cholerae; identical to SEQ ID NO: 239

SEQ ID NO: 452 - DNA, 3642 bp, Escherichia coli; identical to SEQ ID NO: 56

SEQ ID NO: 453 - DNA, 3690 bp, Vibrio cholerae; identical to SEQ ID NO: 123

SEQ ID NO: 454 - DNA, 3456 bp, Vibrio cholerae; identical to SEQ ID NO: 239

SEQ ID NO: 455 - DNA, 3579 bp, Bacillus cereus
atgcaaattcaaaaaatgtttgaaaaagagattaaccgtgatattaagggtgttattaaagttggacaagatgatgataaaaatatttatcaagaattagatgagtatgtcgtaaccaatgagttgttacatcatatgggtgaattctttaaatcatataaaaaaggtattacggggcatacggataaaatgggagtttggatttcaggtttcttcggatctggtaaatcacacttcttaaaaatcctttcttatttattagagaataaacatgtaatggatgaaaatgaaatcaataaagatgccatttcgttttttaataataaaatattagatccgatggtcctcgcagatatgaaactggccggaaatacaacaacagatgtaattctttttaatattgattctaaaagcgaatcggattcaaagtcggataaaaatgcaattgtaaaagtgtttaataaagtatttaatgaaatgcaaggattttgtggctcgatcccttggatagctgatttagaacgtcaaatggtgaaagatgggcgttatgaggaatttaaggcggaatttgaaaagatttcgggtaatacatgggaagaagctcgagaagatttttattatgaagaagattcgattatagaagcgttgtcaaaaacaacgaaaatgagtgaagatgcagcacgtaattggtatgaacgtgcagaagaggattatttcattagtatcgatcgttttgctaaacgtgtgcgtgaatatgtagaagcgaaaggaaataaccatcatgttgttttccttatagatgaattaggacaatatatcggtaatgattcacaactaatgttgaatctgcaaacagtagtagaagatatcggaacgcagtgcggaggaaaagtatgggtattggtaacaagtcagcaagatattgactctgttgttaaagttaacggaaacgacttttcgaaaattcaaggtcgttttgatacaagattaagcctgtctagtgctcacgtagatgaagtaattaaaaaacgtattttattaaaaaacgaagttggtaaacaaactttacgactcctttatggtgataacagttccatcttaaagaatttaattacattctctggtgatacagcagaaatgaaaatatttaataatgaggaagatttcgtagatgtttatccgtttattccataccaatttaatttactacaaaaagtatttacaggtattcgaattcatggggcatcaggaaagcatttagcagaaggggagcgctctttattgagtgcattccaagaatcagcaatgaaatatgctgaaagtgagactggagctcttatcccattttcggcgttctatcaaacaattgaagcatttttagattcgagtattcgtactgtaatcatccatgctcaaaacaattcacgcttaaatgcatacgatgtagaagtattgaaattactattcttaattaaatatgtaaaagaactacctgcaaacctagaaaatttagcaacgttaatgattcaaaacataagtgacgataaaattgagctgaagaagaaaattgaaagttcattaattcgattaagtaaagaaacattaattcaaaaaaatggacaagagtatattttcttaacaaatgatgaacaagatgttaaccgtgaaattaaaaatatgcatgttgactcagcggaagttatccaaaaaattggtgatgtcatttttaatgtagtctatcaagataaaaaatatcgttattctcctaaatatcattttagttttaatacaattattgacgatcgtccgattggtatgcagacgaatgatattggcttgaagatcatcacgccatatttcgatgcaacgactgaattaaatgactctgaattgaaaatgatgtctatgcgtgagagtaatgtaatattaaaattacctcaagacacttcttatttagatgaaatgacagagatattaagaatacaagcatacttgaaaatcaaaagtggcacagcagcttcccaagcgatcgaagatattaaagtgcgtaaatcaagagaagcgaatgaacgaaaagatcgcgttcatatttatataacagaagcattaaaacatgcccaaatctttgttaattcgcagcaattagatgtgaaagagaaaaatcctgttgagagaattaatgatgcttttaaagtattgattgataatttatataataagctgcattatgtgaagaaatttattgatacagcgaagcaattaaatgaattgttagttgaaaatacaacgcagttaacgctgtcggacgataatgaagatgctaatcagttagcggttaaagaggtaaatgactatatcactcgtttaacaacccgcaaccaacagattacgattaagggcatcacaacccattttacaaaacaaccatatgggtggaaagatcttgatattgcttcatttattattaaattgtttaaagggcaagaaattaaattacaattgaatagtagtaatttaacaacaagtgagcgcgatttagtaaattacataacgaagcgtgattatgtagaacgtgtcgttgtgaaaaagagggaacgtatttcacccgcactaatgaaagttgttaaagatctttcaaaagaagtgtttgaagttactgctttaccagatgatgaagatggattaatgaatcgatttaaagaattactagtatctgagaaaaataaaattaatgtactgctagttcaatatcgtaatactttttatccaggacaagatgtattgcaagatggtaaagaatcgattgaacagctactaaacatttcagatacgacaagtttctataataaagtaaaacaattacaaaatgacttcttggactatgcagaagatgtggagcctgtaaaagctttctttgaaacacagcgagatatttatgacgatgcagtgaaacgattaaacatctttgagaagaatcaaacatatgtaactgaccaaaaggtaactggtttcattgagagtatctcgaagattgtgaaacataaagaaccgtataaaaatattcatcaattgccagggcttattaaagagtttgatgaactatttgtagaattgttagaaaaagaatgtgaaccagttaagaatgtaattgaatctgattatcaaactgttttagaagaacttaataagcatgaagagattaaaagtatgttctttaacaaatttaaaaatagttttgatggtataaaggatagattgaaccgtgtaaacaatttctatgaagcaattgcaatgcaaacagaaagtgatcgattgaaagtaagatgtattgatgacattgcaaatgaagttgaaagacgtaaaccacctgtcacatcaccatgtacaggaactacctgtactactgttattgatccgatcgttgaatataaagctaaaaagaaaacaattagtaaaaatacaatacttcgcggaacgaaaacaattgaaaatgaagaagatattgaagcagtactagatgaaattcgaaaacaattacaaaaagaattagaagacgcttcagttatcaaattagtgtaa

SEQ ID NO: 456 - DNA, 3456 bp, Vibrio cholerae; identical to SEQ ID NO: 239

SEQ ID NO: 457 - DNA, 3744 bp, Salmonella enterica
atgatagagacggaatttttaatgcagataagagagctgtttaccaaacaactggatcgcccaatcaatggtgtggtgaaagccgagcagctggatgagcaaatcatctggactgagcttgacgagtatgtggtgacccgtgaacttgaccgccaccttcgtcacttttttgagacctacctgcctggtgtcagccatccagatgatcctagtgtggcgggtaaaattgggatttgggtatcgggttatttcggttccggtaaatctcactttataaagatcctctcttacctgctcggtaacaagaaagctgttaacaatggccaaacaaaagctgccatcgagtttttcaaagagaaaatcagcgatccccttctttacggtgatatccacgctgcagttaaccgcaatactgaagtaattctctttaatatcgacagccgcgcagatactgaaaacaaagaagatgccattctcaaagttttcttgcgcgtcttcaatgagcgcctgggatattgcgctgaccatcctcatatcgcacacctggagcgtgagttagattcccgtggccaatacgagccattcaaagcaaaatttgctgaactcacgggctcaagctgggaagaacagcgtgatgcctatggtttctgtcgtgatgaaatggcaaaagcctgggcctatgctaccggccagtcagatgcctcatcggtgcagagtatggaaaatctcgaatccatgtttactctcgacattgccaacttctgtaaatgggtgcgggagtatctcgatcgtagcgatccatctggcgacagtaaacgcatggtctttctggtagatgaggtcggacagtttatcggcaacaacacccagatgatgctcaaactgcagacgataacagaaaatatcggtaccgcttgtggaggcagagcttgggtaatcgtcacttcacaagaagatatcgatgccgtactaggagctaaaaaaggccaagacttctatcttagcgctaaaaaaggccaagacttctccaagatccaagggcgttttcacacaaggatttccctctcctcgtccaataccaatgaggtaatacagaaacgtctgctcgaaaaaagtgaagacgctaaaaactgcctggcagaattgttcagtcaaaaaggcgacattcttcgcaaccagttgacctttgataccagcactacagctgagcttgctaactacagtgataatgttgagtttgttgatcactacccttttattccctatcagtatctgctggtacaaaaggtcttcgaagcaatccgcaaagtgggggctaccggtaaacatctctcccgtggtgaacgttctctgctggatgcattccagaatgccgcacgccagcagatgaacaaagatatcggtgtattggtgcctttccatgccttttatccggcaatcgaatctttcctcgataccaacgttaaacgcatcttcgaacaagcggctgagaaagcaagcctcgatccttacgacattaatattcttaaatcgctgtttttgatccgctatgtcgatctggtcaaatccaccattgataatctggtcacactctctattgaagaaatagataccgataaagtggcactgaaaagccgaatcgaagccagtctacagcgtcttgaaaaccagctattgattgtcagaaatggcgatgaatacgtattcctgactaacgaagaaaaagaagtcgagcaggagatcaaacacactcaggttgaagcaactgaagagaaccggcaactggcccggttggtgtttgaagaggtaatgggcaatcgccgtcagtatcgctatccggtaaacaagcaggattaccctctgactcgcttttgtaacggccactctatagacggcagccaacaaacagatctggtgctcaaagtcatttccccactggatgccaattttaatagttataacgaacaatcctacaaggcactgagccaagaagggaatggttgtattctggtacgcctgtcgagtgagaagcggatctgggctgaatttgatacgtggttgaaaaccgagaaattcctagcagggatacgaggtaaacgacctgagcaagagaaattgctggcagaaaaagcactcgaaaacacccagcgtcgcagccgtctgaaattactattcgatgatctggtgaaacaagcacagatattcgcactcggtaatgagctgcaaagtaaatcggctagtgtcagcaatatgcttgatgaagcttgtgcctacgtaatcgaaaactcattccaaaagctctctttactacaaagctgtggtaacaacccggtgcaagagctgaagtcggtgatcatggccgatgacatggcacagctaaatgtaaatctcggtgaacaagaccccaatgctgctgcaaaaaaggagattgaactctttttaaatgtcgcagatgaaaaaaatcagccggtctaccttaaagaattgttagagcgattcagtgctcgtcccttcggctggaaccgtgacgaagtaatgctacaggtgactcatctggtcttgcttggtaaggctgcgttatctacaccgaatggtgatttgcccctcaaacgcagttacgaacattttacctcggtacgtagccacagcacactgcgtattcgtcgagtacgtcagcatacagaacagcaagtagctaaagcggctaaactggcgaaagatatttttaataaacccttcgaaagcagcgaaaaagagctggcgaataagcttcttgacgtactaggcgagtggcaacggttaattaaagaatttgattttaaagctaaagatgggaattgccctggcaaaagcaccctgcttaccggcagtcgattgatcgccagcctgcttgagctgggcaacaacagttatgccctaatcgatggattctgccagcagagcaacgaatggcaggattttgccgaagattttgaagaagtcgaggagtttttcactcgtcagtttgatatctggcaacagttgcgtcgagccctcaacgatcaattcaaatccaatcgccatgcgctggagcaaaacccagaagcggctaaagcattagctgcactgcaggctatctacgatgataaatccccgtatagcaaactgcgccaggtgggatcgttaattgatcaactcatcgccattaacctgcaactggtagaacagaaacgtgccgcagctttggaagcgatcaatgcgacccagcaaggggttgcaccgctggttgctgacttaccagctgagttacaaaaccaggcaatgcgtccctttaacctgttaaaagaacgggtcagtaacagcttatccttgcatgaaatcgttagcctgcaacaagaggctgatgatgaagaagataaggtcttagaactgatcaaccgctacagcgccgaacttcaagctcgtctggaagcggagcaagccgcagcacggaaaaaaacggctgaaccgcctaatagcgatgctggtactttgcgagaaccggatccatcagactcgccaactactactgcgaataactctgctgcgacagtggttagccacaaaccaataccaaaacctattgaactggtttcaccagctgaattgctcggtgccagccacatctttatagagacggagcaagatatcgacacctatctcgcgacccttcgcagccgtttgcaacaagcaataggtcaaggtaaacgagtgcgaatcaaataa

SEQ ID NO: 458 - DNA, 3690 bp, Vibrio cholerae; identical to SEQ ID NO: 448

SEQ ID NO: 459 - DNA, 3663 bp, Collinsella aerofaciens
atggacaacacgatcattcgcgacctctttgctaaagacatcaaccgctccatcaacggcgtggtcaaggtccaggattcaaaagatgggtccatccgccaggagcttgacgagtacgtggtgacgcgcgagttgcagaggcattttgccacgttcttcaaggcctacggcgatgccatcgatgtgtccaccgacaagatcggcgtgtggatcagtggtttcttcggttctggtaaatcgcacttcctcaagatgctgagctacctgctcgagaatcgccagatcggcggcaagagcgccatccgctactttgacggcaagatcgtcgaccccatggtcgaggctgccatggagcgcgcctgctcggtgtccacgcaggccatcctctttaacatcgatagcaaggcgggccagtggaagcagggtgatacggctcccacggcgctgcttcgcggctttgagcgcatgttctacgaggcgcgcggcttctacggcgaggacctcaagcttgcaaagctcgaggaatacatcgattccctgggcaagacccaggagttccgcgaggcctttgagcgcgtcaacggcgagtcctggctccagacccgcgatacctacagctactttgaggacgacgtcgtcgaggtgctgcagagcgtgctcggcatgagcgaaaaggccgcatggaactggctcgagggttctgaggacgaggttttggcccctgatgtctttgccaaaaaggtcaaggactacgtggacgctcaggcagcggcccacggcggcaacttccgtttgctctttatggtcgacgaggtgggtcagtttattacaaacgaccaggacccaagccttatgctgagccttcagaccatcgtcgaggagttgggtgccgcctgcggtggccgcgtgtgggtgatggtcacgagccaggaggccatcgacaacctgagcctgcccgtgggcaacgacttttcaaagatccaaggccgtttcaatacccgactttcgctctccagctccagcgtggacgaggtcatccagcgccgtgtgctcgagaagaccgcgccggtggccgatatgcttgcacaggtctacgagcaagacgccgccgtgcttaaaaacaactttacctttgagggtggctcgcgctccgaccttgccggctacgccaactccaaggattttgtggccagctacccgtttgtgggctaccagtttaagctcctgcccgacgtgatgaccgaggtgcgcaagcacggtgtcaaggccaagcacatgtcaacgggcgagcgctccatgctgagcgcgttccaggagagcgctcaggccatccagcatgaccagaccggtgcgctcgtgccgttctggcgcttcttcgatactatctccaaagaccttgagcacggcatcatccaggtggtcgaccgcgcggtccgtgcggccgaggacgcagagggccttgaaccctacgacgttcaggtgctcaagctcctgtacctgattcgttacatcggctacgttaaggccacggccgagaacatctccatcttcatgatcgacggcctcgacgtggacatgcgcgccctcaaggaccgcgtcaaggagtcccttgcccgcctggagcgcgagaactacgtggcacgccagggcgatacctatagcttcctcaccgacgaggagcaggagatagcgcaggagatcgcacgcaccccgatcgataacgcgcaggtgatcgagtctatcaaaaagcgcctgttcgacagcatctacaccgcgcgcaaactcaaccgcggggccaacgactttccgtttgaccgctatgtggacggctcaatccacggtaccagcatgggcggcatggagctttacgtggcgactatggcgagcgacctgggccgtgcggacgataccgagctggccttggcttcttcgggcaaagccatcgtggccttgagcgacgaggcggattattgggagacgctcgtcaacgccgccaagatccgcaagtacgccaagacgcgaaatctccaggagcttcagccgagtacgcgccagatcgtcgagtccaagatgcgcgaggcggcttataacgagaaggaggccgatacccttttgagcgaggccgtgctccatgcacgttgcgcggtcaacggccgcatggttgaggtccgcgcggccaaacccgcccaggtttttgagcaggtgctggcgcagctgtgcgatgtggtctttgaaaaggccgactatatcggcgcgccggtcacgagcgattccgatatccgctccactctggcgggcaacgttcaagctgggctcgctggcatggacgcgggcaacatgcgtgcgctcaaggaggtcgaggactacctcaaagttcagcaccagcgccacctggataccgctatgggcgatatccagcgccagtaccagcaaagaccctttggctggcgcgaggtcgatatcgcaaatgtggtggcgcagcttgtggtggagcagcgcgcgcaggtgctgtttggcggtcaaacggttcaagccaacgatagccgcatggtggcactcctgcgcaaggatgccgataaagcccaggtgcgcttgcgtatgcgcatgagtgaccgtttgctgtgcgatacgggcgagcttatgcgtgacctgtttgagcttggcaccgtgccctccaacgaggataagctcgtggccgagcttaaagcgcgccttgaggacttgcgcgaggcgtgcctcgccatggcacgcgactactacacgggcatcaaaccagcctacccgtatcccggtgaggacgagtgcgagaagatgcgctcggaggtcgccgacatccttaaggaccagagcgagtccgaggcattcttgaccaccttcaccaagcacgaggaccgcctgctcgatgccaaggaagactttgacagggtggttgagttcttcgagtccaaccaacgaacggcgtttgatcacgccaaggatttcttgagtcgcaccgagggtattgagtatgtctccgatgacattcccaacgcggtggagaacgtggcaaaggtgcgcgagatcctcaaagatcccaagccctatggccgcattaaagacctgcagccgcttatggatcccgttgaggacgacataaaaaagctgctgggcatccgccgcaatgagtttttgtgccgcatcgagagcgatctgcaagacctgcaggcacaggctgagagtcaaaagggctttgtcaatcaagccaaggatgccatagcagaagccgccgccaaatacgagtcgttcaaaaaccgtgcccacagtgctcaaagcctcaacgagctgagtgttgccgcgactaactggggcaactggatcgttgctgcaaccaacaagatatacgacgccgtggatgcggcccgcatgcgcatggacaacgagcgccgcaccactgaggtcacgagtacgggtgaggtggtcaagaaggtctccaacaagggcgccgcatcgtctgctcccgtgcccgcgcccaagccccagcgcaagatcaagaccgtgcgccgcgccgatctggccaagccgagtcgtctcttgtccgcagaggacgtggagcgctatgtggatgacttgcgctcccgccttatgcaggcactcgctgcaaacgacgagatccgtatcaactaa

SEQ ID NO: 460 - DNA, 3672 bp, Enterococcus faecium; identical to SEQ ID NO: 296

SEQ ID NO: 461 - DNA, 3456 bp, Vibrio cholerae; identical to SEQ ID NO: 239

SEQ ID NO: 462 - DNA, 3627 bp, Bacteroides sp.; identical to SEQ ID NO: 278

SEQ ID NO: 463 - DNA, 3678 bp, Vibrio cholerae
atgaaaattgaacagattttttccaagaagttgatgcgtgacattaacggcgttgttaaagcggaacagaaagacaatgacagtgtgtatgtcgaacttgatgagtatgttgtaacccgagagctagatcgacattttcgcgctttctttgaggcttacgttccatctgtgacgcaaagcggcgcatcaatgtcaggtaagattggtgtgtggatctctggcttctttggttcgggtaagtctcacttcctgaaaattttatcttatttgcttgagaataaatctgttgaaaaagatggccaaggccgacaagcgtttgagttttttaaagacaaaatcaacgatgccatgctgttggccgatatccaaaacgctgttacaaaagatacagacgttattctttttaacatcgattcacgagccaatacggatgaccgagaaaatgccattcttaaggtcttcctcaaagtctttaatgagcgtgtaggatactgcgctgattttcctcatattgcgcacttagaacgcgagcttgataagcgtaatcaatacatgtctttcaaggacaaatttgctgagttgactcaatcaacttgggaaaaggagcgtgacgcctatgacttctatcgagacgaactttcagaagcactcgctcatgccagtgagcaatcattagagtctgccaaagcgtgggttgagcaggttgaaaacaatttcccgctagatatccgaaacttctgtaagtgggttaatgaatacttagatcgaactggagatcgtaaccttcttttcttagtcgatgaagtcggtcagtttatcggtaagaacacacaaatgatgttgaagcttcagaccattactgaagatcttggcacatattgtggtggcagagcttgggtcgttgttacctctcaggcagacattgatgctgccattggtggtatggataagcgcgatggcgaggacttctctaaaattcaagggcgttttagtacccgcttacagctgtcgagctcgaatacctcggaagttattcaaaagcgtttgttgtccaaaacggaagaagctcgtacacacctcatcgatgtctttgcagaaaagggcgacattcttcgtaaccagctgacatttgataaaacgacaaccgcttctctaaaaggttacaccgacgctccgtctttcgtggacaactatccgtttgtgccttaccactacacgttggttcaaaaagtgtttgagtcaattcgaacaaaaggcgcgacgggtaagcacttagctatgggtgagcgttcattacttgatgcctttcaatcagctgcaaaacagatgaaggactctggccttgatgtgttaatcccgttttacagtttctatgcaccgattgaaagctttttggagccagctgttaagcgaacgattgaccaagcctgtgagttggattccttaacagaattcgatggcaagatcctaaaaactcttttcttgatccgttatgtggacgttgtcaaaagcacactagacaaccttgtaacgctgtcaattgatcgaatcgatgcagataaaattgcgctgcgtaaacaaattgaagagagcttgaatcgtcttgaacgccaattgctgattgcccgtaatggtgatgaatttatcttcctgaccaacgaagaaaaagagatcgaaaacgagatccgccacactgacgttgaaatgtcagaggtctctaacaagctttcagcaatcgtatttgacggtattttgaaaggtaatcgtgcctatcgttacccgattaataagcaagactttgcggtgagccgtttttgcaatggtcatccaaaagatggcaccacgctggaagacctagtcattaaagtcatttcacctttggattcgcactttgaaaattactcccacgatcaagcgtgcatcaatcatacgcttgaggctgatgggtgcgtgctcgtcaagctgggcgaacataagcgtctttgggatgacctgacaacctttattaaaactgaccgattcttaaaacaaaattcaggacagcgaccagagcaagaacaccttctccgcgaaaagcagatggaaaatattgagcgtgaaaaacgcttaagaacggattttgaagctttatttgcagaggctgacgtttacgctatcggcacaaaactaccgaagaaatcagcaacgccaagtgccatcgtagaagaagcatacaaatacgttatcgaaaacaccttcgctaaattgaacatgctcaaggcgacacctggtgaagttttgcgcgagctacaggccgtacttgttgctgatgatattgctcagattggactggatcttcaagcggatgaatgtaacccagaagctacgcgtgaggttgagcagtacgtaacgctgaaagtcgagcgtaatgagcctgtgtacttacgtgacatcgttgcccgtttcggcaagcgcccgtatggctggccagacaatgaaatcttattgctcactgcaaggctgggcttggctggaaaggtttcttttagtacccaaggcacagatctggcgttgaaaaaagcttacgagccgtttaccagtgtgcgtaaacgcggcgagatccgtgtacataagatcaggcaacatgacgagcgccaaattaaaaaggctgctggtcttgttaaagagatcttttctaaaacctttaccggctctggtgagaaggagctctacgaattagtgcgcgatgaattactggcttggaatgaagagcttaaatcattcagaaccaagtcacagacaggccatttcccaggtaaatctcaaattgacgatggtcttgcattggtcgcgggtattcttgagcaaacttcaagcttcgcccttatcgcccgattcttagaagacgctgatgcccttgaagagtttgctgaggactttgaggatcttgatgacttctacaatagccaatttcaaacttggcaagcccttgctggcgcattgaacgagaagtttaaggccaatagacctgcgttagaaaaagacagtgaagcattaaaagcgctcactgaattagaacgcatttacaatatgtcctcaccgtatgagcagctgcgccacattaatccgcttatcgagcaggtggcaaaagttaactcaacattggttgaagaaaaacgcactcatgccttagagcgtgttgatctgcgcataggacgtgtaaaagaagcgttagctgaagctcatgcaccgtctgaactacagaaccaagcactgcgcccgctacaaatgtgcagacagcgcattgaagcaacctcttcaataccacaaattatcagtgagcaaactgaagcggaaggttacgaggacgaagcctatgagttgctgaatggctttatcgaagatcaacgcaaaaaagctgaagctgagcaaagacgtcgtgaaatcgaacagaagaaacgcgaagaagaagcagcgaaagccggtaaggcagctccagcacctgagccagtccctgaaccagtgcagccacagccgcttgcaaaacgtactgtaacgattaaaccaactgatgccatggcaaagtcagtaacaaccggattcattgaaagtgaagccgaagttgatgcctatcttgccgctttaagagagcagctgattgctgctgtcaaagctggtgaccgcgtacgaattaagtaa

SEQ ID NO: 464 - DNA, 3678 bp, Vibrio cholerae; identical to SEQ ID NO: 233

SEQ ID NO: 465 - DNA, 3456 bp, Vibrio cholerae; identical to SEQ ID NO: 239

SEQ ID NO: 466 - DNA, 3672 bp, Enterococcus faecium; identical to SEQ ID NO: 296

SEQ ID NO: 467 - DNA, 3753 bp, Fusobacterium sp.
atgagcgatttaactattaagagtattctacaaaaagatattgagagaaaaatcaatggagttgtaaaggcagatagtaatgaaaaagacactataattacagagttaaacgaatatgttgttacagaagaaattaggaaaagattgataaagttctttgataaatatgttgattcaatcaattctccaacagaagatatgggtgtatggatttctggattctttggttcaggaaaatcacattttctaaaaatgatagggcatattttagaaaataatacctatgatggaaaaacagttgttgactttttcaaagaaaaaatagatgatgcaattttgatggggaatattgaaaaagctgctgaaattccaactgatgtaattctattcaatatagataatgtaagtgatcaagacacacatcaaaataaagatagtatagcacttgcttttttaaaaaaatttaatgagtatttaggttttacaagagatgatatagaaatagcagaatttgaaagaaggctttgggaagatggaaaattagaagaatttaaaaaagcttttgaagaagaatctggaaagacttggaaagatgcaaatagaaatttagatttccactcagatgattttattgatgttgtagaaaaattagaaattatgactagagaaagtgctgaaagatggcttgaaagagatatagtaagatctataaatgctgaaagctttagagatataatagaaaactatttaaagatgaaagaccctaaacacagagtagtttttctagttgatgaaataggtcaatatattggagataattcaaaacttatgttgaacttacaaactttagttgaaactctaggagtaaaattcaaaggtagagtttgggttggggttacatcacaacaagatttaggttctatattaaataatagtgaacatagaaaaaatgacttttctaaaattcaagatagatttaagaccatactttcattatcaagtggaaatattgatgaagttattaaaaaaagattgcttataaagaaaaaaattgaaggagaagatttagaaaaactatttgataaaaatagagttgagattgaaaatttaataaattttgaaacacaaatgacattacctctatatgatagtgctgaggatttctcagaaacatatccttttgttgcctaccaatttaacttactacaaaaagtatttgaaaaagttagaaatatgggacattctgggcaacatatgtcaagaggggaaagatctttattaagttcattccaagaagctggaataaaagtaaaagacaagaatataagaatacttgtaccatttaattatttttatgaatcaatagaacaatttttagaagataatgtaagaagaccatttatccatgcaagaaatgaaaaaaaagtagatgattttggcttagaagtattaaaacttttattcttattaaaaggaattaatggtataaatccgactttaaataaccttacaagttttatgatagattctatagattgtgatagaattgagcttgaaaagaaaataaaaaaagctttagaaaagctagaaagagaagttttaattcaaaaagatggagacaattactatttcttaacaaatgaagaacaagatataaacagagaaattgaaagagaagatatagattttaagaaaatagatgaaaaaatagactcatatatttttaaagaaatatttacaaaaaatagtattataatggaagacactggtaataaatatggttttagtagaactcttgatgaaactcctttttcaaaagcaggagaagaactagcaataactatttttactgaaagagctgaggattatgataatgtttctatagtaggtacaagaccagaaagtgatttaattataagactaccaaatgatgatgaaacttatagaaatgaaataaagctatttttaaaggtagaatcatatattagaaataagcaaaaagataatgagagagaatctattatcagaatattagaaataaaacaaagagaaaatagtataagaaatagaagaataaaaaatgaattagaaagaattataggagaagctgaagtatttatctatggacaaaagcaagatatcaaaacaaaagatgctgctaagaaaattgaagaaagtttaaaagccttggcaaatcatagattccataaagcgaaacttgttaaaaaaccttatgatgaagctgaaataagaaagactctatcatatgtttttgacacaaataaaaatggaatactgtttgatattaaaaagaatattgaagccaatgtaaactgtgaagctataaatgaagtattagacagagtaaaattacttgaaaaaagaggagatactcctataacattaaagaatataagtgattactatttaagaactccttatggttgggggcaattaactatcaatggtttagttggagaattatggaaatatagactaataaatctagaagaatcaaaagttcttgttacagatgaaaatgttgcaacaaatttacttacaaaattacaaaataaaaatttagaaaagattgtaatttcattgagagaagagcttgatcctgaacttgttaaaaaagtaaataatttattgaaagaaataaagactcttaaagaagaaactggtgaagttactattgattctccaaaagaagatttattagaaatattaaatagaaaaataggtatagctaagagatataagattgaatgtgaacatagtaaatatccaggaaaaaaagaattaagtgactggattgagctattagaggagattatattatctagagataatgctgaaaaaactcttaagaatttcttagaaatgaaagatgaaatatcaaaggaatatgataaagttgatagagtttttgacttcttcacaagttctaaaaaagatagatatgatgaagttatccaaaaaatcaacaaaatagaagaatataaagattacattggtggcttaaaagaaactcctgcctataagacaattgaagaaattagaaatgataaaaatatctatgagagaattagagagtttgatgagttaattactgagttagataaagaaaaagataaacttatagaacttgaaaaagaatctttaagagctaaagttgaaaaatatagagaagatttttctgaaaaattaaaagataatactgaaatccttaaaaaattagaagaaaaatttaataactttttggaaaatgaagtcaataatagtgatagttctaatgacatggcaatatttatgaaatctaaaaaattagaaaatatagtttctaaatttgaagatgaatataaaaattatgctagaaaagaaattgagaaattagaatcatatcttaatgaagttgctgaagataaaactgatattgacaaacttagacaaagtataaaatctacttataataattataaaaatgaaatagctaagagtgatattagaaatattagtgctactataacaaaagctattaaagataaagatgatttttatgctgaattaaatggaaaagctaagaaaaaagaaagagttatattaagaaaagtttctataagctcaaagactaatatagaaactgaagatcaagtaaatgactatatttctcgtattgaaaaagatattgaaaagttaaaaaatgaaatgcttgaagctataagaagtaacaagataattgatattggataa

SEQ ID NO: 468 - DNA, 3690 bp, Vibrio cholerae; identical to SEQ ID NO: 448

SEQ ID NO: 469 - DNA, 3621 bp, Aurantimonas manganoxydans
atgacatccatgaacatcgccgaccttttcgtccgtccgatcgaccgtcagatcaacggcgtcatcaaagccgatcaggatgacgccaagagcgtttggcaggagcttgatgaatacgtcatcacgcaggagctggatcgctatatgcgtgagttcctgtccgcctacctcgccccggaaaccctgagccggagcggcgacgcagcgtgccggaacggtgtatgggtgtccggcttcttcgggtcgggaaagtcgcatttcatcaagatcatttcctacctcctcgagaaccgatcggtggagcaggatggggtttcaaagaccgcgctcgatttcttcaggacgaagatcgtcgacccgatgttcgcggccgacatcgagaaggcgacccgcattccaacggatgtcgtgctcttcaacgtcgacagcaaggcgtcgtcgaacgacgagcgtgcgatcctccaggtcttcattcgggtgttcaacgagaagctcggctactgcgctgattttccctacatcgcagacatggaacgcttcctggagcgaaaggggaagtacgaggcgttcaaggccgcctttgaaaaagagactggatctccctggatcgaggagcgtagcgccgtccgattccatgaggatgcactgattggagcaatcgccgaggttttggggaaaccccgtaccgaagctggcgaatggctcgacaagtacgaaaaggatttccagccaactccggagaacttcgcgcactgggtcgcggagtatctggaccgccaaggcccagatcaccgtatcgttttcctagccgacgaaatcggcggcttcattggcagaaacggcaaaatgatgctgaatctgcagaccatcaccgagaatcttggaacggtctgcaagggcggtgcatgggtcgttgtcacgtcgcaagccaacatcgaagcgatcttgggcgagatgcggagcaccgtcgaggaagacttctccaagattcagggtcggttcaaggctcgcctctcgctgtcgggatctcacgcggacgaagtgatccaacggcgccttctcggcaagaccgagccggcgaaggatgaattgaaaaccaacttcgggatgaatggcgagatccttcgccaccaggtcaccttccgcgacaaccggatgacccttcgttccttcgacggagaggacgatttcgtccgccattatccgttcattccctaccagttccagctcgtccagaagatcttcgatgcgagccgcacccacggcatgaccggagcgcacctcgccaagggggagcgttcgatgctggatgccttccagacggctgccgtttacagtgcttccaagcctgtcggtgctcttatcccgcttcacttcttctacccggcaatcgagagcttcctggaggacatcgtccggcgcgccatcaacggcgttcggacgaacccgtcgctcgagcccttcgactccgaggttctcaaaacgctgtttctcattcgctacgtcgacgagatcagcggcaacgtcgacaatctcgtcaccttgttcctcgacaggatcgacgcggaccgcgtcgcgcttcgtaaggcaatcgaggccagcctccgccgcctcgaaagcgagacactgatcagccggaacggtgagaacttcttctttctgaccgacgaagagcgcgacattggcaaggagatcaaggcgatcaggctgaatccgggcgaggagaccagcttgctcggcaatcttatcttcgatgacacgctgcagagcgtcgaccgggggcttttcacctataagccgatcaagagtaatctcgatgtcatgcgctttgtcgacgatgcaccgcgttcggcgctgaaagacaaggcgattcctctcaagatcgtcacccctctcgctgacaactatgaggacttcgccgatgcgacggtcaccatgcgcagtcatgacgaggtgctcgtcgtcctcggcaatgagaaggacctcgctcgcgacgtctacgactatctcaaggtcgagaaatacgcgacgcagaagatggacggcacgcagtcggaatccgtcaagcggatcgtccgggcgcgccagcacgagaacaccgagaggcggaagcgtctccaccagacgatcgaggcgctgatccgcgacgctcgcatctacgtcaacggccggcggctcgatccgaaggcgacgaccgcggacgccatcgtcgtcgaggcgctcgactattacatagccaacaccttcaaaaagatcgggcttctcgttcacctctccgaggacccgatccgggacgcgaaggtcatcctcgcgacctccgacgacacactcgacctgaaggacgaggatccgaacaaagcggctcttgacgaagttctcgaccatgtcggcctgatcgaaaagcagagcaagcagcccatccttttcgacatagccgagcacttcaacaagcggccttacggctggggtctgcgggaaaccgcgctccttgttgtcaagctattccggcgaggttccgcggacctgctgatgaacagcgagcgcctcgaccgcagccagcttgcgtccgagatcgagggacagaacaaatggcgcaagatcgtcatccagcgacgcaagatgctcgacgagacaacgcttcatagcgctcgccagctggcgaaggacatcttcggccggatgccgggcgtcggcgaggacgcgatcgccgaggacatccggctgaacctgacgaactggcaggacaacctgaagtcctggggcgcgctcgccgacgacggcgagtttccaggtaaatcggcgatcgcggagatcgagggcatcattgctccgatcatgcagaagcgtggcagctacgagctaatcgaggccttcgtcaccgcgaaggctgacctcaccggcctcttcgaagactacgaggacctgtccgacttccattcgtcgcagcggcccgcttgggaccttatgcgaaaggccgtcatggacttcgccgtcaacgaaaaggagatcgaaaaggacgaggcggccgccaaggctctgacgtcgatcaaggacatcctggcgctcgaagctccctactcccggatacaggatgcatcggcgctgatcgcaacagtgaccgaggcgaaccggatcttgctcgagaagcgccggaatcatgcctacgggatcgtcgatcctctgatcgcgaagatcaaggcggagctggacgatgtttcgtctgggtcggatctgcgcaaccgttccctccatccgatccagaccatccgcaagcggattgagaccagcccgagcatctctgcgatcttcatggcgcagaccgaagcgcgggaagcttatgatgatgccttcgagatgatcggcaactcggtaatgaaggtggcggagcccgtcaggcagcccgaaacggttggagggggtcctgagggcggcgtgccgtacggaaaattaccggaacctccggtggtggtattcaagccgaaacgggtcattcagccggcaagcctcgtctccgcagatggctacctcgaaagccaggcgcaggtcgacgacttcattgaccgcctgagatcgcgactctccgaagccgtctccaagaacgaacgcatcgaaatccgctga

SEQ ID NO: 470 - DNA, 3534 bp, Sinorhizobium meliloti
atgaccacatttcgcgatatcttcgaaaaacctgtcgatcgtgcgattgagggagttatcaaggccgatgatgaggccagcctccgggtcgaactcgaggagtatgtcatcacaaatgagatcgagcgtcagctcgagaagtttcttgacgcctacaataattacggctcggccaacggggtctggatctcaggcttcttcggctcgggcaaatcgcatctgctgaaaatgctggcgctccttctggagaaccgggatatcggcggaatcccagcctatgagcttttcaaacagaaatgcgagcacaatgagatccttgcagccgatctgcgcaaggccgtgtcgatctcgtcgaagagcatcctgttcaatatcgaccagaaagccgacgtcatttcgaaggggcaaaccgacgcgctgctttcggtgttccagaaagtcttcgacgaaatgggaggctactacggcaagcagccgcacatcgcgcagttcgagcgcgatctggacagccgcggggtgctcgaggcgttcaggcaggcatatcggtccgtcgcggcgaagtcttgggagcgcggacgcgagcaggcgctattggagaatgctaacgtcgccaaggcctatgctcaggccaccggcgccaatccgtccgagggcgaaggcatcctgatgcggtatcgtcaggatttccggtcatcgatcgaggacttcgccgagaaggtgaaggcctacatcgaaacgcagaggccgggcttccgcctgaatttcttcgtcgatgaggtgggtcagtacatcgcggacaacgtcaagcttatgacgaatctccagacgatcgcggagagcttgaatacaaagtgccgcggacgggcctggatcatcgtcacggcgcagcaggatatggcgtccgtcatcggcgatatgaaccagaggcaggagaacgacttctccaagattcaggcacgcttcgccaatcggatgccgctcaacagcgccgatgtcgccgaagtgatccagaagcggctgctcaaaaagacggagtccggcatcggcagcctgtccgatctgtaccatcgcgagtcgaataacttgaagacgctgttcgacttcacggatggctcaatccggttggagaacttccgcgaccgcgatcatttcatccacagctatccctttgttccctaccagtatccgctgttccagttggcgatccagaacctgtcccagcacaacgctttcgagggaaagcacagctcggtcggtgaacggtccatgctgggagtttttcaggaagtcgtagtacggctcgctgatctatcggtcggcgggcttgcgaccttcgatcagatgttcgagggcatccgcaccgcgctcaaatcgaatgtccagcaatcggtcctgatcgccgagaagaacctgggcgacgaattcgccacacgaattctgaaggcgctgtttctggtcaaatacgtgaagggctttaagcccacggcccgcaatgtcgcggttctgatgctggacaggttcgacacggacctcacgaagcataggcggcgggttgatgaggccctgagcctgctggagcagcagacctacatccagcgcaacggtgagctgttcgagtttttgaccgatgaagagaaggatgtcgaacaagaaataaaggcgatcgaagtcgatacggcagagattgccaaagagttggaggcgctgattttcgatggcgtcgtcaagagccgcaagctgcggcacgaggcatcttcgcaggactacgcctttgcgcgctacctcgatggccggctactcggtcgagactatgaattggcgatcaacgtcatcacgccatttaacgagcagagcgctaacgccgaagcgaccgcaatgcgcaccatgtcgagggacgaactcgcgatcgttctcaatgccgacaaccgctttgtcagcgacttgatgacgttcaagcggaccgacaagtatatccgtcaggcgcgctccgtggcgcagcagccgagcatcgagcgcatcgtccgcgagaagggagagcagaacaacatccggcagcgcgatttgactcttaaggtccgagccttggtgggcgactcccggcttttcgtgcgcgggcaggaaatcgaagtgcgctccgaggatgcactggcccggatcgagcgtgcgttccagactctcgtcgacaaggttcacgtcaatctcggcatgctgcgcggcgtcgcctattccgaaaacgagatcggccgtttcctcacgcatggcaacgacggtatgtttggcgaggatggtgccaatctcaccgacgccgagctggaaatccttaacttcgcacagtcaaactcccgcaatggcatcaggacgaccgtcaaggccgtcgtcgagcggttcgagcgtaagccttatggttggagctatgctgccatactttgcacgacggctagcctgcttggtcgtggcaagatcgaagcgcgcgcggatggtagcccgttggaaggtgatgctttgctgcgcggacttcagaacgcccacgcactcggtaatatcgtgctcgaactccagatggaattcacgccagcgcagacgcgcaagctcaaggaattctatcgcgatttttttgatgcgcaaccggctggaacggaaggaaaatccctcggaatcgagacggccgaggcattcggtgcactcaaaaccgaactcgcggtcctggaagggcaatcgtcgcgttacccctttctgtcgacgctgggccagcttcaggatgcgctgcgtgaggtcaccggcaaatcctatgcctggtatattcaggaccttggccgtcacatggatcggttgctcgatttgaaggagggcgtcctcgatccgatccgtcgcttcatgggaggtggtcagaagacgatctatgaagaggcgcggagctatctggcggatcaaagcgctaatttcggatatggtggtgaagagcaggcaggcgccatccaggaggttttggacgatcccaactgcttcaagggcaacgccatccagcaaatcaagggtgcccttgatgccctgagagccgaggttgacaatcggctctcagcggaacgcaagacagcgatttctgacgtcgaggagcttcgtaccaagctgcgggcgctgcctgaattcgcttccttggcggagcctggccgccgcgaaatcgaggcggtctttaagacggttctggacgctatcgagaccagcaagctgatcgcggtgatccgggagcgtgtgagcgggttccgggcgtccggctatccggcggtgctcggccgcgtgacggcgccgcctcctctgaaaaaagacgatgaggacgacaagccgcgcggcttcagggacagcgggaccggtacaagaccggtaccaacccaaccggaatacgtggccgccagcgcattgcgcgtcacctacgccaagccatacctcgccgacgaacgggacattgacacctatctaaataccctgcgcgagacgttgatcgcggaaatccgcgctggcaagcgggtgactgtgtga

SEQ ID NO: 471 - DNA, 3540 bp, Sphingobium yanoikuyae
atggctacttttctgcgtgatatctttgccaagccggtcgaccgttcgatcgatggagtgatcaaggctgacgacaaggccagcctcctgaccgagctcgatgaatatgtcatcaccaatgagatcggcgctcggctggagcaattcctcgacgcctacaacaattatgataccgcgaacggcgtgtggatttctggcttcttcgggtcaggtaagtctcacctgctgaagatgctcgcccttctgctggagaatgacgaggtcgaagggttgcgtgccgtcgaaatctttgagcggaagcttgcgggcaacccgatgctggcgggcgctttgcgcaaggcagtgtcgattccatcccggtcggtcttgttcaatatcgaccagaaggcggatgtgatctcgaaggcggatgtcgatgcgcttctcgccgtcttccagaaggtctttgacgagatgtgcggctactatggcaagctcccgcatatcgcgcagttcgagcgtgatctggacagtcgcggcaagctcgatgccttcaaggcggcctttgcgcaatcttccggaaagccttgggagcgcggacgcgaacaggctctgatggaaggtaagcacattgccgccgcctttgccgaggtcacgggcgatgaggtcaaggatattcttggccagtatcgtaaggatacgaaggtttcgatcgaggatttcgccaatatggtgaagtcgtggatcgatgcgcaggggccgaggttccggctgaatttcttcgtcgatgaggtggggcagtatatcgccgacaacgtcaagctcatgacgaacctgcaaaccattgccgaaagcctgaacacgaagtgcaaggggcaggcctggattgtcgtcaccgcccagcaggacatgggttcggtcatcggggatctgacggcgcagcaagaaaatgacttctcgaaaatccaggcgcgctttgccaaccggatgccactgaactctcaggatgtggccgaagttatccagcgccgtctgctggccaagaccgaggctggtcagatcacccttggcaatctttatgatgctgaggaaaataacctgcgcactttgttcgatttcggcgataattctttcaagttcaggaacttctccggaaaagaccagttcgtcgcgagctacccgttcccgaactaccagtatgacctgttccagcgcgcgatcatgggcctctcgcagcataacgcgtttgagggtaagcacagctcggtcggcgaacgctctatgctgggggtgtttcaggaggtggccaaaaagctggccgacacgccggttggggggctggcgacctttgacctgatgtttgaggggattcgcaccgccctgaaatcatcggttcagcagtcaatccaactggctgaaaagaaccttggcgatgattttgccgtgcgggtgctgaaggtgttgttccttgtcaaatacgtcaaggaattcaaaccgactgcccgcaacatatcgatcctcatgttgtcccggttcgaggcggaccagaccgagcagcgccgcaatatcgaggaggccttgtcgcttctggagcgtcagacgctgatccagcgcaacggcgaagtctatgaattcctcaccaatgaggaaaaggacgtcgaggccgagatcaaggcaatcgccgtcgatcccgccgagatagaacggcagctagatgaactggcgttcggcgcgatcctccgtcacggcaagatcaagcatgccggcacgggtgtcgattacgctttcacccgcaagcttgatggccacagcctgaaccgggaacatgagctttccgtcaatatcatctcgccgttcagcgacgattccgacgcaccggatgtggttcgttcgaacagcatggcaagcgatgagatgattgtcctgctagggcgtgatgtgcgttttacgcgcgatctcgtcctctggctccagaccgtaaaatttgcgcgtcaggtcaccagcggcgacgcccaacccggtcgtgatcgtatcattgcggagaagcgtgaccagaatacgcggcgcgaaaaggaactggtgcagcggctgcgcggccttatcgaggatgctcggctcttcgtgcgcggtgccgagctggagatcggtggcgaagatccgcaggatcggctggtcaaaggtttccaggtcttggtggacaaggtctataccagcctgcctgtcctgcgcggtgccacttacaccgaagcagatcttgggcgagccggacgcgtcgatggcgggcttttcggcggcgaaggcagcggtctgactgaagccgagcaggacgtgctgaatcatgctcaggctcagatgcgccttgggacgcgggtctcggtcaaggctttggtcgagaagttcggagcaaaaccttatggctggccttccatcgccgtcctttgcctgaccgcgagcctcgtcgcacgcggcaagcttgaggctcgggccgacagtgctttgctggaaggggatgcgctggtgcaggggctgcgcaacagccatgcccttggcaacattctgctttccccgcagatcgagttcactgctgcccagatccgcaaatcgcgcgaactgtttcaggagctgttcgatcttcccgcctctggcaatgacgcgcgcagtttgggtgcggagtggcagacgcaactgcgcaagctgcttggtgatgtcgagcaggaaagccgtgccattgcagcctatccctttgccgccgccctcgatcccctgcgcaccttgttggatgggatgcgcgatcagtctgccacctggtttatcaccggcccgatcgggcaggaagaccagcttcttgatgcaaaagaggatgtcttcgacaaggtccgcaacttcatgcgcgggccgcaaaaagccatctacgatgaagtgcgctctttcctgaccaggcaggaacagaaccttggctatgccgaaggcgccgccgccgacaagctgcgtcaggttctcgaggatccccagtgctataaaggcaccgcgattcaggaactgaagacggatttctatgccctgaaggagcgtatcgagcaaaccgttctggctgagcgcaatactgtcatcacggcgattgacggggttgccgaaaaagtcgtccagacttcggaatttggcgcactgccgcccgaacagcaggcgcgcatccgcaaagagcttgcagataggaaaacaggccttgccgcacaaggcctgatcccggccttgcgcaatctggcgaccgaggtgcgttccaacctcctggctgatacgctgacccggatcgccgaactgacacctgcaccaactccgatgcccgcgccccagcccgcaccttccggtggcgtggccgaacctcagccagcgccgtatgtgccaccggcaccggccaagccccaatatatcaaggcgcagtcgatcaccgtccccttcgcgaaaacctatctcgaagatgaggacgatgtgacccgctaccttgatgagatgaaaaagaccctgctggccgagatcggcgcgggcaagaaagtgattgtctga

SEQ ID NO: 472 - DNA, 3672 bp, Pseudomonas fragi
gtgagcattaaagatattttcttcaaggaactcgatcgcccgatcaacggcgtggttaaggcggatcagtccgacgacgcaaccgtgcaccaggagctggatgagtacgttgtcaccaacgagctggaaaaacacttccgcagcttcttcgagtcctacggtactgacttgaacgatccctccatcgccaaccgcgtgggcgtatggatcagcggtttctttggctcgggtaagtcgcacttcctcaagaccttgtcatacctactggccaacatcgaagcgcgcgacgaccagggcaacgctcgcaaggctgtgtccttctttgatgcgagcaaactgcgtgatgccaccatccgtgccgacatcgacaaggccgttgccaacagtgccgatgtcatcttgtttaacatcgacagcaaagccagctccaacgatgctggcaacccgatcctcaatgtcttcctacgggtgttcaacgagcatcaaggtttcagtggcgaccatccccacatcgctcacatggagcgtcatctggcccagcgcggcgtctatgagcgattcaagcaagcctttaatgattccaccgggatggactggaccgaggagcgtgatggctatcagttctaccaggatgacattgagcaagcggtagccgcagccctcgatctatcagctgaggccgcgcacaaatggttcgaagactcagaacaaacgttcagcgtctcggtcgaaaacttctgcaactgggtgcgcgaatacctcgacacccagccagccaaacaccgcgtgttgttcctggtggacgaagtcggccagttcatcggcagcgacaccaaactaatgctcaccctgcagaccatcaccgaaaacctcggcaccatctgcaaaggccgagcctggatcattgtcacctctcaggccgatatggatgccgtactgggtgagctgtccgcctccaaggccaacgatttctcgaaaattgccgggcgcttcaaaacccgactttcgctgtccagctccaacactgacgaagtcatccagaagcgcctgctgcgcaaaacaccggaagctgaagtcgagctgcgcgccctctgggaacagaaaggcgacatcctgcgcaaccagatcaccttcgaccgctccggcccgaccctgaagaacttcgatggcccggaaagcttcatcaacaactatccctttgcgccgtaccacttccagttggtgcaaaaggtcttcgaggaaatccgcaaggtcggtgccaccggggcgcacctggcctacggcgagcgttccatgctcgatgccttccagatggcggccatggccattgcggataaaccgctcggcgcgctgattcccatgtacagcttctaccgcgccgtcgaaggcttcctcgatacagccgtcaagcgcactatcgaccaggcgggcgagagcagcgtcctcgacgcgttcgacgtacagatcctgcgcaccctattcatgatccgatatgtcgacctgatcaagggtaccctcgacaacctcgtcaccctctccatcgaacaggtcgacgaagacaaactggctctacgtcgcaacatcgaagaaaccctccaacgccttgaaaaggaaagcctgatcacccgcaacggtgacgagtttgtcttcctcaccaacgaggaacgcgacatcacccgcaagatcaaggccacagagatcgccggttcagaagagaacaaggcactgtcggacctgatctacaaagacctgctcaaggacaagaacaagttccgctacagcgtcaacaagactgactacagcatgggtcgctacctagacggccacagcctggaaggccgttacgagcacgacctccgtgtcgaagtgatctcgccactggatctcgactacgcgctctatggcgaagccggctgcatcaataaaagcaacgaagctcctgccggcatggcactgttcaaattacctgacagcaaggacttcttcaccgagctgcgcacctggctgaagaccaacaagttcatccgcctcaacgacgacggcagccagcctgagctgagcaagatcctcgccgaacgcggccgcgagaaccaggagcgtaaaaagcgcctacgcttgctgctggaagagctggccgagcgcgcagaggtttatgcgcaggggcagcatctgaagctcaacagcaacaatatcgtcagcaagttcgacgaggcgtgccagtacctccttgaaaacaccttcaccaaactgggctacctgcgagtattacagcaggagcccgagcgtgaactccacgccattctgcacaccaacgacatcggccaactcggcctgaccctcgacggtgacgaaggcaatccgcaggccatcaaggaagttgaacaattcatctcgctgcgcgcctccggcaacgaacgcttgctggtcgcagacatcatcgagcgcttcagtaagcgcccctatggctggccggatggagagatcctgctggtcctcggtcgcctggccgcttccagccgtatttcgttccacgccgcaggccccagcatgccgctgccggacgccttcgagtacctcaccaacagccgtaagcgccgtgaagtctcggtgcagaagaagcgccagaccgacgaaggactgctcaagcaagcacgtaatctgacccaggagctgttcaacgcccttggcccagcaggcgagaaggagttgttcgagtactactgcgtgcacttcggcaactggcgcaccaacctggaaaaatacaaagcaacggttagcgccgggcgcttccctggcaaagagtccatagaacaggccttgctcagcctgcagcgcctgctgagcaacactgatagcgtcgactttttcaaggccgtggtcgacaacaaggaggacttgctggatctggaagaggactaccgggatctacacgagttcttcaccaaccagttgcatacctggcagcaactgcagctggccttgcgtcgtttcgacaagaacaaaccagcgctggataaagacgagaaagcccgcaaagcgctggccgagctgaaagccattgagcagaacaccacgccctacggtcagctacaccaggtcgccacactggttgaaacggtagaatccattaacgccgccatcttggctgaaaagcgtcaacatgccctggcccgtgtcgacgagaaaatcgcccaattacagtccgagattgccaaaagcggtatcgaaaccgctgagctgagtaaccgcttactgcgtcccttacaactggtcaaggcggacctagagaccgaaaccagcatcgccaacatctacatgctgcaaacccagaccgctgacgaacgcctgaacgacggcgtgttcgatctggagcgcgccattcaggcagaggttgaacgcctgcagaagcttcaggaagagcaggccaaggccgcacaggcagccaacacagctaacggcgtcaaggaagaccgagcgcctgccctggtgccaacctccaaacctgtagcgccgcccaaaccggtggtcgaggtggcagcgaccagtgtgttcaacaaactagggaacggcttgtatctagaaagccagagcgatatcgaccgctttatcgacgtcctcaaggtagagctggaaagtgcggttaagcaaaacaaacgcattcgtattcgctga

SEQ ID NO: 473 - DNA, 3726 bp, Lactobacillus helveticus
atgatacaaataaaagatatttttgcaaaagatataaatagagatattcgtggcgtcattaaaattggtcaagatagtgatgatattaaacaacaagaactcgaagaatatgttgtaactgatgaattaaaacgtaactttactcgtttttttgatgcttatgataagagtattaataatcctaccgatgaaatgggagcatggattagcggtttctttggatcaggtaaatctcacttcttaaaaatcctttcctatttattagagaatgatacggtaaaaggacgtcaagcaattgattacttcttacaagatggtaaattcgatgatgatcatttagctgatgccattaataaagctactagtgtaccgaccgaagttgctttattcaatattgattcaaaggctgattcgaacgctgcaaataatgataattcaattctagatgtctttcttaaagtctttaacgagcaattaggatattcaccaattgcagtagtagcagatatggaacgctggcttgatagcattggtaaatatgaggcctttaagcaagcttttgcagatttagctacaacggatcattctagctgggttgaacttagaaaaaattatgcattaatgtcaactaagattaagactgctttagtaaattgtggtgcattggatgaaacagatgcaaataattatgttcaaactctgttaactaaaaaatttagcattgatgcaacagcttttgctaagttggttaaaaattatcttgataaaaaaggtaatgatgctcattttgtattcctagctgatgaagttggtcagtttattggtgacaataatagtagaatgcttaacttacagacaatcgttgagcaactgggtgtccaatgtcaaggtcgtgcgtgggtagtagttacttctcagcaacaaatggatgaagtcgccagcaacttttctaaatatgaacgagatttctctaaaattcaaggtcgttttaatactttgatcaatatgagttctgccaacgcagatgaagttattcgtaaaagattactgactaaaaagccactagtaagtgatcaattggcagatatatactctaaagagcaatatagcattaataataagattaatttcagtgatgcaatcaagcgtcaaaaatttgataatgctcaagaatttgtcgaaaactatccatttattccttatcaatttagtttattaaaagaggtcttaactgcagttcgtcaacatggtgcaaatggtagtcacatgtctgatggtgaacgttcaatgctgggaactttccaggaagctaccaagagatatgagaatgatgaattaggtaggttagtaccattttctgcattctttatcgggatgaaagagttcttaagtcatgatcaccaagtggtatttgatcgagctcaaaccgataggtatgttaacaaaaataatgaagactattgttttaatattcaagtattagccgttctcttcatggtacgttatgttgataattatccttcaactttagaaaatatagttactttactgctagatagtgttgatcaggatagacaagctttaactgcagaagttaaggatgctttaaatgtcttaatgagacagaattatattcaaaagaagctagatacttaccaattcttgactgattcagaacgagaagttaatgaagcaattaatgcaattgaggttgatgatcgtaaggtagctcaaaagattggttcatatttattaacatctaatttgattgacgcaaaatatacttaccctcatatgaagaatcaatatatctttgagttcaatgaatatattgatgaaatggggttaaaccgtttaagcaataatctcaatattcagattatctctacattgattgctgatgattatagagaaattgacttccaacaaaaggctagtgatggtaagaacatcattatcgttcttaaagacgatgatcgttatattgaaaactatcgtcatattgaaaagattaatgcttacttgcaaaaaccggaaagtcgatcagatgataaaaagcaagaaattgcctttaatagaaaggctgaatctaagcaggtagaagaagccactcagaagatgatcaaggatgatctgattgatgctgatatttatgtcttggatgatgttttacctaagggtagtaattttgaaagtcgattagagcaagccaagaaggaaataattgatagtaattatcgtaatttacattatttgactgcggttaagacggatcaagatatccttgataccctaaagggtaaaaataaaaatgacttgttcagtgatgatgaacaggcaattaaagaaatcatcaattatatcagcgtccaagctagcaacatgaataatgtttcattggctaatgtgattaaacgttttggtgaaatcccttatggttataaaccaactgatattgcttggatggtagctaaagcatttgttaacggtaaagttaagttctattttaacaatgaacagatttcattgactagtgctcaagaggatcccaaaggaacgcaacgttacttaatcggcaagaataatatcgctaagttgacaattaagccagttaaagaaatatcgatgcgtcaaaagagggatgcaaaagactttgtcaatgatatccttgatatgcgtttaacagtagatgaaaatactacttctgagcaaatggcagacgatattaaaaacaaaacaaaacgttttgtcgattgtttaaatgcattaatgcgtaaaaagtataattttgatacgccttatcctggtcataaattattagctgaaggtgttcatgacctaaatgctattgttaacgttaaagatagtgaccgtgtcttccagattatttcagatcatttagatgattatgaagattggcatgaagaactcgaagataaagctattcttgagttttacggggatgtagagcaaacaagtagccaacaagcaatttggaataaagcacatcgctatcttgatcgctacaattacgctaagagtatgattgaagaccaagacttaatcggaatagctcaaaagattaaaggttgcctagaaaatgataacttcaacaatacaattcctaagcttaaagagttaaacactcagtttgcggataaatacaatgatattattcaagaggcttacgataagattgaggcacaaattcaaataagtcttgatgtaataaagaagagaattgcggaatcagattttccggaagataaagaccgcgaattaaatgatatggcggaaaatgtcttcaatactttattgcaaaaagctaaggaatacagcaatagcgctagtgaagatgcttatgtatcattggttggactaaaaaacaatattgatggtcaaactaatgagcagaaggaaaatattgctcgagttagttcagaattagctgaacaggctagaaaagagcaagaacttcgagaaaagaaaactgcagcagaagaaaatgacaagaaagaacctgtttctgtagctcccgtatctaataaaactaaacctattattagagttaagagtaataaatctaaagatattaccgaactagttcatgaagattcatggaagatcacgaatgaagaagatcttgataaatatttagctgaattaagaaagaatattaaacaagaacttcaacatacagatatcttaaatgtagacttcaaataa

SEQ ID NO: 474 - DNA, 3456 bp, Vibrio cholerae; identical to SEQ ID NO: 239

SEQ ID NO: 475 - DNA, 3534 bp, Faecalibacterium prausnitzii
atgtttgtagaagacatcaaccgtaaaattaacggtgttgtcaaggttgacgaggacgagaacaaggtcctggaacaggaactgaacgagtacgttattacacgagagctgaagcggcattttgcagactttttcaatacctatgcagaagcatttgacgaaccaacggcagatacaggagtctggatctccggtttttttggcagcggtaaatctcacttcttgaaaatgttgtcatacttgttggaaaacaaagaggttaatggcattcgtacggtggagcgcttccgcaagaaatttgaggatgaccctggtacctttatgcaggtggatcgtgcaaccaaaggtgaaaccgagacgattctgtttaatatcgattatgaaggctctatcaataaggacaaaacagccgttttacgtgtttttgctaaggtgttctataatcatctgggattctttggcagcaatctcaaagttgctatgctggagcagtacattacgcagcagggcaaaatggatgaattttgccgtctgattgaagaaaagaagggcaaaccttggactgaagtgcggaaagcatttgcatttaatggaaaattcattaagcctgcactggcggaagcattggatatcagtgaagaggatgcaaacaactggtttaacgataagagtgcaacggaactctctgtttcacagcttgtagaagacatcaatgcatacgtcagcacaaaacctgcaaacttccgccttctgttcatggtggacgaggcggggcagtatgttggcacggacacggatatgctgctgaatctgcagtctttggtggaaaaaatcggcagcgaatgcagaggaaaagtctgggtggtctgcaccggacaggaagctattgatgagattatcaaagtacgagcagatgaattttctcgaattcaggctcgtttcaaaactcgtctgagcctttcttcttcttccgtagacgaagtaattcagaagcgtattctgaaaaagactccggaagcagaaagaacgctggatgcggtctatgagaaagaaagctccgggatgcgcaacttgttcagctttacaaatgcaatgccggacatcaagggcttctctggtccggcacaatttgcagaggactttccgttcgttccataccagtttctcatcatgcagaaaatttttgtggagatccgcaaacacggcaatgcaggtaaacacttctccggcggcgagcgttccatgctgagcggatttcaggaagcagcacaaaaagtggaaaagcagaacgagtttgcgttggtgccgctgttccgcttctatgatactgtacattctttcctggatggttccattcgcaatgtgattgatcgctgcagcaaagccgtagaaaatcacgatggtctggagccgatggatgttgatgttctgaagcttctctatctcattcgatatgtcaacgaggacataccggccaatctggacaaccttgtgattttgatggcagacgacatccgtctggaaaaggtcgcgatgcgcgaaaagctgcgcggcagtttggatcgactgattgggcagaattacatcggacgtactggtgatacctacaacttcctgacggatgaagagcaggacatccagaaagaaatcaaccttacacaggtggatacgggcgctattgttggggatatagcaaagattatttttggcataatttatgatgcaaaaaagttccgttacggcaagtgtgacttcccgtttgatcagatggtggataacactatgtacggcatcgccacaggcggcatgcgcctgcgctttttgacggcagcttctgatgcaacggaaaaaacggaatttcgcctgatgaacagctccaaaggcagcgaggcgattgtagttttgggcgatacgccgtattatgaatcgcttgaagcatccatgaagatccgcaaatatgtcaaacagcggaatgtcagccagatgcccaagagtgctcaggatattatccgcggccaacaggaagaagcagccaagtatgaagctgaagccagcaaagctctggtagaggctattgaaaacgcaaaattttacgccgatggtgaacatctggacattaagagcggcaatgctaaggccaaaattgaccagacgatggagtatctggtctcgcatgtttacagcaagttggacctgattgggaaaaacgcagataccgatgctgacattctagcagtgctgtccggtgcggactatattctgccggaggcagatccgaaccgcgatgcagaggcggcggtggaagaatatcttgagatgcaggcaatgcatcacctgccgacctccatggcggatgtacagagcaagttcagcagtataccctatggctggaaggaaatcgacattgcttatgtggtggcgcgtttgatcgtgaatcagaaggtaaccatcaaatatgcaggcactaccatccagccggacaacgccaaattacctgacatgctccgcaaaaagagtgaggtgggtaaaacatccattagcaagcgcgtggtggtatcggcaaccaaaatgaaggctgtgcgggaccttctgcgggattacttcgatgtcatggatgttcctgcggacgaagacggtttggttaaatttattgccgatgagttcggaaaccagctgcagcattataacaaactgaacgagaagtacgatgatacccacaagtacccggatcagacaatagtgcacaacgctattactgcaacgcaggaagtgttgaaccagaagaaggacaacatcgcgctgatcgactatctgctcaagaaagaggacgacctctttgatcagaaggatgccatgggcaatgtagagaccttcttcaagagtcagatcggcacctttgatgatgctgcacggctggaacacgagatgcaggcggatctggaccgcattgcgcagaatgcggcggcatacgatgccctgaacaagattcggcttatcatcacagtgccaccttttgggcagaagttcaactacaagcgcattccggaactgaatgggttgatgcaaacggtgcgtacagcccatgaccagatgctggatgacaaacgctctgagattctggagacagtgcgtcagtgcatggaagcgacccataccgctgcaaacggagatccaaaagcattggacatcgtccgcaagtcggatgctttctttgatggctataaggcaaaaattgcaaactgcaagagccttgcgctgctggatggtatgattatcccgctgagccagtacaaggatgagaccgtcagcagcattgagattgcgctggcccctccgacaccgaaaccggtggtaacgaaaaaagatgtcaatatcccggccgtaaagccgaaaaaagtaaagtcttacagccgccagatcctcttccctgccaaaacgctgcgagatgatgcggatattgatgcctatgtggagaagattcgggagcagttgcggaacctgttagacggctgtgatgagataaagttgaactaa

SEQ ID NO: 476 - DNA, 3681 bp, Acinetobacter sp.
atgaacattaaagaacttttttacaagccattagatcgtgcgataaacggggtggtcaaggcagaccagaatgacaataccacggtatatcaggaactcgatgaatacgtggtcaccaatgagctggaaaagcattttcgggactttttccagtcttatggtacagacctaagcgatccttcgattgccaatcgtgtcggcgtatggatttcaggcttctttggttcaggtaaatcacacttcctgaaaaccttatcgtatattctggccaataaagtggcacgtgacgcggaaggtaacgaacgcagtgctgcagaattctttgatgaaagcaaaatccgtgatgcgtttatccgtgcggatattggcaaggccgttagccatcatgccgatgtcatcctatttaacatcgacagtaaagccagttccaatgatgacggcaatccgattctgaatgtgtttttacgcgtgtttaacgagtatcagggttttagtgccgatcatccacatattgcacatatggaacgtcacctgagccagaaaggggtgtatgagcgctttaaacaggcttttgaagaatctagcggcatgtcttggctagaagaacgtgacggctatcagttctatcaggatgatgtcgaaaccgcaatttcccaagccctcaacttatcagcagaagcggcacacaagtggtttgaggattctgagcagacttttagtgtttcggtcgaaaacttctgtcagtgggtgaaagaatacctggacagcaaaggaccccagcaacgcatgttgtttctggtggatgaagtggggcagtttattggcagcgatacccgcttgatgctgacactgcaaaccattactgaaaacctgggtacgatctgtaaaggccgcgcttggattatcgtcacctcacaggcagacatcgatgctgttttaggtgagatgtcttcttccaaagccaatgacttctccaagattgctggacgttttaaaacccgtttatcactgtccagttccaataccgatgaagtcatccagaaacgtttattacgtaaaaccccggaagctgaagcattgctcagatcggtgtttgagcaaaagggcgatatcttaaaaaatcagattacctttgaccgttcaggcccaaccctcaagaactatgaggggccagacagctttattcataactatccttttgcgccgtaccactttcagctggtacaaaaagtatttgaagaaatccgtaaagtcggtgcgaccggtgcacacttggcctatggtgaacggtccatgctggatgcgttccagatggccgcgaatgcgattgctacagatgaagtcggtgccctggttcctttccaccgcttctatacttcagtcgaaggtttcctggatactgcagtgaagcgtaccatcgaccaggcagggcagaataagaccctggatggttttgatgtgcagatgctgcgtaccctgttcatgatccgctatgtcgatatcatcaaaggtacgctggataacctggtgactttgtcgattgagaaaattgatgaagataagctggcattgcgcaagcggattgaagagagcctgcagcgtctggaaaaagaaagcctgattactaggaatggcgatgagttcctgttcctgactaatgaagagcgggatatcactcgaaaaattaaagccactgacttagcagcttcagaagaaaataaagagttagccaatctgatctttaaagatttactgcgcgatcagaacaaataccgccatcaagccaacaagatggactatcagattggtcgtttcctagatagccatagcctggatgggaagtatgagagcgatttgaaagttgaaatcatttctccactagatacggaatataacctctacactgaagcttactgtattggtaaaagtactcaggccgaagggcagatactgtttaaactggcagacgataaacagttctttaatgaactgcgcacctggctgaaaaccaataaattcatccgcttaaatgatgatggcactcagtccgatatttcccgtattctggcagaccgtggtcgtgagaaccaagaacgtaaaaaacgcctgcgtgtccgggtcgaagaaatgttgctggaggcggaaagttatgccttgggtcaacatctacaactttcatcttcaagtccaatcaccaagctggatgaggcctgtcgttatctgctggaaaatacttataccaaactgagctatctgcaggtctatcagcaggatgcctggcgtgaactgaacgccgtcttgactgtcgatgatatggcgcagctcggattgtctctggatggcggtcagagcaatcccaaagccctacaggaagtggagcagtacattgcactacgggccactggtacagagcgtattctggtctcggatgtggtggatcgttttgccaaacgtccttatggctggccggatgccgagattttactgctggtgggtcagttggcggcaatggggcggatttcactgcagttaaatggcggcagcttacagttaaaagatgcctttgagcctttacaaaacagccgccgtcgccgtgatgtgtcgatcattaaaaaacgccagactgatgatcaggtattgaaacaggcacgccaactgacccaagacctattctcggccatggggccagcgactgagaaagagctgtttgaattctatacccaacattttaacaactggttagccaactttaagtcgtacaaaagcaaaactgatgtcgggcagttcccgggcaagaaagtgattgaaaagtcgattctgactttggagcgcttgctggctaatagcgacagcttcgatttctttaaggccgtggttgagaacaaggacgactatctggatctggaagaagattatcgtgatattcatgagttcttcactaaccagatgccgagctggcagcaactgcaacaggccttacgtcattttgagaaaaacaaacaggcgctgggcagtgatgaggtggcaaaaaaagccctctccgaattacatcgtattttcacccttgaatcgccctatggcctgttaaataaagtggctgatttggttcgcacagtggaaagcatcaatgagcaattgctgactgagaagcgtaatcaggcgatagaacacattgatgacaagatcaagcagttagaagctgagattaaaaacagtggcatcgctaccgctgagctgagtaacaagctattacgcccactacaactgcttaaaacggatattgaagtggaaactagcctgtccaccatctatatgctgcaaacccaaaccgccgtggagcgttttgatgaagtcttgtatgagttggaaagcgaagttcgtacggaaatccagcgtcagaccaaaacggcacaactggctcagagcaaagcagagagtgtaaccaacactgcaaccacctccagcccagatacatcaacacctgctgcgagtccggtacagcctgtgacagccgtagttccaccgaaaccggtggtggaagtcgatgtcgccagcatttacagcaaaacctccagcagtgtctatctggaaacagaagaatcagtggatcagtttgtagacgcactcaaagctgaattgaaaaaaattgtgagtgataaaaagcgtgtgcgtatccgctaa

SEQ ID NO: 477 - DNA, 3609 bp, Bacteroides sp.
atgcaactacaagatctgtatatcaaatccattaatcgtccggtcaatccggcagtttctgctaccaagttcgataaagagaccattgatattgaaatcaaggaatacgtttttaccgatgaaatcctcaatggactttatcgcattctgaatgctatcaagaacaataaaccttacgaccatgttggtatttggattgatggctactacggttcgggtaaatctcacttcttaaagtacctcgactactgcattactcccgaaactcgcgatgtagctttagaacgtttacttgatgctgtgaaagaaatcgatcctttcgatggtaagcacaaccttcagtttgagttttcacaggttcaagatattgcttcgtggctcaagactgccaccatcgatacctgtatcttcaacctcgaaacctcctacaatgcggctaccgacaaaaagaaggcttttttgcaggtgttttgggatgagtttaacggcaaacgtggactgaacaagtttaacctcaccttagcacagcttttggaaaaaccgctgatggagcgtgggctgttggaacaatttaaggaggtgattgccgagatgggtggcgattggaacaatcccagcgaggctgccgatttggtggatcaagccttggagatggttgtagatgccgcttgtgaactcaatccgcagtttgaccgcaactccctatacaatcatatcgacaagcgcgactatgccatcagcatcgaccgcttcggcatggagctggcagactatatcaaagacaaaggcgaagattatcgcttgatattgcttgccgatgaggtgagccagtttatcaataaggaacgcgaccgttacttgaatctgcaagagattatcaccaagctctctgaatcctgtcacaatcaagtgtgggtggcttgtacagcccaacaggacctcagcgagattatggatgactgtaatattggtgaagaaaaagacaaggaaggaaagattaaaggtcgttttgaagtgaaagtatcactcaaaggcacgcagcccgaagtgattacacagaagcgtattttggaaaagaagccagaggtgaaaacctatttagctgccatgtacgagcagcagcaaggagccttcagtctccagtttaagttaccaaatgcgtataagagctacgatacggagactgactttatcgacttttacccctttgttccttatcagtttaagctcatcatgcaggtgttcgactctttccttgctttggggtatgtggctaaggaggtgaaaggtaacgaacgaagcatcatcaaggtgattcacactacggctaaggctcccaacaatgctcaggccgaagtaggtaagttcgtttcgtttgatgaactttacaacaatatgttcgaggagggtttgcaggctcgtggacagaaggctgtggataatgctatccgcattgcccgtacctatactgacccgaaattggctgtacgtgtagccaatgtcctctttatggtttgcaatatttcgcaaactgaccaactagttttcccggcaacgctcgacaatatcaccacgttgctgattaacgatatgaccacgcctcgcctcaatctgaagaatgaggtagaaaaggtggtcgatttcctttgcgacaacaacatcatccgtcgtgaacaaggccgtcagggtgcgcccgacttcttctcgttctatagcgaagaggaaatgaaggtagccgagctgattaaaagtcagactgctgataacaacctacaagccggtgaactgaaagaaatcttcaatcgctacttgaaaggattgaagaacaaggaacaatataaaactcgttcgtttgccgtgggaatgaccatcaatcagcgcaactatctcagtaataaccccgatgtagtgctagaatttatgatggatgacgactatgatgcacctgaacaacttgctctgcaaaaccagaccaatcggttggtgtattatgtggggccacagttccgtgccaatgctcgtttgcgcaacaacttctattggtattgcaaggtgcagagctatatgaccgccaaccctgctaccagcgacgagaatgctgctgtgcgcgaagaatttaaaaagcgtgccagcgaagtgatgactggcatcattgagagagagttccaaaagattctcgacacctgtcctctagtaagtggtctctctgtgattgatgatgtagagttgggtaataaaaaagggaatgaccgctacttggctgctatagagaagcatctctccggtatctataccaaagcaggactggtagatttaccgcaaattccccgaaacagtgataaactcaagatagctatccttcgtcccgtgaatccgggtgattacgagggattaaatgactcgcttaccgaagcagaacatgaggtggaaatttacctcaacaagcaatacgaggagttgaatgtgggtgatgtggtagccaagttctctaaagctccgttcggttgggatggcatttgtactctttatgtagtgaacgaacttgtacgccggcataggcgtgactatagttatagcaataatcccaatgtggaggtgagtattgtagcaaaccgtttgctgagcgaaaccaacaagtttaccattcgtccggctataaccatttcgtccgaggtgattaatggtttcattgccgcttggaagaacatctttggtgtgagcgaatctttctccactaccgatagtacacaactattccgtctcagtcgagagaaagagaatgtgcgaagtgtggagaatgtagtagcacgctacaagcagcactacaaggataatgccgcatactctttcagtgcgccgctcgacgagatggtgactttgctcgaaggttggcttgccgagcgcgatccgttgaagtatttccgtcgtgtgattgacgaacagcagcaggcgcgcaccctcttcgatacttgtaaagaagtcgtgcagtttgtccaagaccaaatgggtaattataaggatgtgctccactttgtacgcgataatcgggataattttagcttcgtacctattgagcttcacgaggcagttacgcagttgatgggaatagagaatgcagcatggcctatcggtatacgtacttatatgaagcttcgcaacactcttgccggagctatcgatgctaagcgaacagaacttcgcaaacaaattgctgaggaatatgccaaaacgtatgctcagttggaacaaggctgtaaggaaaatgaggtatcgacttctattctttcagatcaagaggttatagtaaaactcaaaacacaaccggatagcattcctgtgttgcagaccaaccttgataccaatacattctttgctgagcaaacggcgaagatattggctgcaaaaccgaagcctaaacctacggttggtgatgacaaaaacaagaaggaggaaattcctgctaagaagtatcctacacaggtagctttgagtactcgtactactttacctattggctcagaggctgatgtggataagtatttggcacaactcaagaagcagctaatggcacatattgacaaaggcgagacggtaatgattatcaaataa

SEQ ID NO: 478 - DNA, 3678 bp, Proteus mirabilis
atgaaaattgaacagattttttccaagaagttgacgcgtgacattaatggcgttgttaaagcggaacaaaaagacaatgacagtgtgtatgtcgagcttgatgagtatgttgttacccgagagttagatagacactttcgtgcattttttgaggcttacgtcccatcagtgacgcaaagccacggtgatatgtcaggtaaaattggtgtgtggatttctggcttctttggctcgggtaaatcgcacttcctgaaaattttatcttatttgcttgagaataaatctgttgaaaaagatggccaaggccgacaagcgtttgagtttttcaaagacaaaatcaacgacgccatgctgttggcggacatccaaaaagcggttaccaaagacactgatgttattctttttaacatcgattcgcgagccaatacggacgaccgagaaaatgccattcttaaggttttcctcaaagtctttaatgagcgtgtaggatactgcgctgactttcctcatattgcgcacttagaacgcgagcttgataaacgtaatcaatacgcatctttcaaggacaaatttgctgagttgactcaatcaacttgggaaaaggagcgtgacgcctatgacttctatcgagacgaactttcagaagcactcgctcatgccagtgagcaatcattagagtctgccaaagcgtgggttgagcaggttgaaaacaatttcccgctagatatccgaaacttctgtaagtgggttaatgaatacttagatcgcactggggatcgtaaccttcttttcttagtcgatgaagtcggtcagtttatcggtaagaacacacaaatgatgttgaagcttcagaccattactgaagatcttggcacatattgtggtggcagagcttgggtcgttgttacctctcaggcagacattgatgctgccattggtggtatggataagagtgatggcgaggacttctctaaaattcaagggcgttttagtacccgcttacagctgtcgagctcgaatacctcggaagttattcaaaagcgattgttgtccaaaacggaagaagctcgtacatacctcatcgatgtctttgctgaaaagggcgacattcttcgtaaccagctgacatttgataaaacgacaaccgcgtctctaaagggctacaccgacgctccgtctttcgtggacaactatccgtttgtgccttaccactacacgctggttcaaaaagtgtttgagtcaattcgaacaaaaggcgcgacgggtaagcacttagccatgggtgagcgttcattacttgatgctttccaatcagctgcaaaacagatgaaggactctggccttgatgtgttaatcccgttttatagtttctatgcaccgattgaaagctttttggagccagcggttaagcgaacgattgaccaagcctgtgagttggattccttaacagaattcgatggcaagatcctaaaaacgcttttcttgatccgttatgtggacgttgtcaaaagcacactagacaaccttgtgacgctgtcaattgatcgaatcgatgccgataaaattgcgctgcgtaaacaaattgaagagagcttgaatcgtcttgaacgccaattgctgattgcgcgtaatggtgatgagtttatcttcctgaccaacgaagaaaaagagatcgaaaacgagatccgtcacactgacgttgaaatgtcagaggtctcgagcaagctttcagccatcgtatttgacggtattttgaaaggtaatcgtacctatcgatacccgattaataagcaagactttgcggtgagccgtttttgcaatggtcatccaaaagatggcaccacgctggaagacctagtcattaaagtcatttcacctttggattcgcactttgaaaattacgcccacgatcaagcgtgcctcaatcatacgcttgaggctgatgggtgcgtgctcgtcaagctgggcgaacataagcgtctttgggatgagctgacaacctttataaaaactgaccgattcttaaaacaaaattcaggacagcgaccagagcaagaacaccttctccgcgaaaagcagatggaaaatatggagcgtgaaaaacgcttaagaacggattttgaagctttgtttgccgaggctgacgtttacgcgatcggcacaaaactgccgaagaaatcagcaacgccaagtgccatcgtcgaagaagcatacaaatacgttatcgaaaataccttcgctaaattgaacatgctcaaggcaacgcctggtgaagttttgcgtgagctacaggccgttcttgttgctgatgatattgctcagattggactggatcttcaagcggatgaatgtaacccagaagctacgcgtgaggttgagcagtacgtaacgctaaaagtcgagcgtaatgagcctgtttacttacgtgacatcgttgcccacttcggcaagcgcccgtatggctggccagccaatgaaatcttattgctcactgcaaggctgggcttggctggaaagttatcttttagtacccaaggcacagatctggcgttgaaaaaagcttacgagccgtttaccagcgtgcgtaaacgcggtgagatccgtgtacataaaatcaggcaacatgacgagcgccaaatcaaaaaggctgctggtcttgttaaagagatcttttcaaaaacctttaccggctctggtgaaaaggagctctacgaattagtgcgcgatgaattactggcttggaatgaaaagcttaaatcattcagaaccaagtcacagacaggccatttcccaggtaaatctcaaattgacgagggtcttgcattggtcgcgggtattcttgagcaaacttcaagcttcgcccttatcacccgattcttagaagacgctgatgcccttgaagagtttgctgaggactttgaggatcttgatgacttctacaatagccaatttcaaacttggcaagcccttgctggcgcattgaacgagaagtttaaggccaatagacctgcgttagaaaaagacagtgaagcattaaaagcgctcactgaattagaacgcatttacaatatgccctcaccgtatgagcagctgcgccatattaatccgcttatcgagcaggtggcaaaagttaactcaacattggttgaagaaaaacgcactcatgccttagagcgtgttgatctgcgcatcggacgtgtaaaagaagcgctagctgaagctcatgcaccgtctgaattacagaaccaagcactgcgcccgttacaaatgtgcagacagcgcattgaagcaacctcttcaataccacaaattatcagtgagcaaactgaagcggaaggttacgaggacgaagcttatgagttgctgaatggctttatcgaagatcaacgcaaaaaagctgaagctgagcgaagacgtcgtgaactcgaacagcagacacgcgaagaggaagcagcgaaagccggtaaagcagctccagcacctgagccagcctctgaaccagtgcagccacagccggttgcaaaacgtaccgtaacgattaactcaaccgatgccatggctaagtcagtaacaaccggattcattgaaagtgaagccgaagttgatgcctatcttgccgctttaagagagcagctgattgctgcggtcaaagctggcgaccgagtaagaattaagtaa

SEQ ID NO: 479 - DNA, 3642 bp, Bacteroides sp.
atgagtaagataaaagatatactctccattgaattggagaacgacataaagaatgtcatagacttgaattcgcaaaatgaggaagatataaaagacgagcttgatgggtttattcttacggaaagtcttgccaaacatttatctgattttctggatgtattctgttccaatatgaaggaatccggtgtgtggcttagtggtttttatggttctggtaaatcctattttgcaaaaatgataggcttcttgatagccaatcctgttataaaaggaactcccatgcgtgatcggtttatgcctaaactgattgggcttaagaataaggaaatcatagagaatcagatacgttcattggataagacagattatcaggttactctgttcgactgtgcaaaagtcgattccagttatggcatatcttatatggcgatgagccatttcctgttgtctttagggtttctgagtaactggattggaatgatggaattcaacttgatgcttgaaaacaaatatgataagttcttagctacagtaaaggagcagaatgcaggaaaagactggtatgacataagaaaaaagatgtcagcagttacggctcttaaaaaagccattcttactttcatggcagaagatgaatatgaagaaacccgtaaactgattgacgaaagaataaaaacatatgatgctacaaaactgaaggaagatttgagtctttatctggaacattatcaggaaaagaaaatcgtgttctttattgatgaaatgagcgaagctttaagtcagaaaaaaattaatcttctggatttggaaggactttcggaagctttgtcttctcttggaaacagagtatggacagtaggtatcgcacaacaggcctttaatgatgtgctgaatgcatccggactgaatattcatcagctcaataaggtggaagccagattcaagactcgtatccctatagctgccgaagaaattgacactatcatccgtaagcgacttctggctaagactgattcaggaaaagaacagttggagtcttattatgataagaacaacggtatgattcaggatataacccatattgccggtgtttccttgaatgccaccaaagatgagcatacatacgcagattattatccgttctatgagcatcagttcaaactgttacagtatttcctgttcggctcaagagatacggtaacttctcaaatcggtactcgcggtatgttggtttctgtattcgatgtattgaaaaaagaagctatgacagaagcggacgtatttacgcatgttaatgctacgcaactatgccgtcaggcagaggaaaatattccggaagcattgcgtatgcgctatgaacaggcggataaccatatcagtaaagaaggtatgaagtatgtagaaggaagagctttgctgcaaaccattcatttcctggagaaagccaatgcctatactacaatagaaaatatcaccaagtcttatgtccgcagaccggaagactattacagtgtgcttgctgaagtaaagaaagcacttgaaatattggtagagcgtaatgtcttgattacatccggtaatcagtatcgtatcaccagccagatagaacagcagattatcgatgatatgaattcattctctgctgaagtttatcgtgtgcgtgccgagataaccaagatattgaaacaacagaagatcatcaaagtttcgcagacacttacatcggatggacaggcaatacctttttgtgtggaaagctctcttggagagaattttgtaaatgcaggaggaaaatatatgaaagtcagcttctatgatgtctttcatgaagattatgcacagcttgtggcttctgtaaaacaggatacacagagccagaaaggtataataagtatcatcccttcatctgtttacggaacagaaatctttaatcgtgcacaggaacttttgaagatagattatatcgaaaccaagacctatcatacagccgatgagaagaaagtggtaaacaatattgtttctactaaggaagaaaagatgaaattccttactgaattgattaataaatcatacacggaaggaacagcagtctatctgtttaacacctatcagttgactgatgccaattatcagaaagaaatagaatctctccagcgcaagatgttcggaaatattttctataagagactgggtgcgtctttatccgattcattggcagtgaaagtgcttacagcaagcagtacacagctgactaccatgtttggcggttcggaggagttccgtttcttcgattctgccggaaagtttatcggtgagaatttaagtgtgtctacagagattttagagaaatgcaagtcgtactgtactggagataaactggaagaggaactttctgcacctcctacagggtataagttcggaactatccttactgctgtggctgccttattccgtggcaataagttgatagccaagttcaatggcgaagacttccattctgtatcggatgcgcttgaagctaagattttcgacaatacccgtaactttgctaaagcatcgtttaaggctgttatgaaatctttgtcttataatgaccggcaggagattgtagatattctgaaagaggattgccagtacaagaagattaccggagaaaatgctccttcttataatttgaacgattttgagctggtcgattgcatccgtacactttccaaacgcatgatggataaggtaaaggacaaaatcatgggcgatgatgaaatggaacttctgttcaaacgttctgttcaggcacgtaatgtattcagtcaatatacagctgccgtaacagaagccaattatatagctacggcacgtacattccttcaggaagcggatgattatatcaaggcggtagaacaggtacagaaggatttgaagttcatagactctgaatttaaggctattgaagaggagcgcgcttttattcaaaatgtgacggaggaattcgacaagacagaaaatgacatgaacctgattcgtggcaaaaaggaacagtttgaagaagcacgtgaaaaggatttggtggctaatgctccattaatgaaaaaactgactcaggacattaaggatatttattacgaggtaatgaagcataaagccgaattattgagtgaagaagttatagctttattaaccatgacagatgaactgaagagtcagatagaccaatatcctaaggaatggaattccagactctatcgcaagattgaagaattggaaaaatcatggaaacgatatgcaactattcacgtaaatctgaaagaatggagtgtaaagtgtagcaatacaggcatgttgttgcgtgacattgaatacaagattacgaatctgagtatggtcaagcaggaagtcagtttgtgggatacagagattataactcaagatcctgcacccaaaaaaactgatattcctaagtcgcctgatgctccgattccggaagataagccggcaccacaacccaaaccaatacagcgcaatatgaaagcgaagttaccgaagggtaccgcttctgtagctgaatacaggtcttggctgaaacagcagttggcgatgctgaatatgtttggtgaggatgatattttgaattttgataattaa

SEQ ID NO: 480 - DNA, 3642 bp, Salmonella enterica; identical to SEQ ID NO: 8

SEQ ID NO: 481 - DNA, 3672 bp, Pseudomonas fuscovaginae
gtgagcattcaagacatcttctccaaggagctcgaccgccccatcaatggtgtggtcaaagcggaccagtctgacgacgccaccgtgtaccaagaactcgacgagtatgtggttaccaacgagctggagaagcattttcgcagcttcttcgagtcctatggcaccgacctgacggatccttccatcgccaaccgcgtaggcgtctggatcagcggctttttcggctcgggtaagtcgcacttcctgaaaaccctgtcctacctgctggccaacatcagggctcgggatgcccagggcaacacccgcaacgctgttaccttcttcgatgtcaacaagctgcgcgatgcgatgattcgcgcagatatcgataaggctgtcgccaatagcgccgatgtcatcctgttcaacatcgacagcaaggcgagttccaacgacgccggcaacccgattctcaatgtctttctgcgcgttttcaacgagcatcagggattcagcggcgaccacccacacatcgcccatatggagcgccacctaacccagcgtggcgtctatgaacgctttgttgacgtcttcaacgaatctaccggtttggtctgggccgaagagcgcgacggctaccagttctatcaggacgatatcgagaaagccctggcgcaggtgttggccctatccgccgaagcggcacacaagtggttcgaggagtccgagcagactttcagcgtctcggttgagaacttctgccattgggtgcgcgagtacctcgatgccaagccggccaagcaccgtgttctgttcctggtggacgaggtcggtcagttcattggaagcgatacccgtctgatgctgaccctgcagaccatcaccgaaaacctcggtaccatctgtaagggtcgcgcatggatcatcgtcacctcccaggccgacatggatgcggtgctcggtgagctctcagcctccaaggccaacgatttctccaagattgccgggcgcttcaagacacgcctgtcgctgtctagctccaacaccgacgaagtgatccagaagcgcctgctgcgcaaaacggcggaggccgaaacccagttacgcgctctgtgggggcagaagggcgacattctgcgcaaccagatcaccttcgaccgttccggcccgacgctgcgtagttacgacggcccggagagcttcatcgccaactacccctttgcgccttaccacttccaattggtgcagaaagtcttcgaggaaatccgcaaggtcggtgccactggcgcgcatctggcctacggtgagcgctctatgctcgatgccttccagatggcagccttgtctattgccaacaaagagattggcgctttggtgcctctgcactctttctaccgtgcggtggaaggcttcctcgacacagccgtcaagcgcactatcgaccaggccggcgaaaacaccgtactcgataccttcgatgtacagatcctgcgcaccctgttcatgattcgctatgtcgatctgatcaagggcacgctggacaacctcgtcaccctgtccatcgagcaggtcgacgaagacaagctcgccctgcgccgccgtatcgaagaaaccctacagcgcctggagaaagagagcctgatcacccgtaacggtgaagagttcgtcttcctcaccaacgaggagcgcgatatcacccgcaagatcaaggccactgaaattgcctcgtccgatgagaacaaggctctcgctgatctgatctacaaggacttgctcaaggacaagaacaagttccgctatagcatcaacaagaccgactacagtatcggtcgctacctcgatggccatagcctggaaggccgctatgagcatgacctgcgcgtcgaggtgatctcgccgctggatctcgattacgccctttacggtgaagctggctgcatcaacaagagcaacgaagcgcccactggcatggcgctgttcaagctgccggacaacaaggagtttttcaccgagctacgcacctggctgaagaccaacaagttcattcgcctcaatgacgatggcagccagcctgagctgagcaaaatcctcgccgaccgtggccgggagaaccaggagcgcaagaagcgtctgcgcctgatgctcgaagagctgatcgagcgcaccgaagtctacgcactcggccagcacctcaaactgtccggcagcaacattcaaagcaagttcgacgaggcctgccaatacctgctggagaatacctacaccaagctgggttacctgaaggtgttgcagcaggagcccgagcgggagctccataccatcctgcacgcagacgacattggccaactgggcctgaccctcgacggcgaggaaggcaatccgcaggcgatcaaggaagtcgagcagttcatcaccctgcgcgcctctggaaatgaccggttgctggtggctgacatcatcgagcgcttcagcaagcggccctatggctggccggatggcgagatcctgctgatcctcggccgtctggccgcgaccagtcgcatcacctttcatgctgctggtcccagcctgccgctgccggatgccttcgactacctaagcaacagccgcaagcgccgtgaaatctcagtgcagaaaatgcgccagaccgatgaagtgttgctcaagcaggtacgcaaccttagtcaggacttgttcaacgccctcggccctgctggcgagaaggagttgttcgagtattaccggggacatttcaagacctggctgggcaacctcaataactacaagagcaagaccgatgtgggtcgcttccctggcaaagaggtgatcgagcaggctctgctcagtctgcagcgcctcttaagcaacaccgatagcgtcgacttcttcaaggccgtggtcgacaacaaggacgactacctggatctggaggaggactaccgcgatctccacgagttcttcgccaaccagttgcacatctggcagcagttgcagcaagccttgcgtcgcttcgacaagaataagtcagccttggaaaaggacgacaaggcccgcacggccctgcttgagctgcaaaccatcgagaaaaacgtcgcaccctataaccagctaaacaaggtagccggcttggtggaagcggtggaagcgatcaacgccgccatcctcaccgagaagtgcgaacatgccctggcacatgtcgacgagaagattgctcagttgcagactgaaatcgccaagagcggtatcgaaagtgcggagctgagcaaccgcctgctgcgcccgcttcagttggtcaaggcggatctggagaccgaaaccagcatcgccaatatctacctgctgcaaacccaaacggccgacgagcgcctgcacgacggtgtgttcgagctggagcgtgctatccaggccgaagccgaacgccagcaaaagctccagcaggagcaggtcaaggtcgcgcaggccgccaatgcggcctgcggcgtcaaggaagacagcgcgccttccctaacgccaacacctaaaccggttgcaccgcccaagccggtggtcgaggtggccgccaccagcgtattcaacaagctcggcaacggcctgtatctagaaaatcaaagcgatatcgagcgttttatcgacgccctcaaggcggagctggaaagcgccattaagcaagacaagcgaattcgtatccgctga

SEQ ID NO: 482 - DNA, 3561 bp, Lachnospiraceae bacterium
gtggcacaggagttggaagagtatgtggtaacaaaagagctgcaaaagcattttgcggatttttttgccgcctacaaaaagggtattgaaggtatgacaccgaagatgggtgtatggatttcaggtttcttcggaagcggtaaatctcactttctaaagattttatcctatcttttggacaataagtctgtgggaaacaagcacgcctatgactattttgtggacgataaaaagataacggatgaaaaaatactttcagatatgaggcttgcagcttccactccttcagatgttatcctctttaacattgattcaaagagtgagtcaagcggaaagcaaaataaggatgccatagtcaatgtatttttgaaggtctttaatgaaatgcagggattttgcggctcaatgccttatttggccgaccttgaaagaaagcttaacgatgacggaaagtttgaagaatttaaaaaaagctttgaaaatgagtatggagagacttgggaagaatcacgctcagactttgattttattcaagatagtgtagtggatgcgcttgcagatatcagttttatgagtgaggatgcggcaagaaactggtgcgagaaggcaaccacaagctatactataagtattgaagactttgcaaagagagtaagaagctatattgataaaaagggaaacaaccaccatgtagtattccttgtggatgagataggacagtacataggagacgactcaaagcttatgctcaatcttcagacagttaccgaggagcttggcaaggaatgtatgggtaaggcatgggtgattgtcacatcacaacaggatatagattctataaccaaggtaaagggaaacgatttttcaaaaattcagggacgttttgataccagactttcactttcaagtgcaaatgttgacgccgttatcaaaaagagaatacttgataagactgaaacggcagccgaaaccctcagacttttgtatgagcaaaaggcgacagtaatcaaaaacttgattgtattcaatgacggcgttgagaaaaaactctatgcaaatgaaaatgattttaaggaagtctacccttttgtgtcttatcagttcaatctgcttgcaagtgtgctgacatctatacgtacacatggagcttcaggcaagcacctttcggaaggtgagcgttcaatgcttgctttatttaaggagtccgcaaccgaatgtaaggatgatgaggtgggaatacttgtgcctttccatcgcttctatgatgcacttgaaaacttccttgaccacagtcataagggagttatatcaaaggcgtacgacaatacggcaatcaatcctttaaataaggacggagatgtatttacaatcaatgttttaaagactctttttatgataaagtatgtagatcagattgagtcaaatatcgacaatatcacaagcttgatggttgaaaatatagatgatgacagaatagagttaaaatcaagggtggaagaggcgctgaaggtcttgataagccaaatgcttatacaaaaaaacggtagtctatacatatttttgacggatgaagaacaggaaatcaacaatgagattgcaaaagaaaatgttgagatgtccgaggtcatcacaaagataggtgagatgatatatgaggatattttaaaagaaaacaagtacagatatccgtcatttaacggcagatactcattcggttttaatcaaaatattgatgaccgtccgtataagtccaaccagaacttcgatatagggcttcgtatacttacaccttggtatgatgtcaaagaagatgccacactgcgtatgatgtccggacagggcagagaagtcatagtactgctgccggatgacgacgagtttttgaacgagatgacgatgagccttagaatagagcgtttcttaagaaaaaatgccacatcgggacagcttgcaaagtatgagaatatcaaaaagagtaagcatgacgagatgaatgagagaaatgccaatgcaaggctttatcttgtggagtcgctaaaggatgcaagatattatgtcaacggagatattgcaaggctttcagctaaggaagtgagtacaaaggtgaatgaggcaataggacgtctagtgcagatagtattccacaagctctcttatatagataccgctatgggcgaggccgacataagaaaactctttaataccggcaatcagatgaagataaacggaggtaccgtagcaaatatccatgcgacggaggatgtgttaagctttatctctatgaattcaaaaggccatatgaagacttccatgaagactgtaaaagatcgttttatgaaagctccttacggatttgtggaggatgatatatattggataattgcatatttattcaaagtcggagatattgcattcacattaaacggtacgtcagtaaatcttaacaataagagtgtggatgagataataaactatatcacaaagaaggcctttacagaaaagctgcttatggaagagcgtgttcgagtaagtgaaaaggataaaaaagaagtccgtgatgtgatgaaggaggtattccatactcctatagtgcctgatgatgaggatgccatgatggcggatttcaagaggcacgcaaatgatatgataaatgagttgaaggacattgaaataaattatattaagtataattatccgggaaaaaaggtcatagatgacggtaagagattatttcagtctgcaattcagataaatgatgcattggaatttttcggtcatatctcaaagatgagagattttttctatgattttgatgaagactatgagcctgtaaaagcattctttaaaggcggtcaaaaggagatattcagccgtgctatagataagcttagaatttatgatgacagcaagacctatatagtggatacacttgaggacaccgtaaaaaagatgcgtgacattttgaagatgagtatgccgtataaggaaatccacaaattgcctgagcttatggagcaataccaagatgcgtataacaaggtgctggatgaagagttgcaccctatatgtgagtctgtcaaggagtgcaggacatatatatcggatactttaaatgaaaaagagtatgcaaatgaaaaaagacaaaagtatcttgcaggttttgatgagttgttaaacgaagctgagagttccaccaatgtatcaactcttagaggtcttgaagataaagcaaaagctttgatgacacgtctgttgggtgagatggatatgcttgatgagcagattgcaaaaaagaagcaggctgagatagagcaaagtctgaaagaaaaggccggacagatgggcattgatgtcgatgacgatcaagtaaaaaagagtattgaagagcaaagtaagcagtacaaagtcaaaaagaccaagaacatcccgataaagaagatgacaggtacaatgctttggaggcttgagagcaaggaggatatcgacaggtacttatcatctctgcgtgaaaggatgttaaaagagcttgaagaggatactgttataaatatacaactataa

SEQ ID NO: 483 - DNA, 3690 bp, Vibrio cholerae; identical to SEQ ID NO: 123

SEQ ID NO: 484 - DNA, 3669 bp, Roseburia inulinivorans; identical to SEQ ID NO: 326

SEQ ID NO: 485 - DNA, 3642 bp, Salmonella enterica
atgaatattgaacagatctttgagaaacgtctggaccgaaatattaatggcgttgtgaaagccgaacagacggacgatgccagtgcctggattgagcttgatgaatacgtcatcacccgggaactggaagggcatcttcgccacttctttgaatcttatgttccggcaaccggtccggagcgcatacgcatggaaaacaaaattggcgtatgggtgtcagggttctttggctcaggtaaatcacactttatcaagattctgtcgtatctgttgtctaaccgcaaagtcagccataacggtacagaacgtcatgcttactccttctttgaagacaaaatcaaagatgctctgttcctcgctgatatcaacaaagcggtccatcatccgacggaagtgattctgttcaatattgattctcgtgctaacgtcgatgacaaagaagacgccatccttaaagtcttcctgaaggtatttaacgaacgggttggctactgtgctgattttccgcacatcgcccatctggagcgtgagctggctaaacgcggccaatacgacgcgtttaagaccgcattcgccactatcactgactcaagctgggaaaaagagcgcgattcctactatttcatcagcgatgaaatggcagaagccctaagccaggccaccggtcaaagcgttgacgcttcgcgtcaatgggtggaacagctggataagaatttcccattagatatcaataatttttgccagtgggtcaaagagtggctggatgaaaacggcaaaaatatcctcttcatggtggatgaagtcggccagttcatcggtaaaaatacgcagatgatgttgaagctgcagactatcactgaaaacctgggggttatctgtggtggacgcgcatgggttattgttacctcccaggcggatattaatgcggccattggtgggatgagcagccgtgacggacaggacttctctaaaattcagggccgtttctctacccgtttgcagctttcaagctccaacacctccgaagttatccaaaaacgtttgctggtgaaaaccgatgccgcaaaacccgcgctggcgaaagtctggcaggaaaaaggcgacattctacgtaaccagcttgcttttgatcccacaaccaccgcttctttgcgcccctacaccagcgaagaagaatttattgataactacccgtttgtcccgtggcactaccagattctgcagaaggtttttgagtctatccggaccaaaggtgccgccggtaaacagttagccatgggtgaacgctcacagttagaagccttccagactgcggcacagcagatctccccgcagggtctggattctctggttcccttctggcgtttctatgccgcgattgagagcttcctggaaccggccgtcagccgtaccattacacaagcttgccagaatggcattcttgatgagttcgatggcaacttactgaaaacgctgttcctgatccgctacgtcgatgtgctgaaaagtacattagataacctggttaccctttcgatagacaaaatcgataccgataaagtcgaactacgccgtcgcgttgaaaaaagcctgaataagctggaacgagaaatgttgattgcacgtgttgaagacaaatacgtgtttctgaccaacgaagaaaaagagatcgagaacgagatccgtaacgtcgaagtcgacttctccgcgatcaacaagaaactggcatcgatcatctttgatgacattctgaaaaaccggaagtatcgctatccggcgaataagcaggacttcgacattagccgcttcctgaacgggcacccgttagacggcgcgatgcttaacgatctggtagtgaagatccttacgccaaaagatccgacctatgaattctatagcaacgatgctgcctgtcgcccctatacctcagaaggggacggatgcattttaattcgtctacctgctgatgcacgcacctggactgacattgatttggtcgttcagactgaaaaattcctcagagacaacgccgggcagcgcccggaacaggccagcttgctttcagaaaaagctaaagagaacagcgttcgcgagaaaatgcttcgcgtacagctggagtcgcttattgccgaagctgacgtctgggcgatcggcgagcgtttaccgaagaaatcgtcgacgccatccagcattgtggatgaagcctgccgttacgtgattgaaaacacgtttgccaagctgaaaacgctgcgtccgttcaacggcgatatcgcacgtgaaatccatgcgctactgacggtggagaacgatgcggagctggatctgggcgaactggaggaatccaaccccgacgcaatgcgtgaagtggaaagctgggtcagcatgaatatcgaattcaataagccggtttatttacgcgatattctgaaccattttgcccgccgtccttatggatggccggaagaagaagtgaagctgctggttgctcgcctggcgcgcaaaggcaaattcagcttcagccagcagaataacaatatcgagcgtaagcaggtgtgggagctgtttaataacagccgtcgccacagcgagctgcgtctgcacaaaattcgccgtcacgacgaatcacaaattcgcaaagccgcacaaactatggcggaaattgcccaacagccgtttagcgaacgtgaagaaccgcccttggttgaacatatccgccaggtcttcaatgactggaagcaagagctgaatgtcttcaaagcgaaagcggaaggtggaaacaatccaggtaaagatgagattgagtcaggcctgcgcctgctgaattccattctgagtgaaaaagaagattttgccctgattgagaaagtcaccagccaggccaatgagcttctggatttcagtgaagatcgtgaagatttggtcgatttctaccgcaagcagtttgcaacctggcaaaaactaggcgcggcgctgaacggcagctttaaatccaaccgcagcgcgctggaaaaagacgccgtggcggtaaaagcgctgggcgagctggaaaacatctggcagatgtcggagccttataaacatctcaatcgcatcacaccgctgattgaacaggttcagagcgtcaaccacctgttagtcgagcagcaccgccagcacgccctggaacgcattgacgcccgcattgaggagagccgtcaacgcttgcaggaagcgcatgccacatcggagctgcaaaacagcgttctgctgccgatgcaaaaagccagaaaacgtgccgaagtcagccagtcaattccggaaattctggcggaacagcaagagacaatggcgctgcaaacggatgccgagaagaagattaaccagtggatcgacgagctgcgtaaaaagcaggaagcccagctacgggcagcgaatgaagctaaacgcgcggccgagtcacaacagacttatgttgtggtagagaaacccgttatccaaccggtaccgaaaaaaacgcatctggtgaatgtcgccagcgagatgcgcaaagccaccggtggtgaagtgctggaaaccgccgaacaggtggaaaaagcgctggatacgcttcgtacttcgctgctggcagccattgaggcaggtgaccggattcgccttcagtaa

SEQ ID NO: 486 - DNA, 3642 bp, Acidovorax sp.
atgatcattcgcgacctgttccaaaagcccatcgaccgccccatcaacggcgtcatcaaagccgaccagatggacgcagccagcgtgtggcaagagctggaggaatacgtcgtcaccaaacagatcagcgaatacctgcgcagattctttgacgcctatctggccgccatcgaccggccgcacgacgcggccatcactgaccgcatgggcgtctgggtcagcgggttctttggctcgggcaaatcgcacttcatcaagatactgtcgtacctgctggaaaacctgcaggcgcaaaaccccgaaacgggagaaaagcgcagcgccgcccagttcttcgatcaccacaagatcaaagacgccatgctgcaggccgacattcaacgggccgttcaaggcaccgcagatgtgatcctgttcaacatcgacgccaaggctgacagcaaaacagaccgcgacgccatcctgcaagtcttcctgcgcgtcttcaacgagaagctgggctactcgggcgacgctccgcatatcgccgacatggagcgccacctggtttccaagggagcgttggatgccttcaaagctgcctttgccgcatccaacggcagtacctgggagcaagagcgcgatgcggtagattttttgcgggatgacatcgtggcagcgctggcccaagccctcaagatgacgcccgagtctgctggccagtggtttgaccgtgcgcgcgatgactttcgcatcaacatcgaaaactttgctaaggtcgtcaacgactacctggtcacccggcccgcaagtcacaaagtcatcttcctggtcgatgaggttgggcaattcattggcgccaactcgcagctcatgctcagcctgcaaaccatcaccgagcagctgggcacgcagtgcaagggccgcgcctgggtcatcgtcaccagccaggaggacattgacgcagccattggcgaagccaacaaggccaagtcgcaagacttttccaagattcaagggcgttttcatacacggctgtctctggccagcagcaacaccgacgaagtgattggcgagcgcctgctctccaagaccgaagcagcccatgtattgctgcgcgatgcctttgccagcaagggcgacgtcatcaacaaccagctcagctttgtcggcaatgccgtcagcctgcgcggctacaaagacgctgccgagtttgttgcctgctacccctttgcgccgtaccagttcacgctgctgcaaaagatcttcgaaaccatccgcaaagtgggcgccaccggcaagcacctctcgcgcggtgaacgctcgttgctcgacgccttccagtcggctgccgtgcgcaacgcccccaatggcatcaacgtgctggtgccgctgtacgacttctatccgtccatcgaaagcttcatcgacggcatggccaagcgctccatcgacgaggcaccgctcaacccagccctgcagccttacgacagccagctgctcaaggcgatgttcctgattcgctacatccccgacatcgtcaagcccaacatcgacaacctggccacgctgtgcattgaccagatcgacgccgataagctcgcactcaagcgccagatccaggaaagcttggcacggcttgaacagcaacgcctggtcagccgcaacggtgaccagtggttctttctgaccaatgaagagcgcgacgtcgcccgcgagattggccatgtagacgtttccgccgcagaaaaggcacgcctgctcgccgaaatcgtgttcgatgaaatcctgggcagccagaccaaggtgcgccaccgcgataccaagtccgactacgaattcaaccgcctgctcgacggcgcgccctggcgccaggccagccacgccctcagctttgaagtgctcaccccgctgggcgacgactacgacaaactgcacagcgccaaatgcatcctgcgcagcagcgaaggcgccgggcgtgccctcgtgcgcttggctgagggcgagcgcctggacatcgaactggccacctaccagcaaatcgaaaagtacatcgtcagccccaaggccgaccaggccacgccatcgctcaaacgcatcttggccgaccgcaaggatgaaaaccgcgaacgccgccagcgcctcgtgcaccagttgtctgagctcatcaccgcaggcgacttctacgccctgggccagccggtgcaaatcaaggccagcagcccggccaccgtgctcgatgagctgctcaactacctcatcaccaacacctacagcaagctgccgtacctgaaggtgcgacaggccgaccccattgccgaaatcaaggctgtgctcagcgctggcgacctggcccagcacgccctggcccttaatggtgaggcaggcaacccgctagccgtacaagagctgcgcgattacctccagctggctgccagccaatcccgcgtgctgctgtccgacgtggtggaccgctttgctggcatcccctggggctggaagcccgagtgggaaacggtgctgctcgtcgcccgtctgttcatggcaggcgagatcaagctcatgctcgaaggcagcgacctcgaccccgccagcgccgctgacccgctcaccaaatccgcccgcttcaagcaagtctccatcctcaagcgcaaaaccgccgacgccacaatcctgcgccgtgcgcgcgagctgtacaaagacctgttcagccaactcggccgtgaagacgaagacagcctggtggccgactaccgcacccgcctaggcgactggcagtcagaccttaaaagctacgcccacaccgcagccaccccccaccatccgggcaaggccactattgacgcagccctggcccgcatcggccagcagctcgccatccgcgacagctttgcctttatcgaggcactgctctccgccaaggacgactggcaagacgcatctgacgacatccacgacctcgtcaacttctacaaaacccagatcaccgcctggcgcaagctgctagccgctctcagccagtttgccgacaaccgcgaagccctgaacaaggtgccccaggcggcaacggcactggcagagctgacccagatccgcgacaacccccagccttacgccttggtcaaccgcatcgaaccgttggtggccacggtcacatccgttaacgagcaactggcgcaggaaaagcgagaaaaagccctgctttccatcgacgacaagctggccgaggtacaaaaacagctcgctgcttctgccgctacgcccgagctttccaacaaggtcctcaaacccttgcaagacctcaaggcgcggattgcgggcctcaccggcattgcgcaaatcctgtacctgcaaagccaaggcggcgacgccatggacgaagcaatcaccctcatcgaagccgccgtggccgctgctgccgccaagcccaccacgaccaaggtggccagccccggcgataccacccagcccctgcaaaccggcaagcccaacgctttggtaagtccagcaccggcccccaaaacaacccgcgtggtgcgcgctgccgagttctctaaccagccttatttggaaaccgaagctgaggtggatgcctacctcacccggctcaagtccgaactcttggccgtagtgcgggctgggcaaaaagcgcgcgtgcagtaa

SEQ ID NO: 487 - DNA, 3444 bp, Desulfonatronospira thiodismutans
atgctcaatcgccaggtctattttaaggatccttccacctggtcgttggtcaaccagggagtagccaaggttgacgaggataccactccagatgcgctgaaagttctgcgctacgagatggaaacctttgtctgcgacgggcagtacgaaaagggtctggagcagattctgcattcctatctgcgaaatattgaccagggtgctccggaacagccaggagtctggatcagtggttttttcggctgcggcaaatctcacctggtcaaaatcctcaaatccctctggaccgatactgtttttcctgatggagccactgccagaggcatagccaggctgccggattctatacgcactcacctgaaagaattaaatgttcagggcaaaagacaaggaggcctgcatgctgcatcgggcaccctgggcgctggtgcaagaggcagtgtccgcctggctttgctgcgaatcatcttcaagtctgtgggactgcccccaaaatatccggtagccagtttcgtcatctggctcaaacgggaagggatttatgaccaggtccgttccatagttgaagaggaaggccacaactgggatgaagaactggacaatttttatgtggctgaaggtctgcatcaggcccttaccagagtcaagccgcaccattttccgtccccctcttcctgcgtggaaaccttgattaatcttttccctaatgttgaggacatctccaatgacgatatgctcaagaccatcagcaaggctttgaccagggaaaagaagtttccgctgacccttgtcgtcctggacgagattcagcagtttatcggagacagcagtcaacgctccatggaagtacaggaagtggtcgagtcctgctgcaagggtataggcggcaagcttttattcataggaaccggccagacagcaataaccggcacaaccaaccttaaaaaactggaagggcggtttaccatcagggttgaactgtctgatgcagacgtggaaaccgttatacgccagactgtcctggccaaggactccaatgccattccggtgatagagcaggctatgcacaaaaaccttggcgagatttccagacacctgtccggtactgccatagggcacatgcatgaagacatcgatgctctgaccaaagactaccctatccttcctgttagacgccgcttctgggaaaatacgctcagggtactggatcaaaccggcaccgacagtcagctgcgcaaccagctgagcatgatacataaagccattcagaccaacctggaccaccccttaggcaatgtcattccggcggattatctcttttttgatgccgctgaaaggcttcttcaggccaggattctgccgcgcaaggtgcatgaaaaaataatgcgctggcacagcggcaatgatgatgagaggctgaccgcgcgggcctgcggccttatcttcctgttgaacaaattaactgctgccaatcaggcactgggcatcaaaagcgaaccagacacactggctgacctgcttgtcgaagatatagcccagggcagcggcgggttgcgcagcagactccccggactccttgatgattgcagcctgctcatgaaggtgggccaggagtatcgcatccagaccgaggaaagcgctgcctggaatgatgagtttcagaatcagttccaccagctggccaacgaaactcatcgtgtggaagccgaaagagaagatcgcatccggcgcaaatttggggagattactggacggctttccctgctgcacggcagttccaaggttgcccgcaatattcatccggtatttgagccttccttgcctgctgactgtgcccagagaatctgtctctggatcaggcacggatgggaaaccgatgaaaactccatcagggccgaggccagggaggctggaaacaagtcaccgaccatctttgtctttatacccaagcgctccgccgatgacctgagaaggaaccttctaagctgcaaggctgctgcagccaccctggacaaacggggcaacccaggtacatcagagggcatagaagccagagcagccataaagacaattatggacaacagtgaaataaggatcaacgagcttctggatgatgccttttccggagccagggtttttcaggccgggggtacggaaatacttggcggcaatttacaggaaatgattattgaagctgccgaaaacagcctgaaaagactttacccccagtttgatctggctgaccacaccgggtgggaaaaggtctattccaacgccggtaagggttcacccgatgccctcaaagccgtggggtttgagggcgaacctgccaccaatccggtatgcaaggccatacttggatacatagccggaggtaagcggggagcagagatcagaaaccgttttgagtctccggaatacggctggcccagggatgctgtggacggcggcctgcaggtgctcctggtggccggcctggtccgggctgaagatgaacggggcaatactgtccaccccagggaactggagcgaaaagccatcggcaaggctgttttcaaggtggaatcagccactgtgaccacgccccagcgtatccagatacgaaagctctttcaaaagatgggcatcagctcgaaaccgggagaagagctctcccacgtacccgaatttctgcagaaactaagtgaactggccagctcagccggaggcgaacctcccatgcccgagcccccggacacctctttcctggaagatatccgcctctcttcaggcaatgaacagctcctggccatttataatctcagggacgagctgagcaggcacattgacacctggtcagacctctcccagggtatttcccggcgcatgccccagtggagggttctcaaaaacctgtcccattatgcgcatcccgttgaggatgcagagataattctcactcaggtccaggcagtggagcagaacaggcagctcctggaagagccggacctggtggaacccctcatctccagtctgacccaggttttgcgccaggaactgaacaggctgaaacaggcatgggatcaggaatgggaaaagggtgaggcccggctggaaaaagatgaaaactggcacaggctcgcccgcgaacagcgccacgagctgcgcaatcagcaaggacttgtggaagcgtccatcccctctattcagttagacagcaccgattccatcctgaatacattgaacacagcaggcatatcagccttgaaagaccgcattgccgccatgcctggacgatacagtcagatgctgatggaggcggccaggatgctggagccggaggttcaagaggttgccttgccttcttctatcctcaagacagaacaggacgtggacgagtggctgacccaggccaggaaaaaactgttggagcaattaaaaagcggaccggtaattccggggtaa

SEQ ID NO: 488 - DNA, 3645 bp, Oribacterium sp.; identical to SEQ ID NO: 248

SEQ ID NO: 489 - DNA, 3627 bp, Magnetospirillum sp.
atgctgatcaaggaactcttcgagaagcccatcgaccgccccatcaacggcgtcatcaaggctgaccagatcgatgacgggtcgaagtggcaggaactcgatgagtatgtgatcacccgcgaactcgacaaccatctgaggaaattcttcgattcctacctgcggtctatcgacgcttccggtgatcccgagacggctggcaaggtcggagtgtgggtgtcgggtttcttcggctcgggcaaatcgcactttctcaaggtgctgtcctacctgctggaaaacaacacggtcagcatgggtggagaaaccaagcgggccgtggactttttcgacggcaaaatccatgacgccatgctggctgccgacatcaagcgtgcggtcgcagccgaaaccgatgtcatcctcttcaacatcgattcaaaggcggacaccggcaacgacgacccgatcctgacggtgtttaccaacgtcttcaatgaacggctcggctacagccccgaccaccctcacattgccaatctggaacgtcatctcggtgccaagggcaagctggacgaattcaagaaggtctatcgagaaatcgctggcggcgaatgggtcgatgaacgggatgcctttttcctgaattccgacagcatcaagaccgcactggcacgggtgctgggtcagtccgaggattctttcgaaaagtggctcgataaccccgaggtcgccgtcaatctttccccagacaatttcgccgcctgggtgaagcagtatctcgattccaaaggaccgaagcaccgcgtcgtgttcttggtcgatgagatcggacagttcatcgggcaagacacccacatgatgctgcggctccagaccatcacagaaaatctcggcacagtctgcggcggacgggcttgggtgatcgtcacctcgcaggaggatatcgacgcggttctgggcgaaatgcgatccgccaagagcaacgacttctcgaagattcaagggcggttcaagacgcggctatcgctgtccagtgccgacgtgcatgaggtgatccaggctcgcttgctggacaagacggcgaatgcacgggatgccctggttggcgtctataaggacaaggctgacatcctcaaaaaccaactcagcttcaccaacgttggcatgaccttcaagccgttcgccaacgacgatcacttcgccaaggtctacccgttcgccccctaccagttccaattggtacagaagatttttgaggcgatccgccgcgttggtgccaccggtctgcaccttgccaaaggtgaaaggtcgatgctcgacgcttttcagaccgccgccaaggatttgtcgtccgccaatgtcggggttctggctccgctctaccttttctacccatccatcgagagtttcctcgataccaccgtgaaggtgaccatcgatcaggcaggtgataacgcctcgctggaaccattcgacaatctggttctgcggacgctgtttctcatccgctacgtcgaggagattaaggggaacgtcgataacctcgtgaccctattcatcgaccggatcgacgctgaccgtctggcgatcaagaaacagatcgaagcgagcctccaacggctcgaacgggaaaccctcgttcgtcggaatggcgaagactatttcttcctgaccgacgaagagaaggacatcggtcgcggcatcaagggcatcgacctgcatggcggtgaggaggtcaaggaactcggcaggatgatctttgaggatgtcctgggcggaaaccgaaagcaccgcttcgaggacaccaagaaggacttcctgttcaaccgcttctgcgatcagcacccctatggcaccaggactgacgatgatctggcggtgtcggcaatcacaccactgtccgaggactacgacgattggaacgaagctcgttgcctgatgaaatccaacgaaaacggcgggcaggtcatcgtcaagctacccgccgaccgcaagctggggcaggaactgcggacatacctgcaaacggataagttcgtcgcccgcaccaataatggcgggctacccgccagcacggtgagaattctccaagatcgagccgccgagaaccgcaaacgcctggacaatctgaccgtccatcttggcgaattgctgaagaatgccgaattctatgccgctggcagcaaggtggcggtgaagggcggctcaggggatgcggcgatccgccagtccatggactatctgatccgcaacaccttcaccaaactgggtttcctcaagcacatcattcaggaccagaccgctctcctgaacgagatcaaggcggtcctgaacgcccccgataccgccgaccagaagctgaagttggaaggcgacgaggggaatgcccaggcactcaaggaggtgctggcgttcgtcagtttgatggacagcaccagcaagagggtggttctgcacgacctcatcgaaagcaggttcggcaagcgtccctacggatggccggaatgggaggtgctgcggctggttgcccgattggtcgcggctggtgaactgagcctgtccatggacggtgccttgctgacccgtgacaagatttttgaagtggtgaagacgcccaacaagtggcggagcatcgtggtgatcaagcggcagacggtcgatgcctccctgctccagcaagctcggaaccttggaaagaacgtctttgccaagatgggaccggatggcgaggacgccctctacgaattccttcgcgagcaatgcgaaagctggcagaccaatctcagcggctatctcaaactggcggaaacaggcaattaccctggcaaagacgccattgatatcgggctgaaactgctgaagctgatcctgaccgagaaggacagctatggcttcatcaagcggttcgtcacactgaaggtggagttcgagaacctatccgacaacgtgagcgacctggacaccttctacggcacccagcaaccgacctgggaattgctgcggaaaaagcacggtgaattcatcgtcaaccgcaaggaacttgaccacaaccaagatgctgccgccgccttgcagcagatggaagttattctggctcacgtcgccccatacccgttgatcaaggatatcagcggattggtcagcaaggtcgccgccatcaatgacgaggtggtgaataagcgtcgtagccatgccctggggcagattgatcagcatgtttccgaggtgaaggacgccctggatcacatcgcggcatcgccggaactcaggaacaagtgcctgatcgaacttcaaaaacttcggctgaccgccgagaagcagaccagcatcgcccacattcatcaggcggtcgctgaagccgtcgatgccaaggatgacgcactggatgtcatcgcccgatatgtgccgccgaagccacctgccgatcccgtgacgccagcaggtggtgatacgacggttgccgttgctaccaagcccaaggtggtggcaccgcagcccgtcttcaaaaagccccgtgttgttcgacccgctgaaatgaaatcgggctacctgaagactcaagccgacgtggatgccttcctgggaaaactgcggaaggaactcgaagccgccctagccgccgaagaacccattgaaattcgctga

SEQ ID NO: 490 - DNA, 3642 bp, Escherichia coli; identical to SEQ ID NO: 56

SEQ ID NO: 491 - DNA, 3456 bp, Vibrio cholerae; identical to SEQ ID NO: 239

SEQ ID NO: 492 - DNA, 3681 bp, Acinetobacter baumannii
atgaacattaaagaactgttttacaagccattagatcgtgcgattaacggggtcgtaaaagcagaccagaatgacaataccacggtttatcaggaactcgatgagtatgtggtcaccaatgaactggaaaagcattttcgtgactttttccagtcttatggcacagacctaagcgatccttcgattgccaaccgagtcggcgtgtggatttcgggattctttggttcaggtaaatcacatttcctgaaaaccttgtcgtatattctggccaataaagtggcacgcgatgcggaaggtaacgaacgtagtgctgcagaattctttgatgaaactaaaatccgcgatgcatttatccgtgccgatattggcaaggcggtcagccatcatgccgatgtcatcctgtttaacatcgacagtaaagccagctccaatgatgatggcaatccgatcctgaatgtgtttttacgtgtgtttaacgagtatcagggttttagcgcggatcatccacatattgcccatatggaacgtcacctgagccagaaaggggtctacgaacgctttaaacaggcgtttgaggaatccagcggcatgtcctggctagaggagcgtgacggctatcagttctatcaggatgatgtcgaaactgcgatttcccaagccctcaacttatcagcagaagcagcgcataaatggtttgaggattctgagcagacctttagtgtttcggtcgaaaacttctgtcagtgggtgaaagaatacctggacagcaaaggaccccagcaacgcatgttgttcttggtcgatgaagtggggcagtttattggcagcgatacccgcttgatgctgacactgcaaaccattactgaaaacctgggtacgatctgtaaaggccgcgcttggattatcgtcacctcacaggcagacatcgatgctgttttaggtgagatgtcttcttccaaagccaatgacttctccaagattgctggacgttttaaaacccggttatcactgtccagttcaaataccgatgaagtcatccagaaacgtttattacgtaaaaccccagaagctgaagcattgctcagatcagtgtttgagcaaaagggtgatattctcaaaaatcagattacctttgaccgttcaggcccaaccctcaagaactatgaggggccagacagctttatccataattatccttttgcgccgtaccatttccagctggtgcaaaaagtttttgaagaaatccgtaaagtcggtgcgactggtgcacatctggcctatggtgagcgatctatgctggatgcgttccagatggccgcgaatgcgattgccacagatgaagtcggggcactggttcctttccatcgcttctatacttcagtggaaggcttcctggatacagcagtgaagcgtaccatcgaccaggcagggcagaataagaccctggatggttttgatgtgcagatgctgcgtaccctgtttatgatccgctatgtcgatatcatcaaagggaccttggataacctggtgactttgtcgattgagaaaattgacgaagacaaactggcattacgcaagcgcattgaagaaagcctgctgcgtctggaaaaagagagcctgattactcgtaatggcgatgagttcctgttcctgaccaatgaagaacgtgatattacccgcaaaattaaagccactgacttagcggcttcagaagaaaataaagagttagccaatctgatttttaaagatttactgcgcgatcagaacaaataccgccatcaagccaacaagatggactatcagattggtcgttttctggatggtcatagcctggatgggaagtatgagagcgatttgaaagttgaaattgtttctccgctggatacggaatataacctctacactgaagcttactgtattggtaaaagcgccgaggccgaagggcagatactgtttaaactggcagacgataaacagttctttaatgaactgcgcacctggctaaaaaccaataaattcatccgcttaaatgatgatggcacccaatcggatatcagccgtattctggcagaccgtggtcgtgagaatcaggagcgtaaaaaacgcctgcgtgcccgggtcgaagaaatgttgctggacgcggaaagttatgccttgggtcaacatctacaactttcatcttcaagtccaaccaccaagctggatgaggcttgtcgttatttgctggaaaacacctataccaaactgagctatttgcaggtctatcagcaggatgcctggcgtgaactgaacgccgtcttgactgtggatgatatggcgcagctcggattgtctctggatggcggacagagcaatccgaaagccctacaggaagtggaacagtacattgcactacgggccaccggtacagagcgtattctggtctcggatgtggtcgatcgttttgccaaacgcccttatggctggccagatgccgagattttattgctggtaggtcagctggcggcaattgggcggatttcactgcagttaaatggcggcagtttacagttaaaagatgcctttgagcctttacaaaacagccgccgtcgccgtgatgtttccattattaaaaagcgccagactgatgatcaggttttgaaacaggcacggcaactgacccaagacctattctcggccatgggaccagcgactgagaaagagctatttgaattctatttgcagcattttaaaaactggttagccaactttaagtcgtacaaaagcaaaacagatgtcgggcagttcccgggcaagaaagtgattgaaaaatcgattctgactttggaacgtctgctgaccaatagcgacagcttcgatttctttaaagcggtggttgataacaaggacgactatcttgatctggaagaagactatcgtgacattcacgagttcttcagtaaccaaatgccgagctggcagcaactgcaacaggccttacgtcattttgagaaaaacaaacaggcgctgggcagtgatgaggtagctaaaaaagctctctctgaattacatcgtattgccacccttgaatcgccctatggcctgttaaataaagtggctgatttggttcgcacagtggaaagcgtcaatgagcaattgctgactgagaagcgcaatcaggcgatagaacacattgatgacaagatcaagcagttagaagccgagattaaaaacagtggcatcgctagcgcagagctgagtaacaagctattacgcccactacaactgctgaaaacggatattgaagtggaaagcagcctgtccaccatctatatgctgcaaacccaaaccgctgtcgagcgttttgatgaagccttgtatgagttggaaagcgaagttcaggcggaaatccagcgtcaggccaaagcggcacaactggctcagagcaaagcagagagtgtaaccaacactgcaaccgcctccagcccagctacatcaacacctgctgcgagtccggtacagcctgcgacagccgtagtgccaccgaaacctgttgtcgaagttgatgtcgccagcatttacagcaaaagctcaagtagtgtctatctggaaacagaagaatcagtggatcagtttgtagacgcactcaaagctgaattgaaaaaaattgtgggtgataaaaagcgtgtgcgtatccgctaa

SEQ ID NO: 493 - DNA, 3681 bp, Acinetobacter baumannii; identical to SEQ ID NO: 318

SEQ ID NO: 494 - DNA, 3618 bp, Magnetospirillum sp.
atgctgatccgtgaactcttcgagaagaagatcgaccgccccatcaatggcgtcatcaaggccgaccaaaccgatgatgcatcgaagtggcaggaactcgatgagtacgtgatcacccgcgaactcgacaagcatctgcatgggttcttcaattcatatctgaaatccatcgacgcccctggtgacccggaactggccgggaaggttggtgtctgggtttctgggttctttggttccggtaagtcgcacttcatcaaggtgctgtcctacctgctggagaacaaaatggtcagcatgggcggtgaatcccgccgtgccgttgaattcttcgatgggaaaattcaggacgccatgttggctgctgacatcaagcgtgcggtcaacgccgacaccgatgtcatcctgttcaacatcgattccaaggcggataccagcaaggatgattcgatcctgaccgtgttcaccaatgtgttcaacgaacggctcggatttagcccagatcatccccatatcgccgaccttgaacgtcgcctggatgcaaaggggaagtttggtgaattcaaagcggcataccgggagatttccgactgcgattgggtctccgaacgcgatgcctttcacctcaattcggacagcatcaagaccgccctggctcgggttttagggcaatccgaggatgcctttgaaaagtggctcgataaccccgaggcggtgttcaatctttcccccgacaactttgccggttgggtgaagcaatatctcgattccaaggggccaaagcaccgcatcgtgttcctggtggatgagatcggccagttcattgggcaagacacccacatgatgctgcggcttcagaccatcacggaaaacctcggtaccatctgcggtggacgggcatgggtcgtggtgacctcgcaggaggatattgacgccgttcttggtgaaatgcgttccgcgaagagcaacgacttttcgaaaattcaggggcgtttcaaaacccggctttcgctttccagtgccgatgttcatgaggtaattcaggctcgattgctggaaaagaccccagccgccagggatgcccttgtctcggtttacaaggataaggcggacatcctcaaaaaccaactgagcttcaccaacgtcggaatgacgttcaagccgtttgccaacgacgaccatttcgccaaggtctacccgttcgcaccctaccagttccaactggttcagaagatattcgaggctatccgccgtgttggtgccacaggtctacaccttgcccgtggtgaacgctcaatgctcgatgcgttccaaaccgcagcaaaggacatggcatcggaaaaggtcggggtgctggtcccactgcaccgcttctacccgtccattgaaagcttcctcgacaccgccgtaaaggcgaccattgatcaggctggtgataacgcttcgctggagccgttcgacaatctggttctgcgaacgctgttcctcatccggtacgtggaggagatcaaagggacggtcgaaaatctcgtcaccttgttcatcgatcagatcgacgctgaccggctggcgatcaagattcagatggaggccagccttcagcggttggaaggccagaccctcgtgcgtcgtaacggcgatgaattcttcttcctgactgacgaggagaaggagatcggtcgcggcatcaagggcatagaccttcatggtggtgaagaggtcaaagcccttggtgagatgatttttgatggtgtccttggcggttataagaagcaccggttcgaggacaccaagaaggatttcccgttcaaccggttctgcgatcaacacccctttggtaccaagggggatggcgatctggcggtgcaggtaattacgccgttgtcggaggattacccagattggaatgaagcccgctgcctgatgaaatccaccgaagacggtgggcaggtggtcatcaagctacccgatgatcgcaaattgggccgggagttgcggaccttccttcagaccgagaagttcatttcacgcaccaacgatggcggccttcctgccagtacggttcgaattcttcaagatcgtgccgctgagaaccggcaacgtcaggacaatttgaccgtccatattggcgaattgatgaagaatgccgaggtctttgccgcaggcaacaaggtgacggtgaagggcggttccggtgatggagcaatccggcagtccctcgactacctgataaaaaacaccttcaccaagttgggatacctgaagcacatctgcccagacccgcagaccgagattaaagccgtcctgaatgcaccggataccgccgatcagaagctgaagctcgatggtgaagatggcaatgcccccgccctcaaggaagtgctggagtttgtccgcttaaaggacagcatcaaccagaaggtcatcctgcacgacctgatagaaggccggtttggcaaacggccctacggctggccggaatgggaagtggtactgctggttgctcggctggtcgtggccggtgaactcagcatgtccatggaaggggcattgctgacccgagacaagatttttgaacaggtgaagacgcccaacaagtggcgaagcatcatcgtgatcaagcggcagacggttgatgccgccctgctccaacaagcccggaatctcggaaaatccgtcttttccaagatgggaccggacggcgaagacgcactctatgacttcctgcgggaacaatgtgaaaagtggcaggcgaatctcagcggttatctgaaattggccgaaaccggcaaatatccgggcaaggatgccatcgacgccggtctgaagcttctgaggctcatcctggcggagaaggacagctacggtttcattcagaaattcgtcaccttgaaggcggagtttcaaaatctatccgacgacgtgagtgatctcgacaccttctacggcacccagcagccaacctgggaattgctgggtaggaagtacgccgagttcgtcgtcaaccggaaggaactcgaccacaaccccgatgcggcggcggccttgcagcagatggaaaccatattgggccatgccgccccctatccgttgatcaaggacatcagcggcttggtcagcaaggtcacggccatcaatgatgccctggtggtcaagcgtcgcagccacgccttggaaaagatcgatcagcacgtctccgaggtgaaggaagccctcgaccatatcgcggcaccgcctgaactcaggaacaagtgcttgagtgggcttcaaaaactgaggcaaacaaccgagaagcaggccagcatcgcccacatccatcaggcggtcgctgaagccgtcgatgccaaggatgacgcactgggcgaaattgaagcctatgtgccgcccaaaccagccgccaaaacgccaccgccggttactcctggggcaggtggggaagaacccacaaagaccaaagcagaacctccaacgccggtcttcaagaagccgcgagtggtacggcctgccgaaatgaaatctggttacctgaagacccaggccgatgtggatgcgttcctcggaaaactgcggaaggaacttgaatctgccctggccgctgaagaacccattgaaattcgctga

SEQ ID NO: 495 - DNA, 3642 bp, Escherichia coli; identical to SEQ ID NO: 56

SEQ ID NO: 496 - DNA, 3456 bp, Vibrio cholerae; identical to SEQ ID NO: 239

SEQ ID NO: 497 - DNA, 3660 bp, Bacteroides sp.; identical to SEQ ID NO: 420

SEQ ID NO: 498 - DNA, 3456 bp, Vibrio cholerae; identical to SEQ ID NO: 239

SEQ ID NO: 499 - DNA, 3642 bp, Escherichia coli; identical to SEQ ID NO: 56

SEQ ID NO: 500 - DNA, 3690 bp, Vibrio cholerae; identical to SEQ ID NO: 448

SEQ ID NO: 501 - DNA, 3540 bp, Methylophaga aminisulfidivorans
atgaaattaagagccatttttgacaagaaagttgatcgctcaattgagggtgtaatcaaagctgatgatgaggccagccttaagattgaaattgaggaatatgtgctcaccaatgaggtggaaaaccgcctcggaatattcctggatgcctacaacaattacgaaggcgctaacggtgtgtgggtatcaggcttttttggttcaggtaaatcgcatctgcttaaaatgcttgccctcattctggagaaccgtgaagtcgacggaactaatacactcgacttatttcttcccaagtgtgatgacaatgaaattctaaagggcgatctcaagagagcggcagaacttccctctaaaagcatcttattcaatattgatcaaaaagccgacgttatcagtaagacacagatggatgccttgttggccgtctttgtcaaagtctttgacgaaacgtgtggctactatggcaagcaagggcacattgcacaattcgaacgcgacttagactctcgagatctcttccaaaaatttaaagatgcctttgaatctgtttcaggtaaacactggcacatcggtcgggaacaggcgcttctagaatcagcaaacatcgcaaaagcctatgctgaagtaagcggcagtgatgttgagactgcaaaaggcatcctagataaatatcgaactgaatatcgcgtctcaatcgaagactttgccaatcaagttaatcaatatatagatcgccaagagccaaacttcagacttaacttctttgtcgacgaggtgggccaatatattgccgacaatgtgaagttaatgaccaacttgcaaacaatcgctgaaagtttggcaacgaagtcccgcggtcgcgcatggattatcgtcacagctcaagaggacatgaatactgttgtcggtgaaatgaacaaacaacagtctaatgacttctctaagattcaggcacgctttgccaacaagatgaagttgaccagtcagaacgtagatgaagttattcagaaacgtcttttgatgaaaaatgatgatggcgtgcaattgctgtcaaacatctatcatatagaatcgaacaatttcaaaacgctgtttgattttgctgatggttctcagtcctacaaaaactataaggatcgggatcacttcattcattgttacccgtttattccgtatcagtttggtctgttccaatcagccattcaaaatttatcagctcatagcgcatttgagggtaagcacagctccgtcggggagcgatctatgctgggtgttttccaggaagttgctattcaaattagtgagaatgaagttggccgactagccacctttgagatgatgtttgaagggatccgctcagctctaaaaacaaaaacacaacaggcaatactgaaggctgaaaaccagcttgatgatgacttcgccaagcgtttgctcaaggctttgttcttgattaagtacgtcaaagaattcaaagctactgttcgcaacttatgcatattgatgctggagtcatttgatgatgacgtagctgcacttcgtaagcgtgtggaagaagcgctcaacctcttggaacagcaaacttatattcagcgtaacggtgaaacatacgagtatctgactgacgaagaaaaagacatcgagcaggagatcaaaaataccgaaattgagtctgcagatgttgctagtgagttagataagctcatcttcgatgaagccatcagacttcgcaaagtgcgttatgacgaaaatggtcaggactatgctttttcaagaaagcttgatgacaagctgcagggacgagagcatgagttggcagtacacgttatcagtccctttcatgagcatgctgaaaatgagcaaatgctcatcacaaactcaacttacaaagcggatgagctgttcgtcttaatgcccgctgatgaccgtcttattagagatgtaaagctttacaaacaaacagaaaagtacatcaagcaaaatatctctaatacccaaaaagaaacggccaaacggatcctaaacgacaaaggcttccagaacaaagaacgttatgctgatctgagactaagggtaaaaaccttaatcagcaaggcaaagctactggttgcaggtaatgaaatagagatcggcacggaagatcctcaaactcgtgtgattcagggctttcataacctgatttctcgtagctacccgaacttgaaaatgctgcgaggtatcacttacagtgaaaatgacatttcaagatgcctcaaacctgaggagagcttattcgaaaatgacgctattggtctggctgaatctgaacaggaaatgtttgcctttatccaaagcaataacaaaggtggcgttagaacgacagtcaaaagtctggtggacaggtttgagcgcaagccatacggttggtactacgctgcgataatctgcacactcgctaagctctgtgcctgtggcaagattgaagttcgaagtgatagccacctacttgaagatgatgacctgtcaagaggcctacgaaatagtgcaggctttggcaatatggtgcttgagccacaaattgaattcacggcatctcaaatccgtggattaaaagacttctatgaagacttttttgatgcgcctgctaaactaagtgaagcaaaatctctggggcaagagtctgcaaaagcttttgcagagcttatcaatgaactaaaggtcctttcggcacgagccagtcagtacccgttcttgaatgccttgacccctgttgtatccagtcttgaagaagtatcaggcaaaccctacacctggtatttaacagaactaaaatctcaggaagatgctctactggatatgaaagaaaacaccatcgatccagtacgtaagttcatgtccggacctcagagagaaatctatgattcagctcgtcagttcctgcaaaagcaagatgcaaactttgcttacattgatgatgagcaaattaaaaccatacaaaacacactagctgagcctgaatgctttaagggcaatcgcatccagcaaatcaaacggtctgtcgatgagttgcaagaaaaaatcgataacacactcaaatcagagcgagaaaaagcgacagatagagttaatgagttgaaagacaaactcaccaacactgatgagttcagttctttagatgagcaacaacaggtccagcttacccaagagtttgatgagttcattaacgaaatcattagtaaaacgctgattgccgttattagcgatactttacgtcgctttgaagatgaaacttataacaggcttctttctcgagcgatgttctggtcacagcctcaacctgagccggtcaaaccctatcctccgactaccggtggcgccacaaccccagtagaaccgaatgaggtgaaagagcctcaaattcagattattaatagtaaaagcatcaaagtgaactaccagaagccgcttttggcgagcgagactgatgtagaaggttacttagaatcaatgcgtgatgctttgatggaagaaatacgccaaggaaaaagaattcaaatctga

SEQ ID NO: 502 - DNA, 3642 bp, Escherichia coli; identical to SEQ ID NO: 56

SEQ ID NO: 503 - DNA, 3456 bp, Vibrio cholerae; identical to SEQ ID NO: 239

SEQ ID NO: 504 - DNA, 3582 bp, Photobacterium sp.
atgagtatgaaattagagcagctatttagcaaacaagttgatcgtactatcgaaggtgttattaaggctgacgacgatgtagccttatatctcgagttggatgaatatgtaatcaccgatgaagtagctaagcgacttgatattttcctcgatgcctatttgaattaccaaggtgccaacggagtttgggtgtcaggcttttttgggtctggcaaatcacacctgctgaaaatgcttgctctattattagaaaataatcccatcgaagacattactcctttagaggttttcttggagaagcgtcctcttaacgaaggcggtatctttgccaatgatcttaaacgtgcagtaactatcccttcagagagtatcctgtttaatatcgaccaaaaggccgatgtcatcagtaaaaccgagatggatgcccttatcgctgtatttgttaaggtcttcgacgaacactgtggcttttatggtaagcaagcttatattgcacagtttgaacgtgaattagctgatgatggccttttagaagattttgtcagcatttttaaaaatatcagtggtatggaatgggaaaaaggtcgtgcgcgagccaagcgaatgggcgactctatcgataaagcttacaacaaagtatccgctcaaagtgtcacaggtattttagataaataccgtgcagactaccgactctctattgaagattttgctgagcaagtgcaaagctatattgcaacgcagaaagagggtttccgcttaaacttctttatcgatgaggttggtcaatatatagcaggtaatactaagctgatgaccaacctgcaaactgttgctgagagccttgctaccaagtgtaaaggtcaggcttgggttattgtcacggctcaggaggatatgtcttcggtactcggtgaagcaagccaaaagagtgagaatgactttactaagattcaggcccgttttaaaaaccgaatgaaattgactagtcaggatgtggctgaggttattcagcgccgcctgcttgagaagaaagaggagttagtccctactctctccgacctgttccatcagcaagagaataattttaaaaccttatttgattttgctgatggttctcaaacctatcgcaactatcgtgatagagaacacttcattcaaagctacccctttatcccttaccagtttactttgttccagtcagctattcagaatctgtctttacatagtgccttcgaaggtaagcacagctcagtgggtgagcgctcaatgttgggtgtattccagcaagttgctattgctattaaagatcatcaacttggagagctggctactttcgatttaatgtttgaaggtatccgtacagcactgaaaacggctatacagcaatccattatcaaggcagaaaaacaactagataatatgtttgcaatacgcctccttaaagccttattcctagtgaaatacgtcaaagagtttaagcctagtgtgcgcaatctttgcgtgttaatgcacgatagcttcgagcgtgatattccgtcactaaagctggaaatagaagaagccttaaacctgctggaaaaggagagctacattcagcgtaatggcgaagtctacgaataccttactgatgaagaacaagatattgagcaagagatcaagaatactgaggtagacaactcagtcattaccagtgagctcgaaaagctaatttacgatgcagtccttaaaactagaaaaattcgctgggaagaaaataaacaagattacagctttagtcgtaaactggacgacaatctttcagggcgcgaacatgagctagcaatcaatgtaatctcacccttttatgataagttagtgcctctagaaaaacataaagttgatacagtttatgtagacgaagtaagaatagtgatggctgacagtgagcgtctatacagagacttaattctctatcatcaaactgaaaagtactcggtacacgcaactaaaagtactcagcaagattccattaagcgaataattgccgagaaacgcagctataacgcagagcgactattacagttaaagcagttggtagccaagttgattggtacagctaaatattatgtcgcaggacaagatctcgaactcacaggtgacgatggtcaaagtaaaataatcaaagcctttggcgagttgattaaacgcacctatcccaacctaaagatgttgcgtgaagttagttatagcgagaacgacattccaggtattctcactaaagcagagcaaggcctttttggtgatgaaactcaactgcctgaatcccagcaagagatgctgtcctttattcagagcaatagtcgtggcggcgtgagaactacggtaaagtccctgttagaaaaatttgaaggcaagccctacggttggtcatttgcagcggtactctgtacgcttgcgcacctctgtggccgtgctaaggtcgaagtgcgagagtcaacaaatctattggatgatgctgatctagctaaagcactgaagagcacccccctgcatggcagcttgatacttgagccacaagtagagtttagccagtcacagatccgaaaagtcaaagagttctataatgactacttcgataaagtagctcatgccactgaggtaaaggcattagccaaagaggtacaagaaagctttgtcgagcagagcaacgcgatagataagcttttagccctatcggaacaatatccctttattcgtgccttatcgcctatattagccgaactacaagcactaaaagcaaaaccgtatacttggttcatgtcagagctagttagcgatgaggacaaatggttcgacttcaaagaaaacaccatagacccaatcatcaagtttatgaagggtcctcaaaaaggcagctatgacaaagctaagcagttattaacgactcaaaagcccaaccttgactatgtgagtagctcaaacggaaagagcgcctatcaacacataaccgatgctttagtcagccaagatatatacaaaagcagtactattgtgcaactaaaggccaatactgaaagcttagcaaaagagctaaatgagcttttagtcaaagaacgtgcactggcgattagcagtgtcgagtcattgaagaaaaaactcacaggttttgatgaatatcaggcattagatcagagtaaacaagcatcgttagcatcggccttcgataccgctattggcaaactcaatgagcagagcctaatcgccatgttaagggatgaagtgcgccgttttgaggatcaaaaatattcaagtctagtccagcagctaatgacctggagtcagcctgctcctgaactagtaaaaccaaagcactcaacgacaaagcaacctgaagctgctggtaatgtcagtgataagccatctcaggaaaaagctggtgtagaagagtcaactgctgcaccgcaaaccatcaccgccagaaacatgaaggtggaatttcacaaaccttggttagccaatgagcaagatgtagaacagtacctagaagagtataaaaaggctctattagcagcgattaatgatgggaagcatatacagttatga

SEQ ID NO: 505 - DNA, 3456 bp, Vibrio cholerae; identical to SEQ ID NO: 239

SEQ ID NO: 506 - DNA, 3753 bp, Fusobacterium sp.
atgtctgatttagctataaaaaatattttgcaaaaagatattgaaagaaaaataaatggggttgtaaaggcagatagtaatgaaaaagacactgtaattacagaattaaatgaatatgttgttacagaagaaattagagaaagattaacaaagttttttgataaatatgttgattcaattaattttccaactgaggatatgggagtatggatttcaggtttctttggttcaggaaaatctcattttctaaaaatgataggacatattttagaaaacaatacttatgatggaaaaaaagtcgtagatttttttaaagataaaatagatgatgcaattttaatgggaaatattgaaaaagctgctgaaattccaactgatgtaattttgttcaatatagataatgtaagtgatcaagatacatatcaaaataaagatagcatagcagttgcttttttgaaaaaatttaatgaatatttaggttttacaagagatgatatagaaatagcagaatttgaaagaaaactttgggaagatggaaaactagaagaatttaaaaaggtttttgaaaaagaatctggaaaaacttggaaagatgcaaatagaaatttagattttcattcagatgattttcttgatgttatagaaaaattaggaattatgagtagagaaagtgctgaaagatggcttgaaagagatatagttaggtctataagtgctgaaagttttagagatatacttgaaaattatttaaaaatgaaaggacctaaacatagaatagtttttttagttgatgaaatagggcaatatattggtgataattcaaaacttatgttaaacttacaaaccttagttgaaactttgggagttaaatttaaaggcagagtctgggttggggttacatcacaacaagatttaagttctatattaaataatagtgaacatagaaaaaatgatttttcaaaaattcaagatagatttaaaacaatgcttgctttatcaagtggaaatattgatgaagttattaagaaaagactgcttattaagaaaaagattgagggagaagatttagaaaaaatttttgataaaaagagagttgaaattgaaaatttaatacattttgaaaaaacaatgactttacctctatatgatgataataaagatttttcagaaacatatccttttgttgcttatcaatttaatctactacaaaaagtatttgaaaaagttagaaatatgggacattctggacaacatatgtcaagaggagaaagatctttattgagttcattccaagaagctggaataaaagtaaaagataaaaatataggaatacttgtgccatttaattatttctatgaatcaatagaacaatttttagaagacaatgtaagaagaccatttattcacgcaagaaatgaaaagggaatagatgattttggtttagaagtattaaaacttttattcttattaaaaggaattaatgggatagaacccactttaaataatttgacaagttttatgatagattctatggatagtgatagaatagaacttgaaaagaaaataaaaaaagcattagaaaaactagaaaaagaagtcttaattcaaaaagatggagaaaattattatttcttaacaaatgaagaacaagacataaatagagaaattgaaagggaagatattgatttaaagaaaattgatgaaaaaatagattcctacatttttaaggaaatatttacaaagaatagtattctaatggaagaaacaggaaataaatataattttactagaactattgatgaaacagtttattctaaatctggagaagatttggcaataactatttttactgaaagagcagatgattatgataatgttgctattgtgggtacaagaccagaaagtgacctaatattaagactggcaaaagatgatgaaacttatagaaatgaaattaaactatttttaaaggtggaatcatatattagaaataaacaaaaagataatgaaagagaatctattattaggatattggaaataaaacaaagggagaataaaataagagatagaagaattaaaaatgaattagaaagacttataggggaagcagaagtatttgtttatggacaaaagcaagatattaaaacaaaagatgcttctaaaaaaattgaagaaagtttaaaagctttagcaaaccatagatttcataaagcaaaacttgttaaaaagtcttatgatgaagctgaaataaggaatatcttatcttatgtttatgacacagaagaaaatggaatattatttgatattaaaaaagatgttgaaagtaatataaattctgaagctataaaagaagtattagaaagaataacattacttgaaaaaagaggagatactccaataacattaaaaaatataagtgaatattatttgagaagtccttatggttggggacaacttacaatcaatggtttagttggagaattatggaaatataaactaatagatttacaggaatcaaaagtccttgttacagatgaaaatactgcaacaaatttacttacaaaattgcaaaataaaaatcttgaaaaaattgtaatttcattaagagaagaaatagatcctgagcttatcaaaaaagttaataatttattaaaagaaattaaaacaattaaagaagatacaggagaagttactcttgattctccaaaagaagatttgttagagatattaaaaagaaaaattggaatagcaaagagctataaaatagaatgtgaacatagtaaatatccagggaaaaaagaattgactgattggatagaccttttagatgaaattattttatctaaggataatgctgaaaagactcttaaaaatttcttagaaatggaagatgagctatcaaaagaatatgataaggttgatagggtttttgatttctttacaagttctaaaaaagatagatatgacaaagctattgaaaaaataaataaaattgaagagtataaagattatattggtagtttaaaagaaactaatgcctataaaacaattgaagaaattagagttgataaaaatatttatgaaagaattagagagtttgatgatttaatttctgaattagacatagccaaagatgaacttatagaaattgaaaaaacttctttaaaagaaaaagttgaaaagtataaaaaagagttctctgaaaaattaaaagataatccagaagtaattaagaaattagaagaaaagttaaatgaatttttagaaaaagaagttaataataaagataattctaatgatatggcaatatttatgaaatctaaaaaattagaaaatattgttaataattttgaagaagaatataaaaattctgctaaaaaagaaattgagaaattagaaaattatcttaatgaagttgcagaagataaaactgatattgatgaacttagaaaaagtataaaatctacatacaataattataaagatgaaatagccaaaagcgatattaaaaatgtcagtataactattgcaaaagcaattaaggataaagaagattttaatgctgaaattaatggaaaagctaagaaaaaagaaagagtgaaattaagaaaaatttctataaactcaaaaagtaatatagaaagtgaagaacaagtgaaagattatatttcagctattgagaaagatattgaaaagttaaaaaatgaaatgcttgaagctattaaaaataataagattgttgatattggataa

SEQ ID NO: 507 - DNA, 3666 bp, Clostridium perfringens
atggaagcaaatttaggatccatgttttataagaagatagatagacctattaaaggagttataaaggttggacaatcagatgaggaaaatgtaaagcaagaacttgaagagtatgttgtaactagagagcttagtacgcatatagataaattttttgaagcttacaaggaagggattcttggaattactgataaaaatggtgtttggatatcaggattctttggaagtggtaaatctcacttcttaaaaatactttcttatcttctagaaaacaagaagattgacgaaaagagagcagtagaatattttaatgataaggatttagacaatttcaccttaggcaatatgaaacaagcaggtgatatttcaagtgatgtaattttatttaatatagattcaaaatcagattcagattccaaatcaaataaagatgctattgttaatgtatttaacaaagtatttaatgagatgcaaggattttgtggttctatgccttggcttgcagatttagaaagacaaatgtgcaaagatggagtctatgaagatttcaaaagagagtttgaagaaatatcaggaacaccttggatagaagctagagaagacttttattatgaagaggattccataatagaagctttagcaaagacaacaaaaatgagtgaggaagccgctagaagttggtatgataaatgccaagataactattctttaagcatagacaagtttgcttctaaagtaaaggaatattgtaaatcaaaaggagcaaatcatcacgttgtattcttagtagatgaaattggtcaatatataggagacaacactcaattaatgctaaatttacaaacagttgtagaagatttaggaactaagtgtgaaggaaagtgctgggttatagttacttctcaagaaggattagatgaatttacaaaagtaaaaggaaatgacttctcaaaaatacaaggtagatttaatactagactttcactttcatcagcaaatgtagatgaagttattaaaaaacgtatattaagaaagaaagattgggctacaagtcacttaaaagttttatatgatcaaaaggaatctataataaaaaatcttttaactttcacatctgatactgctgagatgaaattatataaagatagtgatgattttgcagaggtttatccatttgttccttatcaatttaatttactacaatcagcttttaatggagtaagagaacatggagcatcgggtaagagtttatcaaaaggggaaagaagtttacttggagcttatcaacaagttgcaattgagtatatgaataaggaatcaaatattcttataccattttcagcattctatagcactatagaaactttcctagattcatcaataagatcagttattatgaaggctgaaagaaatgataagttagaagagtttgatattgaagtattaaaacttttattccttattaaatatgtaaaagaaataaaagccaatatagaaaacttagctacattattagttgatgatattgatatatcaaaaaaagaattaaaagataagttaaatgattcattaaagagattaattagggaaactttaattcagaaaaatggagatgaatatatattccttacaaatgatgagcaggatgtaaataaggaaatagataatatattcatagaaactggtgatgttgtaaataaaattggagagataatttttgatgatatatatggagaagctaaatttagttattcaagaaagtatatattctcatttaatagggctgtagatgatagaccgagaggaagccaaaataatgacataggagttaagataataacagctgcctttgatttaaatggagttggagatcaatttgctttaaaacagttatctgtaagagaaaataatgttatagttgatatttcaaaggattcaaattactttgaagaaatagagaatgttttaaaaatagattcctatttaagagttaaaagtggaagtaagtcttcaattgctatagaggatataaagactaagaaaagcagagaaagagaagaaagacttaagagagctaaatttttaatagaagaagatttaaaaacttgtgatatttatgctaatggaaatcttttagagataaaagaaaagaactgtgtagatagaataaatgaaggattaaaaagcttagtagattctaaatataataagttaaactatgtaaaagagtttaaaaatggaatagatgatttatatggaatcatggataagagagtaaatcaattatcaactcttgatatggatcaaaatagattagctgttgaggaggttagaaatcacattgagcagaattcaacaagaaatttaccaataacagttaagagtgttttaactaaattctcaaatgctccatatggatggaaagagatagatatacaaggaataatagtaactttatttaaaaatcaagatataaaagttatttataatagtgaggttttatctccaaacaatagagatgttgttctttgtgtaactaagaaagacagagttgaaagagtaagcttaaaaatcagagagaaagttcctaataagtatgtagataatttgaaggatataaacagtgaattatttggattttcatcaatgccaagtgatgaagatggaatgatgaacttatttaaagatcaatgtaaaacagagcttaataaaatagatgcaatgctaagttgttttggaataatgagttactatccaggagaaaaaactcttaaaaaaggaaagggactttttgaagaaatattaagtattggagatactttagagttctttaaaacagtttatgaattagatgatgattttgcagattatatagaggatatagaggatataaaaaaattcttctttaataaagagaatggaagaatagacactaacacaaataaaggggaacaaagaaaaatctttgatgatgctattaagactgtaaataactataaaattaatgaagcatttatagtagatgaagatgttgatagcattataaagagtatagaagtaatcttaagaatgacaaaaccttatggaaagataaaagatattccagttttaattggaaaatataatgataaaatagttgaattattagaaataaagagtgaacctgttatagagtttatagaaagttgtaaaaaagaagttttagaaaccttagataatgaagaggtaaaagaaaagttttataataatatattggaagaattcaactcacaaatagaaaaggttgagcattcaaaaagttttatggaattatcttcaatgaaagaaccagctgaaaatttaagattaaagtggattcaaaaaataataactgaaaatgaagttattaaaagaagagaagaaagaaagcttgccgaattaacttcaacaaggggaattggagaagaggaacataaaaatagttatggaaatgatactgaagttccagtagatacagtaaaaccagtagaaatcatacaagttaaaactaaagctgttagcgtaagggaacttgtaaaaggggaaaaaataataaagaacgaagcagatattgatgctgttattgaaagtttaagaaaaaagcttaaaaatgaattagaagaaaatactattataaatttaatttaa

SEQ ID NO: 508 - DNA, 3555 bp, Actinomyces neuii
atgaagctagctgaaatgtatgcgaaggacattaaccgcactattgacggggtaattaaggctagcgaggacgagcacgtgcggctcgaggtcgaagagtacgtgttcactgccgagatcaagaatggtctttcccgtattttggagcagtacactagcccccaccctaagtcgaatggcgtgtggatttcgggattttttggttctggtaagtcgcacctgctcaagatgacgtcgttcttgttgggggatgtgcaggggtcttcgtctgtgagccgggattttgtggccgaacagtttttgcagaaagcctcccaggatgccttcttgcaggcttcgctgaagaaggcggcggcgatcccggccacgtccctgctgttcaatattgatgcgaaggatgataaggcgcagtcttcgaagaacctggcgctgctgggggtgttttatcgcgagttctaccgcgcctgcggctattacgaccgcgatttggcggtggcccgcctggagcgggatttggattcgctgcacaagctggcccagttcaaggaggctttcacccaggtgtcgggtgggaagcggtgggaggatgcccgtaaggcggccctgtttgcgaatggggatgccgaggctgcgctcgcgcagattggctcccctattactaacccgattaagacttatcgcgacaatttggctttgtctgctgaggggtttgccgaagaggtgcgtgattggatcgaccggcagggtcccacttaccggttgaatttctttattgacgaggtcggccagtacattggcacggacacgaagctgatgctctcgctgcagacggttaccgaggagttgttctcgaagtgtcaggggcgctcgtcggtgtttgtcacttcgcaggagcagctgtcttcggtccttggcgagctagctgacaggcgcggggatgatttttcgaagattcagggccgtttcgacacgcaggttaacctgtctactcaggaggtcgaggaggttgtttcgaagcgtctgctcactaaaacggaccaggcctccgctgctctgcgtcaggtttacgatgcccaccaggccgagtttgagtctgcttttagcttcccgaattgggagaagacgtatcgcaactaccccactgccgcctcgtttgttgacacttacccgtttgtgaactatcagttcgacatgtttacccaaactatgattggcctgtcttctgcgggcgcgttcacgggccggcattcttcggtgggggctcgttcgctgttgggtgttgcccagcagattgcgaaggacatccagaacaagcaggtgggggtgctggcctcctttgaccagttctacgatggcatggaccagtcgctgaattcggacatcaagctgaacgtgcagcgggcggtggcgcagtttcgggacagtaacccgttggcgattcgggtgctcaagacgttgttgttggtgcggtatgtgcagaatttcccgaaggatccgaagaatttgcgcgtactgcttcgccgcgatttagacgaggacgtagctcagcttgaggccgacattgaggaggcgctcaagcagcttgagaggcaggtgctggtccagcgcatgcccaatggcacctacgagtatctgacgaatgaggagcaggatattaagcgcgagatcgatagtatgccggtctctaattcccaggtgtgggattacgtgaagagcgcgatcgtgtctgcgcttggcagcgacgctacgaagtaccgttacccggattcgaagatggacttgaacgttggcatgttcgttgacgatacgcaggtcggtggtgagcagcagattgctatccgctattacactccgaacgcgggtgtggatgagggcattgtggcgcagcggtctgtgggctcgcagaaggacttgttcgtcctattagacctgcaggttgatcattacaccgagatcgagacttggcataagactaatgattatttgcgccgcaattcgacttctgcccagggcagcgcttctaggtttattgtcgagcacaaggcgaataatgccgaacgcaacgcttcgctgcaaaaggatattgccgattcgatcaggaacgctcgtttcttcgtaaatgggttagaggtctcgccttcttctaggggtaatgcgaaggatgcggttaggactgcgttgggtcgggtggtggccacggtctacaaccggattggcgaggtgaagcctttcctgtcttggacggagtcgaatattgggctcgccttgcaagatgacgagggcggcatttttaccagccccgaggtggctacgctgtctagcttagctaacgaggtagcccagtggattaacaccaccaggcagcgcgagggcaaatctacttatgtttcggacgctgtggagcactatcacggtgccccgtgcgggtggccggcggcggtaaccttggcgattattgctaggggcgtgcgcgataacaagttggaggtgtcccacaatcaggcgccggtgccgcgcacgcagttggcgcagctgctggcaacgcgcagcgagcataagtcgctgctggtggagcagaagaagacctacgaccgctcccaagttgcccgtctgttaacggttgccaacgatctgactaacgcgtggccgcagatgcagcaggcggcggaggctcccaaagaggttactaagtacgcctacaaggtgattgaggagatgcggcaggtagccgaaagcgattttgcttttgccgcccaggcagatcaggtgattggggctttcgagcccttctctgttacccataacgtcgacttcttcatggacgggcagaacatggccagcctagaagaattgttggatgtgaaagaggatttcgttgagccggtcggcgagttcttcaggaagcatcttccgctggccgaaaaggctaggcagttggccctctctccagagaattacgatctgcctggggcagatgcgcagctgccgggccaaattcaggctctgcttgaaagccccaacttgtacaacctggtgccgaagctgaaggcggccaccgaggacttggagcgcgcccagcgggcccttgcggaagaacagcaccggctgatcgaggccgaattggcccatgcggtcgagggcgtgcaggcctcccagcagtggcagcaggctagtgaggcctcgcgcgagcgggtaggtaatgctattgctgagtttgagaagttggttgccagctctgctaattcggcccagctgtctagtttgcagctgaagttgaatgcggctaagactagttgggtcaacgagctgatgcgcgtaagtcccgtgcctgcccctgcagctgctgcccagggcgacgcggctgcgtcccctgctgcggagcctgcccggcagccggcacagccgaagcagcccagggcgaagagcatttcttctttccttggttcttcttcgctggctacgatcagttctacccaggaactggatgagtatttgggccagctgcgggtccagttggcagattttattgacgatggtggggttgtgacgctgtga

SEQ ID NO: 509 - DNA, 3672 bp, Enterococcus faecium; identical to SEQ ID NO: 238

SEQ ID NO: 510 - DNA, 3642 bp, Escherichia coli
atgaatattgaacagatttttgaaaaacctctaaaacgaaatataaacggggtagtcaaagcagagcaaaccgatgatgccagcgcgtacatcgagttagatgaatatgtcatcacccgcgaactggaaaaccatcttcgccatttcttcgaatcctatgttcctgccactggcccggaacggatccgtatggaaaacaagatcggcgtatgggtttcaggcttcttcggttcaggtaaatcgcactttattaagattctttcttatcttttatctaaccgcaaagttacacataacggtacggaacgtaatgcttactccttctttgaagataaaatcaaagatgcattattccttgccgatattaacaaagcggtgcattacccgactgaagtcattctgttcaatattgattcgcgtgccaacgtagatgacaaagaagatgccattcttaaagtcttcctgaaagttttcaacgaacgcattggatactgcgctgattttccgcatattgcccatcttgagcgcgagctggataaacgcggtcagtatgaaacctttaaagccgcgtttgccgatatcaatggctcgcgctgggaagacgagcgcgacgcttactacttcatcagcgatgacatggcacaagcattaagccaggccacgcagcagagtcttgaatcctcccgccaatgggtggaacaactcgacaaaaacttcccgctggatatcaataatttttgccagtgggtaaaagagtggctggatgacaatggtaagaacatcctctttatggtggatgaagtcggtcagttcattggcaaaaatacgcaaatgatgctgaagctgcagactattactgaaaaccttggggtaatttgcggtggccgcgcatgggttatcgtgacttcgcaggccgatatcaacgcggcaatcggtggtatgagcagtcgcgacggacaggacttctccaagatccaggggcgcttctctacacgcctgcaactttccagctctaacacatcagaagttatccagaaacgtttgttggtaaagactgacgaagcaaaagcggcactggcaaaagtgtggcaagagaaagccgatatcctgcgtaaccagctggcttttgacactacaacaactactgcactacgtccttttaccagcgaagaagagttcgttgacaactacccgtttgtcccgtggcactatcagattctgcaaaaagtgtttgaatctattcggacgaaaggtgcagcgggtaaacaattggccatgggtgagcgttctcagctggaggcattccagacggcggcgcagcaaatctcagcgcaagggctggattctctggtgcctttctggcgcttctatgccgccattgagagcttcctggaacctgccgttagccgcaccatcactcaggcttgccagaatggcattcttgatgagttcgatggcaacctgcttaaaacgctgttcctgatccgctatgtggaaacgctgaaaagcaccctggataacctggtcacattgtctatcgataggatcgatgccgataaagttgagttgcgccgccgggtcgaaaaaagtctcaacacgcttgaacgcctgatgctcattgcgcgcgttgaagataaatatgtgttcctgaccaacgaagagaaagagatcgaaaacgagatccgtaacgttgatgtcgatttctctgcgatcaacaaaaaactggcatcgatcatctttgatgacattctgaaaagccgtaaatatcgttatccggctaacaagcaagactttgatatcagccgcttcctgaacgggcatccattagacggcgcagtgcttaacgatctggtggtgaagatcctgacccctaaagatccgacttattcgttctataacagcgatgcgacctgtcgcccttatacgtcagaaggcgacggctgtattttgattcgtctgcccgaagagggccgtacctggagcgatattgatttagtcgtccagactgaaaagttcctcaaagataacgccgggcaacgtccggaacaggcaaccctgctctcagaaaaagcgcgtgaaaacagcaaccgggaaaaattactccgtgttcagttggaatcactacttgcagaagcagacgtctgggcgattggcgaacgcttaccgaaaaaatcctccacgccatcgaacattgtcgatgaagcctgccgttacgtgattgaaaacaccttcggcaagctgaagatgctgcggccttttaacggtgacatctcccgtgaaattcatgcattactgacggttgagaacgacaccgaactggatctcggtaacctcgaagagtccaaccccgacgccatgcgcgaggtagaaacctggatcagcatgaatatcgaatacaataaacctgtgtatttacgcgatattctgaaccattttgcgcgtcgcccttatggctggcccgaagacgaagtgaaactgctagtagcccgtctggcctgcaaaggtaaattcagcttcagccagcaaaacaacaacgtcgagcgaaaacaggcgtgggagttatttaataacagccgccgccatagcgaattgcgtctgcataaagttcgccgtcatgatgaagcgcaggtgcgtaaagccgcgcaaaccatggctgacatcgctcagcagccgtttaacgaacgggaagagccggcgctggttgaacatattcgtcaggtatttgaagagtggaagcaagagctgaacgtattccgcgccaaggcagagggcggaaacaatccggggaaaaacgagattgaatccggtctgcgcctgcttaatgccattcttaatgagaaagaagattttgccctgatcgaaaaagtctcatcgctgaaagatgaacttctggatttcagcgaagaccgtgaagatttggtcgacttctaccgtaagcaattcgccacctggcaaaaactgggtgctgcgctgaatggcagctttaaatctaaccgcagcgcgctggaaaaagacgccgcagcggttaaagcgctgggcgagctggaaagcatctggcaaatgccggaaccttataagcatctcaatcgcatcacgccgttgattgaacaggtccagaacgtcaaccatcagttagtcgaacagcatcgccagcacgccctcgaacgcattgacgcccgcattgaggaaagccgtcaacgcttgctggaagcgcacgccacgtcggagctgcaaaacagcgttctgctgccgatgcaaaaagccagaaaacgcgctgaagtcagccagtcgattccggaaattttggcggaacagcaagagacaaaagcgctgcaaatggatgcagataaaaagattaacctgtggatcgacgagctgcgtaaaaagcaagaagcacaactccgggcagcaaatgaagctaaacgcgctgccgactcagaacagacttatgttgtggtggaaaaaaccgttatccaaccggtaccgaaaaaaacgcatctggtgaatgtcgccagtgagatgcgtaatgccaccggtggtgaagttctggaaacgaccgaacaggtggaaaaggcgctcgacacgttacgcacaacgctgctggccgtcattaaagcaggcgatcgcattcgccttcagtaa

SEQ ID NO: 511 - DNA, 3456 bp, Vibrio cholerae; identical to SEQ ID NO: 239

SEQ ID NO: 512 - DNA, 3456 bp, Vibrio cholerae; identical to SEQ ID NO: 239

SEQ ID NO: 513 - DNA, 3723 bp, Fusobacterium necrophorum
atgaagaattgtttaatacaaagcacttttcaaaaagatattacaaggaaaatcaatggagtgatcaaagcagatagtaaagaagaagatgttattgtcacagaactgagcgaatatgttgtgacagaagaaattcagaagtatttaaacatctttttcaatcgctatgtggattcgttacaatctcccacggaagacattggagtttggatttcgggtttctttggctccgggaaatctcattttttgaaaatgattggtcgtattttagaaaataaagaatatcaaggaaaaaaagtaattgatttttttgaagaaaaaatacaggatgctattttacaaaaaaatattgaaaaagctgcggaagttcctacagacgttattctatttaatattgataatgtaagtgatcaaaatacgcaacaaaataaagacactattcccattgcttttttgaagaaattcaatgaatatttaggattttcgagagataatatcaaaattgcagattttgagagaatgttatgggaaaaaggaaagtttgaaatttttcagaaaacatttgcagaaatcagtggaaaaatttggaaggaagaatatagaaatttggacttcgatgcggatgacttcttagatactatagaaaaattggagattatgagtcgagaagctgctatccgatggctagaaaaagaaagtgatatttcaattagtgcagaaagcttagccgatttattggaacaatacttaaaaaaacaatctaaagagcatcgaattgttttcttagtggatgaaataggacaatatattggagaaaactctcaattgatgttaaatcttcaaactttagtggaaaccttgggagtaaaattcaaaggaagaatttgggtaggagtaacttcacaacaggatttaggaaatattttaggaaaagctcgagaaagaagtaatgatttttcaaaaatacaagatagatttaagacaatgttgcctctatccagtgcaaatattgatgaagttattaaaaaaagactattagaaaagaaacagttacaacaggaagaattagaaagtctatatgacaaaacgagaatttatattgaaaatgcaattacttttgataaaacgggaatgacgctagctctttttgaagacagaaaagattttgctgaaagctatccttttgtaggataccagtttaatctattacaaaaagtttttgaaaaagtcagaaatatgggatattccggacaacatatgtcacgaggagaacgttcccttttaagttctttccaagaagcaggaattcgtgtaaaagatatggaagtgggttcgcttgttccttttcaatatttttatcaatcgattgaacaatttttggaagataatgtaagaagaccctttattcatgctaaaaatgaaagaggcattgatgaatttggcttagaagtgttgaaacttctatttttattaaaagggattaaaggaatcactccaaatatcaataatttagtgagctttatggtggattctgtggattgcgatcgtttggcgttggaagaaaaaataaaaaaagctttgggaaaattagaacaacaagttttaattcagaaagatggagagggatactatttcctaacgaatgaagagcaagacatcaacaaagaaatcaatcaagaactcattaatgaacaggatgtctataaggaattgaacacctatattttcggacaaatttttacaagtccgacagtgactatggaagatacgaaaaataaatataattttagtcaaaaaattgatgaaattccttttggaaaaataggagggcaattggatattctcattttaactcccagatcggacgaatatgataatattgccattcttggatatcgtgatggctatgatttaattcttcgacttcctgaagaaatgacatattggaaagaaattcaacaatctctgagaatagcttcctatgtacaaaaaacattgcgaggaagcattagagaagttgtccatcaaattttacaaatgaaacaacaagaaaattcgaagagaaaacaaagaatacaaagtgaagtggaaagaatgttgtcggaagcggaaatctacattcaaggtcaaaaagtaaacattacgactacacaagcggataaacgtattgcagaagctttaaaagctgtggcaagacatcgctttaataaagcaaaattgatacaaaaaccttattatgaatcagagattagaaatgtattaagttatgaatacgatgccggaaccaatttatttgatatcaaaaaagatatgagtacaaaccctaattatgaagcattacaggaaattttgacctacattactttacatacgagtcgaggaaatgtgattaccttgaaacatattgtggaatatttttcaaagaaaccttatggatgggaaatattttctattcatggcttggttgcagaattatggatatataagcaaattcaaatagaagagtctaaaaatcctattcataatgcagaagaattaaagattcttcttgtgaaatctcaatccaaaacggaagaaagacttgtgattagtcttagagaagaaattgataccgaacttcttcaaaaggtaaataatcttttgaaaaaattatttggaccggaaaaagaagtttccgtggatcagcaaaaaaaagacatcttggaaattttaaagaaaaaaatagatttgcctaaaatgtatagtagagaatgtgaaagtggggtatatcccggaaaaaaagaattacaagaatggattgacttattggaagagattctgttttccaaagaaaaaacggaaaaattattgaaacatttcttagaaatggaagaagaattgttggaagcttatgataatcaaggagtcgtacttgatttctttcgttcttccaaaaagaagaaatttgatgaaggattggaaaaaagaaagaagataaaagaatatgaagctgtgatcggaagtattcaagaaacgaagccatatcaagatttagtggatattttaacaaataagagcccatataatcaaattaaacatattgatgccttattagaagaaatacaagtggaagaagaaaagttaatcttagaagaaaagaatatgcttcttcaaagaatagaagaaaaagcaaaagaattttcaatcctttttcaagaacgagatgctatgttagaaaaaacgatagaaaaattaaaggcatttaagaataaaatagaaaaaacagatgatctttctatttttttcagtctgagtgactggaataaagtattgtcttctatcgaaatggaatatcgaaaaaatattcaagaagaattacgaagttttgaaaaagctgcttttgaagtgacagaagataagacagatgtcaaagaattagtggaagatattagaaacaccttccatgcttatcaagaagaagcaaaatccaatgatgtggatcaattggaacaattaattcaaaaggcaaaaaaagatcaagagggatttatcctacaaggaaacggacgagcgaagaaaaaagagagagtacaattccgtaaaatccgagttgcggaaaaatccaatattgaaaccatagaagctgtggaggaatatatttcaaaactggaaaatgaaatacaaagtttaaaagaaaaaatgttacaagcaatacgagaaaataagattgtggatatacaatag

SEQ ID NO: 514 - DNA, 3456 bp, Vibrio cholerae; identical to SEQ ID NO: 239

SEQ ID NO: 515 - DNA, 3459 bp, Xanthomonas vesicatoria
ttgaacaaggggaagcaaatgctcaatcgcgacatttatcaaaaggacccgtcgacccgaaagctggttaacgagggtgtggccagcgtcaacgacgaaaaaaccaatcaggcactgtccgtcctgcggtacgagcttgaaaccttcgtctgcgatggccagtacgaaaagggtctggaacacatcctcgacgtctacctgaaaaacatcgagcaggccgagcagcctgccgtgtgggtcagcggcttctacggctcgggcaagtcgcacctggtcaagatgctgcgtgcgctctgggtcgacagcgcctttgacgacaacgccaccgcgcggggcatcgcgaacctgccacaaggcgtgagcgaccagttcaaggaactcagtacccaggcgaagcgccacggcggtctgcatgcggcgtctggcacgctgggttccagttcgcgcgacaagtccgttcgcatggccctgctgggcatcctcttcaagtccgtcggcctgccggagcaatacccggtggcgcgctttgtcatgtggctccagcatgaaggcatctacgacgccgtgcggggccatgtagagaagagcggcttcgactggaacgaagagctggacaacttctacgtggcggagggcctgcacgaagccctggtcaaggccaagcccaacctgttcacgtcgccagcgtcctgcgtcgagaccctgaacaacctgtacccctatgtgcaggatgtctccagcggcgacatgctcaaggccattcgccaggcgctgacccgcgacggcaaattcccgctgaccctggtagtgctcgacgaggtgcagcagtacatcggtgaagacagccagcgctccattgatgtgcaggaagtggtcgaggcctgctgcaaaaacatcggcgccaagatgctgttcatcggcaccggccaaacagccgtcaccggcacctccaacctcaagaagcttgagggccgcttcactgtgcgtgtggagctgtccgacgctgacgtcgatgccgtgatccgtcaggtcatcctggccaagaagcccgaggccaaggcaccggtcgaaaaagtgatgcagaccaacctgggcgaaatctcacgccacctagccggcaccaccatcggccaccgcgccgacgacattcaattcttcccgcaggactatcccatcctgccggtgcgccgtcgcttttgggaaaacaccctgcgtgtgctggaccagaccggcaccgacagtcagttgcgcaaccagctctcgatgatccacaaggtcatccagaccaatgtggatgcaccggtcggcagcgtggtgccagcggactacctgtacttcgatgcggccgacaagctgctgcagtcgcgcatcctgccgcgcaaggtgcatgagaagaccatggtctgggtcaaaggcaccgatgaccagcgcctgatgggccgcgcctgtggtttagtgtttctgatcaacaagctggccagcagcaacaacgaaataggcattcgcgccaccgtcgacaccctggccgatttgttggtggaagacctcacccaaggctccagcgcgctgcgcagcaagctcccgagcgtgctcgataagtgcgagctgctgatgacggtcggtgacgagtaccgcatccagacagaagaaagcgccgcctggaacgacgagttcctcagccagcgcaacagcctggccaacgaagcccaccgggtagacgcggagcgcgacgatcgcatccgccgccgcttcggcgagatggtgcgcaaactgtcgctgacccaaggcacgtctaaggtcacgcgcgatatcttcccggtgttcgatgcccaattgccgggcgacgccgccgagaaggtctgcgtatgggtgcgcgatggctggagcattgatgagaactcggtgcgggccgatgcgcgccaggcgggcaaccagtcgcccaccgtgttcgtgttcatccccaagcgctcggccgatgatctgcgccactacctgatcgacttcaaggccgccagcgccacgctggacaagcgcggcgtacccaacaccgccgagggcaccgaggcccgctcggccatggagaccaccaagcagaccgctgaaggcaagatccgcgagctgctgcaagaggccttctcgggcgcccgcgtcttccaaggcggtggcaacgagatcctggggaccgacctgcaggacatgacgctggaggctgccaccaacgcgctgcagcggctctacccgcagttcaacatcgccgaccacgccggttggcccaaggtctacgagaaggcgcagaagggtgcgccagatgccctcaagagcgtgggcgacgacggcgagcccgccaagaatccggtctgcaaagccatcctggccttcattgccggtggcaagaaaggcatcgacatccgcaagaacttcgagggtgcaacctacggctggccgggtgacgcggtggacggcggcttgcaggtgctgctggtggcagggctgatccgcgcccaggacgaaaagggtcagaccatcgacccgaaggacctggaacgcaaggttatcggcaagaccatgttcaaggtcgagtcggccacagtgtcagcggcgcagcgcatccagatccgcaaggtgctgcagaaggtcggcctcatcgccaagcaaggcgaagagctggcctacgtgccgcagttcctggtcagcgcgcaagaactggccaaccgcgccgggggcgaggccccacgtccggcacgccccgtgaccaccacactggaagaaatccgcctgacggcaggcaacgagcagctgctggccctgtacaaccagcgcgacgaactcagcgccgccattcacacctggacggatctggccgagcgcatcgacaagcgcatgcccgcctggaacacgctcaagcgcctgctggcccaggccgatggggtgtcgggggctgaggtcttggtggcacaggtcacgcacctggagcagcagcgccagttgttggaggagcctgatcccgtcacgccgctggtggccagcctcactcagttgctgcgcgacgaactgaaccggctgcacaccgactaccagacccgccacaagaacggaatggcgcgcctggacgccgataccaactggaagcagctggagcccgagcagcgcaacagccttctggtcgcccagaaactgaccctcaccgacgcgcccaaggtgcaagtggccaataccgacgaagtgctggccacggtcgatcgcttgtcgctgtcgtcgtttgccgaccgcgtagccgctatcgactcgcgcttcgacgcggtgctggtggctgccgccgagttgatggagcccaaggcgcagttcgtcaagctgcccagccgcaccatcaagactgacgaagacatcgaggcctggctgctggacgccaagcaaaccatcgcacaggccttgaagaacggcccggtcatccttcactga

SEQ ID NO: 516 - DNA, 3645 bp, Lactobacillus zeae
atggaaattaaagaattgttcaaacgaccgatcgatcgaaatattcaaggtgtcatcaaagttgatcaagatgatgacgcaaatgtaagacaggagcttgaagaatacgttgtgacaaaagagttacaacgccattttgctgatttcttcagtgctttcaacgagagcttgcatggcccaacggatgatatgggtgtgtggatttcaggcttcttcggttctgggaaatcacattttttaaagattatctcttacattttgtcgaatcgtcctgttaatcaaaaaccagctgtcgatttttttgatgacaagatcaatgatccgatggtgcttaacgatatgcatgccgcagcggctgctaaaaataaggttattttgttcaacattgatgctaaggctaaggacaacagcggaactgatcagcagtccattttaaaagtcttcatgcaggtctttaacgaaatgcagggattcactgatgttgatttttggatcgctgagttggagcgaaaactaacagatgcgggcaaatttgatgcgtttaaggaacagataagctctattgatcctaaacatcaatcttgggaagaactacgcgatgcctattattttaataagggtactattcaggcggctatggttgctagcggttatgcaagtgaatctaatgcagagggtttcattgaacagctaagtacaccttatgaaatcagtatcgaggagtttgctgattgtgtgagtgcttatactaaaaaaactggtaatcgcgttattttcctcgctgatgaagtgggccaatttattggtgatagtgtccagcggatgttgaacttgcaaacgattgtggaacaacttggcacaaaaacacatggtaaagcgtgggtcgttgtcacgtcgcaacaggcgatcgacaaagtaacggatattgcttcaggacaagatttctcgaaaattcaagggcgattcaaaaccagaattgccatgagttcaactaatgttgacgaagtgattcggcaacggctcttaactaagacggaaccagcagaaaatctgttagagtcgaaatacgaggcgaatgctgcatctatcaacaatgccattgatttcgacgacggcattagccggccaaagtacaattctggtcgtgattttgcgcaaaactatccatttattccatatcaatttgatttattgcaggacgtgttaactgctattcgagaaaacggctcggaaggcaagcatttgtctgaaggcgaacgctcaatgttgtcgttgttccaagaatccgccgaagcaatgatgacatctgaagataatgttttggcaccattcagtcttttctttgaaggactagatcaatttcttgatcatacccatgcgatcgtgattcaacgtgcccgtgaatctgcgaaggttaacccagatcatgaggacaatccatttacactacagatcctcaaggttttgtttatggtgaagtatgtcaagaaattcaaagcaaccttgaacaacattacgaccttgatgatcgataaagtagatgtagatcgagtcgtgttgaaaaagcgcgtatccgatgcgcttaccattttggtgaatcaagaattcgtggaaaataatctgagcgataagacctatgagttcttgactgatgctgagcaggacattacgcgcgatatcaagaatcagcaaattgagagtggtgacatttccagacagattagtgactatctgtttgagggaaaatcagccctaaacggagcatactcgtatcccaaattgaacggccggtatatcttcaactttgacaagaagattgacaatgttgatagtgtgcaacatcgcaatcctttaaccgttcatgtggttacacccttagacggtgattttcaaaatgaaacggattttttgcaagcttcttctggaatagaaagcaatgctgttttggttgcgttaccagctacatcagattacattgaccaagttcgccgtgccctgaagattgaacattttgttaacactaatccaacgggacgagatgaacgatacaagatcatggtcgatgcccgtcaaggtgagcgcgtgcaattacttaagcaggcaaatattcaaatgactaacgctttagatgatgctgacgtttatgttggcggtcgaaaaattgaatccgaagccagcttcaagaatcggctagacgctgcgatgaagttactgattgacaataactatcggaagcttgattatatcaacgccgccaagtctgaaaaagatatccaagacttatttgatccggatcgtttatcaatcgatgaaggcgacaaccgtcaggcgctggatgctttgactgactggctaattcaagagaatcagaataacacccatgtaaccatgacgagtatcttggctaaattccgtggcatcccatatggttacaccgaagaagacatcgaatggttgctagcaaagctggtgacagatggcaagttaaagatgttctttaatggatcgccgataaatactttgagcgatgggatttcttccaaagcaatgaccgagttctttaccaaaaagcagaaacgaaccaatcttgcattccaagttcgaccggagatcccagctaataagattaagaagatgcgtgaagtcgctgcggaggtttttgataagaagacctttgactcagacaatgaagaacagatggctagcgaactaaaagctaaaattcagagtgacctaaagaatcttcaggattttgagaatcttgatcagcgcttcccaggccatgttttgttacaaactgggatacggatgtcaaaagacttagtgacgattaatgacgccagtgttttctatgattatgtgtttaaaaatgctgacaggttggaagactggcatgaagattatattgatgatggtatccgagacttttacttttccattccccagagagagatctgggaacagggactagaagcagttcgtaattaccaacaatctcgtgactttttgagtgacggtgatttgaaggaaatagcaaagcaattggaaactgccctaaaatcgcagaagttgcgcaaggaaacggttccatcgattaaagaactgcgcgctcaattcaatgaattgtttattcaagcatttgataaggaagcagctaaatacttggccgagatcgaagaacttaagaaacgcgggttggatcggttgtcagattcgggtttagaagctacgacccaagaaaaattgaaacaggaattcgtgatggtcattgaccgaattgctaaggaaggtcaagatgccactacaattaatgcactagcggtaaagcctgctcaggcccgatcacaattggaacagcttactggccgcattgccgacatgacagctaaactggctgttaaaccaccggtagttaagcctaagtcggacgattctggggaaggcacaaatcctgaactggtgacgccaaaagtccaagttaaaaaggcagagagaattgttaaaatgcgtcagttacttgatccgggcgactataaacttgaagattccgaggatatagagaagatcgcagcccttttcaaacaaagattagaggcaaaactatcaagcgagcagaatcaagttattaaattggaaatagattga

SEQ ID NO: 517 - DNA, 1548 bp, Bacteroides ovatus
atgcataagatacaagatcttttcgacccgaccaaacaacttaatagaaccattgaaagcgtggttacgtttggagccaatacagaacaagatttaagttcagaaattcgtgaatatgtggtaacagacaaacttcataaaaactatgaagatgtaataacggatttgcagactgcatttgatgattccagcaaagaagtcggaatatgggtatctggattttatggatccggaaagagttcatttgcgaaatatcttggtctgtcattcgacaagagtgtaatgattgacggtgtatcatttggtgacaaattgatgagtcgtatccaggatactgccatcacggctatgcatcgaaccatcatatcacgccataacccacaagtggtaatgattgacctcagcacgcaatctgttgctggtaaaatcgcaaacgttagcgacatcgtttactatgaaacattgaaattactgggtgtaaccaagtgtacagaccaaaaggttatgtgtttcattgacttattgcatagcgaaggtaaatatgaagaattttgccgattggtagaaacagaaaagaataaatcctgggaatcggtagaatccaacgaccttgctgccaatcttattgcagctaatcttgctcctcgcgtacttcctgcttattttccagatagtgcaagtttcaagaatattaatttgagtagtgcattgaatgaaaaagaacgttttgttcgactacataaattggttaaggagaaaacaggaaaagacaaaatcatttatgtattggatgaagttggtcaatatgtcgcatccaacgttgatttgattttgaacgttcaaggcatgatgcaaattttcaaggatgaattccgtggtgatgtttgggttattgcaacagcacagcaaactttgacagaagacaatcgtcaggcccaactcaactccaacgaacttttccgtctgaacgaccgattccccgttaaagtggatattgaagcaaatgacatcaaggagattatcacaaaacgtttattgggtaaatccaaagacggaagtgattatctcaaacgtttgttctcgcagaatgaaggtttactcaaaaatagtatccatctaactttgcaagaacgaagcatctataatcaattgctgactgacgagacatttaccaatctctatccgttcttgcctgttcacattgatatcttattgtctttactgcagaagttagctagtagaacggggggggtcggcttacgttcagtcattcgtttgattcgcgatatcttggtagataaccatcttgcagatgccacaataggccagcttgccggtccagaacatttctatgatgtgctccattccgacatggagcgtaattcagcgaaagagattgtgatttcagctgataaagccatatccatattcaacggagataaattggctgtccgtatctgcaagacaattgcggtcatgcagttactcgatgattttaatttgtctttcgacaaccctatgtgccttgttatacaacaacgtgggtag

SEQ ID NO: 518 - DNA, 2121 bp, Bacteroides ovatus
gtgggtagcacttttgacaaatcaaaggttcgtgaagcgattgaaagaatcatggattctaccagtgtaactcttcaagagattgatggtaaatatcaatttatgaccaatgccattttgagcatacgtgaagaacgaaataagattatccctcgagatgcagagaaggctgatgttcttcaagaacaattaaaggatatgctttctccagctccttctgtcaatgtatattccagcaaaaccatcactgccggagtcgaactgactgagagaaaccgtccttataatattcatccaacaacaagcggtttgaaactgaacatccgttttgttgatggtagtgcttttgatgaaactcatcagcaattattgacagaaagtactcgccaagaaaataaccgcacactttattggttatgcactttggctaaagataaggaaacgatattacaggaaatcgtacgaagtcaaaatatcaagaatcgacatcaaaacgaaacaaataaagagatacaggcttacttgcgtgctcaaacagactttgccgatgaaaaaaagagagagttgaacaaaatcctgcgtgaggcacaagccaatagtgaagttatcttccgtggttcgccacaacaggttaatggcgagacatacaagacggttgcgctgaaaaccattgccgaaaaggtatttgagaaataccctttggcttcaagcaatatgaagggagactgcgtcaacaaattggcttcatacggagatttgacaactataccagacgctctgaatccatttaagatcatcaagaaaacagatggtaccattgacgtctctcatccggcaatctctgaaataaaggattatattgctacgctcaatgaagtgaccggctctgaaattatgaaccgatttgagcgcgatccttatggatggtcaaaagacactatccgctatattgttgcactcatgctgaaagcaaacattatccagattcgtgttgcaggaaagaatgttacagtctttggtgatacagctgttgaagcgatggcgactaataatagtttcaacaagattagtgttctacttaacacggaaggagctcttaccacaacagaattgttgaaggcagcacagagtatgactggtttattcaatagttcacgagtcgcacctgtcaaagaccaaattgcgaaagaagcatacaaaaagattaaattgtatttacaaaaattcaatcgactattgcccgatttcgaggtcttgaaattagatggtgaatccattgttcgccaagcaatcaactatgcacaacgtatcattgacagcgaaggtggtgaggcggcattcttgttgggtaaggatgtcgactgccaaaaggcttttaaatacgtgatggatatcataaaatgcaacgaacaagcttctctcattaaccatctgaagcatatcaaccatttggcaaatgaatctcatactcttcctgaagttgagcaactggcagactacatcaagcatgtcaatgatgtgcgccaattgtatcatgaatacattgccaatccggatttgcatctgatagtctctaatattacagatctacgcaatcagtttgatgcatacctcaatcaagcttgtatcgaattccagacacagacagaaaaattgttggatgaaagtcgcacgacaatgaagagtatgccagagtatgcaaagttggatgacaagcaacgtactcagatcgatactcagcttgatggtttaagcattgagtgcactcatccttctattagtaatctgcgcgaaatgatcaataagtttgtgacttattatctaccatctggaagtattaagacaatagagaatagaatcaggcaatatgctgcagacaatgcacctgcagtaaaggttataccgacacctcccacttctcctcaaaaaggtgctacccaagaggatgatgcgaccaaaccaaacaaagtggaagagccaacctatcagcctaaacgcttgcaagtgaaacgaaagattacaactcgaacagaattgcaacaggtaattgatcaactgacttcgttattgggcgaaatcagtgacaacagtcctgttgaatttaattttaatgaagattaa

SEQ ID NO: 519 - DNA, 2367 bp, Escherichia coli; identical to SEQ ID NO: 418

SEQ ID NO: 520 - DNA, 1092 bp, Escherichia coli; identical to SEQ ID NO: 419

SEQ ID NO: 521 - DNA, 2367 bp, Escherichia coli; identical to SEQ ID NO: 418

SEQ ID NO: 522 - DNA, 1092 bp, Escherichia coli; identical to SEQ ID NO: 419

SEQ ID NO: 523 - DNA, 2754 bp, Coprobacillus sp.
atgattattaaagagatgtttaaacaagatattaatcgaccaattaatggtgttattcaagttgaacaagaacaaaaagaagtaattaaacaagaagtacaagaatatgttatcacaagtgaattaaagaaacattttaatcatttctttgataaatatagtgaatcatttagtacacccactgataatactggtgtttggattactggtttctttggaagtgggaaatctcactttttaaagatgctttcttatttattagaaaataaagaaattgatggcagaaatactgtggattattttagagaaaaatttgatgatgaattatcatttatgtcaattgaaaaatctactcaagtgttgactgaaactatcttatttaatatagatgttgaaggatctattagtaaagatgatacagctgttttgagagtatttgcaaagatgttttatgaacatttaggattctatggtaaagatttaaaactagctaaattagaacaattcatttcaaaaagaggaaaaatggatgagttcaaaaatatctttgaagaaaagaacggcgaatcatggattcattcaagagaagattatgctttctgggaagatgatattgttgatactttagtagaagtattaggaatgtcacaagaatcagcacatcattggtttgatggcacagaaacagctgatatttccatcggacaattagttcaagaaataaaagaatatgtagagtctaaacctaaaggttttagattattatttatgattgatgaagctggtcaatatatcggtacaaatacaagtttattattaaatcttcaatctttgattgaaaaacttggttctacttgtagaggtcaagtatgggtagttgctactggacaagaagctttagatgacatgattaaattacgtactgatgaattttcacgtatcatggcaagatttaatgttcgtttaagtttgacttcatcatcagtaggagaagtgattgaaaagcgtttactaacaaagacggatcaagcttatgaaaacctaagtatggtctatgataataatgattcagtattaagtaatttgtactctttacaaacacaaaagaaagatttaaaaggatatcaatcacctagtgagtttgctcgtatcttcccatttgttccttatcaattcatcattatgcaagatgtgttcaatgaaatacgaaaaaaaggacatgctggtaaacatcaatctagtggggaacgttctatgttgaatggatttcaagaatctgctcaaaaaattgaaaacagggatgaatttgcattagtacctatgtattacttctatgatacacttcatagttttttggatacttctataagaagtgttatagaacgtgctgaaaaagcttcaatgaatgaacaaggtcttaatgaatttgacgttaatttattaaagcttctttatcttattcgttatattgatgatattccttctaatgttgaaaatattacgatattaatggctgatgatatacgtgtagataaacaagaatttagagaaaaagttaagaaatcattagaacatttaattaatcaaaactatgtttcacgtaatggggatgtatttatgttcttgactgatgaagaacaagatatcgctcgtgatataaaaaatacggatgtagatacttctatgattgtcagtagattaggtgatttaatttttaatgatatctataaacctaagaaatataaatataacaagtatgattttgcttttaatgaaggagtcgatcaacaagttatcggtgctacttacaatgatgtaatgaagttacattttatgagtgtagccgcagatccaaatgaacttcaagaacttcgattaattactaattccaagaatgctgaagttatttgtgttctttcagatagttatacatattatgaagctatggaaacagctgaaaagattagaaaatacataaaacaaattaacgtgagtcaaaaacctgcttctattcaaaaaattattcaagataaacaaaatgaagcaagaagattagaaatacaagtcatcgatgatgttaaacaagccattgtagaaggaaaatactatatagctggagaagttgttacattacaaggaaatgatgcagtagcaaaaattaataaggctttagagtacttagttgaacatacttactataacttaaatatgattgacgctttctatgataatgatgcagatataacagcagtattaaatgggacaaagacattcttagctggtatggaaccaaacaaacaagcatgtgatgaaatagaaaaatacttagaattacaagccaatatgaaaatgcctacctcaatgtttgatatccaacaaagatatgctagaaaaccttatggatggagagaatctgatattgccggagtagttgctcaattactagtaggtcaaaaagttattattaaatatgcaggtcaaaatatccaaactaatgattatcgtatggttggttatttaagaaagagatcagaagtaggacaagtaagaatatctaaaagagaaagtataaatgcttcaaaactaaatcaaacaaaaactttcttaagagaatattttgatgtcatggatttacctaatgatgaagatggcttaattacatatattattactaattttaaaactaaaaacagcatagatttttcagtatctttttataactatcacgaaccgtcaatatatccctgtttataa

SEQ ID NO: 524 - DNA, 762 bp, Coprobacillus sp.
atgaaattagtaaatgatgttcttaaaaatcaaagtgacagtattgctttaattgattctatagtaaatctgcaagatgatttattagacaacaaagatgatatgaaagcagtagaagaattctatcattcacaaatcactttatttgaaaatgctgataaagtattagttcaaacgacaagagagatggattactacaatgatgatgaagatgtaaatcaagctattcatctaataaaagaagttgttcgttatgatgataattacaactactcacgtattcctcaattaaatggagctattgcaactataaaaaatgctaagaacattttattagaatccaagaaacaagaattattagctttaatagaccaatgttttagcgaaattgacacaaaagctaaggaagataatataaaactagcaggattattaaatcaagctagagttaattttgatagtaaaaaagatgaaatttctaacttaaatgatttgattactctagaagccaagaaacaaaagatatttgaagatactaataaatatattcgatcgatggataaagcattaaaaccagatactgctacaccaccaaaagaaccaacaactacaactacacgtagagttaaagaatattatagacaagttattttccctactaaaactataaaaaatgaagcagacattgatttatatctagatgaattaaagactaaactaatgaacttaattagtgatggtgatgaagttaaattaaaatag

SEQ ID NO: 525 - DNA, 3696 bp, Natronorubrum tibetense
atgactgatacgacacttgaatcactgtttgctcgctcgccgacgcgagaactcgaagaagtacagaaagtcaacgaagtcggccaagccgaacgcgacatcgacgagttctacgagactgatagcgctcgaaaagtactcacagaacttggagaagtcgtcaacagtacaggatcacagccacgcttccggtatgtccatgccaccttcggatccgggaaaacgcaccttctgaagctgatcggaatcgcgaccggcgagatcgaggggctcgaaacggtcgctccgaagctgtcgagccaattctctgggttcaaggaattcagagaccggctcaattcgtcccacatcgatcacctggtccccctgttcatgaacctcctcgaccgggacaaggttcgtgactcaacgctctctctcctgatctacgaggagctggggaatcagctcaactacccgactgacccactctggctactcgagtgggcgtggacactagagatcgagcatgggctctgggaagccgtacgctctgtagaacacgatggaatgtcgatagaggaagcagcacaagacaaggctgcgctccgtccatggctctatgaagcacttcccgagatggacgagactgacggcacgccctatgcaacgaaagatggcgtcagagaatcaatcgagcaagccacgggacggatcagtactgaggcgttcacacctgatgagctcgtagaacggctggaccgaacgaagcgctacctacaggaatcaggcgaaacgtacgagttcctcatcgggctcgacgaagtcgccatttacgtcggtgaccagcaacaccgctatcgagagttcctggagacggtcgacacactcatcgccgacattaatcccccaattttggggacaggacagtggtcgctgcgggacatgcagcaggatttcatgggagaggtcgatcctgaggcgtggtacacgaacgaaattccgctccggggtgccgataccgagatcatagtcagaaagcggtggctccgaaagtcagattccggggcgaacacggtacacgatctgctcgaacgggctcctgacttcgagttagaacttgccgacgcttcagaatacaccgacgtcggtgagcccgtagaggcgtatcccttccgtgaacacgacctctggttgctccgtgaggtaatgcagagtctcaagaaagaagacttggaagtggacagagagtatgttcagggacgagcgctgctgattctcgttcgttctctcttcaccagctttgattggtcccagaaagagcctggagcggtcgttgcgtgggatgaaatctatgacttgattgagcgcgaaacaacggacattccggggtgggcaaaggaccagatccagaaagtcgagaacacgactgacgagatgggggtgagtgtcgcgaaagttctctatctccttggccaggtcgacgccgtcccaacaacgaaggagaacatcacacggctgctggttagctcagtagatactgacatcgatcagctcgaaagcgatgttgaggaagccctcaaagcgctgatggaggacaacttcgttcgaaccgacgagagtgtccaaccgcagacgtatagaatcctgtcgaaggagattgtcgagttctgggatcagattcaccgggaggcagcagggcttcctcaacatcaagttcggtacaatattgaggaccttcttcgggaggcggatcgtggtcggttgaccgcggatgattcactccgaacgcggaatatcgatgggatttccgacgccccgtatacgttccgctacactgtattagaccaagtcgactcctcaccggaacctcgtttcgatggtgtagttgccagggtactagcggctgacccggatacaatagaagagtcacgaacaagatggcaggaggcgaacgttggtgaccaaggcgttgaagacgtccttatcgttattgagctttcagagggccttcgcgagagtattcggcatctgattgcgttggataagttattggagccgggggctagcgcagaactccgtatcgagcaacaacaggaggaggagaccgtcgaagacgagatcgaggaactcctctatggcgcgaagctctatacgccggaccataacacgacgcgagggacgtatctaagcaacatcgatagtgtgctcgctgatgctgtcagagagaaattcgagaacaggaaaacactcgatacacggctgcaggaggttgacgacgctcggaccctcttcgagttcttcaacgggaatggtacgtggccgttctcaagcgacgacgcagaaatgctcggggtcaagacagttccgagagagattagtgacgggtgggctgaagagttcctcaacgattacgctggagaggaattagtgagtggagagactgtcctcgaagaaatcgctggtcgacgggggaaatatctcgggacgccacgcgaggcactggcggcgcttctgatcacgcttgccgcagcaaacaaaatcgagatcagacgtgatggggtccgtatcgaagacccgggcgaaatcggtcgcgtgatgcgacgtctttccgatatccgtgacatcgatattggattcgatcccgtggacattgagggaagtagcaatctaaaagcggtctatcagtctctccgaggattcgctccacaagggaacgatccgaccgcttggctctccaatctcgcatcatgggcagaaaagaatagttcgggtattcggaacatctgtgctcgtgtggatctcgagtttgacgaagaaatcacactggatgcgctccgtgacgtattagaaccagggatggcaggtggcgaacttgacgatgcagtactgacagaatcgccagtaccaacgcaggcagagtggttccacaaagctgaaccattattcgagggcgaggagccgctctgggatgagttcaacagtacactcgagacgatgcgatcactgtacccagatgctgcgattacctacaagatggaggacgccgtcgatgggtcgcgcatcccatccaaggagagcctgactaagcaccagacagaggctcaggacttccgtacctcacagattagtgaactctaccaccttctcacgggaaccgcacctgaagcggattcgatctcggagctctgttcagcggtcgagcaagcgttactggatcaagacataatcgtggaaatcgacaccgtcaccgagacgattccaggagtgaatttcgagtcactcagagaactcgatgagatcgctgaatccgcggctgacatctccgaatccgatatcgcatccgggaacgcagtcagcgaagctagccagcttgaggaggcacgaggactacttgaggatcaaccagatggtccactctacaaccagctcgaatctcggtacgaggaactcaactcagaacattctgaggcgttcatcacgaagcaggtgaagcgtgcgctaagtggaccagacctcgtcacaccgtctcgagcagaagcgttggtgaaacaggccgatgcaaagctccagtcaacggacgatgatgacgacgatgatgaagacgatgatgaccaagatgacgacggaccatctgtcgacgagctctgggcagatgtgaccgaaccaggtgacggtactattgtggttatcgatacagaggagggagaccgatga

SEQ ID NO: 526 - DNA, 3702 bp, Natronorubrum tibetense
atgacgcccatggacgacctgttcgagaagcaggacgcgaccttcgaggagtccattcgtatcgaccggaagttcgaggaggacgaagacagagccgctcatcgtgaccagctctaccgccactacctcgacacctaccacatcacagatgcctcagagaccttccttcgtgacttctttactcgaattcacggccacgacgaggagatgcggaagggagccaatcactggctctacgggtactacggcagcgggaagagtcacctgttgaccgtcctcaacctcctcaccgcgtctgcggacctcgcagaggaagacagagaggaagtctggaatcggctggattcagatagcgcctacagcgacctcttcgatacctggtcctcgatgctcgacgagtaccgtctcgtccccctcccgatcaacctcctgaagtatcagagtgttcgcgaacagagcttcagcgagatcatcctccaagcagtctatcaggcgcgaggcctctcgaaccgactcgacgtcgcattcttcgaggagtggtaccagaatcagggaacgtgggatcagcgtgacgaactcacgaaagaggtcctcaaagacgaaggcgttcccaacgcggatcagtactcgtgggacgacgtccaacagtaccgaaccctctctgatctcgttctcgaggagctcgtcgaacgagagacaggaactgcagatgggttggcggacatccaacgccaggacatcgggcagcggatggctgtcgaagccgtcgagtcgtatcggcaagaccttgaggcggagtctgagaagccggtaaagatcgtcctcctcgtcgatgaggtgacgctcttcatcggtggtgactaccagcgtctctcggaactcaacgcgctcgcggagagtatcgatacgatcggcgaggggaacatccagatggtcgcgacggcgcagtcccaaatcgaggacgtccgaccaggacttgccgcgaagcaactcgacttcgggattctcaaagaccggttcccccaccagtatcacctgccaagtcatcacgtcggggaaatcgttcagcgtcgcctcctcgagaagaccgaagagggagcagactgggttgagtcagaagcactaacggcgcgggtacatccgacatctacgttcgtctactcagaggtcgggcagaacacggagccacctctcaatcgagtcaaggaaaatgagttcgtgcagttctacccgctcctaccctaccagccggcgctcttcctggagatactctcgaaccttcggaacgagttggccgactcgacgaagtcgatcttctctgggacagcgagagcgattctcgccatcgttgccggactccgagaccgatggatgcgcgacgaaagcaaagacgagctgtccctcatcagcctcgtcgacttctatgacctgattcagtacgagcttgaggacatcatccccaacgagatcgaagtcctggaggagatcgaagccgacgaagacacaactgatttcgacctcaaggtcgcaaaagcggtcttgctcctctcgtacgtgcccgattcagtcccacagaacgatgccaacatcgcggtggcggtgatggacgacctcaacgggcagccgcgaacgaccgtccggaatcaggtccagaattcactggagaacctcgacaagtacatcaggccgaacacggccgaggacggtcctctccttcgaatcacggatcgagaggaacgagagattatcgaagaggcacgcaagaaccgcaagaacccagattgggatgagattatcacggctttcgacaatgaactctgggcggacatcagccctcgtctgaatctcccaacgtcggttccctacggtggggacggtgacaactaccccatctcgtacaacttctccatcgatggacaaccactagatggggcggacgaacacgagagttccctcgaagccactgtggttatccggggcgtgcgacctgatgtcgactctaagaaaatcaacgagggaacgatctactggtcggttaaggaggatggattggagaatctccgaagccagctcatcgagtggtggtcgttccacgaagcgactgccgaaacggagacacccgatacgatagcccgagacgtcgacgatgcagcggatagggtgaaaagtaagctcgcgagcgcgctcaaagatggctcgtacaaggttgaatctcaggaaccgcgtggtctcgattctgcggtcaaagagtgcatcaaccgtgcctatcccttgttcttccatcccgtcatgctcgaggtagaccagagttacctctcggagctaaagcgactcaacgacgacgaggagtacccggagtgggcacagaagatcgatgtcccaacaccagatgcggaggtgtccacgatggggacgattgcgaaagagattcgaggcgccgtcggtcgaacgctggtcgaccatgacaacgagatgggtctgccagcgctcttcgaaaacatcaccgaggagacgccgttctacggagaggtcaaaccggcagtaacggcggtcctttgggggctgtgtcgcgcaggagagttccgtcccattgcagaagacggagaggctctctccgcggatgaactgctgacgctctctcagcagatggagatcaagctgcgtacggcaccgtcgtcgacgtctctcaaggaacagttcatcgatgctggaatcatcgatccgattcaaacggtcgacgagggaatcgtcgccctcgaagagttgaacgagtcggtcaagaggcaagcgcgcacgcttgcagagacgacagaagtcagtacagagacggaattagagagcgatgcactcgtctctctggttgcgtcattcagcaatgcgctctctgaactggcggatagcgcagaatctcgcgccgacgcaatcgctgctgacgatacggactgggaagagataatcgatcaagtggcgagtgacgaagagtggttgactgcggttgaggatcgatgggactccagagaatcctacctgttacaactcgacgggctactgcgattcagagagctggagattgactggcttagccagtcgttctacgacgcacttgaccagctgagccaacagctcgaaaacgagtctggtcgggagtggtggacgcaggagggttggcagtccttcgatcagtcactagatgcccggttgaccgcaatctcggcgcttgaagaggattggtcggctcaagtggctgaaaccaacgcgaaatcactagtgacggaactcgagggacaccaatggctgatcccgcccctacagctccctgagcacagcgttcacgatggattccagtccggatatctccgcccacttcggcacttcagagatacccacgaaagcatccaagtctgtattagtgcgttaacgaaccgggaaccaggaactcacgacgagcgtacattgaaacgagcgctcgggacggtatcctcaacgacggattgggatagcctcactgaggaccgagtcgacacgtatcgagaaaagtacgagactgtagagcagttggtcggtgggactcgacccgaggaaatcgaaggcgtaggtgtgctattcggcgatgaatctgcactcaagggccaatttgagcgtctcgtgaagtcgaggaagccgacgattgaacagatcgatggaggtgtgattatcaaatga

SEQ ID NO: 527 - DNA, 3843 bp, Haloarcula argentinensis
atgagcgacacacacattcacgacatcttccagcaatcaccgactcgcgaactcgaagaagtccagaaggtcaacgccagagcacaggccgaaaacgacgtccgcgagttctacgagaccgccagcgctcgcgacgtgctcactacgctcggagatctcgtcgacaagtatccacacgagcaaccgcgtttcctctacatctccgcgacgttcgggtcggggaagacacacctcctgaaactcatcggcttcgccgccgataccgaatcggagtttaccgatctcggcgaagaactggcgaacaggtggccgggtttccagtcgttccgacagagcgtcgccgactctcacgtcgaccgactgaagcccgtcttcctgaacctcctcaaccgagacgcgtcacaagaaccgccgctcccctacctcatttacgaggcaatcggccgcgaactcgggtatccgactgatccgaactggctgctcgaatgggcgtggcaactcgacatgaaccacgatgactgctgggagcggctacagcaagtcgagcacgacggacagacgttcgaggacgtgtacgacgagcgggcgtcactacgaagctggctgtacgacgccgttccgacactcgaggactcaccgttcgcgtctcgggaggaggtcaagcagtcgatcgacgacgccatcgcggaagtcgatcccgacgagttcgatcccgaggagctcgtcgaccgcgtcgaagcggcgcaagcgtcgctgagcacgccggagaccgagacggagttgctgatcgggctcgacgaggtggccctgttcatcggcgatggccgccatcgctacagagagttccaagaaacgatggaagcgctgaccgagctcggcgtcgggcctaaccctccggtcatcgggactggacagtatccgatcgaacgtatccacggtgagttcgacgatacggcagtcacggaacaaccgtggtacggtgcccaagaaccgctcgaaggcgcggacaccgagatcatcgtccggaaacggtggctgcagaaggatgtcgagggcggacaggccgtcgagaccgcgctccgggagctgcccgacctgacactcgacgcatatacagatatcgccggggccgatccggacgcaatcgaatcgtacccgttccgagagtacgatctcgggttgctccggacggtgattcagcaactgatgccgcgtggacgcgtgactgaaaaagagtacgtgcagggtcgggcgttgctcatcctcgtccgatcgctgttcacgcggttcgagtggggagacaagcaggtcggtgccctcgtcacatgggacgagctgtacgacctgctggtcgaggagacgacgtacgtcccgctctgggtacaggagatggtcgagaacaaactcgtcccatcggccggcggcgacgagaacgcgttctcagttcgggtggcaaaggcgctgtacctgctgaatcaggttcagtcctcggtgccatcgacaccggcaaacctcgcccgactgatggtcacgtcgactgacgagtcgttcgagtccgtccgagacgacgtcgaatcggcgctgtctgctctcctcaaggatcggaaggtgctgacggagacaaacgaccgtggcgacgaggagtacctgctggtctccgaggaacaggaggatatcctgacgcgggcgaagacccgcgcacaacagattccatcgcaccggctgtcggccaagttggagaattccattcgcgagggcagcgatcgcctgctctctgctggcagtcgacacgaagtggatttcgagggagagcgcaaagtcccgctccggtttggctactccgtcctcgatccgatcgagaaagcaccgacgccggagttcgacgccgttcgtgtgcgactggtcgcgaaccgtgacgccgaggtcagcgatcaggttgcggcgtggcaggcaacgaacgagggccgggacggtggtgagcatatcctcgtcgccgtcagtttacagcaatcgacgatcgatcgcctgcgagacgtgatgggtatgcaggaagtgctctcggaagagacagacacgtatccggatctggagtccgatcaccgcgacgaacagcgggcactcgaatcggcgattcgcgaaagtctcaaagaagcagacgtctacgtccggacgggcgggacgagagggcgatacgaggacgcgttcgatcaggtcgtgcaaacggaagtccagtccgtgttcagcggaacgcggttcgtcctgacgaacggcatcacggaagtcgacgatgccaagctgatggcacagttcttccgcggtgtcgccgactggccgctcacgagcgaagacgctgtcacgcttggagtagataccgaccgcgccgaactcgccgacggctggtgtcgggaattcctcaacgagtacgtggacactcagtcgcttcgggctgaggacgtgcttacccagactgtccagcgtggcggcgcgtatcgcgggacgccccaggagtcgatctcggcactgctgatcacgcttgcaacagccaacgagatcgcactccggcgggacgacgagtacattaccgaaccggaggagatcggacgggcggtcagaaacaagacgaacctgaccgaggtacagatccgcttcgagtcgataggcgatatcgatccagagcggattcgggaaaccgtcaagacgctgatcggcgaggagccggacgggaccgaccccgacgcgtggctctctgcgttagccgagtgggttgacgagaacagcgtactggtgaaacgcgtcattcgaggcgtcagcagggagttcggcgacggcgcttcgctggacgaactcgaaacagcgctccaacccgcactcgagggcgaatctcttgaaacggatgctttcgcgtccgaaacggtcgaacagcagtccgagcggttcgctcgggccagcgagctcttccagccgagcgaggacggccagtctctctgggagcagttcagccagcggacagtagaaatgaagcggcgctaccccggtccggacattacgggggagatgcaagcagtcgtcggcggagacgaagtgccagccgccgaccggcttcgaacactactcgaagacgctgacacgcacaggcgtaccgtcgtccgtgcgcagtacgaacgcatcacgggcgaaccgccgacggacgaggagccagagagcatggtgtccagtctcgccacgtggctctacgctcatgacgggagcagcaaggaaaccgcagaccgcgtcgccgtcgaattcgacggcgtcaccatcgacgacctctacgatctcttcgagacggcgtggcgtggtgactcgttctccgaggaagccctcgtcgacccgacggtcgtccaacaggccagacggtacgaacgggcacggcggctcctcgaagcccccggtagcgaagcctcgctctggtcgcaactccgcgacgcgtcgaaacggctcgcggaagaccatccgaatcacccagtcacggccgacgtgaacgagatgctcacccggtcgcagccgccgagtgtcgacgatgtagaacaactcctcgatgcggcggagaacccattcaagatcgacgagcggcttgcggaactcgccgaggaactgcagtccgagcatccagaccacgacatcaccgacgagatcgtcgatgcagtagaggggatccgctcaccaagtgaggaacgagtgggtgaattgatcgaagaagctgaacaagtgcttgcgggcgtggacgagcagttacggcgaattcaggagacgatagatgacctaccggatggcgctgtcgtgctgatcgagtcgctcgattga

SEQ ID NO: 528 - DNA, 3684 bp, Haloarcula argentinensis
atgacggacgagggctggttcgctgccgatgtggggagcgacttcgaggagtccgtgcgcatcgaccgcgaagacgacggtcgggatcaccggctggactcgatcgagacctaccacgtgacggaggagtccgaggacttcatgtccgacttcttctcgcgcctgctcggccgttccgaggatatgcggtcgggtgcgaactactggctctacgggtactacgggagcgggaaaagccacctcctcagcgtgcttcgtggtctgttagacagcgaatggctccgacagcgagatgaggtctgggagcaactaaccgatggtcgtgagctggacacgctcgaatccacgtggtcgtcgatccacgatgagtacgaagtcatcccgatctcggtgaacctactgaagcatcagggccagaagaaactgagcttcagcgagattgtcctccgcagtgctcacacgtcgaaacggctcactggtgccgagggggggctctcgtcgcagctcgacgtcgccttcttcgaggactggtaccggacgaccgacgcgtgggacgaccggacacccaacacccaaacggcactccggagtacggttgacagccccgagaagtacgactgggaggacgttcagcagtacaccgctctcgcggacgccgttctacccaccctcttcgagcaggagaccggcacggttgatggtctagacgacctgatgccgtctgatctcgacccgcaggcgatggtcgagcgcctcgaacagttgcggagcgaccgcgaagcggaactcggccgcccagtcaaactcgtgctgttgctcgacgaggtcagtctcttcatcgggacggatttcgaccgcctcacagagttgcagacgctcgcggagagcgtcgacgagaccggcgacggcgacatccaactggtggcgacggcacaggccaaaatcgaggacgtccagccgcagttcgcggctcgtggggccgacttcagcatcgtcaaggaccggttcccgcatcggtttggcctgccgagccgacacgtcggcgaaatatcgacgcaacggctactcaagaagtcggaagccgggagggagggcacggagcgcgtcctcgaccgaaccagcaacgagcccgagacactgctcgtgtactccggcatcgaacagaacaccgaccccccgctcgacaacatcgatcgcgagcgtctcatcgagttctatccgttcctcccgtatcagccaccgctgttcctcgagatcctctcgaacctccggcaggaagcacacgatccggcgaagtcgatcttctcgggaaccgcacgagcgattctggctctcgtccacggactcctccaagagtggatagaggccggcaacgagaccaacgtcatttcgctggtcgacttctacgacctcatcgaaccggagctcgatgacattacgccacaggacgtgggcgtcatcgaggagattgaggaacaatacgaggcaggcgaactggaagagatcgacgtggacgtcgcgaaggccgtgctgctcctccaacacatcccggacaccattccgatgtccgagcggaacctcgcagtcgccgtgttgagcgacctcgatggcccgactcagttccagatggagaaccgcgtcgaggattccctccaacggcttcggaaattcatccgccccacgcacgacgaaactgggccgaagtacgcgttcacgcatcctgaagagcgcgagatcatcgaggccgccgaggaaaacctcgacaatccggactggcagtccatcatcgaagccgtggacaggtatctctgggaggacatcgtacgcgacctctcactgccgacgtcggccgagtacggggataccggcgagcagtatcccgttcgctacggattcagtatcgacgggatcgaactcggtacgacggtcgacgctgaggacgcactcgatgtcgaggtcgccgtcgagggaatttctcccgctggaacagacgtcgactacgacggggacccgctcgaatggacgatcggacaggacggactcgacgacctccgagatagcctcatcgagtggtggtcgctcagagatgccgtcggagaccatacgctcccacagtccgtcgagcgtgacctctccgaccgcggggctcgcgttcagagcaaactcgctggggccctcaatagcggagcattcgacatcaaggatcgaggcgatcagatcgggggcatgggcacaggagtcgaggagtatctcgatgtcaactatcccgacgacttccatcccgtaatgctgcaagtcggcgacgaacacttacaggagctccggggcctctccgcccaggacccgctccctgtgtgggcccagcagatcgatgtcgcgaccgaagaccccgaaacgcacggtgggtcgatccagaacaacgtacgcgccttcaccggccgacagttgaagcaacgcggcgggaacctcgcgatggcgacgatcctcgacggcattgtaaagaagaagccgatctacgaggacgcccccccggcgctgtgtgcgatcatctggggcctctgccggaagggggacttcctgcccgtcgacgaaacgggtgactccctcgaactcgacgcagtcatcgatctgaacaaactgacgacgacacgtctcaagattgcgaagagtggcgatgtccgaggaactctccgcgagggcggattcatcgactcgacggaaaccatcccggacggaatcgtcaggctacagtccgcgaacgacacgctcgcgggtcgaatcggtagtctcgtagaggacgtcaaactggtcgccgagagtgacatccaaacgcaagccgttcgcatccttctcgagtcgttcgtggacgcgctcgaagccgagcagcagagtgcgatcgaccgacgagaggccgtcaagtcacgcgacactgactgggaggacgtcgtcgaagcaaccaacaacgcccaagagtggtacgacgatgccgaggaggtgtggagcttgcgcctgcccgcgctcacacgaatcgacgcacagttgactctcgcccagcagtcgtacgactggctgaccgaggagtgcgacacggccagccagacgcttcgcgagagcatcgacgactacgagggcgagtggtggacgcacgatggctgggatcggttcaacgacgcccaaaccactgtaccggcgcttgacgacgcgatcgagaccgcgtgggactcgttccgggaagaaaccggagccgatggattggtcgaggagttacaggcgcatccgtggatccagcccctgagcgagttcgggtcaaacgttcggccggccttcgagagcgagtacatcacaccgctccgccgagctgcatcgtggcacgaggacgtctcggacgcggtgtcgacggtgatcagcggaacgaccaacgccgaggctgacgacttcattcgagcgacgaacacactcctcgacagcgaacccctcgctgtggttgcaggcagcgacatcggcgaattacgggatacgttcgaagagctacagacactcgttggggagcagtctcccacagacatcgcggcgatcggggttctcccgtcggatcgcggaccgctggactccgaactggaacggcttgtcgaacaccacgacctcagtatcgagcggactgaaacgggggtgatcatccgatga

SEQ ID NO: 529 - DNA, 3597 bp, Halosimplex carlsbadense
ttgctgaaactcatcggcctcgtagccgacagcgagtccgaattcgcgcaccttggagacgaattagcccaacagtggcctgggttcgacaacctagcccggtcgatcgacgagtcgcacgtcgaccgtctcaagcctgttttcctgaaccttctcgaccgggacgcctccaaggaaccgcctctcccgtttctcatcttcgaggcgattggtcgtgaactcggatatccgacggaccccaactggctgcttgagtgggcctggactgtcgatatggaatacgatggtgtctgggatgcactcattgccgccgagcaaaacgggcagaccttcgaggacgtcctcgaagaacgagcgtcgctgcgacgctggctctacgagacgctaccgtcattgtcggagacgagtggaaccgatctcgacagaaaatccggcgtcaaagcgtccattgagcgtgcagaggaggaggtcgacccggaatcattcgaccccggagagctggtcgaccgagtcgaggccgtcaccgacgcgttgaacgaaagcggaccacagacggagttactattggggctcgacgaggttgcactcttcgtcggtgatagtcgtcaccgataccgagagttcgaggagacgatggaagcactccagcatggcccgaatccggttgttgtcacgaccgggcagtattcgctcccggcgacacgcgagagtctcatcggggagccagcggacgatcactggacgcatcagcaggtacctctcgaaggcgctgacacggagattatcgtccggaaacggtggctgcagaaagacggttccagcagtgatcgggtctcctcgctcgtctcatcgatgcccgatctctctttagagacgtattcggcagtcgaaagtgcagatcccgaccccgccgagtcgtaccccttccgcgagtacgacctcaccttacttcgaaaggtgatgcaggaactgatcacgcagggacgagcaaccgaccgagactacatccaaggccgagcgctgcttgtgttggttcgctcgctgttcacgaaattcgggtgggcgacggccgaggagggggcactcgtgacgtgggacgagctgttcgatctactggtagaggaaaccacgtatgtcccgctgtgggtgcaagagatgctcgataatacgttgataccgaccttcgacggcgatgagagcgcctgggaggtccgggtatcgaaagcactgtacctgcttaatcagacaccggcagtcccagctacaccagagaatctgggccggttgatgctcgacgacgtccactcttcagtagatgagacggtggacaacaccgaatcggcgctgaatacactcgtggacaagcgaaaagtgctcaccgagaccaacgacaaaggtgacgaagtgtatacactggtctctgaggaacaggagagtattctcagtcgagcacagaccaaagctgagcagatctcacctcatcagttgtctgcgtggctagaaacgcgactccgcgaaaacgacgacttcttccggagcgatagtagcgttcacgaggccgatgtcggcgacgaacgcctcgttccacttcggtacgagtactccattctcgaccccgtcggtcgagcacccaccacagaattcgatgccgttcgaatccgcgtcttagctgatgaccctgacacggtcactgatcaggttgaaacgtggaaggacgtaaacgacggccgagcaggaggcgagcacattctcatcgcgatcgacgtgcccgagacgacactcgacaggattcgaaacgtcctcgggatgggagaagtcctcgaagcggagactgagacacacgaggagctcgaacgggaacatcggactgacaaacggcggttagagtcgtctgtgggcgacctcctcgaaagtgcgtctatccacactgttcacgagtatcgcggtgaacgtccaggtgtactcgaagaagtcgtcgaggaccaggttcagtctgtcttcggctctactcggaaggtactatcgcgccctctcgtcgaagtcgacgatgcgaaagggttagcgaagttcttccgcggtagcggcgagtggcccctcgccgacagcgatgcagtcatattaggagtagacagggcagatcgtcggatcggagacagtggctggtgtcgagacttcatcgaccagtacgaatcacagagcgcagtagacgtggagacgcttctccagcaaacccgcacctccaacggagactatcgggggacgccgcaagagtcgatcgcagcgctcctcatcacgctcgcgacgtccaacgagaaggtcgctctgaaacaggacaccgactacgtgacggagccagcagcaatcggtcggcaggtgcgtacgaagagtggactcacttcgttgcaggtcaggttcggcgttgatacgatcaatccgaaggagatccgtacagtcgtctcgactgttctgggtcacgaaccagacggcgacgaccccgacgagtgggtcaccgagctcgcgacctgggtagatgagcagagcgtcctcgtcaagcggacattcaaaggagtatctcgggagttcaatgtctctctggaatcgctcgaatctgcgttatcgccggcgtacagtggtggcgaaatctccacatcggatctcgtcgaggatggcgttaaatcggatgcagagacgttcgcagatgcgcgcgagctctttgcggtcgaaggcgacgagaaatctctctggacgcagttttccgagacgctagagttagtagaatcgctgtaccccagtgcgacgattacgtcgcgaatgcagactacagccgaaggtggatctgtacctacgaaggagacactgacaacccggatcgctgatgcgaccggccatcgtatcgacgttctctctgaacagcaccggcgaatcacgggcagaacgatcgacgtgtcggatccggcagagatctgtgcggacctctccgcgtgggtgcgagagaacgaaccaacggtcaaaacgctattcgaggatgcaacggatgcgttcagtggcatttcgttcgaccacctcgaacaagtgttcgaaactgcttgggccgctgaccagatcgaggaagaagcactcgtcgcctctagtgcgcgccaacaagcgaaagcctacgagaagatccgcgagatcctcgatggggattcgagtccgtggaaccagttggaagcagccagggaaacccttcgtgcggaccatccagactcacccacgaccgcagcagtagacactgtcctcgattcatcgcgaccgccgtcacttcagcggatacaacaactcatcgatgaagcagacgatccgaaaccaccggatgccgacgacgatgtctgggcggaattgcagcgtgtcgcagaggacctccgccaggaactgccaaacgcgaaagtcaccgatgaggtgactacggtcgtggacgctgacgagcggccaaccgaagaacggtcagaagaactgctctcagatgcgaagacgatcttggaacggatgcgaacgatgcaagaggaattagatggtctggatgacgatgagatcgtgctgatcgacaaagttgagtga

SEQ ID NO: 530 - DNA, 3747 bp, Halosimplex carlsbadense
gtggatctccaggggaggtgtcagttgatggtcgatgcgagttggttcgaagaccttccagaagacttcgaggaatcagttcgcatcgacagggatgagcgcgatcatcgcgaacgcgccatccagtcataccacgtgactgcggactcccagcgctttatccgagacttcgtcgatcggacacttggacaggcagacgatatgcgtacaggttcgaactattggctctatggctattacggcagtgggaagagccacctgctgaccgtcctcgacggactactcgactccgactggctcgacggacgatacgacgacgtctgggacaaccttacgcaagtagcagaagacgacgatgtggaccaattgcgtgaccactggcgtacaatccacgacgagtattacgtgattcctgtctcgatcaatcttctcaagtatcaggggcagaagcagcggagcttcagtgagatcgttctcaggcatgcccatcaggatcccgatctgaccggagttgacgacgatatctcgaagggactctcctcccaactcgatgtagcgtatttcgagaagtggttccggacgaccgacgcatggcctgaacgacagactcgtgcgcaggacgcgcttgaaacagtcgcggccggacctagtgggtacgacttggatacggagaacctctgggaagacatccagagatataacgcactggcagatgtggttctcccgaagctcttcgaggaagtcaacgaaacccgggacgggtataccgatcttcaaccctctgacatcgatccagaagaggtggtgactcggttagatcaattgcgcgcagagcgggaggaagaactagagaaaccagtaaaactggttttactccttgacgaagtgagtctcttcatcgggactgacttcgagcgcttgaccgaacttcagacgctcgcagaaaatatcgacgatatcggtgatggtgatattcagttagtcgccactgctcaggcgaaaatcgaagacgtgcagccgaagttcgccgcacacggtgcagactttagcatcgtcaaggatcgattcccacaccgttatcaacttcccagtaagcatgtaggtgatatcgccaagcgtcgtctcttcgagaagtccgaccagggcgaatcccgagtcgatgaggtgctcgaaactgcctctgtgaagcccacagaatcactggtatacaacgaaattaaacagaacacaaagccaccactcgacagcatcgacgaagatgcactcgtcgagttctatcccttcctcccctatcacgcaccgctctttctcgagatactgtttaatctcaggcgagaagccacagatcccgcaaagtcgatcttttcaggaactgctcgcgcaatcctcgcgctcatgcacaacctcctccagcgctggattgaggatgggaaacccgaccacgtcattaccttggtcgatttctacgagttagtcaagccagagcttcgcgagatcctcactcaggacatgcgagtcatcgagggatcggacacgacccgtgggatcgcagatgaggttgaagacgggaatcttgaagagttcgaccttgctgtagcgaaggcagttctgttactacagcacgtccacgacatcgtccccctgaacgaagggaacatcgctgtctcggtcatgtccgatcttaacgggcggtcgtggatcagcacgcaaaatcgggtcgaagaatcactcggtcggcttcagaagttcattcgacccactgaggacgaatctggcgcaagataccggttcgccacacaggaagagcgcctgatctacgatgacacggaagcaaacgaggagaatccagattgggatgccatcctccatgcgttagatgagcatctttgggagcgtatcattcaggacctcgctctccccgagtccgttccatatagcgactctggtgacgaataccccgttgcatacaagtatcgtatcgacggggaagactttgagacgactacagaggctgaaggagggctagaggtttccatcgcagtgctgggtgttcatcccgactatccgtctgacaacggggatggggaaaccctctactgggaaatcgataccgacggcctcgaagaccttcgtaagcatctcgttgagtggtgggcgcttcgagacgctatttcgacacacaatgccccctcagcggtcgaacgtgacctcgaacggcgagccagtgctgtcaagagtaagctcgtcagcgccatgcaaagcggttcctacaccgtaaaagatcgaacggatattggaagtctctcgaaggcagtgcagactgcagtcgacgtagggtatccagatgacttccaccctatgatgctccaagtggacgaagatcgtctccaggaactcgcagagctttccaccgaagatccgctgccagcatgggcacatacgattcaagtaccgtcttctgacccaacggcaagccaagggaagaaaacgatacagagcaacgtgatggcgctcaccggtcgacagctaaaggacaaagaagacggcttgaacctgaatacggtcctcgatggaattgcagacaaaaagccgttctacgacgacgctcgtccggcactgtgcgccattatctggggcttctgtcgggaaggacggcttgttcccatcgaagaagacgggaataccctcgaaaattcggtggtgttggatcagaaccggctttcgacgacgaggctgaaactcctcccacgcgaaccgatcgggaagctcctcgaaaagggtggcttcaaagaaaccacagagacagtcgctgacggactgatcaaccttcaggaagcaaatcagcagctccactcggcgctcactggtcttcgagaggatatccagctcattgccgacaccgacatccggtcaaaagccgtcagaagccttctggagtctctcgctgacgagctatctgaacggattgacgccacttcggatcgtctcgctgtcgtcaggtcgcagggcgacggactcggagatgccattgaacagaccaacgacgaacaggaatggctcgatgaagttgtagacgtttggaatcgtcggctggtgtcactctaccgcttcgatgtgcatctccttctgggcgataatgagttcgaatggattgacgagaatgctcagtcattggtagaggaacaacgtgatgcgctcgcgacgttcgaagggcgttggtggacgaccgaggggtggaaggtgttagtcggcgagacggccacgggactcagcgacgagcttcagcgatcgtgggacgagtatgtcgacgaccaaggcctcggtgcgttcgtggagcgtctcgaagaccacccctggatcgttgacgcgacggaacttccgacaagtgtgcagcctgcgtttgagcggacatacatcacgccactccgagagcttcgtcggtggtaccataccatcgaggaaacagtctccgtactcggcgctgacgacgaagacacgctcgtttcggcggctgatgatgtctcagccgttgagtctcgtgaagaggctatcgacgacgatatcgctgtactggagtctagactcgaacggttctcgacaatcgtcggggatctggaacctgacgaagtggaccggatcggggcccttccggacgacaggcaggctatcaatcaacgtctcgaacggctcgtagagaaccgagagctggatatcgagacggttgattcgggggtgatcattcgatga

SEQ ID NO: 531 - DNA, 3624 bp, Rhodopirellula sp.
atgaagatcaaagagctattcgccgaggatgtcactcgcagcattccgccggttgtttacttccaccagcatttgccggaacacatcgaatccgaagtccgtgaatacatcatcacgggtggatggaacgaagaccatcccaactacaaacgcgtgcccgatggtattcacgaacaatacgttaagctgctgcgtggaatcactcgagaacttgataagccaggtggcccagacctgccgaatgcgtggatttcgggcttctacggttcgggtaaatcgagcttcgccaagttgcttggcttgtctcttgacgggaaaagtctgcccgacgggacatcgctttctgaagcatggcttgcgagaaacaagtcccagcgtcgccaagaaatggttgacgcatggggcgagctgcgtgcgaagatcaatccaatctcggttgtcttcgacgttggtgccaaggcacgtgacaacgaacacgttcacgcagtcgcgattcgtcagctccaggagcgactcggctatgcaaccaaagacccgatcgtcgccgacttcgagctaaagctggaacgcgacggactgtacgaccatttccaagaaatcgccgaggcccagctcggcaagccatggtcagaggtcaaagacacgtcgatggtcgaccaatcattctcattggtgatgcatcacttggacaaacaaaaacacattgatccgctctcgtggtcaatggcctacgcaggcaaagcacctcccggacgctcggccgaagaagccaccgccgacattggcgacatgctgcgctttcgggccgacgatgccacgctgtttttcgtcattgacgaagtctctcagtacagtcaattcaacaaagaccgaaccgacaagcttcgagcattcgcgacttcgcttggttcgacgcttcgtggcaaagtctggatgcttgcgcttggtcaacagaagcttgacgaaggtgccggcgacgacgtcctcgtttgggcgcgagaccgctttcctcctcaattgcgagttcacctttcagccaccaacatccgcgacgtcgtccaccgtcggctgcttcaaaagaagaccgagcacgttgcgatgctcaagtccgcgttcgatgaacatcgaccagagctaaagctgttcgcctacggatgcagcgaagtcaccgctgacgaattcgtcgaaatctacccgatgttgccggggcaaattgacctcgtgctgcaaatcacttccgcgttgcggacgcgttccaaccgggctccaggagacgaccacgcgattcggggtttgctgcaattgctcggcgacttgttcagcgacctcaaactagccgaggcagaattcggcaaagtggtcagcctggatcagatctacgagatccagaagaccgctctcgattcggacacgcaatcgagcatgtcacggatcatgaataagtgcgtcgagatcaaagccgacttggcacttcgagccgccaaagcggtcgcgttactggagctgatccaagaatccgaaccgaccacgcccgaaatggtcgccaaatgcctctacgaccgtctcggtgtcggagatcaggtttctgaagtcaaaggagcactcgagcttcttcgttcgcatggtttgctcggctactccgacaaactgggctacaagatccaatcgtctgctggcgaagaatgggatcgcgaacggcgcgacggcggtgccagcgtcgacaaagtcggtgactatgtgttcgcagccctcaaagaactgttggcgacgatcgagaagcccaaactcaacgaccggccctttccagtatcgggcttgttcaacaacgctcgtctgcatgacgacgccaaaatattcaatcccaacgaccccacctgcgtcacgatcgacttccgttacctgcccaacgaagaccgtggggaatccgactggatccgtcaaagcgatgaatccgcgctgaagaaccgactggtttgggtatgcggcgacaacgaaactgttcgtgaagaagtccgtgaactggctcgcagcgaggcaatggtcaagaagtatcgtccacgacgcgagaacttgagcgttcaaaagcgaacgtgtctgaatgaggaagagatcaaactcgaagacggcacccgaaaggtcaaaaaagccgtcgaggaatgttttcgtgccgggacgttctatttccgcggcgacaagtacgaagctcgttcacagggcgaagcgttttcaacggcggcaaaccgttgcgccacccgaatcatcaaagatctgttcggaatgtttgatggcaccgtcgtcagcccagccgaagtcgaacaactcctgcaagcggaccttgtcggcgtctcgacaaagttcatgcgagacgaacttgggattctggacctggacggggcacgctatgaagccacctgtaccggtgtcgtaccggttcgtattcaggagaagattgcgcgagacaacggagtcagcggcagtctgctcttatccgactttggcggcgcgccgttcggataccgaccagagcttatcaaggcttgcgttgccggactgattcgaggatcgaaagtcaaagcccagttgagcgatggcggagccgagatcaattcatggcgcgacgtggggatgcaggaactattcacctccgcccaagccttccgccgcgccgacttcttccctgcggatgagggtgacatcaatcccggtcaactgaacaaaattagaaaattcttcaacgatgaattcaacctgaagcttgggcgagatatcggtgagatcgccgacgcggttgagacacaatttcaccctctcaatcgcaagctgaatgatgtggtcggtgacctgaaaaaactctccgtcgccgtcccgattcctcccgagtttgaaacacttcagcgagccattgaaaaatgtcttgcaaaggtgcgtcacgccaaaccaaccgtccagcaactgctaaagaacctggacgcacttcgagaaggtatccgcaaggtcaacgtgtaccgatcggagcttcaagacgatttgatcggcaagatcaacgatgcgggcgaggtaatgcgttaccagttcaagcaactcgaagacctcggccccttcgatgcagaggtggccgaagctgccgagcgaattcaatcgcatctgaaaaccgatcgtccttggatggatgccagcgaattggacagcgacgtcgagttattgcgtgaagcgtacaagacgcagcgacgcgaactgttaggtgcacaggaagttggcgcggacgcagcacgcgggaccgtcaagaagcggcctggattcagcacgctttcatccgatcactcggcgattgtgcttcgtgaatttgattcggcggtcaccagtaccgatgaagacgctgtatcgcccaagttgattgacttgcgagattcattccaggcacggttgggacggtgcgaagtagccgccaatcgcaagctcgatgaaatccttagcgagaccagcgacaagatcctgcgtccggtcgcgctcaactacaccaatcgcgtcatcaatgatgaaaccgatgtcgacaagctgcttgctgagattcgcaaggagctgatggaacaactggaagccggcgtcaaagtaaggattgtttga

SEQ ID NO: 532 - DNA, 3669 bp, Pseudanabaena biceps
atgcttgttaaagatatttttgctagggacgtaacgcgggacattgcgcctgtggtctatttccatgaacaggagccagctaaattatgggaagaggtttcggaatatatcatcacggggggctatgctgaaaatgacccgcgccatactcgtaccaatcagggcattcacgagcagtttgtgcgtttacttaaggcgatcgcccaagatttagaacagccgaatcggtcagggactacattacctgctgcttggatttcggggttttatggttcggggaaatctagctttgcgaagttgttgggacttgcgctagacgatcgccaaatgccaaatggacaaaaacttgctgatgctttattgtcgcgggatgattcgcctaagtccaccgaatttaaggaggcttggcaaaagttaaccaagcggatcgaggcgatcgcggtggtatttgatataggctctttagcgcgggaaaatgaagatatccatcaagttgctaaacgcgaaatccagaaacgtttgggctattgcaaaactagtaattatgtcgctgagcatgaactgaagttagaaatcgatgggcgttgggatgcttttttagaatgtgcgatcaccaccatcggtaagccttgggagcagatcaaaaatagtgaattagctgaagaggatttctctctgattttgcatcgtcttgagcctgaaaagtacattgagccgatgagttggatcgacagtcgggcggggagtagaacggggctaggttcagccgtggatgaaacgactaaggcgatcgccgccatgctcaatcgtcgcgctcctagcaaaacactgtttattaccattgatgaagtcagtcaatatatccatcaaaatgacaatcggatgctgaagttacagtcttttgtagaagatctcggtcaaaaactgaaggggcgggtgtggctgttggcaacggggcaacaacaactagaagatggcatcgatcaagggaatattggcaagctcaaggatcgatttccgcccagatttcgggtgcatctgacacctgcgaatattcgtgatgttgtgcataaacgtctattgcaaaagtcacctgtccatgaagcagagttgcgaaatttgtttcaacaacatcgttccgatctgaagctctatgcctatggttgtgagaatatttcggaagaggattttctagaggtttatcccctgctgcccaactacatcgatctgtttatgcagattaccagtagcttgcgcttgacctctacccgtgtcaaaggtgatgactatgccgtgcgcgggttgctgcaaatgctaggagaattatttcggacacaagggctaggcgatcgcaagctgggagctttagtcaccattgatgcgatctacgagattcagcagacggcgttggatgtggatactcaaaatacgatgacacggatcttgggagatcgcgaaattgtcggtgatcaattggcgctcaaagttgccaaggcgatcgctttattacaactaattcaagaatctcagccaacgacagcaaaattgattagtcaatgcctttatgacagccttggtgtaggtaacaatgaaccagagatacagattgccctcgataaattacgcgatcgcggacatattacctactctgagaaattgggttataaactgcaaagctccgcagggcaggaatggcaaagagagcgtgatagcgagggtgtgaatgatgaaaaaatgaccgcgatcttgatggaaaaactcaaggtgctgatcggcgatactgaaaatcctaaatataaaggacgttctttccgttggcaggcttactttagcgatgaacgtcagcgcaaggatgagcgcttgatctcacctaatgatgtggcgacagcaattgtcgatttgcgctatatccgtgatgatctcaaagaagatgtcacgatttggattgcccagactggacaggaagcctatcgcgatcgcctgttatgggtagtggggaatatcagcgatattcctgaactagcgagaagacaggtgcgatcgcggcaaatgatcagcaaatatcaaggtcgatttgcagcgctatcacctaataagcaaaggctgttgatcgaagaacagtcggaagccgatcgccttgattcaattctcaaagaagctatctctaatgcctttgtgaggggaagcttctattttcgggggcggcaactggacgcgcaggggcttactttttcgagtctgttgcaacacaccgctgagagtattttacctgatgtttatccccattttcaggacatggcgatcgcccctagcgagttagaacaattgttcaaaaaacaactttcgggcgtatcccagaagtttatggagagggagttgggaattttgagcctagatgcggggaaatatgtacccacctgtaatggcgaaattcccacgctgatctatgaggcaatagcacgaaataatggtttagcgggtagtagcctattaacaatatttggcagtgcgccctatggctacgcctccgatcttgtccgtgcttgtctgttgggactgctacgagcaaataaaattcgtattcgtaccgaaaatcagcaaatgattagttcatacgcggatgtgggtgtggaggatttatttaagaaagagcgcgatctgaaaaaggcggaaattttactttctacagaaagcgatatcaccgtgcgcgatcgcaatgccatttgtaaattttttaatgactatttacaagtagaactagaccgtgagaaagaagcgatcgccgatgccgtgtttaaatattttccctataaggcttctctattacgggagttagaagggaaatataaccgattacccttacggttacaggatgtcgccgatcaaaactatgacgatcgccaccaactccctgacagcttgcaaaaattgcaaaaagccctaactgattgctgtcaatcgcgccaaattgaagacaccgtaagagccgtcaaacgacatttagaagttttgcaagatgggatgcagcgcctaagtatcgaaaatagcgaactgactaatgaggcgatcgcccaagtcaaaaaagcccatgatgtttatattcattgcgtggaacagttgcgcggtatgggcaaattagcagacctcgaaccgatggcgatcgccctacgtcaacaactgcaagcggaacgcccttggcgcgatctgacaagtttaacccctagtattgaggcgatcgccttgcgctatcgtgaggtaaggcatgacttgcttgatgctcaatatctccaactagaagcagtggcagcaagggtaaagacgagacatggctttgcgcgactcagtgaagaaaaggctgactatgtgatccgtccgatccgacaggcagagattaaaaccacgatcgatgctctctatccgacgctgatccagttacgcgactcggcaatacgacaattagagcaagcagaaatggaagctaatgccactctcgatcgcttaatttcggaagagactcaggagcaggttctcacccttgatgtgcttacggatttacgcaatcgtgaacttcgcaatcctgatgaggtgaatgccttagtcgatacctttcgcgatcgcttattgaagcagttggaaaataagaaaaatatacggattcggttgatctaa

SEQ ID NO: 533 - DNA, 3735 bp, Planctomycete KSU-1
atgaaatattctgaactgatacatttcgagcctattgagacgaccatccagcttcgtgacacagataaactcgaagaagcaaaaaagctcatttctacctttgttatttctcatgaaatggctgaaaagcttgaaagtattgtttttccccagcttcagtttgaacagccattggacaacaagggcattctcgtggttgggaattatggtacaggaaaatcacatttaatgtcggttgtttctgcaattgctgaacatgcccatctcgtctcttttcttaaaaatccacaagtaagtaatgcagcttctataatcgccggtaaatttaaagtgttacgtgcagagcttggttctacgaccatggattttcgggaaattatatgctcacagctagaagagagcctctcggcatggaaaattgattataaattcccgccacgggataaaatatcgaatcataaagacgcattcgaagagatgatgtccacttttcatcagaagtatccagaccatggtcttcttatggtggttgatgaatttcttgactatctgcgttcccgccgtgatcacgatcttatccttgacctgaactttttacgggagattggggaggtctgtaagcatttaaaattccgttttattgctggtgtgcaggagtcgatatttgacaatccgcgtttttcctttgtagccgaagtcatcaaacgggtcaaggaccgctttgaacaaatccttattgcccgtcatgatgttaaatatgtagtctcagaacggttactccagaagacggcagatcagcatgcaaagatacgtgaataccttatcccttatgcaaaattttataccaacatgaacgaacgtatggatgaatttgtccgtttatttcccattcaccctgattacattgatatttttgaacggataaaggccgtggaaaaacgtgagattctgaaaaccttttctttgttaatgaagcaaattcttaatatggatgttcctgaagacaggcttggcttgatttcttatgatagttattggaatatgttaaaggaaaatgcatccttccgtacaatacctgaagtacgtgaggtactggaatgcagcgccaaactggaaaatttggtgaatacgggctatcctcgtggtaaaaataaagaatttgcgctgagaattattcaaggtcttagtgtttaccgattggcagtaggtgatattgaatcccccgttggtcttaatgcagaaggattaagggatgcccttggtctttttgaccctattgtagttgaattaggaggtgatgcagcagatgatttacgtggtgaagtagaaactgcattaagattgattagtaagacggtcaacggccaattcatctctgcgaccgaacgagatgagatggggcgccctggtggacaattttatctggatgtcaaaaaaaccgttgactacgatgcccagattatacggcgtgcagagagtctcgattcacaaacgcttgaccgctattattacgaagcccttaaaagggtaatggaatgtactgactacacgtacgttactggataccgcatttggcaatacgaactggaatggcgtgaacgcaaagtgatgcgtacgggttatcttttctttggggcatcgaatgagaggtctactgctgtaccacaacgtgacttttatctttacttcctccagcctaacgatccgccacgatacaaagacgagaagaaatcagacgaggtgttctttaaactcactggaatagacgagaccttccgtgagaatctccgcagttatgctgcaagcctcgacctttcttccatttcttcaggacaatccaaaacaatttatgaatcaaaggccaagggctttcttgacaacgttgtgaaatggcttcaggaacatataacaacggcctttgaaataacctatcaggggcgaacaaaacaactccttgagtgggcaaaaggtctgcccccaaagaaaggcacggatggaggtaataatttcagggatattattaatgccgttgcagggttttgtcttgaaaagcattttgctgatcagtcgcccgaatatccattcttttccattttaattactggcagcaaccgtgctcaggctgctacggatgcattgaagtggattgccggtggggcaaaaactaggcagggtactgctgcgcttgatgcattaggccttcttgatggcgaaaagctggatccttataaatctaaatatgtgaattttatccgggaggttcttggtcagaggggacaaggacaggtattgaatagaggagaggtatttaaaaaagaacatgatgttgaatacatggtaccggatagattccggctcgaaccggagtgggttattgtcctcctggctgcacttgtttattctggcgatattgtgctttcaatacccggcaaaaagtatgatgcaagtaatctgaaccaacttattgccacaccattagaagaccttgtcaattttaagcatattgaaaggcctaaggaatggaacattccgtctctcaaagcactcttcgaactccttggacttacccccggtatggcacaactcattacgcagggtaaggaagaacccgttcaggaactccagcgtgttgtctcaacaaccatcgaaaatcttgttattgctttacaaaaccttcacggaggcatgatcttctgggggaaacccgtattgacagaatcgcaaaaagaagcatatacatcccacctgaattcgataaagacattccttgagtccattcaggcatataattctccgggcaaaatgaagaattttcgttatgatgtaaacgagataaaagcacagcacgtgggaatccaaacactcctcgaattaaagaaattacaggatctggtggctgaatttggcccaatggcttcatatctgtcatctgccgagactgttttgcctgacacacatcaagtggtaacaagaatgaggacataccgtgaatctgttttttcacaaataataaatcaattcaaacaaaatccaatacaggtaaggcaacaaatcatgcaggaatttctggaactcaaaaagatttacaagagagattatatcacacttcatgccagggcccggttaggcgctcatgaagataaacgtaaagctgaattattgtgtaataaaaaacttgaaaatctccagaatattgccactattaacctgatgaacagacagcaactcataaactttcaaaaccgtcttgcaggattaaagacatgcattacccttatagaaaaggaaattgagtttacaccaacatgtccacattgcgagtttcggccttcgacagaacctaatcctcttgacgtaaaggcaattctgtcaaatatggatagggaactcgataacatcgttgatgagtggacacaaaccttactggcaaatcttgaagatccaacaatccaggagaatttgtcactgataaaatcaacgcagcgaaagctggttgataattttttaaaaaaccggcagttgcctgacaagattacccatgagtttatcgatacacttaatgaaatcctttccggtcttacaaggatagtggtaaaaatggaagatttacggaatgtgcttgtttcaggcggttctccggttactattgaagagatagaaagacgctttgaggattatatagccagtttaactaaaggcaatgaggctaataaggtaaggattgttatagaataa

SEQ ID NO: 534 - DNA, 3699 bp, Bacillus cereus
atgttaaaatatggagatttaataaagtttgaagccgttgaatcggttgttcaactaaaagaagcaaatgatatagattatgcaatttcactattaaatacatatgttatttcagataacatggcagaaaaactaacgaatgagattattgaaaatattcaattcgatcgttgggttgataataaaggaatgcttattgttggtaactatggaactggtaaatcacatttaatgagtgttatttctacaattgcagaattaccaggagcaagtgagcacttacgtcataaagaagtagctgaaaaggcaaaggagattgaagggaaatttcaagttgttcgtgctgagtttggtgcggttacaatgccattacgcgatatcatttgtcatgaattagaacgtggattggaaagaatggggattgattatacattcccagcggcggaccgagttacgaataacaaagaaatgttttatgagatgatggaattgttccatgagcaatatccagataaagggctacttttagtaattgatgaattgcttgactatttacgaggtcgaaaagaacaggatttgactttagatttaggttttttacgtgaagtaggagaagtatgtggtaaatctcgcttccgttttatttctggtgtacaggaaatgttatttgataatcctaaatttagttttgttgctgattcgcttcgtcgtgtgaaagaacgttttaaagaagcacgcatcgttcgtgaagatatagcgttcgttgtgtctgagcgtttgttaaagaaaaacgatgaacaaaaagcattggttcgtgaacatttaagcaaatttacaaaattgtacaatggattagcggaagatatggaaatgttcgtaaatatgtatccaattcatccttcctatcttgaaacatttgaaaaggtaaatattgctgaaaagcgtgtcgtacttcaaacaattagtaaagaaattaaaaaattgctaatgcttgaagttcctgaagatgctacaggattaatctcttttgatcgttattggcaatacattgaggaagattcgtctcttcgaacaaatgataatgtaaagttagttatgaataaagttgaaatgttaaaaggatgtattcagacaggtgtgaagcgccagtataaaattatggccaatcagttagttgatgcattagctgtgtatcgtttaacaacagatgacttaaaaacaccaatcggtcttacatctgaatcattacgtgacaaattatttataagtcatccaatgttgttagaattagatgaagaggcttctgaatttttaacaacgatgattgaatcggctatgaaagatttaatgactgcagcgagtttccaatttgtatcgttaaataaagataatggtcaatattacattgatattgcaaaagtaacggcagttgatgaattaattcaacagcgtggagaaggtttaacagataatcaattagatagttattatttccaggtgttaaaacaagcgacagaagtagcggatacttcttatgtaagtggatataaaatttggttgcatgaaatcccatggatcgatcgtcgtgttaaacgagaaggttatatattctttggggcaccgaatgagcgatctacagcgcaacctgaacgtgatttttacatttatatgcttcaacctttcgaggaaccaaaatttaaagatgaacaaaaagaagatgaagtatttttccgtttgattaagaaaaatgatgattttattaatttgctacgtctatatagtggttcatgtgaaatgtataaagatacaacaacaaatcgtcatctatataagccgaaaatggatgattacttaaagaaattagtaaagtggttaaaagaaaactttgttgaagcttttgaaattgtttatagaggaaagcacgctgatgttttagagcatggattcttccttccaagtaatccagatacactaattcaaattattgattcggtttcacaagatttactttcacaatggttcgaggtgaaatatagtgagtacccgactttccgtaaattagataaatcgtttgttacgaaatcaaatatgcaaacatacgtaaaagatgcgttagattacttaaatggaaagaaaacaaatcaaggggaagcaattttaaatggtttagtccttcttgataataatgggaatgtcactgcaagaaattctggttatgcgaaatgggtattagaattactaaatcaaaaagaaacaggacaagtgttgaatcaaaatgaattaatagaagtcattaatacagtacaggggacaccggatcaaagattaacaaagcaattcgcaatggaacccgaattattagcggtagtattagcgtcgttaattcaaagtggggaaattgttgttactgtaaatggtacgacatatgaagctatgaattttgctgagtttgttcgtttaccaataaatgacttaacatactttagtcatattaaaaggccgagtggtttaccagttccagcagtacaagctttaattgatatgtttggtggagaacaaattgattttactaatttagatgctgtggacttttctattaaaagaattatttctagagcgaaagaagaaacaaacaaaacggtcgagatggttgctaatatccgaaatcgatttgtaatttgggacggacagttattctcattggaagaaaaagaagaaaaaattacaaagttaaatagtttaaatgaatttttacaaggactacaaatttacaatactcgtgctaaaatggtgaacttgaaatatgatataaatcgtattgaagaagaaaaagagaacttagaaattgttcatgggcttgagaagttacaacagaagattaatgaatatacaaaagtagcggattatttaatgaaagcaagatatatcgtgtctcctagtcaagaatggattgatgctgttgatgtgtcacttggtaatttaagcatcagtttaaaaaatggcgaagattgttctagagaagttgctgagcttgagcgactaaaaaaagaatatattgaacattatatggtacttcaccaaacagcaagattaaatgcaacagagaataagaagaaatcagagttattaaaggatccgcgttatgatgctttaaatacattggcttctaagatatcattcttacctcatcaagcttttgatgattggcaaatgagtctaaaagcgctgaaagattgttataatctaacagtggaaaaactgcagcatatgccagagtgtccaaattgcagattcaatccaagagaggaacaaaataaagcaaagccttccttgacacagttagaagatcaattaggcgaacttctaaactcatggacagaaacattattaacgaattttaatgattcaattgtaaaagaaagtattgatttactcgaatctgagcaaaaatgtttaatgaatgaattgattcaaaatcaagcatttacaattccaatttcattaaatttaattaatgctatcaatgttgttcttaaaggaattcataaagagcatattgaaatggggcaacttttgaaagtatttggagatggaaatcctattacagtggatgaagcgcgtaaaaactttgatatgctattaaaagggttaattggtacgaatgaaacaaaccgaattcgtttaacggttaagaaataa

SEQ ID NO: 535 - DNA, 2841 bp, Clostridium thermocellum
atgtcggaacgcatggaagagtacgtaaacctgtttcctattcatccttcttatattgaagtatttaacaagatttatattattgagaatcgtcatatacttaaaaacatttcggagattattaaacggatacttgacaatgaaatcaccgaagattctcctggaattgtgtcttttgacagctactggacgtttattaaggataatttttcatatagaacggatgccaatattaaagaggttgtagaaaaaagcggaatgttggaggatattattaaccgttcatttccgaaacgactttataaacctttggcattgcagataatatatgctttaagcgtacatagattaaccaccggtgatattagtattcgtgcgggacttacggcagaaaatttgagagatgacctctgcctgtatttaaaaggtatgcccgaccaaagttcagatactttgcaatctttaattcaaacagtattgaaagatatcatgaccactgtcagcggacagtttattgaatataatgccgataatgggcaatattatcttgatttgaaaaaagacatcgactatgacgaaaaaatcacgcaaagagcagcatttatggacgacgacagtttgaataactatttttatgatgtcgtttattattgcttggaatgggatcagaaagaatatgttgataatttcaaaatttacgaacacaggttaaactggatgtcccacaacattttccgttcaggatacctgttttttggtacgcctgaatctcggcctactgctcagccgccggaggattattatatatactttattcctccctatggcaatgagagttatacagacaataaaaaagaggatgaagtctttttcctgtttaagcccaatgaagaatttaagaataccttgaagttatatggagctgctcaaatattgaaaggtttggcagaagtaaaaaataagcctgcttatcaaagtaaagctgaagtttacaagaaagaactgacgaaataccttagtgaaaataagaatacttgctttgaggttgtttataagggtgaaaagaagcaactattggaagtgatggggaaactgtataagagcacaaatccgtttaaagaaacaattgatctggttgcttctatctgtttggatgaatacttcgcgaaaaagtatccagaaatgcctaaattcaagattcaaattaccagccgaaaccgggtggaaattattcgggcaggtattgacaggtttgcagggagaaaaagtcaacaggccaatgctttgctggaaagttttgggttgcttgacggagataagattaccgtgcaaaattccaagtatgcacaatattttatcaaggaattagaaaaaattccagcgaatgaagttatcaattttagtgatatttatactgaagttccaaataaggatgaatattatatagacaaacaatttggaatctcctatgcccttttgcccattgttctgctggcattagtacatacaggacatgcagttattaccttaaggaatggtactaccttgactgcttctgatttggaaatactgcccaagatacaggcaaccgacatatatgagttcaagtatatttccaaaccgaaagatatgcgattggtggagctggttaaactttatgaattattggagttacctgctggtttaattaacaatcctgcccagcgagaagcagggcttggaagactattggcaaaagcacaagaaacggcgaatatagcggttagggctaacagtaaattaaatggagattttgaactttggggcgaaccgcttattgccgaacatattgcttcggattataaagcggctgcaaaaagagtgctggatatgttaggaaatttccaaagcagattcaatacagtggccaaactcaataattttaattatacaatggaacagattgagcagcttggcaaagatattacggcgtcaaaaactgtgttggaatacgaaaaattcagaaacgagtgccttgctaatgttagttacatgatgaatctggaacgtatggaactcggaaatactttaagagcggcaattgagacagcaaaagagagttttcgaaaaatacgggataatatacctgaggatatgagtggtgaagctgcggcagctgatgtaaatgagcttcttacaaaagttaaaaatcaatatattgatatttacttttcggaacatcagaaaagacggttgggggtatccgatggccgacgtaaaggagaactggtaagctcggtaaaactggctaatttaaaacgtttgagagagataaacagtattttttcagcccacaaacttgacaacattgaaaaagagctggccgggttaaaagtctgttatgagttgaccccggagatgcttaaaaccagccatttctgccctaaatgccattttctcatgaatgaagaagacattccggtgaaaggaagacttgatgagattgaggaacggattgataatttattggatgaatggaccaataccctgtataatactgtaaccgatccgacccttatcgaacagaaacaatatctaagtccacagcaatgtcaggtaattgatgagtttattaatacgaaacgtttgccggagaaggctgaccaattctttattactgctattaaggaccttttgcaagggtttgaacctgttgccattgcagccgatgaattaatcgacagactcagtgcgcttgggccttgtgatatcgatacatttcagcataaattgaaagaacttgtggatgattatatcaaaggtaaagataaagagaagctgcggattattataaaaagataa

SEQ ID NO: 536 - DNA, 3696 bp, Lachnospiraceae bacterium
atgaaatattcagagctaattagctttagtccaattgaatctaccttgcagctggttcagtccaacagcaataaggcagaggaaatcaataatattaaaacttacgtgatgtctgagggcatggcacagagtttgaaggcaccggtcattgaccagctgcagatggatgaggtagttgataacaagggcgcacttgtcgttggtaactatggtactggtaaatctcacttgatgagtgtgatttcttcaattgcaaaagatgctgacaatttacagtacctgcagaataaggcctttgcaaaggatatggaatgcatcgcaggtaaatttgaagtattgcgtatagaaatcggtggcgttaccatgtcactgtacgacattttatcaggctatattcaggacgattttgataagagaaacgtcgattttgaattccctgagcaatccactgtacacaatcctaaaaaagtgatccaggacatgatgatggcctttgctgaaaagtatccagacaagggttacctgattgtagtcgatgagtttctgtcctacttgacctctcgtgacgaacgccagattgttctcgacctggagttcttccgtgcgctgggtgaaatgtgctctaaaagcaagctccgtgtcatttttggtgttcaggagaagattttcgataacccacgcttcagctttgtatctgatacgctgaaacatgtatctgaccgttttacgcagctcatcatcacgaaggaagctacatcttatgttgtttccgagcgtattttgaaaaagtcaccggaacagaaggctttgattcgtaagcatctggagaagttctccaacctttatacaggcatgtcctcccgtttggaggagttcgtagacctgtatccgattcatccgtcttacattgacgtgtttaataaaatttacttaattgagaatagacatattctgaagaacatctctacgaccattcgggatattttcaatacagaggtgccggaaaatgcaccgggcattatttctttcgatgattattggcctgcaatcaaatccaatggtctgcttaagagcgacgtaaccatcaaccgtgttgttaccgcaagtggtcagctggaggatattatcaaccgtgccttccctaagcctgcctacaagccgctggcaattaagattatttatgcgctgagtgtacaccgcttgaccaccaatggtctggatgtgcagttcggcttgactgctgaaaatatgaaggatgacttgtgcctcttcctgacgatgccggagcaggatgcagacttcctgctttctttgattaagaccacactgaaggatatcatgaccaccgtttctggccagttcattatcttcaacgatggcaacaatcagtattatatcgacgtggacaaggtcgtagactacgatgagaaaatcaagcagaaggcttccgttatggcagaaggcgaactgaatcgtttcttctatcagcttgtttatggctgtttggattgggatgcaaagcagtacgttcctggttttgaaatctaccagagagacttgaattgggattctcataatatcttccgtgagggctacctgttcctcggattaccgggagaacgtagcactgctcagccggagcgagacttctatatccacatcatgcctccgtacagtgcaacagcaatcgctgtaaagaatctggaagatgaagtgtatttcttcttcaagtcttccgatgaattcaaggagctgcttggtttatttgccgcagccaattccctggcacaaatcagtgaaggcaaggataaggatgcctacctgaacaaggccggtatggtgcgcaagagactcatcaaataccttagcgagaacaagaacacttgctttgaagtgcagtacaagggccagaagcgacagatgattgaagttctgaaggaccgttacaacagagatatggactttaaggatactgttgaccttgctgcctctgtttgccttgatgaatactttgatagcatttatccggagttccctgctatgaaaaccaagataaccagaaagaacatggcagagaatgcccgtcaggctttcgactattttgcaggacgtaaaacgcagcctgcagcactgatgcttcagagctttggcattctggatggtgagaaaatccgtccggaaggctctaagtatgctgcttattatattgaccagctgaagaaattaccgccacagggtgttatcaactactccgatttgttcgagcttaagttcggagatgtgtttgaagataagaaattcaagattagcttcctattcacaccgattgtattcctgtctatggtatatgcaggttatgcgacgatgaccttgaaaaacggtacggttatcactgcctccaatcttgacgaggtgccaaggctgggagttatggatttgtatgaattcaagtatctgtccagaccggcgcagatttctatggtggagctgaagaagctgttcgaagttctggatatcaatggtgcgcttctggataatccaaatgaccgtgaagaaggtataaagcagttattagcaaaggcgcaggaaatcagcaattcttctgttctggcagtacgtaagttgcaggaaggctttgaactttggggcgagcctctggcaaatgcacagcaggtagatagaatgcagaaggcttgcactgctgttcgtgatgagtttagcaattatgctgcgaagtacaacacacctgcgaagctgaataatttcagcctttcgggagaacaggttgatgttttggcagagcagattgctctcatcaagactattgctgaatatgtaaccttcaagacagattgctccgcagtcgttagctatattgcaaatattgaattccttgaccttggggcagtattaaagcaggagttggaggccggaaagaccgccttccgtgaaatccgagatagcattgctgatggaacttccggtgaaactgcagcacaaaaggttacgactgagctggacaaactgaaagaaaaatacatcacgatgtactttgaggagcataagaaaaagcaccttgacattgaggatgcaaagcgtcgtggtaagctgcaggaaagcatcgagctggcaaatctgcgtaaactgcgtagcatagaaatactctctggtgcaaagctgactgccatcgagcaggatatggcagaactgaaggtttgttatgagctgattccggttgagttgaaaaccagccatatctgccctcattgccattatacctatggagacaaagcaaagaatgtagctggccagctggataacatcgatattcgtattgacgatttggtggctgaatggacaaacacgctactcaatacaatctctgacccgattgtggttagccagaaggagtacctgagtgcagagcagcagaaggccattgatgagtttatttcctttaaggccttgccaaagcgtgtggatgaccactttgtaaacagcattaaagctctgcttctgggctttgagccggtggtgattgatactgaggacattattgcaaaactggatgagcttgggccttgcgatgtaactacctttaagaataaattgagcagcatcgtggagtcttacattcaaggaaaagatgcggctaaactgcgtattgtagtgaagcggaaagatagcgaggtgtaa

SEQ ID NO: 537 - DNA, 3720 bp, Enterococcus faecium
atgctgtataaagaattagtaaattttgaaccaattgattcagtcatccaattaacagatgcaaattcaacagaaaaggcaatgcacctgttggatacatacgtaatctcagatcgcatggcagaaacaattaatgaaattatttttaagcaactacaatacactagaccagaagacaacaagggattattggtcgttggtaactatggctcaggtaaatctcatttaatgtcagtaatctcaacaattgctgagtatgaaggtgctagtaagcatattgcaaataaagaagtagctgagcacgctaaacaaattgaaggacaattcaaggtaatccggtttgaaattggtggggtggatcgcccgttcaaagatattattatttcacaactcgaaaaaggctttattgaaatggatgtcaactttgaatttccagaagatgattcgaagttaaccaataataaagaatggctactggaaatgatggatgccttcaatacaaaatatccagaaaaagggttattagtagtcgtcgatgaacttctggattatcttcgttcacgtaaagagttagaaatgacattggatttagggttcttacgtgagttaggtgaagtagcgtatgatagccggtttaggtttatggctgggattcaggagatgctattcgataacccacgtttctattatgtagcggatccactgcgacgggtaaaggaacgcttcgagcaagtacgtattgttaaagaagatattgcctatgttatttcacaacgtttacttaagaaaaatgatttacaaaaagctaaaattcgtgaacacttaacggagttttctaagctctacgaccgactaagtgagaatatggaaacatatgttgagctgtttccaattcatcctgcatatttatcgacatttgagaatgttcataatattgaaaaacggatagcattgaaaaccatcaccaatgagatgaaaaagattattaataacgaagtaccgatagatgatccaggattagtttcctatgatagttattggacatacattgaggaagacccatcttacaagacaattcctgaagttcgagaagtgatggataaagtatcaattttgaaggatagaatcaatagtgcctttccttcaacaaaaagacgctatcaaaaaatgtctattcgtatagtgaatgctatggcattgaatcgtctaactactgatgatatctattctaaggtagggatgacttctgatgaattgaaagatgacctttttctaacaattcctggtcagatggatatgctgcttgaagatcctgatcctgcgggatttttgaaaacaaatatagatgtggctattaagacaattatggaaacagtcagttatcaatatatttcagtaaatgaagtcaatgcacaatattatctagatttgaaaaaagatattgatgtagatagtctgattgcagatcgtgctgaaatcattgaagcggacacaatggaccgctactattttgatttattacaaaatgcgattgctttggatgaccttacttatatttctggttataagatttggtcatatgagcttccttgggaacaacgccgagtaatgcgaaaaggatatcttttcttgggttctcccaatgagcgatctacagcgcaaccagagagagatttttacatttacatgttacgaccatttaataccgtaaactataaagatgagaagcgctcggatgaagtcttcttcaaacttaatttagaagacgattactttgaaaagacattacgaaaatatgctgcggcaaaagagcagtacattgaaacaacacaagcacaaaaacccttatttaaagctaagtatgatagctactataagcaattgaataaatggctgttcgaacattttgtagatgtattcaaggtggtttataaaggtaaagaaggatatctttctgattttggaatgttccttccacaagaagatactttgaaagcaatggtcaactatgcttctgcagagttcttgaatgatgcctttcaagagaaatacccagattatccaacctttaaagaatataagccaggatatctaacaaatgataatatcaaaacttccgcaagtgatgctttgcaattcttaaatggacgttcaacaaaaactgggaaggccatactgaacggcttggttatggaagatagtgctgggaaagtaactgccgaatccatttctagttctggcttttcacgatggattttggaaatgctagaagaaaaaggtaacggcaaggtggttaataataaggaaatatatgatcaagatgccttacgtggtacaggagatagacgtctttcaaaagagtttaaattggagcccgaattagtagttgtcgtgattggtgcgcttctttatgcaggaaaattagagataagcgtagctggaacgaactatacagcaatgaactatcgagagtttgctgccgaaaatatcgagatattgtctaatttcgactatatcaaaaagccatctggtcttccaattaatgaaatcaatgcagtactaaatctatttgatgaatacgccccaaactttgatgagaagattctagaaggatatattaggcgccttagcagcaagtcaattgaagaagtgagtcataccttaaatactattgagatggtcaagaaaggtttttctattggcggcacagaagttatggacgcaaatactcgacaagatacaattatgagactcacttcttataaagacttttgtgaaaaagtccaacggtataataccgttgctaaaatgaaaaacttttcggctagcgttactgaaatctcagaacaagaagaaaacaagaaattaattgattcaattgaacagatgaagaaagacgttgacgaagtcggtacactagtgacatacattacacaggctacttacaactatggccttgagagtgattggacaaagaatgcccaagaagcgattaatgctgtcgttgaagccgtgaagaaaggtgctggattcaagtcgcaaatggatgacttgaaagaaattaaagagcactatatagatgaatattatgatattcatcagaaatctcgattaacaagtaaagaggaaattaatcgtgatgggctacttaattcagttgaggcagatgtattagctacactaaaggccaatatcgacattcttccgggtcaacagcttattgattgggtccgagagctacgtgctacaagagcttgtttttcactaacaaaagctgaactagaacaatatccgacatgtactcattgtaatttcgaaattggaaaaactgatcggaattccaaattggttgtatctaatggtaaagaaaagttaactggaatttatgaaaattggatggagattcttgtaagtagcttacaacagggagacattgttgagaatcgggaactcttgaataatgaagaaaaagtagaaattaatcaattcattgctacaaaagaattaacatttccgattagtccccaattcttgaataccataaataatttgtttaaaggctttgagaaggttgaaataactgaagcggagctggttaaagcaatgggagacggtagtccaatgtcagttaatgaattagaaggacgtatccgtcaattgattgcagagctaactgaaggcaaagagaaaaataaagttagaattatgtttaagaggtga

SEQ ID NO: 538 - DNA, 3687 bp, Caloramator australicus
atgagatacaatgaaatagtaaattttgagccgcttgagagtttaattcaattgttggatgctaatcaaaaagaaaaagcaatcaatttagtaaaatcttatgttatgtcggattctatggctgaactattaaatgaagttgtaatacctcagctgcaatttgataacataatggacaataaaggaatatttatagtaggaaactatgggacaggaaaatcacacttaatgtcggttatatcatcaattgcagaagatagagagttattacaatatgttgataatgagaaatttaaaatagaagcagaaaagatagctgggaaatttgaagttttaagaatagaattgggatctgtttatacaaatcttagagacattatattgaaaaaagaaatagaaatagatttaaaaaacagaggcattgattttatcttccctgaaatgaatgaaataacaaataataaagaatctttaattgaaatgatggctaaatttgaggaaaaatatccagacaaaggatatcttattattattgatgagcttttagattttttaaagaccaaaagagaacatgaacttattcttgatttaggctttttaagggagcttggggaagtttgtaaaaatacaagaataagaattatagcaggacttcaagaatcattatttgatagtccaaaattttcacatgtaaaagacaagatattacaaattagggatagatacgaaaatataattataagaagagaagatattgcatatgtagtatcaaaaagactgttgaaaaaggatgaaaggcaaaaggcatatataaggcagcaccttcaaaagttcactcatctttataataatatggttaatacccttgaaacatttgttgatttatatccaatacatcctaaatatattgaggtttttcaaaatatatatattgcagagcacaggcatatattaaaaacaataagtttaacaataaaaaagattttgaatgaagaaattccagaaaatgatacaggtattatttcctatgattcatattgggatcatttaaaagaaatgacggcagcaaggacagatgtgcagattagagaagttgtagataaaagtaagactttagaaaatataatcgattcttccttcactaagccagtttataaaaaatatgctataaaaataataaaggcattaagcgttcatagattgacaacaggtgatatatatgcaccaattggaattactatagaaaatataaaggatgatttatgtttaaacattatagaatctcctgaaattgatgaagaatttttattgtcgacaatttcaacaatacttagagaaataataaagacggttagtggtcaattcatttcatataatgaaaataatggacaatattaccttgatttaaagaaggttgttgattatcaagcaaagattgtagaaaaggtagaaatgctttcagaagaccatctaaatagatattactttaaactattattaaaattattagaatgggaagatattacatcaagcgttcccggacatcaaatttgggaatataagctcttatggacagataaaaatgtagaaagaaaaggatatttattccttggaaaccctaatgaaaggccaacagctcaaccaccaagagatttttatatatactttttaagactttttgaatataatgattggaaggatcaaaacaaagaagatgaggtattctttatatttaatgtaataaacgatgattttgaaaatcaacttaaactttatgcggctgcaaatgaattggcgatagcatcacctggaaatagttcggataaaaggacgtatttagataaagcaaaagaatttgaaaaaggtataataaatttaataaagaataatatattaaattgttttaaaataaggtataaaggtcaagaaaaaactattttagaagctataaaaattaaaactataggagaaaaaagctttaaagaaataatcgatgttatagcttcaaattatttatcaagctattttaaccaaatatatcctgattatcctaagttttcaacaattataacatttaacaacatagaacaggcaactaaagcagctctaaattgtattgcaggcaaaaaagaagaacttggactaagagttttggattcattaggacttcttgacggggaaagggttgatccctctgattctatttatgctaaacattacttagatttagtttcagatttagcacctggaatggttataaacaaaaaagatttatttgaaaaagataaaagtgaagatgaaattgataaaaaatttaaattggagcctaattttgttgtggttattttagcttctcttgtttatagtggtgatattatcctaactgatgcagttaataaagaatatgattcaacaaaacttaatgaattagcatcagcaaatctgtataatataattgaatttaaatatataaaaagaccaaaggatatcccgattgaagctttaataaaactttcggaatgtttaggtataccaggacatataaaaaatccagcaaggagagtagaagcaataactgatattttaaaggaagtggatacaattataaaagatatattttatgtaaaagagcaaattaataaaggcatatatatttgggattgtgttcctcaaatgatcgaaagaaaaaaagatacatatttagataaattaaacaaatttaaagaatttttagatagcttaaaaatatataacacccctgctaaattaaaatcctttaaatatacagcagatgaaatagaagaaaattttaaacctaataaaatattaaaagatataaaatttatattggaatttagagaaaaaatacaagtttatgtagaatatttaaagacggcagatgcatttatagatgatagcatttttaaagagattatagataaggttaaaaacaagataaaagaagctatgaatgatttaagtaagctaaatgaagattatattaacgaaatattggaagatttaaaaaaagcaaaaaacagatataaagaagtttatttggatgagcataagaaatatagattggacattaatgcagataataaaaaggctaaactgctttcaagcaaagaatttgataacttgagaaagctttgccagataaaggatatatttaattcaaagaaatttgatgacattagcaaaaagtttagttctgcattaacttgttttaatttgacaaatgatgatattgaaagaaatgtaatatgtccgcattgtaaatttaatcctaaggataataataaagttttagtttatggcctaatggattcaatagaggaggatatattaaatactttaaatgattgggaacaacagcttttaaaggcacttgaggatagtattattgtagaaaacatgaaatatttaaaatcagatgaaaaaagggaaattgaagaatttataagcaataaaaaattacctgaaattattacaattagctttattaatgctattaaccaactaatggatggctttgataagatagaaataaaaagcgaaaatttaaaggatataattcctaaaggacctataactgtagacgaatttaaagatgcgatagataaatatataaacaatttattaaagggaaaacaaaaggataaagtaagaatattaataaagtaa
